United States Patent 9,932,637 (GENETIC POLYMORPHISMS ASSOCIATED WITH CARDIOVASCULAR DISORDERS AND DRUG RESPONSE, METHODS OF DETECTION AND USES THEREOF) - sequence listing, part 8

SEQ ID NO: 13459 - DNA, 14320 bp, Homo sapiens
cagtctccattccttcttcccccaccctccagttctcatcctgtacactacctccagacccccagggattcagatcctgtctcccccaatgagagacttttttttttagggggagccaaattatttgttacaacatgtagatttcacttgttgtagagatgttctattttcaaggatacagagctcaaagggagcacaattccctggagagctagggaaataatgaagtctaaggtctggcagatctggatctgaatcctggcaatgcatttcgggagttcrgtgtcaccctgagcatctttcaattccttgaacttcagtctcctcatctctgaaatggggttattatctacctgcagaggtgctgcagtattaactgaggcaacgttgcamcgtttctagaatgatatttagggctcatattgacccagtaggaagtatagttaccttgggmcaggggagctacctgagtggagtcaacttttaggttatagggaccaagttgaaacatgcttaaaattcacaagtctgtaccattctgtccttcaggtaccctaagctggtttgggtttatacattcccacagtgcctaccacatcccaatggctttatgaccttgaggtcctgatctgttttatcatagctcttgatcttcctcaaaaattcttacagctgtattccacaggtcatcaccaagggactgctagaactggatcatagcagcttccaagagctgagtgtgtacatttcctcccaactctgcattcagtttaaattgcttgtggtgagagtattcataccatgggaattggcagacactgtgaatcaaacccaccccctgcactgcccccctccagtgagcgagttcttgaacacttactggtacaccactgtcaccaaccctgctttttrtagacatgtcctttaagcaaagcaattcatgggaaagtaaatttaattatcagaccatttcattagattcctcactgccacaaacaggtggttgtggtgataatctgggcttttttgatcgctttagaaaggcagttctgtaatgacatgaaaaacatattgcttggtaatttatttatttgttcccaatgtttgctacggattgtggtgaaaacacaaacacccaggacaaagggcaaggttcatcccaccatgacgatgggaggcagtttcatcccaccatgatgatgggaagtccttatatcaggactccagggatcttgtgtcctgatataaggctctcactttccaatcagcaggaagttatgcttcccagcctctaggaaagcataggagttaaggagaactgaaatctggggcagttataaatcttcccttatgtgtacaacagtttaaatcarttggtcatctaccaaaatctgaggaacaagagcagctttagaaaatgggctgggcatggtggctcatgcctataatcccagcacttggggaggccaagacaggtggatcacctgaggacaggagttggagaccagcctggccaacatggtgaaaccccgtctctactaaaaaaaaaaacaaaaaccacaaaaattagctgggcatggtggcatgtgcctgcaatcccagctactcgggaggctgaggcaggagaatcgcttgaacctgggaggcggaggttgatgtaagccgagattgcgccactgtactccagcctgagtgagagasagactgtctcaaaaaaagagaaaagtaaagaaaagaaaagagtaagattaaaaacaagtaaagaaaataaatcctcccgctttttttgctccttcatgggtatggctgcatcctctgctcactggtttgagttattattttcccatgggcaattaaagccctggcctccactgcagttttcacatcaaacctaagagtctcaggtgccccttggtggagcaacctmactagagacattaatcatactacgggataattgacaaatgcattgtgagtgtctgatttctgtggctcaggatgcttagtagcagtggggtcaagggcacagatgacacaggtccaaatttccccacccctacgtagtagctgtgtgacctggggcaggttgcttaacttttctggacttttgattccacattggttagatggaaataccatattattataaatattgtaaatagtacccatcaaacacttaatgtgaaccagaaaccctcataaaatgtttgctagtctttgttgttgaaaggtcactatgatgatggctcaaaatcctgacctgaaggtgtgctatgttcctgcttcacttgtgctgtggacatgttcctatttatcatagtgcagttgttgagactgggtgtctagagccatgtgatttggttcagctcctaactctgtcacttgctctttgacctaggcagaaaactttgcctctttgggcttcagtccccggtgtttttattttattttatttttcaagatggagtctcattctgtcacccaagctggagtgcagtggtgcaatcttggctcactgcaacctctgcctcctggcttcaagccatcctcccgcctcagcctcccaagtaagtgggactacaggtgtgcgccaccacgcctggctaatttttgtatttttagtagagatgaggtttcaccatgttggccaggctggtctcgaactcctgacctcaagtgatccacctgccttgscctcccaaagtgttgagatcacaggtgtgagccatggtgccaggcctctcctgtctttaactggggataatgtgtgcagaattccccctaaaggatctatsatgcgtaaggtggaccctcacagaaagcgtcaaagacacacgaatctcttagcaggaggccgccaggtggcacaaaatcaaaactgcatcattgagaattatgttatgaagtcatttactgacttgagcctcagttttcctattaatacaatgagactgtagtaacttcatagggctcttgcaagagttcagctaaaattctccaccttgccacctagaacatgtcacagaaggtatcctggcccctgtatgggattcatacatgaagaggactgccttgtaaagtcatttgattagggatccagagggtgtactggtagaggacagattttcaaccccttgacagttcgaaggtcagctacacaactggcttgtgttcctcgctgacacctccctgagtagcaatgtgcatttgtgtgccttccctttgccaggcatttctaagaggatgaatcctaacaggtatggcagccagagggcaggggcagggagaagaataagatgttccttggtgtaccccattgtcatgagttcatcatttctgttaactgtgggggcagagagttccaattgcaactggcttgttgtgagactgccccggtggttgctgccagatgatccacaaatgccaagctcctcacctgagccctgccagccttcaggacctcctttgcacgaagagcaatttgcagaagagaacactgcaggggaggcaccatagaccccttctggtctgtactgttcaaaatcacatgacatccgccagaggcctggtgggaagccagggttttaggcactagaaatggagctcagaaaggaggagaaaggtccctgctggtctgtggagagggccttggccaccagagggatcaaatggcccaggcaggaaataagtatcccgctytcagatctgaggccagattttcaagtgtatgcatgattctggggtgctacaaagggtatagagtatggagttagaacattacacgtcaacaagaatatgggttttgaacccagacctcagtttgaatctgagttccagcactgccccgttgcttggccgtgagttacttcacctccwttagcctctgtctcccctccactacaataacacctgcctggtggggagtgaggatattgtgcgaatcagaagtaataacaggtcgttggcacctaagagactctcagtaaccagcagtcatcaccaccgtcgtcgtctttttttttggccattacagttgggattagactaaccctccctaagcagctattragcctcacactccctggacaaagacatgaaaaactctggatgatttggaagggagatctagaaatggtgaaaggactgscaagtgcctctgtgctgataytgtacctgggctcagtggtctggctaaaggagaggtgctggggccaggtgacaggcgagtctctatayggcaggcccaaaaaatggaggtgcaggcttcatctatactttgatgtgtatgcttccttctttaaacttgtgataatcagagttatagctgctttaaacttgtaaaaatcagagttatagctgcttttgaactagtacttgttgtgtgcccaggaaatggccaaatgttatcactcatccttccaagaamcacatgaaggttatattattatgtcgactttccagatgaggagactgaggctyagtggyttgtcataggtgtcaaagacaggagtccartgtaaggacttctggcttcagcacaggggattttcctaccatcccatattgccaccccatctgcaaaaatacctggatctatcttcctcctgctgattctcagctccctccaggactgaagagatgatattgattctcacttgatagaggttagaaagggcctctcccttccctagctgaatagagagggtttcctttttcttttcttttytttttttttttttaaatgggaaacttacagggaataagatctgtttcttcatttgctttgcaagagagttggatttgtacacgatgcctgagctggctcggttttctaaagacctaactttgcagcattcttcaagggctccagagagtcccttgtgccatcaaattaagtttggaaacttcaataaaaaagtcccgaaggaaactgtcaattaatgcatttacactgaagcatcatatttgggaaaaacatcttcaaacgcaaacgctgttttccaaccattaaaaagtttatgcgctgcttggtttccatggatacctgaggtaatagcctccttcctctcattgaagagtgaatgttgctcagttacttttttcctgtttttttttcacttttgtcttcctgacttttttcttccatccctatttatgaaaacaaaaagataactaaattgaaacsttgacaatgtaatttgtcagaggaaggcagcctgttttataagctcaggtgatttcatttttgttcacctgtttatttcatgacacttgcaggaaaaagargaattttcatttgatcaaatcatttccatgatccatcaaacacacaagttaaaaagggaaatgctctcagtctttaataacagtcttaatcgtgtgtagagcagagattgacaaactatggcctgccggctaaatctggcccagtgccttttttttwataaataaagttttattggaatacagacacgttcatttgggtagacgttgtcgatggccgctttcacaacaatagcagagttgagtgatcgtgccagacattatatgggccacagagcctaaattacttaatctctggccctttgcagaagtagtttactgacctattatatacaggaaagaatgagggcttgggtggcacttagtagtgttgtcacttttgtcattggccttgacctgactcagtctccgtattgttgagatgggaatgacgggaccctcagtagtgttttgggatataaggcacacggtaaaggaacaacaaataggaattacattccgtcgagattcttttgctagaaagatccaaagaaacctaccttgtgattctagatgttttttaggaaacccaaagaaagtatgaaaaagcccaagccaagtccttccactgttgttcccgggcctgtgtgtgctgtgtgtctttsctgggagaaggtcagagctggagtggggcactcgattccggcaagagaaggcaaacaaaagaagccacaacagtctaggaagaaatctttaatttctattcagctttaaagagtttgagagmgttttttcccctctgttaacaaacgasttcaagtacatgccttcatattataaaagtacctgaaattgcctagaatagcagcatgcatagcttgttagtatttacatatatttacatagggaaacaagagaaagatctacagttatttacagtctacataggggaagagaaaggcagcctaattgtatttcctaaaatacagtagatgagtagtcagcacatgcatatttagataatatttgcatgatagaatgcaaactttraaaaagacatacctttgtaactttctatgctaaggtgttgcataatcaaggttaatttttgtttgtttctagtctatkggcatcaagtgctttaaaatgctcactaacaccgaggcagaattatttacccgggcaattaaagcaacagcacacacgatcatttcctactaactagcaacacgctgctggtgaatgaaatatctattgtttctcattacccatcgaccactgtgaagagatctctctgtgtaaaggcagtgcctaagctatcaccattaattatggaagtaatataaatgasacactctccacagtatgttctaaatgaaatattaacaaggccagcgtcttggaacctgagaaatggtctgttccagtgagctctgtatggaaatccacacacctaactcagacatgcccgatttgaaatagcggggctggacattgggggcctacctgtgagatctgaattattgcaaagtacatcctcttaatttgtttctggaaggcagagttaagagttaattccttcccatgatgtggccccagcggagaccttgtgttttttttttttttttycttcagtgctttttcaggactatgttatagaatacttatggggcatacgtgtaaatgaactgtcaaccttaaaatctaaacaaamagcttgtttgtggttygtcctgaaatcctccctgctcacaaaacagccagctacttggttttctaaaagacgtaattttgcaggcagacttcrtagagccattctgtgcagaasaagggaagggagaagctgtttgttttacctgtagtatgaagatattctttgcgctgttagaactgagctcattaattctgcctggcaataatttcaaaggtttattttggtgtagatggcgaatacagatgcatacatttatacgcagtayacgagctagctataaccataacagaggttaaagaagtagagtaaaaatgtaaaatgtttcaaataaacacacactaaatatcttcttttatatcttataaacacccagcagtcctttagcacgggcrtcaaggtggcccagytggaaaatttcagtgacatgccatcagatttgttccatgtagaaggacgacactatcagttagatgcttattttgttggcaaatttctatggcacttctgcttggcyayttcaaaccaaccatggaagaatagataccccaatgcgatgtttcatccctattcataaagaaactgtactttgagcaatgtaggtatcccaggcagcatcagagggaatgcccagggaattcttccatggatataagacatcatcaacaataccttctcttagttctaatgagacagcctctcaggtccggtcagttctagaacgctttgggcaggcacaaatggaagatggaacaagtgtgcatgtaatgacccacatggattgccttgaagccgtttctttttccttccctcgttaggagtaccctcaccctaaccccagcaaagcatgtctagggtctcacaataayagcaggtctcagaaagataaaataattctgaatgttacaactcgtcccatttaaggctagacataaatctatcacagatcctttggaacatcgatggcaagaattctggaacacgaaggaggtatgaaaagggcttcactcgtttcatggaaaagctcagaacagtttgtcgacttggaaacacaggccctgasagygtaccmaggtcaccctgcccttcaatcctgctgatagcccaagttaacatcctcccatgccttggccttcccagaacaaacatggctttggacgcctttgggtggttgggactggctgcctatttttytctaaaacttaagttttaggaaagaattctttccagctttccatcctgaacctgctggtctccaggctcgttcctgcaaatatttcacagaggagtaagagccacattcktgctggctttccarttcattctcctctcttcgagtccacctcttaaaacttcttagtgmtcttgcaagaaactcatgtcttttgtcagggagaatggcatggcctttgtatgacacttccttctagccagactcggatttgggggcatcatatttgggatggctgcaccgyaaacaggaaaggccacaggacagytcacaggttctctctgaacagaagcctgtgagcacgtgcctgtcatttaaaagctgcatggcactcttccccctgcatgcgtttctctcaaggtgtcccttgtaatttgtggttgtggtctgtgcttgaacctgttgcatttatggtgatggactggcactttactctctctgagccacggccatcaagcccctgtcatagacactgtcccyagtgtcacctggggaatgacactcttcacctgtcatgggagaggcaactgaaaaggagcctgaggtttttctacctttgtgaacctgttgctagcaaagaaatatttttccttgtggcaaaagatcaacatctaaacacattgtccacgtctaatttgttagggagggcrtgttctcttctggagggctaagagttggcatgggatctaaatggattctccagaacactttctcacacttctaaagcctgaaaacaaatatttgctttcctgatcatcttcattgtttctttttgggaaattgagtgcattcctcttctataataaaggttaagaatagcctgtgagttagcaaaactcccaaaggtttatgaagaaagttacatttcaatacctacaggaagtatttgcatgtgtctaaggctggattgttgaaggcctttgtgggagtcagttgtcaggaatttgtaggaatgactgtgttaggaatcattggaggagagggagtcagagggatggatcagtattttctctgcaaacctgatgaaacactccagagcccgcacctacaygcgtgggaactgataagatgggggttgtgtccacttcacttgtatgggatgtcggtgctttgaaaaaattctatcatcaaagagtaggtttcttagttctgcaaatctggcacctggagatggcattttgaatcggacracctttttagtaagggtcacttgctgttggatcatcgaagggggtgctgagtcttcatttttgttcatccaaatggatatcatttcaatttagctccatgagtaaatcaatggaaaaaaaaatctccttttaacatttctcgggtgaacacacgacagcccccacatttcattttaggccatgttagggcatcacctcatggccagacatggcctggctgagaaggcggcagagcaggcagagaggcataggaagccggagccccgtggaagacatagatgaggaaatgggccacgtgcaaatatttgtgtcacatatttggggagcaggtttcatgtaccaacggacacggagtctgaagtcactcactctacgtaattatctgtatggctttggacgagttgcttttgatctctgatatcaggtaggcttctctctaaataaatggaaatactaactgtccctggctcatagarctctgtgagggttaggcaacaatgcttacaaagctctccatgcagagmctggcaaatcgtaacctctcaataaatgctagtcattgatgtcacttgaatagtactcgttggctacaactcactgaaaaagccgggcagtttgcagggctgaggactttggagtagacatctctgttctcgtctgctgcttcccatcattttggtggaagttggtgtgttsgttggttagcacttattccaaattgaattgtataatttcattatagaagtatcacggtggaagaagagggtgacttactggtgtggtcacctagccagggaggcctatgagcctcattcctgtataggctgcattactttatgaacaaatgcaatttgtggcaaatgtgtcccctaaaagattgctcttggatagtgagtagggaacaagtggccttttggagcagtttgctttcatttgtgtttccaatgagagattgaagctgtaattgtttgtgaggaatggctgtatcccaagcaccgaggtatctggagatgacctctgcactgttctgggagagtggttatagcctctcctgggggagtgttactgggagacagggaaagacagggcgtgtrgacggccatctattccacctgtgacatgagggctcaccccctcatctccaccgcagcagctctctgataaatgtagctctctgataaatgattctgttcctagtggtgtattcacagagtcartggataaggtggctggctttgcatttgagaagtatttgctttgtccaacagacaccagatgagtaacaatggaagtaggcagggtttgaagaggtatgtgtctttccttttagccaaacctgctcacttcagatcaccactttgtcctgggacgttagtcatgggaacactgccgtcttcaaaagggctgttctccttccctgctcttggtgttccaagcctaatctaacttccagggttcattcctttcataactctactttttgcataagtggattaattcagcatttgctgtgcaatgtccctgtaagaaagcaatcttagaacatctactctctcacaatcattgaatatatagatatgccatgatattgtgtctattttttatatatctcatagttaagtctactttaagacaggaatctcctctttcttttaaatgagcatgcattttaaaatagaaaaacctgaaagcaaaacacggtgtaacatgtgtccctgtgagtattatattagagtactaaccaatgcattacaaatatcaatatgtgggtgcttttttttttctttaccatatattgtttatcagaaacctctgtaccctttcctttaaaggagtcaatatkcatttgtattctgtgctgacaactataaattgatggctagcagttatcaaatgaatgttgatgaaaagcagctacttaacattttcatcccaacaccgagttttggaaggayggataatttagatctgagggcctcaactataaataaacagcaactgctttctaaatcccacctttctgtagttgaagattgtgctgcaaatctgacagatgatttttgaaagagaatgatgaatccttattaccaagatactcttaatcccaaacaagagtcctgggtaattttacatatactctcaagattgattgcacagttctcctctggcagctcacaaatgtttgactagatcggaaatggcattcgggcatgattaaaaagattctwctgggcttcccagaaattctcagtcctgtgtcgtcaacaacctaactcattgccattgctgcgggatagacacctcccccgtttcccatgattagcaaccatatacaacctacaggcttctgataaatgattgattctcaaaaaaaaaaaaatcgtttaggggaacccatagctccagccagtgtttgtatgtcaaggtattattatttatcacaatggatcagtaagcattgatgacaactggcaaggtattgcttcaratattttataacggagttgttaacattatttcctttagatggctcyttcatcttttctgcattatgaactgatgccccaaaaggtggtatgaatgaaagtcatstgatggtgattaaagtgctctttaaattttttttttaatcagtttaagaatgctttctcttttattggcagtacctgcttgtttactattgagatttcactaatgtgcctcagtcttattctgatgatatgtaggccgaaaagctggtgagccaaaaatgagaacctgttactaaactgtcatcacatctgatcatattaagatgtcactcagaggttgccattggtacggctgaaaattctccaagagaccaaaggtgtggtgtgtrtgggaccaacaagatattgttactgcttaattgtccagcaagggaggaaagtagagtgagtacccatgagcaccaagcatgaatctgagaaggagaatttgccaaaggtggacgattgatttttggagtagagaaggtcgtctttgctttcgggtgcccctcctgtgtactgtgttctacaaagccagagccacttgtgatggaatttagatggtaaatcaccccaagcctagtggcaaaggaatcaaagccatctcctgataaaaagttaggcttttcaaaaaggtatggctctcagcattgtagccaaatgtaggttggcatgaaatgaagccagttgtaattgcctttagattccgtggaaggaaaaggtaggtccccagctcctgcaacaatggcattctgaatcaatgggactgcagaatttcttagcaaaaataccattccagtaatgcaagagtgcaacgtggtatcattacagtaggtcakagtggcaaaatattttatcaggttaggaagaattctgctttttgctttcccaaacggactgctttggtctttcctcacgcttggcagaacagtgaaaggccagtctgtcatgacgtttgaatgctgaatagtataaccattgtggcatagagggcgggaggctggacttgaaatgggtgagctggattctcccaccactcgggagttaatggcaagtcacttggccactctggtcgttttggcagctgcaaggtaaaatgaaaatatatgacagatatctggaagttgatacaaaacaccatctccaccagaactctaagattccaggccaaaataatacttggcttgagttagctggatgagcatctcaattctccaatttgtctttagaggcacttctgcttcccttttccccacatgggatgcagaagagccagataaaccccttgaagttgtttagataaatgtgccaggtgctaagctcagggttattaggaataataattcagtgaaaggaaatttggatgacatgaactcatttccattakacttgagccacacaaatcaatgggaaaagaaacagytgaatccagsataatatctggctatttggagtgggcatgataatggagggagattggggaggtaacaaaccagctactattaagttcaagtcatgtcagttattcaaattcaggaccagtggaacttgtccagtatcatcaagcagccagttattatcaaaacccaagtctttgtctcrctcacggtccacaccccgcccagagtcgtatcacttgactgcatttgaccattcagttttcagaccaactccawtgttactagatatcctgacactgaagaagctaaaaccaaacarcaatgacaacaacaaacccaagtctgccttatggcasattcttcacrtcgtaacaccttccttgggaccctatttctcagtatggacctgactctcccagggatcctagaatgcaagcatagtgattgcaaaccagaccatttgagggaaactcctcyagtaagcaccctgcatggtcacaatgtaaaccctgcaggggcagaaaaatgataagctttgggtcgggtcggaaagccatttcccccacaatcaaagttccttagtgttttccttgtgggggcgagcttatcttcagttaccttttccggtcctctcttgcaacccctctccctctcatcagctgaaaattagtggatgcagctagggctctgaaacacataaataatcataagatgccagataaactgtattggttttaaattagagacgtgccgaccatgtctccctctgaacagcagcctattatttttrattatggcttgcaaagcaaagtgatttcttgccctctttatagcatccctgacagtattctgtcagtttggatgatatgatgcctcatcactgcacacgtccctagccacagccscaactgttactcaaaaggtgaatgaaagtgatcagctgcactctttgcaacttacattttgaagtgggctgggaggaaatgtacccccttacctgtggtcccattgtaaat

SEQ ID NO: 13460 - DNA, 20317 bp, Homo sapiens
tattcaataaatagtattgggacaactggctccataagcaaaaaagaaaaaaaagaaccccatttcatcagacaaaaagacacacactcatgcacgtgcacatgcatgtataagcatacactctctctccagattaaggacctaaatgcaaaagcaaaattataagcatattgaaaaacacatagaatatgcttatgaccttagggccttttaaaattagactattttagccaaatgaaaaggtttacagagcactttgatgaacatccatgttctcaccattgcttaagaaataaaagctcaagcttttattcaatttttattccgttacaaacataattgaagccatataaatagttcttgcctttaagaagtccaaagtttagagatgcagaatatgcacaaagtgccacaggagcacagaaaatacccaattcagacaggggccagragcgcccagtcttaaaataagggtaggggttcctagatagagaaaatagcacacatatgaactctacatcatctttgactctaattgtcaagtgaagattaccaatgacaaaatcccagagcatgccagtctaaccagagytatgctatctgaaacatagctctgattaactcactttgcactagggggtggggttgggggtaatacataaaacagaacatccaaacaaaaaaagactgagcagatcaatcaaccttagagcaaagggtgaagctgattgcttaaaagaaaatgaaactttggaggcagaacattccaaatgtaacagggcaacagatttacagtgctgaaaggaatgaatctcctgctctggatatgtatacacacagctttaaaacaatcatctatatactatagccatttttcagccaatgtagctctcttattcacgatcaatcagctaatttcttattaaatcttactaagatacactagatagccgcaaagtttaaaaaaaaaagaagaagaagagactgtagccattttgactatatatatcacaagtgtttctgaagcctttcacattgttgaccatccctggttcttgaatttctcctatatcctggtttctatgtaaccagataatgtagttgaattctttcctttatcctctttcttgtctcctttactgaattctctgctagcttttatctccaggctatgaaggtacccaaagataaagtactgggcatcgacttttctttttaaataccaacttctttgaagacatgacttcaactactaccttcaaacaaaataatttcaagaattttggcttggatctttcttttaattccagttacatttcatcttcttagatattctgtctctgagtcttatcaatttaagaggtctaaaaacaatacaccataggtacatgctcatgaacacatatacacataaatgcccacccactttttttgtttattatactttaagttctagggtacatgtgcacaacatgcaggttacatatgatacatgtgccatgttggtgtgctgcacccgttaactagtcatttacattaggtatatctcctaatgctatccctcccccctccccctaccccatgacaggccctggtgtgtgatgttctccaccctgtgtccaagcgttctcattgttcaattctcacctatgagtgagaacatgcggtgtttggttttctgtccttgcaacagtttgctcagaatgatggtttctagcttcatccatgtccctacaaaggacatgaactcatccttttttacggctgcatagtattccatggtgtatatgtgccacattttcttaatccagtctatcattgatggrcatttgrrttggttccaagtctttgctattgtgaatagtgctgcaataaacatacgtgtgcatgtatgtctttatagcagcatgatttataatcctttgggtatatgccmagtaatgggatgaatgcccacacactttttaaaaagtcacaaggacttaccatttttccctatctacaaacaactcatcctcttcaactgcctaagtcaatggagtccatcgtttctctcatctaygcagtacattttagcttttctcagttacaaatcttatcctgtcttctctcccataatatctttcccacccatctcttctttttactctctaccacaaactaacctaatttggacattgatcacctcaataatttcaactgtgttcctgcttccagtctctttcctccccaccaagcattctgaacattgttggtggatcactctctctacaacacaactttaaacctgtcattcttctcctcaacagctttttaaagggtgaataataatgccaaatattctaactatttaagaacctaaaattttggctttgatgtgcctatccaatctatcttttccaatactcaagtttctctattctaaaaaaaaaaaaaaatcctttcctcagactcctccctcaagctaccttactactatacttctagagagaactgcttgcaattgcaagcaatctggcttttttactccaataatgctgaaattattcttgtagtttccaaactgcaaagcaaatacttaagctcctcattttgcttgaccacaccatgccatttataattcggtcttatctttcatcactccctactaaccatccctgtagactcagcaaaccactagacttcctctaacataccttgttctttcagtctgtgcttctacatatattattccaatgtctttcctgactctgctgtgcactacaaactgcttttgaagtatcatctcttatatggaatttccccccacttcaaacatctttgctgtcagtgtactcttacatcattccctaacaggactcagaacactgcacagtaattgtttcacatatcttgatatcctcagaatctaccatagtttgaggcacctggtggacaattaagggtgggtttttatagactttctggtatgatcttattttctatctactcgctgtcgctcaagcgtactgtatggagacgcaggatgtatcatggttaagaggtcagattctgaagccaggctgtctatgtatgacctttagatctaccacttagctgggcaaattaattaaccttcttgtgcctgggtttccctatgtgtaaaaagaggattttatcctattattattagacctacttcataatattatgaagattaaatgccttaatatgggcaaagtgctcaaaacagcaactggcacaacataagcactaaatatattgcctgttttaattaatagaccttagttactgctgatcctttccacaagctagtcctatattatgttctatattctccattctacattttgtcctccattcgctattattaatgggctgtcttcatttttccctttatccaaatcctacccaggtttcaaggccaacttctggtaaatcctttgctcattccaatccttaaatgytcactccaatccttaaacgatcattccctaattttaatatctacaggattttctgcatcactctgcatttaattaaaactgctttgcatccttgtagtttttttcgtataagtttgtcaatccaattattataaactctttgaaggtcctgattacatctcctgcacctttgtgagttcgtacagcaggtagtrattgcttagtatttgctgtgtaaaataataaagcacaataggaacctcaactctgatcattctgcctttgcaatcaaagaaacggagaarctgtgagaacattccatgcttctctaggagccaagctgcaaatgtattagggccagagaattctgactcccattaaaatgagcagctctgaaaggagggagcggggaatccctccctgccactgtagaggatttatgggttgcccttaagttcccaaaccaaattgtggcactggggtttttatgagaaacgtgtcaacatgacaaaatgattcagagcacaggatttggagtcacacagatctagktttcagmgagactcctgtttccttctctataaaggggacattttaacacctacttcacatgtatttaactttcgccctaacactgaactgaagtgcaaagccttggaaacaaatttaaataaattgaaaatactgcaattcacaaataaragtgagaacaacatttttagttacgtaagactatattatattaaattaggtggcagcagtatttataataatctaaattgcctgtgagaaaattaaactggtattgtcaatacatacttaaaataagaaaaaaatcccactacagtctgtcctttttgacactttctccttcctgtaatttttttctttcactcaagattaaaaacaaacgttcaagattatccctaaagagaaatagttggaaagcacaatttaatagcaagttggttctataaatgtaatatttcagttcatagttcaaaaatacttccaaataggaattaacatgaatttaagaaattaacataatggcacacagctaaactgatgatctgagtccgtaatttcaaattaagagttgttccaacttgaagctggcagtcatacacagtttaaagggtttgtttacagcactgtcaaaagcaaataccacaatctttcagaaaattcaccctggcattctaataactagttattttaaggcagtataattgttgaaatacttcacaaactaagccaaaatgcgtttccttctgaaggcaaaaaaaaaaaaaaaaaaaaaaggtgacgtcttatttttaacctgtgattttttttttttttcagtttcggattatgaaataaaatgctgttcatccactgaagaacagacccttgcttcctgcactatcttcaaaagtttaggtcggarraggtaaaattttaaaaactgatttgttctccttgggatacagtgagatgtggaattcgttaggaatgataattattaatagaaaagatcaaaagaaggaaagaaacgttaatagtgtttataagcattgtgaactttcaacaaagctgaaacgttacgatttcaagatgaaaaaacggctttggggaagggaaatccacctcgagaatgaagacaagtgcggagcgaatagaatttcaggggagatgaaaaggggattgggaaaaacgtgggatctggtaacaaaaaggggggtttgttcttgaagggcgttctgcggggcgggcgttaagaggggtgcgtgcgtgcgcctgggtgaagtttgtactcagggctgcgataatcgaggtgacaaagttgtggaagtagaattcggaggtscgggagcaggaaggggaaggaatgtggggatttccaggctgggctgacaagttccgggcgctgctctcagggggaagggaggtctcctcgagtgccagatagcccgtccgaaaccaccgacactctaactccagctacgcgacccagcacccggcccctcctcacctcaggccgcgccgcctcgaccctccgcgtctccacagcgcacgaaccccttggcgccaggctgggccagacccgtcggcctggcaggcgcggcccccggttcagctgcgccggggcggcccagcgcgactccgcgggccttttggctgctcgccccggctccggaacactgtcagatccttctccgcagaggtagcgcgccaccccagtcccgcggcggggcggggcgctccccaatcccgcccagctgcgcccccggccggccaacgctgcgccccgccccctaccgggacctaggcgctgattggcccctgagagaccctttgcgcccaggcattggtccagtggccgcctgtcgacgagggggcgggactccgaggggtagcgattcccgtaacgcggctcttcgcgtcccggattccggtggctgcgtccgcgtcgcctctcccagactagatcgaagggttccccccacctcccctctgtgggcggaaagagcggaatgttccatttttctgtggaataacggggtcatgaactggagcccgggtgctgcccgccgcccgctgcccccgccctcccttctcgccagggcgcctgcggcctctcttcgcggccttccccgagggactcagagccgcgagggaccgcctagctcccttggggatggggaaggcgtgggagcctmttggggaaagtgaagagctcggtggccgtgactccgcacgagactgcggcagattgtggcggcggcttctctccaagacttacgtaaacgagccttgccacagtacttttttaaattagtaaatgagtttgggtgcgattgatcagtgagccccagaggtggtggcccaccaagcgactagtgtttctttgcggtttgtacctccccgtttatgataaaaaataccgggtaaaaacctattcatcccgcctccgcccccccctttccctcagaaaatggacctcaaggctcatgatgtttgtttctccccaaaggaagatgagaatcttgagttaaaagataaggcatgtgcgtgcgtgcgtgtggggtgtktgcgtgggtgtctgtaaaagtaaacacccaaaggtagaggtttttgtggaagaatgagaggatataggaaggaaataatggtttaatgaacttaaattatatccataaattaacaattataaagttcttcattatattgaggattcagatagagtaaaacatagatcgaattttaatctcttagttgttgatcagataatttataaaagggcaaagtgggcctgctaacggagtcgcaggcaaagtagatggtgctgcagctgatgtgttcagctcttgctcctccctgtcatcctatatctaacctatagattgtgaccagattctgttctagctttgccatttagaggggtgtttattttaaracaaatttttataaaaatttgttaaattgaaaattttgtrtagatccaggaaacttgatttttttgttgttgttcacagtctcactctgtcacccaggctggagtgcagtggctggatcatgctcaccgcacgttcaaattcctgggctctagcgatcctcccacctcaacctcccaagtatctcagactacaggtgcccctacaatacctggccaatttttaaaatttttggagagacaagattttggtatgctgacccggctggtcttgaactgctggcaacaaacgatcctccggccttagtggcctcccaaagtgctgagataacaggtgtgatgcaaagatgtatttaggggagatgtatagtggttaaatgtaccctctggttctagattgcctaggtttaaatgctgatgcctctatttctcatctctgtgaccttgggcaagtcttttcaaatttcttcatctgcaaaatgagaataacaataccaacctaacaggattgttgcaaggattaaatgagttaaaatacatacagtgtttggcacatagtaggtgctctgtaagtatcagctataatcattattgaatgtctactcggtcaacacttctgaaatattttagtatcacaacatatattaaaaatgatgatattttgctggacggggaagggcaggtacacagaagtggattgatatgtcacaacacaccagcctgccttggcaccattaggaaaacaaatgactgagttagtgcttttatgggtgtctttttattggctcagctcaggtcctgctcccaagaaactcacattttatgggagtagttaaagtctgaggccaaaaggatgaatcaatattggagaagtatttttcagagcaacaggacggaagacctctgctgtgctggaattacatgactttgcagatacctctgtagagtattggccttgaaattacgaatttcagattaaggatttgttactagaaagccttgtcaaaatgcaaaggtaagtaggggaaagtagtatattaatggagaactctccatttgtgtcctgtgaccatttgagattttagatatgtcaagagcaggccgggtgcagtggctcacacctgtaatcccagcattttgggaggctgaggcaggcggatcacttgaggccaggaattcaagaccagcctggtgaaaccccaactctattaaaaatacaaagattagccaggcatggyggtgggtgcctgtaatcccagttacttgggaggctgaggcaygagaatcacttgaacccaggaggcagaggttgcagtgagctgagatcctgccactgcactccagcctgggtgacagagcaaaactccttctcaaaaaaaaaaaaaaaaaaaaaaagagattgaggaaactgtacagtgagaaagtaacatgaaggcaccaaaattacaattacttgggagtaagtgagcaaagcttaggaaattgtgccatggaacaaaggtgataaatgtcaaagacaaactttgcctgcatttctaattccctaaatctggtgctgactaggatatccctttacttccttgtctgtgcccagttatgtttctgaaattctgtgtcagccctggaattatcctcatgttctgtatcaccttaatgatttcagcatccatgttcatgactcattagcactctgacctcacaatttctcatcgttttcttttccaatcatcttcaacttcactctgtatcagcaacccacagatggagccacaccttcaacctagtcatcaatgaaattacttcccctccaaaatgctggattgtgagtttccctctctgtacctacagccacctacccccatctatctctattctgtggtcattcccattgaatctgtaatttgtcctcaatgtgacagcctgacagccagtctttcttctcatagtttatcagctgtttcctatcattttttatcttacttaccagtaagaaccccctttttttttttgagacggagttttgctgttgttgtccaggctggggtgcaatggcacgatcttggctcaccgcaacctccgcctccctggttcaagtgattctcctgcctcagcctcccaagtagctgagattacaggtgctcaccaccatgcctggctaattttttgtacttttagtacagacggggtttcaccaagttggccaggctgatctcaactcctaaaagtgatgggattacaggggtgagccaccgccccccaagaacccttttatcaaccattttaactgcactattmtcttcagttcccttgaccttcagctatgtttaccttatcaggctatttcctaactatttcctttttccttgagctatcagccccaccgtaacatttattcttagtacagaaccttgttttactcccttaaaatcaagaccatcatttgtgagcatccttgacttttctccaacttaggaagcaaatagatatttatcctctttctcttttccccactcagaggaagaaaggcccctttacttttaaaaggttaatttctcctcctctgttcttggtactactttaagtctagtcccctagttttatatttttcattattaacactaaatgactttgaaatgtttaaaaattagatattaactcagtggtgagttgaggacagcctctctgcctgtgttaaaacctttgtaacctgatagcacctaattcaccaaaattaaaaataattaaatgtctaaaaatgaagaatgttaagctacattgaaattcacttaacaaaatgaggtgagaatgaaaaatgaacttaaatttccaaactagaagacaagagaaattcatttcatagcaacaaaactcaaaaccattatgactgctatttcaaaaaatgttttgaagaatgtatattcagaaaaatcaacataccataagagtacagcctgaaaatttttgacaaaatgaacacattcatgtttatcatctatatcaagaaacagaaggcctggcacggtggctcacaccagtaatcccagcacttccggaggccaaggcgggcagatcacgaggtcaggagttcragaccagcctggccaacgtggtgaaacctcatctctactaaaaatacaaaaattagctgggcttggtggtgcattcctgtaatcccagctactggggaggctgaggcaggagaatggcttgaacctaggaggcggaggttgtagtgagccaagattgtagtgagccaaggttgtatagtgagcmactacactccagcctgggtgacagagcaagacttggtctcaaaaakaaaaaaaaaagaaagaaatagaaaatagtctgggtgcggtggctcatacctgtaatcccagcactttgggaggccagaggctaaagcgggtagrtcacaaggtcaaaagtttgagactatcctggccaacgtggtgaaacccagtctctactaaaaatacaaaaattagccaggcgtggtggcacacgcctgtagtctcagccactcgggaggttgagatatgagaatcgcttgaacccgggaggcagaggttgcartgagctgagatcacgccactgcactccagcctggtgacaaagtgagactctgtcttaaaaaaaaaaagaaacagaaaatgaccagtaccccaaaagggccctcctcccatccagttattggaaggtcataactgaccactattctaatgtcatagcgttgtacccaagcgagttagagaaaacgacacactttgagacgaattaagagtcctttattagccagcgaccgagagatagctaacgctcacaattctctctgccccgaagaaggggctagattttcttttatactttggtttagaaaggggaggggggtctagttaaaacaattttacagaaataaagtaggcaaaaagttaaaaggataaatggttacaggaaagtaaacagttccaggtgcaggggctttaagactattacaagatgatagactcagggctttgggtgttatcaatcagacgaattcctgggaattgcggatatagcttgccacagtatcttatcagttaattgcattcttggatgtgctgggagtcagcttgcayaagttaagtccttgaggaaggggctgccagtgaaagagtcaagatggagtctgtctggctctcttagctaagggagagtcaattcaggtggaaacaagcctaaaaacagggttagtaaaaacaaggttgggcattacaatagttttatgctgtctttttaaacttgaaaagtgtacagaaaaattttttcacatcagatgggtaatgtgccaacgtcgtaacaaggtttgcgggaggcacatctcacacatgcacatgaaaacccaatcatcaggcttataaactacaaaagaatctgaaacttcttaggcttaatattaggttggtgcaaaagtaatttctgccattacttttaatggtgaaaaccacaattttacaccaacstaatatatttacttattttattttaatgaatatactaaaccaagagagtttaaaatgaaataagtactgctctgtggccgggcgtagtggctcacgcctgtaatcccagcactttgggaggccgagaygggcggatcacaaggtcaggagatcgagaccatcctggctaacacggtgaaaccccatctctactaaaaaatacaaaaaattagctgggcgtggtggtgggcgcctgtagtcccagctacttgggaggctgaagcaggagaatggtgtgaacccgggaggtggagcttgcagtgagccgagattgcaccactgcactccagcctgggtgatagagcaagactctgtctcaaaaaaaaaaaagaaagaaataagcactgctctgtaaaggtaaacacagaggaagggatctagctcagagatctccatactgtggacttccagggawaaccctggtcaaatagccatgggctggtcaatgattttgagttactctttgagagggaagcttggcttcagagaaggaaaggccagtgcaagacatgtgagcagcagttaggtgcatcctattcctagacacatacataggataaggaagtcaggtattgggactgtagctttggaatggactatacttgcttcagaatattatcagggggagtttgagaagcaagggctttccttcgttgattctcctttcaccagtcttcctggaaagaatattctgcagttacaaaataggttccttggctgcmagtctgatacttgtgctaaaaccaaatagatgaaaaagtatcaacatgaattttaaaaaatatattgtgtgagcttrtatagctaagaattcccagccccctacataggatctgaagaaagatctagtactaattgtattaaataatggtttaggcaaatgtgtatctgtctccttaagagaggaaggcagtccctactgtaaagtaaaaatgaaatggatatacttcctgagagggctggaattttctgawaattgtcccctctgatttttcacaggatttacggaatggccatcttccataattaacaaataaataaatgaaatttaatgtcagggtcaaatgaaactggaaacaaagcttatctggtgatatatcaaattatgagagtcattatttggatgtaaggatatatgacagatagactcttaggagaaatgctatgacctcctgcttcttggtattccttgtgtgatttcctcctcttgagtgtgaaggcatgtatgtcattgagttatataagatagtgcccatcttgctagtgtctctctctctcttgtggctctgaaaaatcaagctgcctgccatgtttgagctttgatatggaaagacccacatgttaaggaactgagggcagactctgccaacagctagctttgaaactgaatctcccggccaggcacagtggctcatgcctttaatcccagcactttgggaggccaaggtgggtggatcacaaggtcaggagttcaagaccagcctggccaagatggtgaaaccccatctctactaaaaatacaaaaattagctgggtgtggtggcaggcacctgtaatcccagctacccaggaggctgagggagagaatttcttgaacccaggaggcagaggttgcagtgagctgagatcacgccactgcactccagcctgggtggcagagcgagactccatctcaaaaaaaaaaaaaaaagagagaaagaaaccaaatctctcagtcctacaacctcaaggaactgaattttgccaacaaaagcagatccttccccagtcaagcctcagatgagacagcatcctcagctaacaacttgtttgcagcctcatgagaactgaagcagagaacccagctaaactgtgcctagactcctgaccacagaaactgagataataaatgtgtgttgttttaagctgccaagtaygtgataatttgttatgtagtggagaactaatacaacagggaaaagttaaaagctattcacataaatatttataatggatactatttctacacatttaaatcaagcttctcttacgttcataagaagatacgaatctggagaaggaaattatatcaagcagaacgctgctctggtgttgtgaagacgggatcccaccattctaatgtattcaatttatttattcaataagttttgagcatcaactatgttccaggcactgagatattaatctaaggaagacacacgtgttgtcctcattgaggagctcaaaagtctaatacataaaccaacaatcatacaaaaatcatagccatgttacagtgctatgaggaagatgttaagagaatattctggaagtactcatacataaatacttcagaaactgggcattataagaagtcagttgcctctctctactttcagttctacatttttataccttgtagtggatttaaaatggccacaaattcttcaatactcttctatggagagatttgagggctatttcccttcatcttgaatttaggcaggcttgttcagggtctggcttttaagaggagctttcaccttggtctgtggaagtcctgagtcactgtgtacaaagtccatctaccttattacaccatctggagagagctgagactacagggagagggggagtggcccggctgatcccagtcttcctagtgaccctgcccaggaacttggcatgtgagtaaagccatcttggaacctccataccagaccagccacgagatgaataatactaactgatcccagtcaatgccacatagagcagaagaactgcctaactgaattctttccaaactgctgactcaaaaatttgtatggtataataaaatgtttgttttaagtcactgttttgttaggagtaataagcaaccagaataaaattctaatctttatcatgtaccgtgctgaaaatctgaccatctcactctccttaaaactccgtcaatcccttcccattacccaaatccctcttgtatgtcatagaagtccctcattacgtgacctctacctacttctctggtcttgtctcctaacatggcctccaactccaggctctcatattacctatttgctaatggttcctgggccagcatccaacatactgttccctccttccatgccaagaagagacagcttattctgtttccttggccggtcattgccttcttcatttgctttgcctaacttgctcaccgtgtaaaaatattcatctaagtagttacttcctctcagaagtctgctctaggccatgagaaactcacagccaaaaatgcaaatgattccagatgatcattcactgtagaaaaggaattgatgggccgggcgtggtggctcatgcctgtaatcccagcactttgggaggccgaggcattaggatcacaaggtcaggagattgagaccatcctggccaacatggtgaagcccggtctctactaaaaatacaaaaactttgctgggcgtggtggsgcacaccagtagtcccagctactcaggaggctaaggcaggagaattgcttgaacccaggaggcagaggttgcagtragctgagattgcgccactgcacgccagcctggtgacagaacgagactccatctcaaaaaaagaaasaaagaaaaagaaaagaaagaaaaggaattgaggaagagatttctagaccacagagcaaaaagggaatgggggaacccagataaaatggcagactgaaaaaattctttgctctttaagttagtctctcccaacatatacaatgtcatggatgctgtattagtcatttgaacaaagtgctatgttaattcagaaaagagacaattaattttccctggagagactggagatgctttctagaggaagtgtgacattgaagcaagttcatgaaagatgagtaggaactcactaagggagataatggagggaagcagttcttggcagagggaacagcaagaggaagcagtgggaatgygaaaggacaaggtattaccaagaggtctggtgagagtagatcagggagtgcggggtgagaaataaattgagacgagaaggtggaggccttccttaaaagccatgctacacaggggatttacactttattttgtagggagatattagaatttttaaagcaggatactgttgagaacagatttgtgattcagaaagcaaattatattaatactgtgaaggatgaattgggggaacaagaaactggaagagagcttgaactagaatagctccttattttggaagagaaggaagagggtgttctgaataatgccagggagatagaatggcaagacttgacagtgggatatggtaagaaatgtatggacagatctgtgatcaaagcctgggttaatcattgcggataagctgtatattcttaagtaatttcttccccctcccctcccctcccctcccctyccctcctctgtcctcccctcccctgttctctcctctccttttttttttctttgagacagggtctggctttattgcccaggctggagtgcagtgatgggatcatagctcactgcagcctcaaactcctgggctcaagcgacttttccacctcagcctcctaaggagctgggactataggcacacaccaccatgtgtggctaatttttttgattttttgtagatacagggtctcactttattgcccagactgatctcaaactcctgggctttcactctagttgtgtcctttgtggttcttggatgtcatcacccccacattaggcacctgcaggtatgtccttgtccccacctgagctctggatgtacattccatgctactttccacttttgtgtctcatggtcatgactgtaagtccccttggaccctttgtcagctaaattatgtgtctttcttgggggcccgttagcttttctgtgccactctcggggctgcaaaagattcagagggactgcctcagactttccctacctagggcactatatgtggtcatctttaccttaattctgtgacaacattgtggtctaggaaacatctgctaggctgctgcctcccaggattccagatgttaatagattcccaacattgtcatgagcctccaccatgtctccccaacttggagctaaccccaagtaaggggcatggtggaggaccttttcttagatctttattacctgaagttattttgcttaacactcatttctctacttttgcgctccccaacttggaaagtctttatctagcctaggggtgggggtggggtaggggggttgatattagtgggaggggcaattaagatgggtcagcaagtatctccccaaatctttctgtcttactactaaggcttttgaatttgagagtccaagagtttggcaccttcattctctgctagtcagtgggttttygttgtttgtctttctaatgcaatcagggagagttgttaagtgaagagtgtagagagaaaaaaattctggaacaaataccttacttaaatatcttgatatgctgaaataaagtttttgtctcttccaaatatatgcatcctcttctcacatctgccaagacagtcataggtaagaaacctcaaattagaataaagagtatccgcttccttaatctgatttctgtgtgcagataatgagaagaggcgaaggatcaaccagattctgaaaacttgctttcaggtaccaggggccagagcataaaactagatattttcccaggattgattgatttaggtactgaccctcaggggtcacatagaaaatttcccagtgacattaaaggaagcccatactctattgtgtaagaaaagagaaaaactaaacaagctgccaggtgttgaacttctccttgtgtccagttctckttctgccttgtggagctgtaggagagggtcaccaatgcccagacatgccattacaccttcccttcttttgcccaccttcttacctcttaacatcattctcatgaattttttttcatatacttgctacctttttctaactttataaagacagaaaaataaatgaagaatgaatcatctgtcttgtgtgttagatgtcatggcaggaggtagaaaggaaactgaatatgtctttaaacccctggagcatctagctacagatggactaaatggtccaacccaaatgcagaaaatcagtgtaaaccacttagactgtgattctgatttcaataaaaagtgaattttttttccaagtaggaatatgttaagctgttttctctaatcagagacaaattttcaatgcctggataacaagtattatcctaagtgctacccytttttgtgtgccagctatgtgacagaaactcactataccagacactttatatcccaattaatctttgcaacaaacagggcaggaaatagcagttgttcactgtagtcacactcttatgacctagaagtgttaatttatatatatgtaaattgtacatcttccttatatattataattatataattaaattatacaattattatatattatattatatattatatatattatatgatatatgatatatgatatatattatattatatattatttatatatttaatatatatcatatataatatatattatatattatacaatatatacattatatattatatattatacaatatatacattatatatyatatactatatattatatatcatatayaytatatataatataywatatatgatatactatataatatataatatatgatataatatactatgatatataatatatgatatatgatatatcaaatatataatatacgatatataatatataatatatgatatcatatattatatattatrtatattatatattatatattatattttatatatkatatatgatatatcatatatcatatataatatatatgatatatsatatatcatatataatatatatattttatatattatatatgatataatatatataatatatgatacatgatatataatattatatattatataatatattacatataatatataatataatatatataatatatactatataatataatataggatatataatatatataataattatattatatagtatatattatatatattatawtatatactatatwatataattatataattatataattaaattawataattaaattatgatttatataattatatattccttatatattataaatgtatatattatatattttattgtatataaatattatatatataaagaaacacagtctctctgtcatgcagtggctctatcatagctcactgcagcctcaaactcttaagctcaagtgatcctccggcctcagcctcctaagtagctgggactacaggtgtgtgccattacgcccagctaattaaaaaaawtttttgtagagatgaggtctccctatgttgcccaagctggtgtcaaactcctggcctcaagcaatcctcttgccttggcctcctaaattgctggaactacaagcatgagccactacacacagctattttggtgtatttctaatatcttttagatgcatataattttttatttgttttgtcaattaccaccatggcctaaacaatttcctatgttgttaaaagcttattttactgactacactcatgacgtttttaatagtgcattgaaattttccaataaatttcacagatatattgggagtagacatagcagagggtatggtagcctcagattagcctgggtgtaatcttggaaggaggcaactgccttgctgctccctctacttttgcctctcctgtagccaagcctcaggagaggcttttctgcatggtttccagggtttggtttgtgagggaagaagatgagggtaaagtcaactcaaacttcatcatagcattgtgcccactttgccctgtcactgccattctccagcagaaacactttggacaccaacacatgctccctcttggagaaactttctagtttgggtaaaaagaccaaaaagtgggaaaaaattaattagaaatatggagatcatgggtggaaggagctaccatggcatgaccctgaaagccctcagcatattctggcatggatctctgaggaaatacaagatgacctctgtgtgaggtgtttttcatgttggttggaattttcactggtaagaacacaagtacctttaagctttggccagaaggtttcagatcttgaataaacccaaactcatttgtgctttttctaagtagaatagtcaggttgaacctgtggatcaacagttgacattatgccaaccaaaatatttctctttttggaagcaactaatgagtttcaataattcttcttgagtctttctcacataaggaaacagggcacatcattaaaactgccctggaggaaattatatgataatctttgtaaaactaacattccagaagggaggggactttaccaatgcaggggattattaatagctattttgtgccttcagatggcatgatgctttatgtgttagtgaatttcacaggatcacatatgtgcaagggggccaggctcggatcaagggggtatgtggctgctggctctgatttttgttctgctgggccttggtggaagcaaccagttaggcaaatagagccaggcacactatccttaatgtattagacaattggtaattctttgttgtttatgatgataggtttgataggaatctctggacatggagatagaaaaccaggtggctctaccattyattagttctataactatagacagattacttgtctcacctgaacctccatttccttatctgtaaaatggaaatacaatctctttcaataagttgttatgaaatctaaataagataatatatgtaaaagtgctagacatggaaaaatattttataattttt

SEQ ID NO: 13461 - DNA, 91576 bp, Homo sapiens
aatgacattgactagcccagtgttttccttgtttacatcttggacataagtcaggtggctcttttttatttgagactgggcaattcttttttagatgaccaatttgatcacaattataacatttccctccaaatgttctaacttgtcctcctaaagcaactcctgttattgtggaataaagtttagaaaatatccaaagcttatcagcctgtaaattctgggtagttcagttgtctaccatgctgttaattaaatgaaaacatcctgttatttcagggtccttccttgacaaagtactatacagctgaagaacatctcgaatacaattttggtgggaaaggagccaattgatttcaacagaatcagatctgagcttcataaagtctttgaagtgacttcacagagacgcagacatgtgcacttgaagatgctgccccttccctggtacctagcaaagctcctgcctctttgtgtgcgtcactgtgaaacccccacccttctgcctcgtgctaaacgcacacagtatctagtcaggggaaaagactgcatttaggagatagaaaatagtttggattacttaaaggaataaggtgttgcctggaatttctggtttgtaaggtggtcactgttcttttttaaaatatttgtaatatggaatgggctcagtaagaagagcttggaaaatgcagaaagttatgaaaaataagtcacttataattatgctacctactgataaccactcctaatattttgattcattttctgcctatcttctttcacatatgtgtttttttacatacgtacttttcccccttagtttgtttccttttattttatagagcagaaccctagtcttttaaacagtttagagtgaaatatatgctatatcagtttttactttctctagggagaaaaattaatttactagaaaggcatgaaatgatcatgggaagagtggttaagactactgaagagaaatatttggaaaataagatttcgatatcttctttttttttgagatggagtctggctctgtctcccaggctggagtgcagtggcgtaatctcggctcactgcaagctccgcctcccgggttgacaccattttcctgcctcagcctcctgagtagttgggaytaccagtagatgggactacaggcacctgccaacackcccggctaatttttttgtatttttagtagagacggggtttcaccatgttagccaggatggtctggatctcctgacctcgtgatccaccygcctcggcctcccaaagtgctgcgattacaggcatgagccaccgcgcctggccgctttcgatattttctaaactttaattcaaaagcactttgtgctgtgttctatataaaaaacataataaaaattgaaatgaaagaataattgttattataaaagtactagcttacttttgtatggattcagaatatactaaattaactttttaaaacacaacttttaaaaaatgtatcaaaataataaacgtgttctgatatttttaaaataagtgaccttgtgttctttaaccagtccacatctttagagaacaaaaatgtgttatgatattatgggccatgctaatgacctctagaaaacatcagaatatttctggatatttaataatagctttatatatgactaatgctcatttctatgtaattctgtttaatagttgctttaaaggtgaattttgccacatttactttgacagcagtataaggagtgagatagacatgaacctgaatttcaatttaaaatcatggaagagagggaaaaaaaaccagcttaagaaaaatcaactgataaactgcaagaaaaaaatgcaacttacatcacaaaagctaattgctttattatttagagagtacttaaaaattaaagaccaaacttctctccacccaacaaaaatgggcaaaggacatacagctaggtcaccaagaaagaagggcaaataggtggtgagtayatgtaaagatacttgataggacttttgcttagttgaatctttagcaaatctcttttatttcttgggattttgaagaagtaatttttaaaggaggactagaaactaagtgattgggaattggcctttttagaattaaaatttcccattacaagaaaaaaaaatcctgtgttcttttttttttccagaatggagtaggtcagtgagcaatgtgattaataaatatttcaatgtctgtgacttttgatttattttggagacagggtcttgctctgttacccaggctggagtgcagtggtgctatctaggcttactgcaacctcacctgtcactttttaattgcaagaaagctgaaaggtttttttctattatatcagttataatgakaaatactgtatatactaactatgagtaaaatactatattgcctaacttgtattattaagcaattctgctaacctgtgaccttacattttcatctgaaaagcaggggctggacaccaattgccctatgaagctattgctagtcctaacattctttgttttgtttgcttttttggcacacttaagtgtgtactatgaagtttatgatgctttaatgaaattttctgtctctaccattgtaatgagaaaggaataaaatactttattttgcaaatctacttatggaatatagttctgtacctgattgttttcataatccctgtgttgatgtgtaatgccacagacatgctcttgatrgtaacaggaaagaaaatcagacacagctaaacataaaggtcagttggctggcaggtgcttagcaggtgtaaatagaggcccattcatgctgctccacttgctcctgaaaagcataatgtaaatacagtatactaattaggaggcaaagaaccatctaacatggttcttttttttttttttttttttttttgagataaagtcttgctctgtcaccaggctggagtgcagtggcgcratcttgactcactgcaacctccgcctcccaggttcaagcaattcccctgcctcagcctcctgagtagctgggactacaggtgtgcgccaccacgcccagctaattttttgtattttagtacagacggggtttcaccatgttggccaggatggtctaratctcctgacctcgtgatctgcccacctcggcctcccaaagtgctgggattacaggcatgagccaccgcgcccagccctaacatcaaattttaaaagagttggccacagtttaatgacatccctgcacaccagcctccacccatactgcccttcataagccccttaaaggagatcccatagttctaaaccgggtccacaaacacasatatcctcattctctccttttcttctctttggcagtttgacaaaatctttagggggaattggaggaaacattaatytcctaaatcaacttcattcaaagctttggcttcaagttctacccgttaaggcctcaggaagttcattgtcgacattgaactcagtcactaaaatgacctcaaggctaagggatagaccacagctccacttcacaagtaagcttgcaacacctgatttaggaaagtttgctgtgcagacagttgtagctcatccattttacagaccgatctcgatttgtttcctagggtctaaaattatttaaatcaaaatctctcagaaatttctggacatttaataaattcatgctggaggagaactggcagagatatgttaaatgcacttgaccacaagaaccatttatttcatccaatatttaccagctattcattgtacacttactacagattttggcactggagatattataagaaagctctaaccctgacttatggaacttatcccaaaaaataggaaacaaggctcagaaccattcaaatgaagcttcagttaactcaaataaaaattagttttataaatttaatgtgaaagtcttcgagtatattaagaatggcttgattaaccccagggatggaaattttactgattgaaagaaagtttcaataaaataccgatcttygaatctaatctgacacctgaaactaggaaatcaaacactagccatattttttcttctattctttataataatttttctcatgagaaaaaggtatctttcttccaagcctgaaaataaatggagaatttttaatatctattgatgtggagaaaaataaatagactatctgctttcacaaataagtgctggcattgagccacagaacatgtctgtcatattgctctttcacaccatacattaacaggaataataatttctcctcattgagtttcctatttactatccccttaattatacctcctttaattactgtcatagagtgtctgaattttataatccaagatactaagatgtttatttgatataccaccagactcaatgtcttgtattctatgccaaaaatttgaaaatgtttgggaagaggaaattccgtggtttggtgaacccagaaagtcttcagtacatctcagttatagaactgtattaaatacatttaaactctataattccataagacccattttaggtttatacactaagcatcyaattcctcactatcctctcatacaaaccctgtgtaatacaagttctactcccataattctatgaacaaaacaacaattgatacatagatttgatttttaaaatacattttctttaccttattctaartgtaacatagggtcaacatagaaaaagaaaactgaaaagcacaaggaaagtgaaatatctataatcttaaccattgttaattttgttgtgttccaaattagtgtatgtatatatatatatatatatatatatwgcatttttgttttaataaaaggactgccaaaatgcacatgccaatttggactctgctttttccacttacaatgatatcatagtttctcacatttggtattcttttgcaatacttgctgcatagaattccatcacacaaaggtaactgccagaaattccttattacttttgctagacacttagggtttacattttttacaaaaattataaatctttgatcacagctctgatgatttctctgggaactgagagcctaacacaagtcatttccactttaagacttttaacattctgaaaagttatgttacaaacagagtgctggtccccctgcaacatgytcactcacattggctgacrttttaattctttgccaatctgaggggaagagatgtcaactttttttgtttgctcttttaatgccagtcatgttcccttttttttcccccttttaccagtcatactggcttactcagaaccctacaaatcaatcctgctcattcttaattttccaacattgttcctgagattgtttcaccagaaaagttctcccccttatccacttcgcctaacaatttctacccatcccaatcctcctgcatttattgcttccaggaatttggcacttaggacacccttgtccttacattgttcatgcatgtatatttcgtcttcaataaaacatttagttgctcaagggcaagggtcccatagagtctcaatatgctaacggcctggtgttgcttaataatttagattctgacgggtcctctccagggaggggagcaaagggcaaattatcttaggggctgggagtgcagaagccaaacctttgagactgtgaaaagaagacggcgccgagacgattcagtagcaggcattcaagcaagaaaaactcaaatattgttcccaataatgcctgactaatgccaaataccaagtaagggcccaggcagtcctgacagcctgcagtgccccaggataaaactaaccctgaggggtgctagcccacgataaccccctgccagggctctggacacgccctgtctcctcgaaggccaacgggctgcccctgcgcgccgaggccccgccccgcggcccgccgattggccccagccgccccggcgctaagactcaatttcacactacrcgcccaggccacgcccacctgtcatgcggccctggaaactgtgagtttggggattgttgtgtccactaaccggactcagaagggacttccctgctcggctggctttcggtttctctgctcacctccggataaatcacggggtctcccgcgccgctcatggcgcctcccgtccgtctcgagcgtccctttccttccyggcgctttcctgggttgcttctggcggccctggtgttgctgctgtcctccttctccggtaggaccccggggtggattcgcgcgtccgcggcgaggctagarctctgctcagtcagtcgggcaggaggcgcggggcgaagctcactgcacgtcgtgcctgcttgggatagagagcgaggccagggttctccgaggggtgccgtgctcagatcccgggggtatgtggcgggggatgcgggaaccacgcagaagcttgtttggtggcatcgtgtgcgcggscgacatttacgcaggatctggctgcgttcccaaaagaagcgtgaatcgtgttttcgggattgagcccagtcagcaaggggagggcttactgggcgccccaggtragggcttgctctggagtgcacaggtgcgtgggattgttgctagagcccgtgctgtgcccgtggtgagagtttgccctgtgttcccttggtgccttggtgagtagggtgttcattagggcttggacagtacccgcggtaagggttgcagtgcgtctgctktgccccatgggctgggctggcctgggctgggctgggcgagcaggggcctggccaggtgttgctgggagcgtgctgtgcgcaagtggcctgtgtgcggagttcactgtgggcaagacagctcactgtttgctttgagtggagcgagcgcggactctgcggctagggagggcatgttgagtgagagcaggctctcagtgcctggggttagagaggtggtaagggcgcaccatgcttttagtgcyttctgtgaacagtgtccgtgttgcctgagatcgtattggtcttgaattttaagtggctgcttttttggggggtgggtgggccatcgagtcatcttcctgttcccaaccaatatagacagtatctgattccattgcctagtggctttttgacattgttttccttcttttcattagtttgagtcatatttgagagatgtgaagcaacctaaaaaacactggtagccaaacctagtgagaaattagtatcctaacaaaggaaggcagataatgttaatcttgttttcccctacagctcataaactgaagcttaaggcctatcccactgttytgtatttcattgaatggaatcaatatttttaaaaatgcatgctaggccaggcccagttgctcacacctgtgatcccagcactttgggaggcccaagttgggtgattgcttaagcccaggagttcaagatcagcctggacaacatgtcaaaaccccatgtctacaaaaaataaaaaaattagatgggcatggtggtgtatgcccgtggtcccaactactccagaggctgaggtgggaggatcgcttgagcccaggaggagaagactgcagtgagctgtgatcatgccactgcactccagcctggatgacagtgtgagaccctgtctcaaaaaaaaaaaaaaaaaaaaaaagccaaaaaatacatgcttaaatacaggcttattgtgcaaaatgaacaaaataaaaggacaactgtttttaatattttgttatatttccttctgactttattgtgtttcatgtgtatctatrtccaaattatatttaggatcttattccatgtacagattgtacgttgcatttcttctcttaggaacattcattcaacraatatgggtcttgtatgtctggtgctgttacactrgtaggtaataacagacaattcctattttctttatcctttttttactatttgtttacacacgtacatgcaggaagataagcagggactttttttgctcattgttaagtgcttaatgccgggaacacagtaggcaatcaacagatgtttgctaaaatgtattgggagtggcagacattaaccaaaacataatagtaacaaatatattaaccagggaagtgttctggaggaaaggagtataattttctgacagcatttaacaaatgactggggggagggaaggctttgcttctcatcaarcagacaaaactctgccactttggggcatctgtgctttctgttccctcagtcctggaacgttctccccatgacctgctgcataaatgggctgtttcttctgcaagctcagctggaatgttaccrcttcagagaccttcttggaaccccccaactcaggttgaacacatacaacccagttcaagtacctcttgtaatcacccttttaaagtgatcttttctgttctctgtctctccccatcagaatgcaggaatcttctgtcttcccccatttgtggtyccaaaagccccatttgtttgcttctgtatgaaccctaactcagtatccatatagacatctgttaaatatcagaaaattaaatatactatttggctggggcttagagcctaggaaaaagtccctcctgcctccaagaggaaggttctttaaagagctrtgctcaggatggtctttctgttgtacctaaaaagctagggcagcagcagctgagggccagaaaggatctgtctcccctgtttatgttgactctgcagggcttccagtacttcagtcttgcatctcactgatcattaaaacgttcattttgaaggagggtgatgggattagggagcagtggtgttaagaagaaaacgaaaggacttttttttctttttaaagattaatgtttagaataggcttagtactagaagtacatacagcctgggcatcataaggagagcccacctctacagaatattaaaaacaaaaaattagccaggtgtgatgttgcatgcctgtggtcccagcyacttgggaggctgaagggcgtgaagggggaggatcactggagcccccatggtcaaggctgcagtgagccctaatcataccactgcactccagcttgggtgacagagtgagacccggtctcaaacacacacacacacacacacacacacacacagacacacacacacacacagaaaaaaaaaaaaaacctggaagttgaagaagataatgaaagcaatttgaaatagaggaacatagaattataaaatgaatagggtgcaacatggaagataacaaaactaaaaatgaagagaaggaaaaataaggttaagtttgaggttgatagggttaaatcaagacaggtatgaaacctagagaaagtaaaaatgagaactcacgatgctaggcagagagaatacatgaattaaaataaacattcaatttttggagcaactcactctcacaaagataaggttttgtaagcaggtggtgctgtgcatgggagacctgccctctcaaaggtagttgccaaatggttccagatagcagaaggaaacatgtgtcaaatttcaggccagtctcattcattcctccagaagaggagctgcttttttggacaaaacccccgatctcctgttgtgtgtggtctcttctgcctatttcaggtgttttccttattttcaatgaaagaagccaagaccartaagttcttattgcttcttagtttcctcactcggcatactacaatgcaaaaagagcagtccatatctggtcacctgccaggataccagaagactgggagataggcagcacaagaaatggctaaatcttctttctccattgttctgtagaatgattattttcaatatgaaattgattacaatatattcttcacattgttttgtgtttgacagcagtggactttgagtaccaaatttttttcraatagctactatgagggacatattgtgctgggtgttgtggccacatggatgaatggagtcggccttgttaactattaaactcaaaaacacgtgataattacctgagagatccatgcaggggagagtccaggggaaggtgactgatcactgcttcccagggggaggcagaaaatgcttcttggaggagatgatgggtggattaaagaagacaagagctgagcaggagttgtagctacyggccagggaggaagggtattcagakcagaggaagcaaggtgagcaaaggcaccaagatgtgacactgctggactgccaagctattcagtgtggcagagtagggtaaaggagacaacaaagaagggagaggaataaatcacagggtgagcagttctaaaaagcaacagkcttgtcaggaataaacaatcaccatcgtaaactcagactttgrtattattccctgtccttttagggcagcttgagcccttttgtttgacttagcacaacgtgactccaaactagggttgttttaatttcccragacacagtagtaggcratttcttgaggacctaattgcagatagagtttgtcggtctcagcatgtgggagctccagatgaatggcagtaatgggaagcagtttggtagtggttcagcagtgtggcctgggaacctagttgactggcctgcctcctgggtctgccaacctaactggaatgtattcttgggttctgattgtgatgggatttaaaagtctctaagctatgttaggaagccttagacattatcctgaggtcattggagagccatcgaaaggtatctgtcttggaaaaaccttgattacyctgtcatataaatactgctctggtaatgtgaaaaatgaattgaatgaaaggtggcaagataggtatggagacctatttrgttatgtcgtggtaatccagataagaaatgatagtggcttgaatgaaaagtaaaggatacaactacatagaataaacgggcatttcagttgtggaaacataacttgtttggggggcgtgtgtgtgtatgtgtatgtgtgtgtagagtcaaaagtggctcttgggyctccctttgttgtttgagctagagtgacacattccaagtagagctgtgtggggaggcaattgaatatgtagttttggcaccccagctagagatctgggatggagagatacccagctaggaggcagctggttatcagtggtaatgaagtcacagaagtgtatatattctcccagggggacctgcagaatggaatcacaggaagtcctcctacagactcatcagggatattaccttggtatgagccagaggacaagctgaaaaccagagtggtttgctctcctaaaagccaaggagtgagaactcttcaggcagaagagagtgagggcagagtgatcagtagctctcacgttatcaagagggtaattcaaactattaaggaagagactgttaggaggagtttaacaaggaggaggccctttaatgactcagaaagtagttgaagtaattttcatagacctaraaatgagtgggaagtgagaaataaaattgaaatatgtagatgtcagagtttatgttttgtggaagcaaaaaaggttttaaatagattggatagtgggagaaggagcaagatggtcaggtttcattgccatttcacttgtagtcaaataccatgaatttctggtaatactaatctgggcagggctgtggrtatgcgtgtacattagttaattttttgcaagcaggtgtgaatgtacagaagttgaacagttcagtggatgcagtgtagatttttttttttttgagacagagtctcgctctgctgcccaggctggagtgcagtggtgcaatctcagctcactgcaacctctgccacctgggttcaagcaattcttctgcctcagcctcccgagtagctgggactacaggcgtgtgccactacacctggctaattttttgtatttttagtagaaatggggtttcaccrtgttagccaggatggtctctatctcctgacctcgtgatccgccsgcctcggcctcccaaactgctgggattacagrcgtgagccactgcacccggcccagtgtagataattcactttactaaaactcacctggaactttggggaaatttctgactgcacctatcttatgatataatggcacctactgttgaggtatagtattgtagcttaatattaattataatataaaatatctagaaaaaataagtcaagatactgtttttctgggggtaggcatgtttagtttgaaattttccataggaagaaattcagtcctctgaaaacgtattgccaataagtgcattgcaggacatgatatataaagaaaatattggacagtrtatatatggagaattttagaatttagaatatgacatgaaatgaaggtgagatttcacttggttagaattttcttgaccagtctctcaacctgaggcaggaccatgaccagggagtaagaaaagaaatgctccttggagatcaaaatagatctatctactttggtccttccactatagaagaggcctttgcattctgttggccctttaggcttttacttgatgtctccatcatcttattttgcaagcccacagataatttgaggaagatgagttgccgcagtagaaatgatagggagaaaaaaaaaactacaaaaaacagaaataaaaaattctaaaaccacagcaatatagtagctttattataggacatgctggataaacaatccaacagctacctcagggagcttctgagagaatgcatgatgcaatgatcagtgaggcaagatcamattgtgtttgatgttcaagaaaggaaaaacaattcatgtaagtctatccaaagtagtaaatgttttatatttaagtagtgtatattcacttgtcagatgctcagttcrcttatctgaaacctatgaaataaagtcttatattttagaatatttgagttcatatttattttaatctatgaaatccactacatttacttaataatcacctcttaccataacatttcttgagcacccacaaggtgggtagagtgtagtagaaaaagaagaacatggtccttgacccccaggaacttgccttttaagagaagacascctgaagtgacaagctgttataagttagtgttttaaactatggaagaacaatctgagcagagtgctctatactgtagatgacttcttagaggagaagttacttttgaaatgaatttagaaaaatgtggagaaagatgcatccatatatattttaagatcaaagacattaatgctgtctcttcagtttattgtcgaatgtttattcccaaacaaaccaaaagctaataggatgttacttaaaacatgcaaatcccatttcctccactactaccagcactcaggtaaaagcatggaacagtcatttaaaatcttgccaagggccttcctattttttctgtactacctgctgccagaccacagtccatggctgatgaaagtgatatcagtacttcatcttcatgttcctattctcttatccctagatgcctatgaggagccaccaacatttgaagctatggagctcattggtaaaccaaaaccctactatgagattggggaacaagtagattataagtgtaaaaaaggacacttctacgtacctcctcttgccacccatactatttgtgatcggaatcacacatggctacctgtctcagatgagccctgttatagtaaataaactagcctttttttttttgttttctgcttgctctagagatttgcacacattttakggtacatattccactatggagatgatgatttttttttcttgtgaaatgaggtttaagatagcaatgcatttttgcagactttgagaaattgaaatctccaagaaatctttttcttggcaatagattgcctgggtgaacatgaaactgaaatttgcccttataataggtaaagaaagaaaataatatgcccwtgcattcaaarycgcaatgcagaattttgaccttgattccaatctgtttagaaactggattgaaaaaatctcaaaattattttcttttaggaaaaacatgtccatgtataggtgatcctttacatggccaagcagtccttgcaaatgggacttatgagctaggttatcagatacactttatttgtaatgaggggtaagtaagttcctccttagaggaaataaggaaaatgttagtaattttattttcgttttgcttctcttcttaagctttcatataaactttatttaattttgctttctatgtgacaagttatacttctagccaaacaactcttggatgttttatggagacagcaaagacrtagagtaaatagaaattgatattgaaggaaagcataactacttgctatttctgacaataagtctgttgaaagcattaagartgtagtaatcatgagaattcatccttcacaactgagtgtcccctatttaaatctgcaaactcttagagttaaagtagggctsacagaaatgagaaatagaattgccaactaaaaatatgcttgtatccagatgactctgtaaagtgtgacctggttagcctttaccatcatgttgaacaaaagctctcagttgaaaaaccttatttctgagactgctacaatgtgaagcatctcaagaacaggcactgagcactcggtaatagcctttgttctgcaggacttttaaagtcmtrgatattggggatactggacatttaagtgaaatgtgcttttagagagtaaatgtaattttcatagattttctattgctataacacaatacgtgagactagataattcataaagaaaagaatttatttggctcatatttctggaggctggggaattcaagggcatggcagtagtacctggcaagggctttcatgctgcatcagaacatgctggaaagtgaaagggaaattcagcacttgcaaaaaagacaaagcacaagggaggggctctcgctttataacaacctgctcttgtggtaacgaatccaagcctacaagaatgaagatccactccctcaagaattaatgaagaccctctagaaaggcattatccctcttaatgccctaatcatttctgaaaggccccatcacctctcactgctgttacactggcaattaaatttcaataagagttttggtagagacaaaccasattcaaacaatagcaataatacactataatatataaacaaagtgagtcttggaggaaaagtgcactgtgaccatgtaaggcagtttcactaagagtttttaaaatttggtcaagtagaaatattggagtattcaattaatagttacatagagcttgctaggcactatgagggataccaaaagtttaagacatggaccctcctaaaagaagttctaaccttattgagaaacaatatatactgagaggtatcaaaccaaaatactaaatgagaaataccaaataatagaattaatcatgttattacactaagagtccagaaggaggagagattcctgtgaatttaaatcagggaagatttcactgagtataggtgtatactcaatgaaagtattcctataytcaatgagctactcctagaaagacattctgttctaaataatattaataggagctaaaactcgtgtagcactcactatgtgccaaatgctaacttatctaatctcctaaacaaccccacgagctatgtactgttatccccttttaatcaattaggtaactgagtgagaggaactttaagtgatttacccaagctcaagaaactagtaagttgggaagcagagactctaatccaggcattccagctctagggcctgttctctctacagtcttgtccttactgagcaaagtcgtgtgagaaaacgcacagaaatgaatgtgtaatgtgattgcaggaggcagcaaagaggctgggtggaacggcacagcagatttatttagatgtttttgctctcggccaatatacgttcaaatagagaaactctttatttgattaaattgcagatttatttagcactttcattatatagtatgttgtttaagaaaccacccccctcaaattactgcagcgtagaaaataaaccatataaaaagttccttcattattatgtgkcttattaattgctatacaaaacagtaaccctttcttttcccatttagttattrcttaattggtaaagaaattctatattgtgaacttaaaggatcagtagcagtttggagcagtaagcccccaatatgtgaaagtaagtaaattcttttttttttttttttaattcagaccagtagtcctcaaagattttttgcctcagggcaccttttacattttaagrttaacaaagatcccaaagaggtttcttttatgtgggttatatctrttggtatttatcrtattggaattcaaactgaragattttttaaataagtattgattctttttgtttttgtttttgtttttcctaagagagggtaccagtatgtttcccaggctggagcacagtggcacaatctcaggtcactgcaacctcagcctcctgagcagctgagactacaggcatgtgccaccatacctggctttttgtaacttttgtagagacgtggttttgccatgatgcccaggctggtcttgaactcccgtgctcaagcaatctgcccccgtgggcctcccaaagtgctgggattacaaatgtgagccaccccacctggcctgattaatttgtaagaatagatgcaatacaaattaacatatataacattttttaatgaaaaataacaattttccaaaacaaaataaaattagtgagaatagtggcattgttcacattttttgcacatctcttcaacayctaacttaaaggaagacttggatttgggctgttgtgtaatcacacaatatgtagactttggaaaatatcactatacacttctgcccggcgcagtggctcaggcctgtaatcccagctctttgggaggccgacgcgggtggatcgcgaggtcaggagatccagaccatcctgtctaataccctgaaaccccgtctctactaaaaatacaaaaaattagccaggcgtggtggtagcagcctgtagtcccagctactctggaggctgaggcaggagaatggcgtgaacccgggaggcggagcttgcagcgagccgagatcgcgccactgcaytccagcctgggcgacagagcgagattccgtctcaaaatcaatcaatcaatcaatcaatcaatchctatacacttataaggatgagagtgaaaaaagacaatatkttggtggtattgtgaatcaccaatttagaaaatggatatatttaaaaattgcaaaggatttctcagctagcgctcagttaagcatattttctcattaaattgtcagyatttcttgtgataactagaagaaaacttagcatggccttgcaaataaatataggcgtattaggccgttttcgtattgctataaagaaatgcctgagactgggtaatttataaagaaaagaggtttaattggctcgtgattctacaagctgtacaggaagcatgatgctggcatctgctgggggtttggggaggcctcaggaaacaacaaccattgggaaaggcaaagggggagcaaggtgtctcacatggcaggagcaggagcaaggtggggaggacgggaggtgttgcgcacttttaaataaccagatctcccaagcactcagtatcacgagaacagcaccaaggggacggtgctaaaccattcatgagaaatccacccccatgattcagacccctcccaccaggccccacctccaacattgtggactacaatttgacatgagatttggtggggacacagatccaaaccatatcaataggtatttacactttaagaaaatgagatttgttctgaaagttagttactacattaatggtttgaatttgggatgatatatttgctcatagaaaccttcttttaaatccatattgaattcacaaccagcttgtagaaaccctatattgacaaattcactgaagacacagaaattttactaatgctgccttaatcttttacatttctttcctctttttcttcaattttaagagattttgtgcacatgacctccaaaaataaaaaatggaaaacacacctttagtgaagtagaagtatttgagtatcttaatgcagtaactgatagttgtgatcctgcacctggaccagatccattttcacttattggagagagcacgatttattgtggtgacaattcagtatggaatcatgctgctccagagtgtaaaagtcacctttcaatttatttccttcttcatctgtaagtactctggaaatattttgtaaatagttttatctacaaataaagcaggtgtatgtgcttcctcctcctgtgtaattggatctaatttattttaatacaggtcaattcaagccaaaaaatagttctagctagagttctctatttttcacccccacatgttcttgggatttcatttcatacagtgtgaactactgtgtaatctgcatgagttagaagtttttgtttgaaagaccaaaaaaaataataaatcaacaaacactggcttaaaaataagaaaggtggttcttgtattacaagaaatctaagagttctggctttggtagtggtagactgtaacagactaatgctctcaccaataaaaatgataaactctggataaaaaataattttcttaaagaccagagtgaccaaaagtatgaagactccacaggggacttgcccgtttaaacaaagaaatcacagaataacagtgatttaaaagtatatacttcccaagtatgcatgaaacattctccaaagtagaccatattctagacaataagacaattttccacaaatctcaaaaaattgaaatcattcaaaatacattatctgatcacaacagaatgaaagtaggaatcaacaacaaggccaatccccaaagaaatgaaaagtatasaagacactcctaaataatccatgcataaaaatagtagtcagccgggaaattagaaagtgttttgaattgaatcataacacatcaaaatatccaaacatgtaggatacagctaaagcattgcttacaggggaatgtatagcataacatacttacgttagaaaaaaaagaaaagcctcaaatcaatgatttaattttccaccttaagaaactaaaaaagaagagcaaattaaatcccaaactagcagatgtaaggaaatgataaagatagagccaaaatcaatgaaactgagaagagaaaaaaaaawatagagaaratcaatgaaaccaacagttgctacttggagatcaataaaatgtgtaaacctacagccagactgacaaagaaaaaaaaracacaaattaaccaatactgagaatgaaagaagtggtggtcaagcacggcaccccagccagcttgaagaccctgcactcctgcagctggcaggggcagtcactcctggacttgtccttttagaagctccagctttaccacttgctggtggagcccaaccactgccgcagggtyctcatcaccaacacgcctggcagatccaagaggagatggcccaggatgggatgtggtgaacagcagcacccaagagtgtggggtgcgtgtggctccactgcctggtttctgcagagatcctgtgccagtgccctgtgcccgccacacaggagccagagggggagcaccatgccccccacttyggagactgctgcacgaaggggccaggtatcagacctttgctgtctcacctyagcactggcaccaggagccctgcaaagcagcatctgggagatggacagccagggggaaaataaaggaagctttcagaagtggctagatgagatatttgaaatactgaaaactaaaaatcccaactgcatggaagagctggcctcagatgtggtcagttcttacgacaacctggacacacagtgctgacccgcatgatgggatgcaccaagctgggcccctgcaacgcacttggaggcttggccctgccrccgccccacctcccagctccagctacaattgcagtctgacctgggcaagcaagagcacatggtggagatcctgatggagacctgagccacacgtgccacagtgctggccagacatggaggatgggatcccgccaagggaactctggccagcctgtagcccactgcccagccttgccggctcctctgctgattcctgcatggtctgcagccccaggcccattcccttccttcccctctgcagagggcaagccggaggctggtctcagcaggagctagggctctcctcaaaggctttctgaccttggggcaggcttgacatccccatrgccctgcatccctcatcccttttcatgtctactggaggacagtgagccatagctgcagcaatcttgtttaaatttaggtagttgaattttttagaattaagttttgtatgttttgagcaataaattgtcttaagatatatattttaggttgcttcaagatagctgaataggaacagctctggtctacagctcccagtgagatcaacgtagaagacaggtgatttctgcatttccaactgaagtacctggttcatctcactgggactggttggacagtggatgcagcccatggagggcaagctgaagcagagcgggatgtcacctcaccaaggaagtacaaagggtcaggggacttccctttcctagccagggaaagctgtgagtgactgcctggaagaacagtacactcctgcccaaatactgtgcttttcccacagtcttcacaaccagcagaccaggagactccctcctgtgcctggctggggaggtcccacgcccacggagccttgctcgctgctagtgcagcagtgtgagatccacctgggatgctggaacttggctgggggaggagcrtccgacattgctaaggcttgactgggcggttctakgctcacagtgtaaacaaagcrccagggaagcctgaactgggtggagcccactgcagctcagcaaggcctactgcctctctagattccacctctgggtgcatggcatatctgaacaaaaggcagcagacagcttctgcacacttaaacgtcccagcctgacagctctgaagagagcagtggttctcccagcacagcattcgagctcctataacggacagactgcctccccaagtgggtccctgacccccgtatagcctaactgggagacacctcccaataggggctgacagacacctcacacaggtgggtgcccctctaggatgaagcttccagaggaaggatcaggcagcaatattgactgttctgcagcctccgctggtgatacccacgcaaacaaggtctggagtggacctccagcaaactccaacacacctgcagctgagggacctgtctgttagaaggaaaacaaagaaacagaaaggaatagcaggtggtgatatcccctttatcattttttattgtgtctatttgattcttctctcttttcttctttattagtcttgctagcagtctatcaattttgttgatcttttcaaaaaaccagctcctggatccattgattttttgaagggttttttatgtctctatttccttcagttctgctctgatcttagttatttcttgccttctgctagcttttgaatgtgtttgctcttgcttctctagttcttttaattgtgatgttaggktgtcaattttagatctttcctgctttcttttgtgggcatttagtgctataaatttccctttacacactgctttaaatgtgtcccagagattctggtatgttgtgtttttgttcttgttggtttcaaagaacatctttatttctgctttcatttcgttatgtacccagtagtcattcaggagcgggttgttcagtttccatgtagttgagctgtttygagtgagtttcttaatcctgagttctagtttgattgcactgtggtctgagagacagtttgttataatttctkttcttttacatttgctgtggagcgctttacttccaactatgtggtcaattttggaataagtgyggtgtggtgctgaaaagaatgtatattctgttgatttggggtggagagttctgtagatgtctattargtctgcttggtgcagagctgrgttcaattcctggatatccttgttaactttctgtctcattgatcgtctaatgttgacagtggggtgttaaactctcccattattattgtgtgggagtctaagtctctttgtaggtcactaaggacttgctttatgaatctgggtgctcctgtattgggtgcatatatatttaggatagttagctcttcttgttgaattgatccctttatcattatgtaatggtcttctttgtctcttttgttctttgttggtttaaagtctgttttatcagagactaggattgcaacccctgccttttttttgttttccatttgcttggtagatcttcctccatccytttattttgagcctatgtgtgtctctgcacatgagatgggtttcctgaaaacagcacactgatgggtcttgactctttatcctatttgccagtctgtgtcttttaattggagcatttagcccatttacatttaaggttaatattgttatgtgtgaatttgatcctgtcattatgatgttagctggttattttgctygttagttgatgcagtttcttcctagccttgatggtctttacaatttggcatgtttttgcagtggctggtaccgattgttcctttccatgtttagtgcttccttcagaagctgttttagggcaggcctggtggtgacaaaatctctcagcatttgcttgtctgtaaagtattttatttctccttcacttatgaagcttagtttggctggatatgaaattctgggttgaaaatyctttyctttaagaatgttgaatattggccctcactctcttctggcttgtagagtttctgctgagagatccgctgttagtctgatgggcgtccctttgtgggtaacccgacctttctctctggctgcccttaacatttttttccttcatttcaactttggtgaatctgacaattatgtgtcttggagttgctcttctygaggagtatctttgtggtgttctctgtatttcctgaatttgaatgttggcctgccttgctagactggggaagttctcctggataatatcctgcagagtgttttccaacttggttccattctccccatcactttcaggtacaccaatcagacgtagatttggtctttccatatagtcccatatttcttggaggctttgttcrtttctttttattcttttttctctaaacttctcttctcacttcatttsattcatttgatcttccatctctgataccctttcttccagttgattgaatcagctactgaggcttgtgcattcgtcacrtagttctcgtgccatagttttcagctccatcaggtcctttaaggacttctctgcattggttattctagttagacattcatctaattttttttcaaggtttttaatttctttgccatgggttcgaacttcctcctttagctcagagtagtttgatcgtctgaagccttcttctctcaactcatcaaagtcattctccatccagctttgttcctttgctggtgaggagctgcgttcctttggaggaggagargcgctctgatttttagwgtttccagtttttctgctctgttttttccccatctttgtagttttatctacctttggtctttgatgatggtgacatacagataggtttttggtgtggatgtcctttctgtttgttagttttccttctaacagtcaggaccctcagctgcaggtctgttggagtttgctggaggtccactctagaccctgtttgcctggatgtcagcagcggtggctgcagaacagcggatactggtgaactgcaaatgctgctgcctgatcttcctttggaagttttgtctcagaggagtacccgctgtgtgaggtgtcagtccgcccctactgggggktgcctcccagttaggctatttgggggtcagggacccacttgaggaggtagtctgcccgttctcagatctcaagctgcgtgctgggagaaccactactctcttcaaagctgtcagacagggacatttaagtctgcagaggattctgctaccttttgtttgtctgtgccctgcccccagaggtggagcctacagaggcaggcaggcctccttgagctgtgatgggctccacccagttcgagcttcccgcagctttgtttacctactcaagcctmggcaatggtgggcgcccctcccccagcctcactgctgccttgcagtttgatctcagactgctgtgctagcaatgagcragactccgtgggcgtaggaccctctgagccatgtgcgggatataatctcctggtgtgccgtttgttaagccattggaaaagcacagtattagggtgggagtgacccaattttccaggtgccatctgtcacccctttctttgactaggaaagggaattccctgaccccttgtgmttcccaggtgaggcgatgcctcgccctgcttcggctcatgcacagtgcgctgcacccactgtcctgcactccccagtgagatgaacccggtacctcagttggaaatgcagaaatcacccgtcttctgtgtcgytcacactgggagctgtagactggagctgttcctattyggccatcttggctcctccctcctattttattcttttcagagtgatctgttgacacctttactgagtttgttcctaytgcaggactctttgattttctggagtgcaaccagtttgagtcttttgatgtaacacatttaaacagggaaatttctgctgtctgcagaacacgacctatatttctgtctcttccctgcctgcagtcttccacacctcataatgttattctttttttctctttactgggcagttttatctggcaatagcaactaaatttatagcaactgaaaggcaggaaaagtccttatttactgagatgaaatagaggactttttgcagggactcctgatcagcagctgtgcttatgactggagagattattttgatatgayggaagggattattgtcctgatttcagcactgctatctctggtttcactttccttgcrgcagaagcaagagactaattgtaggaagagcattagcctgcgyagactatgcttaattaacatcatttctgtggtcttcagtttccatttagtttaatgagattgttgaactcaaatctcaatcactggattctaatttgtttatatatttcctatctccctaatattttaaaggatctaggggaattatgcrcgttaacatagtaattagaataccattttataattcctataaaagcctgttaactggtagcctccttagttgagtcctgtaggttttgaggggcaggaagagatggtttttttagtggactgatatatgagcaaaacaagattgcatatgaatttaatactcaataaggtatccaggcttactcacatgctcctagtgggtatatgtactaatactaagtttgttgatacagtcttttgaaagagttaactataagcatttcataaagtgtttataaaacactgatctagcttagtgtttgagagcagaggagagaattgcttgtgagaaaaagtttataaaaaagagaaactacaggggtattttttgaaaaatgacaaatcaaaattcctcatgggattgtcagtcattttttgtcatcagtaagaggaagaataaatagcaagataatgatgttaaggtagatctaaatgtgctaatgtgaaaaaatgtccaggaagtcctaagcggaaaagaggaagatgtaaattatgtagtataataccacttaacagttttttaaaaagatacatatgtttaccccaagcacattacttttatgatttattactkgttatcttctaggatttccattataaaatatgaaacgtagtgagcatttttttggtttttttttgaracggagtctygctctgttgcccaggctggagtgcagtggcatgatytcggctcactgcaagctctgcctcccgggttcccgccattctcctgcctcagcctcccgagtagctggggctacaggcacccgccaccatgccaggctaatttttttgtatttttagtagagacagagtttcaccatgttagccaggatgatcttgatctcctgaccttgtgatccatctgccttggtatcccaaagtgctgggattacaggcgtgagctgtagtgaccattcttgtacatgcatccttacatacttgtgcaaatatatatgtagattaaattatttttttttctagttggagccttgctctgtcacccaggctggagtccagtgacatgatctcggctcactgcaacctccatctccagggttcaagcaattctcctggctcagcctcccgagtagctgggattacaggtgcgacaccatgccaggctaatttttgtatttttaatagagatggggtttcaccatgttggccaggctggtctcgaactcctgacctcrtgatccaccygcctcagcctccaaaaatgctgggattacaggcgtgagccaccatgcctggcaaagaatgacactgggtgtattaaaaagtatgataagtgacatgatcacagtagacatttcctccaatagaatattgggagaaagcctaatggaaaccaatgaaaaataagaaacacacgtagcctttggaacatagcctttctcacctagtggaggaggagctgagacttgagtaagacagtcagatgaagtaaggcagtattcgggaatgtttgtgtgagctaagactatacatcctgagtgatacacgtgtgttggaccatgtatacatgggtctccattagtgaagccgcactgagtagagaatagttttctacctaaagcatctttactccatgatgaatcagttatgcatggaggagaaagagctaacacgtgtactgaaatatctgctacattatctactcaaccctaattctactcacctttctacagcctttgatatttagagttactccgtcctcacasaactctttccaactccagcactggaaacaattgactcctgtctctaccaaactgtacgtcccagattcttgtcttaggagccatagaactccaaaggtttatggctataactgtgttttgacataattggctttctttatagtcctacgtgatttacttatrcattacaaaaaacagctctgagaagggattcataattctgaccagccaggcaaaggtgtatacatgatacataaagatattaagaacccctcatgactattcacaatagcaaagacatggaatcaatttcaatgcccatcagtgatagactggataaagaaaatgtgctacatatccaccatggaatactatgcagccataaaaaagaatgagatcatgtcctcttcagggacatggatggatctagaggccattatccattgcaaactaacgcaggaacaggaaaccaaatactgcatgttctcacttataaatgggagctgaatgatgagaacacatggacagatgtgggggaacaacacatactgggatctattggagggtagaggataggaagagggagaggattaggaaaaataactaatggtactaggcttaatacttgggtggtgaaataatctgtacaacaaacccccatgacacaagtttacctatgtaataaacctgcacatgtacccctaaacgtaaaagttaataaaagaacccctgcatggatatggatcatgtatttccattcagatcttcctttcattaattttacatgcccctcttcaacagtctcattgattcctgtgattttgaccatctcccatccattatcttttacaaaagtcctcttgtgccttttttggaagtccattttcataatcaacaaattacctatattcccaatcttttcctaaacattctcacacctcctggccttcactaaaccccatctgtcccatgcccacatctttctcagtttaaaaaacaacaacaatgaaaaactttcgctgcttaaccttgatggcgctatcccttccccacccaatggtttcctattgctactgtaacaaattatcttgtggtttaaaacaacacaaatctattctttcacatttcaggagatcgtaagtccacagtgagtcttacaggatgaaaaccaaggtgttgaaaagactgactccttctgaaagctccagtggagaacctgtttcttgcttctaaggggcactagcattccctggctcatggcagcaacactctgagctctgttttcatcattrccttctggtctattaccttcctcttataaggatccctgtgatcatatcaggttcacctagctactccaagatactctttccatctcaatatccaactgcaaagtcctaaactgcaaggtaacactcacagattctgggatgtaggatgaggacattttgggggaacattattcagcctaccacgcactcctccttttctctcattcttggattgttttttattgttattttttaaattggctcataatgattgtacacatttatgggatacagcaaaggaaacaacagagtgaagaaaaaaacctacagaatgtgagaaaatgtttgcaacctatgcctttgacaaggggttaatatccagaatatctgaggaactcaaacaactcagcaaaataaaacaaataatattatttaaaagtgggcacaagacctgaacagacatcactcaaaagaagacatagaaatggccaacgaatataaaacaaaatgctcaacattcttagtcatcagagaaatmcaaaataaaaccagagagagatatcacctcaccctagttatcagagctcttatcaaaaagataaaagataacaaatgctgctgaggatgtggaaaatagagacctcttatacactgttagggaatccaaattaatatggccattatgggaaatagtatggaggtttctcaaaaaattaaaagcagaactaccatatgatccagcaatcccactactgggtatatacccaaaagaaaggaaaccagtatgatgaaaagatatctgcactctcacattcaatgatgcactattcacaatagccaaggtatggaatcaacccaagtgttcaccaatggacgaatggataaataaaatgtggtatatatacacaagggaatactattcagccataagaaagaatgaaatcctatcatttgcagcaacatggatgaatctaggggatattatattawatgaagtaaatcaggcacagaaagacaaatcctgtatgatatcagtcatgtgcaatctaaaaaagctcatctcatagaagtagagagtagaatactggttaccagaggttggggtagggagagacaatgggagatggagagagattggttaaaggrcacagggtcacagatacataagaataaattcayccttgaatacttaaccctctgccctacatctgtcactcctacatccatattcattgctaatcctggggctaactcttgattgctttcttctcactactaaccttaagaaaggaagtaaccaaaatccaatacatgagcaactgttcattccatctccaatatctttgttmattgtccactttatccacccagtcagggccaccatcaaacctcacttggatgtcagcaaaagctccctggctggtctcccctctccattattgctttaatctagtctccatactatacacagatttacattttttgaatatatatctaattgtccttccctttttaaaaatcttacaatggcatgacatctcaattcacgataaggaaattggttcttcacattccctgtgcactgtacacatcgcctgcaattgcccttcaacacagagagcaggcatttcattagctgaccttcccacacacattcttgcaaagaggaaaagtcaagcagggtgtttggaggtgagttgccatcatccaccgcctttgtctgkaaggaagcgyagggcctcacacgcgggatccatcggaagcccaagcattgtcaagctctgctgctgcacctgggtcagcaaggtgggctctgccagcgaaactcgttagaaacaatgcaaatggggagtaaacatggccttgcccatgaaggggaagctggtcaaaagcattttgtcccggaaccccgcagccctccccatgctctgggcgcggagcacaaggattggtcactcctctttgcactgcgcttttcctcttatcaaatctggtttgtagatgtgcttcgggaggatgggggtctcttctccgagaagccgggagcctgttgggcagcsggcgcccggtctccccttctgctgcggaggatccctgctggcggtcgtggtgctgctcgcgctgccrgtggcctggggtgaaacgctggggggcgtggggaggcgcccgggctgacgaggcacccagggccccgcagagaactcgcgtgccgcgctgggctgcgctrctctgcgcgcccgggtccaaaggcagcgcgatgggtgggctgagcgcgctacctggcagggcggcgggtctgggatccttctgcgcactggagaccctcgctgcctctaggtaagcgtggagttcccacgtgcaggggcttaagtcgtgacgagcgcagtggaaggcgcagatgctgagcgggtgccgcacgaaattccttgcctttgtgtattcacagcctcggctggctatagccgagcgtggcgtcgatcctagcgaaacgggacttggggatccgacaaacctgagttctggtcctagaaacttaactgtgaggcaagttagcacacctaagtctgtttgctcttctgtaaaatggggacactggtatctctgcattgtggagttgctgcctcagtggcataaagcctgtcgagtatctaacacagggcctgtccccgagtccatttctatcccccaaccgttacctctgcactttgctcccagtggtgtttagacaagcagtcctagggatgtcctgcatggaactgtcctcgtcccctaccccaagccaccaccgccatcatcatgatgcacttgattgacagcatactttaagacagatgcatgccaggcacttggggattagaagagcaagggaagccccagaacatgcaatgtaaccgctgcaggtagaagggacagtagatatgtttacaatttgcattttagtgatgtgtttagtacaaaataaagcctattataactactatggaaattttgaggccacatctcttcctttttttaacttcaagtaggtaaacatcttcagttagaacccttctattattagttttgggctccccagaagtcttcttggttgcctagactcactggcaacatctcacttgaagtgacagtyttggttgttttggtcctgtctcttcctgacaactcagggttcgtccttctctgccactagacgttttgcattcattatttgagtgttccttcttctctaaaagagtaaggggaaaagaaaaccaagttcccccaagagttgttattaatatttgatctycttaggcaccagaaagtaacctgtctagtgaagagatatgataaaacttacaattttatttttaggagagaagcatgcccagtaagttaagcaatctgttgtcagtgcttactgaggttctcacaataacctccaaatgtgaaacagcctaaactaaactacctagaaattttgttgctggagtaatttcaattttaaaatgcttatggatgcttccggtgtgcacagtcctttggaatttaaaagaaatgtaagagaaagagctatgctcccaaggtgtatgcatatagaagtaggtggtggagttttatgaaatctactttttaggaagccagtgttctggtttttccagactctgctacttaccaactggggctgtggacccagcaacttaagtcacatcactgaccttcagtgtccacgtgtataaaatgagcatgactgacatcctgatttctgagagaggtattttgaaaatcaggtggggtagtgcatgtgacagcgttttgtaatctgaaaaccctcatgcatgtctgaaaaaccatgactaagcagtygtgcargactgcaggatcactgaaaagggagaaatctcaactcctatgatcaggaaagggtgagggaaaagagtatgactttactagcacttgaagagtgaatccagaaacaggttgcataggacagtttatgggaatatttatatataaaaartaacagaggaactaggattgttttgtcattagagggtactcctactacccatgaagtggtatggtgctatttgaaagagaacttagattagctgcaaatagatattgcaaacttagggcaactactgaaaaaagtgaaaaaaagaagtacaattgatatgccagtaaggaagagtgaattgcatcatataaaatgctcagttaaaacaataaacggggccaggcgcagtggctcacacctataatcccagcactttaggaggcagggtagataacttgaggtcaggactttgagaccagcctggccaacatggtgaatacccatttctacaaaaatccaaaaattagcygggcatgatggtgggtgcctgtaatcccagctactcaggaggctgaggcaggagaatctcttgaacctgggaggcagaggttgcagtgagccgagatcatgccactacactccagcctgggcgaaagagtgagactctgtctcaaaaataaaaataaaataaaataaaggtcaggaaaagaatgcaagacaaaaaatagaaacagagaacaagagaagaaagacaacaaatagaaacaagtaacatattaaaccaactatatcaaccatcattttgagtgtcaatgatctaaaggcaccaattgaaacagatcatcagagtcgatcaacaaacaaaactcaactatatattgtgtactccctataagaccattttaaatatagacaatatatattaaaagtaaatgggtaaagatataccatgctaatgctagtcacagaaagcaggagtagctgtgttaatttcaaacacagcagacttcagacgaaggaaaattattaggaataaagagggtcatcatataatgataaaggggctaattctccaagaaggcataacaatatctaatatgtatccatctgacagagaaacaaaatatgtggggcaaagctgatagaactgcaaggagaaatagatgaatgcactatcatagttggagacttcagcacctttaycttttctgatatcagaaaagataaaggtgctgaagtctctttatcagaaatgggcagattcagcaggcagaaaatccataaggacatacttgaactcaacagcaccatcaatccacttggatataattgacatatacagacgacttcatccaacaacagcaaaagacattctctggctcacattcatggggatagaccacattgtgrgccataaaaatagtatgctaattaagctttaccagggagtgtttaacatagggtagactctggcrccctcacatggtcctcatgtaggatctgatttggttttccctgctaggtaaaggtgcaagatagaaagaagggtaattccaatttgctttctgtgctttgtgatgtattctggtttacatatgctcggatgagtagatgtatgatttatattatctactgttatctaaaataawcttcacattcggacaggcaacatcaaaactgtcctacacagaaatactgggtgaagatcacttaataagacgaactccagaaaacaagaaaatggcagagttgacaatccctctcaccctccctgcaaagacrcatgtatacaaatttcttttgtcagagacattaagagaaacaaatgctgtcaatctaatcacaactgatcacaacttgatgaaaccaaaaaatctagaaagtatcatgaagacagttgaaatacagctttacattcactattgtgaccagaggaactcactgtggctgttttttgtccccttagatgtcaactaatgattgtgttaagtgatcatgattaacagagcatttaaaatgtttattttatctgttttacatttcaaaaatttatatttaggcatataatttatatatttgtgtacatatataatttattactttatatttttgaaagtgcatgctctttttttaagctgacagacatgcctaagcaaagcaagtgcaagtctgttccttaaagggtaagtatgcagaatggaaagcagagtgtacttcgggttgacagctcatatttgcrcagacatgaaagtgatgatgtgttaattgtgcgtatagcacagaataaatcagcttgctttgaatggaagatctgaaccaggagtgcatgaaattgggctgagtcatacaagaaaaaacccgaaatgagataacaaaatatacccactagaatggctaaaatggaaaagattgaccaaaccaagtgttggcaataaagtggagaagctggaattataatatactgctattcggcaggtaaaattacaacataactttagaaaatagttcaaccgtttcttaaaaccttacacacacayctgtcatattactcagcattttactcttaggtttttacccaagagaaatgaaatcatatgtccacamaaagacttgtacatgaattttcataacagttttgtttgtaatagccaacgagtgggaacaatccaaatgtccctcaacaagtgaatggataaactaaattaacatatatttatacaattgaatattacccagcaacaaaaggaaacaatttgtatatgtgcagcaacctagatagaactctaattatgctgtgtgaaggctaaaacatttaaaamaatcggagtgatttcctttatatgataggatataaacgaagtgattcgggttatatgaaattttagaaagtcaaatcaatctgtagtaagagaaaacaggtcgaaggttgcctagagaaggaagtggatgtttggatgcattacagaaggacatgagggaactgtgtggggtgaagggtatgatggaaatgttcattgtcttcatttggtgatggtttcacagggcatatatataagtaatcaaattgtacactttaaatactcatcaaccattttatgtaatacatcttaataaagctataaaaactttttaaacttatggtaggtcttgagtttatggagtttatattaatatatttatcataagaaccagccacaaattgagggattggtaataaagagggaaaggaaactacatcaagcattctttgttgaaggctcatatgttccttttttgggctactaygcaaatttatattattacctatactatgcatwtactactataaaggtaagaatattaggtaattaaggggaaggaacttctttctttccaagaatggttcattatatttgctttgttgctttgatctagttctaacctctcattgcaagctttgttgtgacgtttaccctctctyaatacagcttttggcgctaggagagctccacttggaatctcttcctttgtctagcatcaatgcataagacacatatcaaaattgtatttcatcccacatatcaactagaggaaaggtgaatgcataacactgaaagtcacggaactgttttattcgtktttttttttttatacagtggttctcaaagtgctgttatctatccaaatcagctgtgaaacttttaaaaaatatagactcctgggctctaacccagacccactaaatcagagattctggggacatagcgtggactcttcatttttttttaagttttataagtaattcttcaattatttgatcattgcaacaaatatgcattgagtgcttataactgagtgttaagcacaaggactaggtattaatttagaagtacaaaaaacatgtcatcatttgccctcaaattatacatatctaatatcttttgagagaaatagatacttctaaaagcacacaaaattaaaaagcacaaattgcaaccacaaacaattattgatatgaaaggaaaaggaaagggcctgactagaaattatcatagggtggggcagagggaagtagtttagattccaaatccctgagagggtcagggaaggcatcagactagattgggtgcgttcagggtggtatggccatagacaggccagggaaggcttcgataagaaggtggtattttagcaaacacctggaggaagaattgaagtcatagccaagataaaagtgcatcacacaaaaggaatgtcatagacaggggaaaaatgtgtgtcttcaggaaactgaaaaaggggaaagggccaccacaccttggtgaggggacccagtggtaagagatgaagcaggaaacatagacaagggcatctttgtacaaagccaaaagttggttcttttaagtctaataaaattgacctctggcctcaatctacccaattaattagtggaaggtgtgggaaggaacagaaatgaaaacaaaacaaacaagatatttccaaaactagagtaagatgctattctttttcaacagatatatcttcttgattacatactgtttgactctgtgatttttgttgctttaaattaaatctacaaggccttaaggggcctagctgagtctactatataatatgaaatatctrtgagaaaatacgtcttctttatggtaaagtatagctttagttgttgagctttgttcactctttgtgctcaagattgacgtggcgacagacttccaacattggtggctgctactgagggccaaagaggagatgtgtactcccactgaatctgagtgtccactgagtgtgaaggtggatggtaaaatgcatgagtgtatcttacactcatactttacaagaaagtatgataaatgaggatgggagagaagctacaacacaggcacttactgattaactaaaatttgaagctgtgaattgcagcttcccctttagtgaaagatgatataaatagcttagttttcttcaaactagcagagactttttaaatggatggatgctgattttttttttaaaaaaagagcccatttctaaggcatgttttaaagcaggygtcctcaacccctggggcataaaccggtactgtccggtggcctgttaggaactgagcagaacagtaggaggtgagcggccaakcattactgcctgagctccacctcctgtcagatcactggcagcattagattctcataggagcagaaaccctattgtgaactgtgcatacgagggatctaggttgcatgttccctatgagaatctaatgcctgatgatctgagtggaacagttccatctcaaaaccatttccctgcaccctccattcacgkaaaaattgtcttccacaaaacgagtctcaggtgccaaaaagattggggaccaaagttctaaaggaatcaatctctttgctattattgttattattattgttaagatggagtcttgctctgtcacccaggctggagtgcagtggcacagtcttggctcactgcaacctctgcctcctgggttcaaatgattctcctgcctcagtctcccaagtagcttggactacaggcacatgccaccatgctctgctaattttttgtatttttagtagagacggggtttcaccatgttggccaaactggtctcgaactcctgacctccagtgacccacccaccttggtctcccaaagtgctggaattacagacatgagccaccacacccagctcccttggctattagtgaagtcttctttttcttttttgatcacatctatgcagtatatttgagagaaagaggaagtagagtgggaatttcagcagggcatggtggctcacacctgtaatcccaggactttgggaggcagaggtgggcagatcacctgaggtcaggagtttgagcctggccaacacggtgaaaccttgtttctactaaaaattcaaaaattagccggatgtgatggcaggygcctgtaatcccatctactcaggaggctgaggcagggagaattgcttgaacctgtgaggcagaggatcgcaccactgcactccagcctgggtgacagagggagactctgtcacaaaaaaaaaaaaaaaaaaaaaaaagtatggtaatttctccattaacttcgatgctgctgtggtcttgatccccagatcaatgcaatgtcccggaatggcttccatttgccaggcctaccaacctaactgatgactttgagtttcccattgggacatatctgaactatgaatgccgccctggttattccggaagaccgttttctatcatctgcctaaaaaaytcagtctggacaagtgctaaggacaagtgcaaacgtaagtaactctggagtgggaacccctctgttagtcaaacatctgtaagatctgattcaatttgttcaaattttgtaactgagttgcatacaacaattagtttgctaaggtgcaatacatatgagaattattcttgtagatcataccttgttactgctttgagttcctggcaccttcattacaagtttatttcatgagaaaccgtcattgcaggacatgattgagggaaaayccccattcactgggggtctcccaytttcatgactaaaattaagtaatgaatgacttgggacaagaaagagaagtggattaaataactaaaagatgcgacaatcttgggcyttgagatctttggattatatcagttgaattgaattacagataataacgaagtttacatttttctgggaggcataatatggggatgaaacagatctgaaaggaaagttttttttgaaagggagctgatcctgaggcagtctggtgagtttcctcaaggtagcaaaatctgtggaaccatcagaactgcatgtgttcctcagtaagctataggcaggttgagaccttatgtactaaaaaaaaattcagtttactctacttggcttcaaatttctgtttctttcctgtaggtaaatcatgtcgtaatcctccagatcctgtgaatggcatggcacatgtgatcaaagacatccagttcrgatcccaaattaaatattcttgtcctaaagggtgagttggcatctcttgaaccaacatctcttggttcaagggttctaacacagccatactaccttctagtcacatctcagaaaggacaactaaactattaccatctgctctttaaagrcttcaacacaggtgcttagctcctgactgaaatggacaaaggtatgacaagatcagggggaaaatcatctgtatccttgctggaaaccaaggcagagcatatatgaaaagtgtggcattcattgggtgggaaggaagaaaatgggggaagagtatagtcaaagcacacaatcagccttaacacagattagacattgctcaaagaaagggaaggccattgagcagctgtgtgagagaaatcttaatggtcatagcacaratagtttgctagggctgctgtaacagagtactccaaaacaggcggcttaatacaaacaaagtttttggagttctgttccggaggctggaagtacaaaatcaagatattggcagagccagagccagatccatagccatgctccctccaaaacctgtagggatggatccttctttgcttcttccagtttctgaagccccaggccttggcgtgtggcagcagaactccagtttctgtctctgtctgtcctcacatggctgtcttccctctgggtctctgtcctcctatgctgttctcttatctgtgcatgtctgtgtccaaagttctttttttttttttttgagatggagtctggctctgttgcccaggctggagtgcagtggcgagatctcggctcactgcaagctccacctcccgggttcctgccattctcctgcctcagcctcttgagtaggctgggacaacaggtgcccaccaccatttttttttttttttttttttttkkawttttagtagagacaggatttcaccatgttagccaggatggtctcgatctcctgatctcatgatccgcccacctcmcggcctcccaaagtgctgggattacaggcatgagccaccgcrcccagcccaaaattctctctttcaataaggacaccagtcatattggattgsggcccacactaacaacttcatcttaacttgattgcctctgcaaagaccgtatttccaaataaggtcacattaataggaactggggattaagacatccatatatttcaggggtgaggggaacataattctcatgcattgctggtaggaatgcaaaatggcaccatgactttgaaagacattttggcagttttgtataaaaataaacatactcttaacatattatccagcagttatcctccttggtatttatctaaaggaattgaaatctcaggttcacacacaaaaaaatctgcacacagatgtttataacagctttattcataattgccaaaacttggaagcaatcaagatgtcctttagcaagggaatggataaactgtggtacatgcatacaatagaatattattcaataccaaaaagaaatgagctatcaagccatgaagagacatagaggaaccttaaataatgaatcttctttcactattactaagtgaaagaagccaatctgaaaagcctatatagtatatgattccaactatacaccattctggaaaaggcaaaactatagagatgtaaaaagatcagcagttgccaggggttagggaagaaggggatgaataggcagagcacagaggattttgagggtagtgaaactactctgtatgatgccataacagtaggtacatgtcataataaatttatccaaagtcatatgatgtacaataccaagagtggaccctaagataaactatggacttggggtgaccatgatgtgtcagcgtaggttcatcagttgcaaaaaatatttaccaccctggtgaaagatgtttataataggggaggctatccatgtataggggcagggagtatataggaaatctctgtatcttctgttcattattgctgtgaaccaaaaacttgtgctaaaacacaaagtctatttttttttaaactacataaaagtaaatacacaggcacatgtgcataaacagacacgcacacagtcgagtacaggtaaaacaggaaatttgaacaaaactggtggatcatacctgtctcaatatcttgagtttgatgttgcactattgttttgcaaaatgttattattaggggaaaattgagtaaagtgtacctgggatctttctgtgctattccctacaactgcatgggaatctgattatctcaaaataaaawwwttttttttttaagttactactaaatttccaagggsatgggcttcctaccaaagaattgtatattgtgaaattaaatcattcgaacttaaaacaattcaaacttatagctgggagaactttaaattattctgagccatgagaagacygtggctatgcagcctgagtcatgcagcaggcagctgtaacttctgcctttttatcctgtgaatagttaaaaccaaatggcgccagagataagacccactcagatcactacgccttttcagggagcaataatcttccttggaatgtagcaatatgtaaccaatcaaagtgatgtaactatgcatggtcccatatggaaaatataatcctgctaaaatttctctgtctctgcctatgtaagtgataccttacgtcctccactttggaatgctgaccccattcatttggagttggtgtcttccaggtggctacccttaagctktgtgctcaaataaactctatccttaaatatattttctgaatctcattatttaargttaacaatgtgctaacctaaacaattcacaggatttgttttttattctcattttttcctaacccaaccacctgkttcaaggcacatagattaagaaggaaaatggaaatgggactaatatcccaggcttcactgtccctctycgggccctggggaggagactcccaaaagtctagacatgttcacccacatcctgtatgtggtttctggaaacgaaatgatcatggcwtttcctgaaccatggcttaactttgtgaatccacaactctctcttccccaggagatccaaaaagrtagggtaggatgtaaaggcttcaatctgtttaaatggatatgagagtccctggctctccttaaaataagtagcatggattttgtctctctgccttacttcctcacaaacattctgaatgagaaaagttcaaaccattatttgttcaagtacttaatctactttgggacacaagtttaataaattaaaatattcttctatctgttccctttgatcagtgaacataaagttatcctttgactcatatttaaaatgttcagtactacaacactgaacaatagtatggaggaaaaaaaatgccaatttaagtttgaacttgcttcaccattcctatcccaacccccatgattagaaaatcaaaaagaacactttgagaaataacctcagtggggtyaaaagccagagtctccaggatgtcttgttcttaagacaaatagaaggaggtacaaatataggattgcagacttgtttacttcatttgttctctatttgtgtgcatgtgtgttggcagtgcaattgagaatgctttcatttttggtggtgtactagaaggcattaaaaaacaaaatgagaagtgggaattgaacaatgtgaatacatggacacagggaggggagcatcacactccggggcctgttggtgggtggggggctaggggcgggatagcactaggagaaatacctaatgtaggtgaccggttgacgggtgcagcaaaccrccatggcacatgtatacctatgtaacaaaactgcacattctgcacatgtaccccagaacttaaagtataataaaaattaattaattgattaattaattttaaaaaacaaaatgagtccaggcgcagtggctcatgcgtgtaatcccagcactttgggaggctgaggtgggagaatcacctgaggtcaggaattcaagaccaccctagtcaacatgatgaaaccccgtctttactaaaaatacaaaaattagccaggcatagtggcgtgcacctgtaatcccagctacttgagaggctgaggcaggagaatcacttgaatctgggaggtggaggttgcagtgacattgcactccagcytgggcgacaagagtgaaactctmtctcaaaaataataataataataaataaccaaaatgatatcgaagtcactaataattacaacataatagctactataatgtaacaatgtgtcaagtgtctgcagaaggacccactgttgtctcactattcatttgatctccatttggcactgtttcgttgtttgaataaagctttatgctgccaggttttcctacatatttgtaaaacaaagttctcagccattccaataaccatgactgttacttgacattgcttcattcatgtatagtactatcaagtttgagcctaccctcactatgactagtttggcccaaccatctatcacaacagagggtctcaggtgaagtaaaataaatgttataaattcttccaaatttatggcacactttgaacagtttgagacatactaattgagaattgctaactttaacattttaagtataaaataagtgttcagttctttttggtcagcttggattgcctttggttctagttataaatcattttctttctttctttctttctttytttctttytttctttctttttctttctttytttctttytctttctttccttccttccttccttccctccttccttccttctttctttctttctctttctttctttctctctttctctttctctctctctctccctctgactctctctctctctctaccccgcccctttctttcctactgacaaggtcttgctttattgcccagactggagtgcagtggcatgatcaacactcactgcagcctcaatctcccaggctcaagcgatcttcctgcctcagccttctgagtagctaggactacaggaatgtgccaccatgcgtggctttttaataaaawttttgttkagacagggtctcactatgttgcccaggcttctctcgaactcctgagctcaagcagtcctcctacctcagcctccaaacgtgctgggattacaggcgtgagccactgtgaatggcctacttwgatgaatcttactgataaaagcccatccatgcatccatatattaatacttataaggcatagaaatacatacaacaggactrcatacacacatacatatgtatatatatgacagcttccctgcactcaagaagcttgtgttgtcttttaaaaaaatgaaatttataggaaaaactgtaactcatctttgatttatataaaaatgtgtcataagataataaaaaagagaaatcccatccaactgagaaggcatggaagagaaaatgacaaagtcccaagaatgtgaaatttgggaaggtgatagacaattctttgacaagtggaaaatgtccctctgaattctataagagtgtaatctctggaagtagtaatytaattgggtagttgacctgtgtatttagaatgtaacattccttattttttgcctctagataccractcattggttcctcgtctgccacatgcatcrtctcaggcaacactgtcatttgggataataaaacacctgtttgtgacagtgagttgaaatatgcattcctatttcttttaccgatacattctaatttttctctggaataataaaaatcttaaccgaattccttctgtgcaawctgtacttcacatggctgaagacagccataatgttctcagatattcctatggggttcctggcaactctttctttaagttctttcttatcctgggatgtgtcttttctaattctaggggcctaaatacgtaaaaggcttcaaacttgattttacttcaataaacttgaaattatgttggttctaccacctccagtataataatcatcctgcttggcaaatcagtaaagattttaaaaattgatactcttcaaggttagcgaagctgtggaagaacctggactctcatgtaccacgagatcaacacatcctcttgaaaggccccatgcactataaacctcagaagtgggcatgtattttaacctayttcttaraatttrtacttaggaaataatcacacactttttaaagyagtttggtataaacttttcattgcagcattatttatattagttaaaatgttagagtaacctaaatattttaaactatggtttggaaataatctactagtaggaaaaagatgtgttcaaatgaccattayaaagaattccctaagaaacatraaatagctatgcagaatgaaaataagtatatccatacactggcatggtattcagccataaaaaatgatagcataaagaagcacttaatgactagaaagagatgtgttttatgtggaaaaagaatcagatgaacggcatatatggcaagatctcattttattaaaaaaaaatacacctatgtagtgagggccaggctgaggctgagagaaatgcagtgtataacatctttgtcttactcttctctttggataacttggggacttctttacttttcttcttggtatttaaaaatgttgttacttttactagaaagtttacgagcttcagaatctaaatttacaaatgacattggtcacacatttattgctgtttatccactttaagaaacagttttgctattttgtaaaacaaattgggaaaccttccatcttatttgaaatctgtaataagataacatggaattggaataggaattttcttggaaatattaaaaaaaattagtaaaatagaaaaaacaaacaatataataatacacctatacctatatctatatttttatctctgtttctasttctgtaaactctctatayccaaatcctggtaaatggctgtaagtcttcttggagaagrctaggggaagatttacaatacatgcttttgactgcgtagcatggtgcttcctcaagagaatccagtctcccatccgttggtgctgctctgggtctataaactattcaagtctaggaattgttgatgaacaatgaacttcttttgcaataattcaagtcagacttcaattcacttgacctaaatctcttatgcttatacaaatcaaataacaccttagtcggctatccctctacttcggttttagagactccatgatcaattagcccaataacaatgttctcttcagtcaaatcattctgattgctgtttcagttctaatagccattacaattgtctctggcaattaagtgctgccaattggactctgtcaccctgagctcctttggtccccaagtgaattcagagaacccagttcaatggcaacagttcccactgtcattcctggcctacagagaatgagccatcgcagaggatgctgaaactccccgtgtgaatgtttttctcaagcctccagtaaaaggtctgtcttctgaaccctccactcctgcatgtgcctcaccagctctatccaaggatgtgactttcagagtggaatggctgttgcttaacctctgcctctcaaatatcaggctaatttctcatgctgtaaccctagtccagaaccrtacagagaaastaagtctggaaaacttaattccaaattggcctggttgacactgtacaaaaccaccagataattataattttatttaactctttgtcttcttttctttccttccctccttcccttctgcctgcctgcttgccttccttctttgcttgcttccttcctttctccctcccttcctccctcctttccttccttcctycctccctccctyccttcctycctcccttccttccttccttccttccttccttccttccttccttccttccctccttccctccttccctcctttccttctccttattttctttcttctttaccacacggctaggaccaccagtataacattgaacattggtagcaatagatgtcatccttgtcttgttccacatctcaaagggaaggattaaaacatttcaccattaacctggtgtttacagtaggctttttgtaggtaaccatttttgaattaaggacattctcatayactcttcattattaaaaattttttgtctttgaaacatgttgaagtttatcgagcactttagttatatgtatcgatgtaatcatatctgtttctcttttttctgttaatgtaacaaactgttttgagtacatttttgaaaggcaaataattttgaatttcaattttacattcttaaaatcaactaagtcaatacttaatcatttttatatataacaaatacccttttataatacattttatatgtttctattaaagtataattcatgtatcataaaagttaccttttcaaattacacaattcagtggtatttagtatattcataaagttgtatattacggtctgaatgtttgagtccaccccaaatccatatgttgaaatctttacccctaaggtgatgacattagggagtgaggcctttggaaggtgatgagatcatgagagcagagctgtcacgaatgggattagcgtcctaataaaagaggcccagaagagctcctttgcccctcctgccatgggaagaaatgctgaatctgccagagaggttggtcctgaactccttagcctccacaactatgagaaataaatttttgttgtgtatgagctaaccagtttatagtattttgttataacagcccaaatagactaagacattgggcaaccagcaccgccaattaattccggaacactttcatcatcccattcctgttttagagattagactgtaattttctttcttgtaatgtcctcataagattttgatatcaaacttatgacagtcttataaagccagctggtagtgtttcatatatttgcttccttgtaagagtttatataaaattggtattatttcttctttaaatgtttaaaagaattcactggaaaagccatatagcctggagtttactttgttgggaggtctttttttattccaacaattttcttgtaccatgtagactttttgctgaagtataacatatatatgtagtaaagtgcacacatcttaattatgcagttcagtagatatttacaaattaaatgcacccatgtaagtggcactcagattaagatatagaacattatcagcaccccagaagccttcctgatgccctttcccagttatcttcccaaagtaaccgctattctgatttataacactaatagttttgctgcttcctaaattttataaaggaatcaaaaaataggtactcttctgtgtccggcttctgctcagtgttatatttggaagtcacttttgttgctgcatgaaggatggtcagtttttttattattatattgtatttcactgatgatcttgagtaccttttcatatgtttgtgaagggcctattccaaacttttgtctgttatttactggtttgtctatgattttattgttttgtagaagttgtttaaatattctcttgttttctaataaatgtaacacaaatgttgtctttcaggctrtggcttttctttttctttttcccttcttaatgatgtcttctgttgtagtaagttctacattttaataatattcaatttatgggtctttttttccagttactgctttttctattctacttaggcaattgggccaggtgaggtggctcacgtctataatcctagcactttgggaggccaaggcaggaggattgcttgaagccaggagttcgagaccagcctgggcaacaaagcgagaccctgtctctacaaaaaataaaataaaattagctgggctcagtggcacatgcctgtaagtcccagctacttgggagcctgaggtgggaggatcccttgagcacaggggttcaaggcttcagtgggttatgatggtaccactgcactccagtccaggtgacagagtgagaccctgtttcttatggataggcaattgatctaatatcatttattaaatgttgcaccatggccataagtcaggtgacctatatgtggatgtcattccagggaggttctgttccaytggtttatttgccatacattgtgtttttgtttggtttagttttttgccatactataatggcaaaaaaaactgtagcattacattaagattttaattactatagcatgacattaatatttgatatctggtggcatatatcttctaactatgtgcatcttcaagatttacttggtgattcttggcactttgcattaccatataaaatttagaatcagcttgtcaatttccacaaaaagaatcctacttgaatttgtattgagtttctattgrcttagtacawcaatttgtagacattaacaaatttagttttgaagtttaaatttatgaacatgatatatcctcccatttttgaagtcttctttaatttcttttaaaaatatttgttaatttaccttatagaagtcatgtacatctttcattatctttattactacatattatttttaaaattttattctctatttacttcttagatatgcactggtttcacctcagctccagcaattttattaaatttacttttaaattgaatagtttttctgtatatcttttgaagttgctgcataattatgtcatctatgaatctgacaaagtttttaaatcttttcctttcttatgtcttttgtttatttcatctgctttattgcattggctagaacctccagtacaacattgaatagaagagatgatacaagccttttaatggttatcacaaatcatgatgtatgctgtagatttttgtatgatatcctttattagattaaggaaactcccctttacttctgattgctaaaagatttatcatgaatgttcattctaattgatcactctgcatgtattgagattatcatgtttctttttcactctgttaatgtaatatattacattgattgatctttaaagggcaaacaaactctgaattcctagaatcaacctatgttgcttgtgatgtgttatagatgattatcctatcwatgaaatgtgtgtgagtgtgtgtgtggtgtgtgtgtgcaggattgctcatatttttattgtaacgttgtaacattgatttaatatttaaaatcagtcaaggtaaacctcactttgatcattgtatcatcctttggaaatattgctggattcagtttcataatattttgtttagaaaatttgcatttatgttctcaagagatctttggttataatttggttttattttaatgtccttatcaggtttgggcatcaagattatgttgggctagtaaaatgtgttaaaaattgtttatttttttctagtctccggaataatttgtgtaacattaatattatttttccttatatgtttggaagaattcagcaatgaagcaatctggacctgagggtttgttgttgttgttgttaggttttaaattagtgattcaatttctttaatagctataaaagtattattttatatcrtattgaattagtttgggtaagttatatttttcaaggaatttactcattttatttaaattttctaggttattagcataatgctatttattatatcctcagaaatcctttggatgtctgtaaattctgtagtggtactcctatgctaattaatttctgatattggtaatatctttttgcttctttttccttaattagttttactggggctttatcaagtttactaagcttttcatataaactacttttaactttcttgttttttctttaaagtgtgactattttctcttttactgatttctgcttattttcttctactttctttaagctttgtgtactcctccactcctaaattcttgatattgattagataatttgttttcaacctttatttttctaatatatacatttaacctatacatttttctctaaaactattttacttcccacaatctttatatttttattatcattgtacataaaagttttctaatttaccttttgatgtcttctttgacccataggctatttagaagggcattgcttaatttctaaatatttggagatcttctagttatcattctttcattaattcaatcatttgagacatggtttatggcccagaatatggatgattttggtaaaatgttacatatgcacttgaaaagactgtacagttattttgtttcattttctagaaatgtcatttaggaaaatgtggtttagaacagactttttttctccctccacttgttctctcagttatggagaagcatgtgtaaaatatctgtattagtttcccagggctgctgtaacaaattaccacaaacttggtggcttcaaagaagagaaatttactctctcaacagtttggaggccagaaatccagttaagatgtcaataggattggttccatctgcaagctgttctgtgcctctcttcaggcttccttccagtggctgctggcaatcgttgatgttccttggcttgtagatgcatcatttcgttttccgcctccatcttcaagtcgccttctcctctgtgtgtgtcctttgctcttctggctcctgtaaagacactggacatggatttagaagccaccctggcaatccagaatggtctcaactcaagatcattaatttgattgtatctacaaagactctccaaactgggtcacattcacaggtttcagagattaggttaggacacagatattttttaaggaggacagtggttattcaacccattacaatccccaactatgactatgaatttgcctgtctttcctctttgttctagcaatctttaagcaatctttactttatgtattttaaacatgttattaaatgcatgtttaaataattgcatttgttaaattttttgtttattctttctgctgaattgactgttttatcataatgaaatgtctctctttacctctcataatacttcttgccttaaaatctactttgtacattaatatagctatatcagctttctttcttgtatttatattatatatatttcaaatcttttactttcagcccttctttgtcttatatttaaagcttgtctgttataaacatcatatggtaaagttttgttgttttattcagtctttctttgttgttcattagtgtttgaaacatttaaatttaataataaaaagttaaaattataaataaataaatttaatctagttactgataagtctaactcttggttatttgttttctatttgtttcatgtgtttgtgcctttattcctcatttctcacatttttgaattcatcaagtatttttattattctattttccccagtagcttttaagttatatttcattttttattcttaaatcactactctagagacagacatccttgatttactatagtctactaaaattgtgcttttaccagtctccaaacaacgcaagtacccaaactattaatatttaattccatttgtgtcctcctcctctttttgtattgttgccatacgttttgtaaaaagaaaagcttcagctgaattaaatttaaaagagtttaattgagcaatgaacgattcgcaaatcaggcagccttccaagccaaagtaagctcagagactcctgcccagctgcgtggtggaagaggatttacggacagaaaaaggaaactgacgtacagaaaacagaagtgaggtacagaaacagcccgattggttatagctcagcgtttggcttatttgaagacagttcaaacagttagccacatttgattggccaaaactcggtgattggcataagagtaacctacggtctgtttacatcttcactcgttataattcgcagtttacagagaaayctttaggctgagcttaaactatgtaaggctttaggctaaacttgatttaacaatttacatatgttatatatttcaaagacgtaattgttgttgttgtctttataaaaataatatctatttatatttacaccgtagtgaattcttagaatttttatgttgcctcagcatccatttagaatatgtttagctttctcatgccagaagcagggcttagtcacccttaatgccctttctagttctgtacctcctcccaattttgcaacgtggtcgagccagatatctgctttatacaactgcctcctggtgaccacctctccatgggacagctagataaaacctacttgactagcgtccctgccctctgtgccctgcatggacttcgcagttatgctgccgtgaccacctctcagtcgcagcatgactgcctggaacatgtgcctgctttctttaaactcaccaattagaactccccatgggagataccttggcttgtagatgcaagatgctgggtcatactctggtccccaataaaggcattggccgatggatccccttctctctctctctctacgttcctcgcactgaccaacctctttgtgatcttcaggcgtgccatacccccagcccgtaataaamtctttactkccatcttgtgtttcttgtaatgactgaagaggttttctctatcataaagatcctaaatgaaaacatacccgcatatgagctctttctggtgtgtttccttcttattgcaattctatcaatcctatatgaaactattttccttcagcctgaaaaagtctctttggcatttttgtattgtagatcttctgacaacaaattctttaaacatttttctaattgtggttcctttgaaggttattgtctatgtttcctgctgcttttatggattacactttaaaatagattttttacaatattactatgttktgtctaggtaagtatttctttgtattgcttgggtttatcttgttgcacaactggagtgcagtggcgcgatctcggctgactgcaatctccacctcccagattcaaggaatcttcccacctcagccacctcggtagctgggattacaggcctgtgccactattcctggctaatttttgtatttttagtagagacagggtttcaacatgttggccaggctggtctcaaacccctgacctcaggtgatctgcccacctgggccacccaaagtgctaagattacaggcatgagccaccacgccaggcctgtatagctttttgaatctgtaatcttgcatcagtcttggaaatttctcagttattacttcttcaaatgttgtttatgtctattatctcctctcatggcaggacttcacttaaacatgctaggctttattcttctatatcttggtctgtatgtttaacatgcatttaaggagtttttgtggactaatatatgaccacttttacacagatatcatgttattatatcaaacttagatttgagtaaatgagttgataagttttatacctcttgtgtgttgtgaaatattgaaattacatttggaagcatctgttacttgaaagttcaatagagcttatctttttttttttattcttacatgtttgttgggtaattctagctttctaaatctttttgaatgaatattggcaatttatrtttccatttatatcatttagattttcaaaatatttaacccccagtagtctacagttttataaatattctcatattcataaaaatgtttaaattccttttcctactgtgtatatttgtgtcttctctcttcccttatactttatcttttggcaaaggtttttatattttatttttctaaaaaggctaacctcagttattaacaaaaatgcaaattaagaaagcaaatgaaaagagtaggagaacactgtataaactctataatactataatcaaagggctatttaaaatgaaaagaatgtggatggagttaataaatgcatgcaaatattataggaaatcatataagtaagaaaggcaggacacatcatattatccccaccaaaattacaactttgtaaaaatgtacctacgtgttagcaaagaataaaagcaaataatgaatgtaaaaatagttacagtttagtgactcgtgagatttttgtcattcattatttaaattgactgtgctcttcctttcccaggaattatttgtgggctaccccccaccatcgccaatggagatttcactagcatcagcagagagtattttcactatggatcagtggtgacctaccactgcaatcttggaagcagagggaaaaaggtgtttgagcttgtgggtgagccctccatatactgcaccagcaaagatgatcaagtgggcatctggagtggcccagyccctcagtgcattatacctaacaaatgcacgcctccaaatgtggaaaatggaatattggtatctgacaacagaagcttattttccttaaatgaagttgtggagtttaggtgtcagcctggctttgkcatgaaagggccctcccatgtgaagtgccaggccctgaacaaatgggagccagagttaccaagctgctccaggggtgagtctgactgaggcctagaagggccctgccagtgacatgcattgctgttggatcaggagattagtatttgttcagggggagggatttgtgctgagcagggtcgagaagcaaattttctaggtagtgaacatgaaattcagaaggtgtgtgtacatgcagatgtgctgaaatgaagaagcaaagctaaacctggacaaggaacgtgatgtttctttggagttcttataagcaaatctattaattacctttgagtataataactgctgatagaaaatgagtgattcttccagccaggcaccataatacaggctacatgtgaattttaatccttaaaacaaagttattaggtagttaccagtttttctaggtttgtctgttttgttttgcttgagacagggtcttgatctgtcactcaagttggactgcagaggtgagatcatggcttactgcaaccgccacctccctggctcaagcaattctcctgcctgagcctcycaagcagctgggactrcaggtgcatgctaccacrcctggttaaattttttatattttttttatagagatcgaatctcaccatgtttcccaggcttgtctcgaacacctgagctgaagcaatccacccacctgggcctcccaaagtgctgagattataggcatgagccactgtgcctggcctctatgttttgcagagaaaatgtgccttagagaaatcggataactttctaagatattaacttgcagactgaagactgaaaygcaagtccacccgactccagagacttggctttgctagtcagcatccagtcaggaaatcaaaacttactctagatactttcaaggagggagggatttcatgcaggctgtattagactcttctcacattgtataaagaactacctgagactgggtaatttataaagaaaagaggtttaattaactctcagttctgcaggctatacaggaggaatgactgaagactcctcaggaaacttacaatcatggtggaaggcaaagaggaagcatgtatattttcatatggctggcaggagacagcaactagggaggtgctacacattttaaacaagcagatctcaagagaactatatcacaatacagcactagggtgatggtgataaaccattagaaaccacccccatgatccagtcacttcccactaggctcctcctccaacactgggaattacaatttgacatgagatttgggtggggacacagagacaaaccatatcacagctaataggtcacaaagatgttagaagggcaggaaaatcaggcagcctccctagcaataggacgaaggcagagttaccagagatcagggagctgctgtggctcccagtctacacagcacaggagcctggagggatgctcaagtggccagcccctcccactgagcaggcagctccctgaaagctgctaatgctgcaggagccaccacagctgccagaatgcagctgatattgctggagccaaagtcattggcatcgctagaattgaagctgtagctgctcactgaagtcatctatactgccactgcctgagccacctctagaagtagaacagactctgccatcatcctgctttttaatttggtatatatgcctccaactggaagaacctaaccagagcccagctatcaaggaagacaaatgattatagttttaaggtttccattgctagcagccaaaagacagtgcagaagtgtgaggctaggggccaacagaaatttaaccagcacagcacctcaatattacatcaccaggcattgattagtcaagggaaacactgggtgatgagccctgaaaatggacattacagcatcagagtatttacaaactccctaaagaagtcatttttctagtccaatcccccatttgatgcttgagaaagctgaagtccagaaaagggaactgatctgctcaaagacaaactgaaattattttttccattttataacagttttatataatttagttgagacctaaatgtgttctgacttcctgagttccgatcaactatattaagagagagccagcgctgcccttacaatatgttgtgtgaaatagacactctcattatggtgacagtaggtcttttagattttgttcgacagttgcccaccttctcactggagtgaaatgaatgactaggcagcaccttgctgcatagcatgaagggaggagacccatagttctttaccaccctatgtcaggtggccgctgagagaagacttgaaaggagaagagaatagatgtatgtttgttgcaccagtgtgataggtgatggagggacctattagatgagacatgggcaggggcactcctttatggcctaaaatgcaagackaaattggtgatgcctttctagaaaggaagcatggagatataaaaatccatcatccctcccaattttgtactgggtgaacagtaattggaagcattctagaaggaactgtccattgtgaaatcttagttgcatactttagatgtaaaacaatgaattggggatacctctgttttagtcacagttgtgcaatgtgtcagttctatgagtgatggcaagacatcttcctcgccctgtgtatttagtttgttatcaatgtaataaggctgttattctaccttttttgttacatatagatttgtaattattattcccttggccagtttaacagtgagagaaaagttattttcacacaattagcagtactttgtttctctctccccagtatgtcagccacctccagatgtcctgcatgctgagcgtacccaaagggacaaggacaacttttcacccgggcaggaagtgttctacagctgtgagcccggctacgacctcagaggatctacgtatttrcactgcacaccccagggagactggagccctgcagcccccagatgtgaaggtgactagactcttatctggcttggtatttttagcttgcgtctttattctccacatgccagttatttctgttcgtttttctttttttccagtgaaatcctgtgatgacttcctgggccaacttcctaatggccatgtgctatttccacttaatctccagcttggagcaaaagtggattttgtttgtgatgaagggtgagtatgagcttgcctgacctgctggacattgaaattggggttaggaattagtccaaaaaggggagatttgatgtggcttaaaaaaagacagacagacasacacacacacacacacacacaatcagagagatgaacttttgaaagtatatataggaagaaaggaaagacacatatggaactaataayatgagatatgaagaggacactgggccatatattaactggcaaattcaaagacaagtataattacttgttattaatatataggtaacacagtaagtttaaaaaatcctattttcaaaattttagaatttcaaaacagcaaatagaatatgagtaatttaagagtctcagaaaaaattgcaagtaacaaaaaacttattctaaagagctaggatcatttaagaatcatttcagtaaattctttaaaccatcagtaatgaaatttgtaataggactgaaagtgtaaaaatcagcattttaaaaaaatccagtcatatatcgtctggctagtcatgggctctgggctctgagctggggttctgatggctgctgttaatatttccagcaaggtcattaccttgtttatgtccacctagtgctcttcrcagggtgcacatctctacacgggagctgaccagcatgggcaacaaagcacctgatcccaaaatgtaacacagaatcttggcaggctccaaaagccagcacccagtaagagttaggagggcatcggggcccaacagacattgagaattttcaacaattgcgtacaaaaattatgtcctctcttctttcctttttcccctagaatattcgtgcttactcttcagcagcccaaattgcccttttgagccttcttcacgccatcacagatgtggagatgaaaggacaatctctgttctctcgccagctatttcccactttaccactccaaactgggagctgttttacttgctgttccagggtcagagttacgaaggcattgcattagaagactgggtttctaataatgacaatgagtaatcagtgaaactccaagcctgggtcctgggtcaaggagatggtggcyattttgtgaccacctttttcaattcaagcaggactatcatgtgaccaagctactgcattttgccactctatattgctcccttctggaggctgtgatttttccagaataacgtagyctgtgcaactctgccacctgctggcctcaggtcctcaaaatcctgaaattggggctgggccttagattgtgaactaagtgtcctcttggctgaaacagctcrctattcactcctattttcttctttagatttcaattaaaaggcagctctgctagttactgtgttttgkctggaatggaaagcctttggratagcagtgttccagtgtgtgaacgtaagtaataggagtaacatttcaggccaatctctccycttcatctgttcagtatttgacccaygacctcccctaatgtggttcttcaattttctaatctgaattattgatttgaaaatttcttattttagtaatgtttggttgtgaatcaatgtgtacatcacctgtctttggaactatctgatctgtctctgtcattttgtattctatgttctmttgcgataaatcctatggtcgtgtgcttctaggtcaggagagattagataatgtgaagcttttacaatttgctttctttctctacttcttttctttcttctcttctttccttccttcagttcttttttcccttcttctctccctctctccttccttctttttcattttgttctccaatcaatgtgcagtcagtctacaatttgtgtatatatttgataatactcaagtatcaaacatgcctttatttaatcaattatttattgatcacatactttgtgcctctgttcatctagatactggagttatagcaatgaacaagatgagtgaagtccctgtccccatgttgtttttactcaggtrgggagaaggacaaggaaaaaaataagcaaattaaatgctacggataatagatcaaagcaatgaagaatgagggaaaagtggggagtaacattagacagggtgagcagtttgagactccataaattctcaaaatatgtacctaaataatttatgctgagagattcataaataataagtcatttttttaaaatgagcctcatatgttcaataatcagtagactactgatttctcctagtctacccatttataatttccccaatagaagatagaactttgcttcatttcttgattctaatgattggaaaacatgtttctttagaaaaccatgaaattttactaaaatgtttatgttcttagaaatgtacttggacatcttacagtgctttttagagtaaaattttggaagaacataacttatatagagatgcttgctgtctaagaaatccagtgctccttgaggcagcatgacaaatgtctgttctactatcatgcatgaaagctcattgattggactactcaagctttctcttatttttcataactctggtagttaaaataacttcttccaaatgccagttctaatgaaaaatgccaattagaaatgaggaagagactattataaacaaatcagtagatgctagaaaggagtaacaacttgaaacctgacccagaaagtaaaaaaagaaaataaatcatsaacagacsttgacattttcaaaagcaaagcaatctgaatccatttggagttttttataatggcctgaatatgtttcaattcactgtggcagggctattgttatcactgagactgatgatcaatatcagtaagtaatcagtgaaagttttcacctatttaagatgattagcacacatatatacatttgwgaaatatttcccaagaacgtaggcyccttcctcagcactgtgtccccaggatcctgatgagtggctgacacaggataagtgctaaattaakaaakattgactaaatgaatgagtaacccttcaaaacggttatttttcttcttcaaatgttttgctacttcattaaagttgtaaagtaagtaaacttgcaytggatctttcccatgtctgcaaaagcttcttattgaattttttcaattgtgggataagagaaaccttttttcaaaagcgttcagataggtggatgtaagagtttttcttgcaggtcgtctttgattattgcttgaaatgctcacttcaygagaatgtttcaaggaatatttgtagagaaaatcttcattccttatgggaaaataaataataaatgactctatatcaggaaataaarattgtgtaggaagacaaattctgtttgaataactaggtgggaagaaatcctttgaaaactttattggtagtaaataatgccataaatgacctttacattttgataagggatgcaaggtctctacacagatctaaatctagatctagatagatctggagggaaggtctttttgaaagtggggcttagtaggtggctgatcctgaggctctctgatgagttttctcaaggtgscaaaatctgtggaactatcagaactgcgtgttttcttcaggaagctacatgcaggttgagaccttacgtactgaagagagttcagattactctacctggctccaaaacattttctttcccacaggtaaatcatgtgaaactcctccagwtccagtgaatggcatggtgcatgtgatcacagacatcyakgttggatccagaatcaactattcttgtactacagggtgagttggcagcaacatctcttggttccagagttccagcacagyaatactaccttctagccacatctcaggaaggaaactaggctgttgccacctgctcttgagaggtttgaacacaggtattaactcctgattgaaatgaacaaagataggagaagattaggggaaaaatctgtgtccttgctggaaaccagggcagtgcacacataaakagtatgccgttcactggatgggaargaaaaaaaattaggagtatagtagtcaaagcacacaaacaaccctaacccagagtagacattgctggaagaaagggaagggcatgtagcagctgtgtgagagaacaaatcttaatgataacagcatgatcgcttgctagggctgccatcaaaaagtacaggccttcctcattttattgtacttcacagatgttatgctttttacaaattgaaggcttgtggcaacgctgcracaagcatgtcagttggcatcatttatccaacagtgtgtgttgacttcgtgtctctgtgtagcattttggttattctcacaatatcccagadgttttcattattaycatgtctgtgatagtgatctgtcttcagtgatctttgatgttactattttcattgtttggagtccctacgaactgcacccatataagacagaaaacttaataaatgtgcatgctttgactgctccatggacaagacattccccttctctctccctctcttcaggactccctaatccctgaacacaataatactaaaatgaggccaattaatagccctacaatggcctttaagtgttgacatgaagggaggagtcatgcatctcttactttaaatcaaaagctggagatgattaagcttagtgaggaagatatgttgaaagccaagacaggccaaaagtcaggcctcatgtgccaaacagctagcgagttgcaaaggcaaagcaaaagtacttgaaggaaacttaaagtgctmttccagtgaacacatgaatgataagaargtgaaacagccttattgctgatatggaagaagttttagtggtctagatacaagatcaaactagacatatttccttaagctaaagcctaatcctgagcaaggccctaactctcttcaattctgtgaaggctgacagaggtgaggaagctgcagaaaaaaagctggaagcagctgggcactgtggctcatgcctgtaattccagcwctttgggaggcagaggcaggtggatcacctgaggtcaggtgttcaagaccagcctgaccaatatggtgaaacctcatatctactgaaaatgcaaaaattaaccaggcgttgtggcgggttgcctgtagttccagctactcgggagtctgaggcatgagaataacttgaacccgggaagcagaagttgccgagattgtgccactgcactccaggttgggtgattcctgaggtttaaggaaagaagtcatctccataacataaaggtgcaaggtgaagcaacaagtgctgacatagaagctgcagcaagttgtcctgatgatctaactaagatcattgatgaaggtgttaaaataaatagcagattctccatgtagacaaaacagccatctattggamcttcatagctagagaggagaagccaatgcctgggttcaaagcttcaaaggataggctgcctttttaggagctaatctcgttggtgagtttgagttgaagccaatgctcactgaccattctaaaagccctagggcccttaagaattatgctaaatgtaccttgcctgtgtctataaatggaacaacaaagtctgatgacagaggtatgtttgcagcatggtttactgaatattttaggctcactgttgagatatagtgctcagaaaaacagattcctttcaaaatgttacatacagctcattgactttgtatccaatcaggcaagagctctgatggagatggacaaggagatgcatgtagttttcctgcctgctgacaacagcagccattctgcagcccatggctgagcagtaattttgactttgaagttttagtatttaagaaatatattttgtgccaggcatggtgtaatcccagcatattgggagaccaaggtgggcggatcatgaggtcaggatttcaagascagcctggccaacatagtgaaaccccgtctctattaaaaatacaaaaattggccagcatggcagaatgtgcctgtagtcccaactactcaggaggctgaggcaggagaatcacctgaacccaggaggtgaaagttccagtgagccgagattgcgtcaccgcactccaggttgggcaatagagggagacttcaactcaaaaaaaagaaaaagaaaagaaaaggaaaaaaaaatacattttgtaaggctatagttcccacagacagtaattcctctgatggatctgaacaaagtaagttgaaaactgcaggaaakaattaatcattctacatactgttaagaacactcatgattcatgggaagaggttaaaatatcaacattaacaggagtttggtagaagttgattcygaccctcatggatgactttgagaggttcaagacttcagcggaggaaataattgcagatgtgacagaagtagcaagaacactacaattagaagcagagcctaaaggtgtgactgtattgctacaatatcatgatcaaacttgaacagaagaggagttacttcttatggatgagcagagaaagtagatttttgaggtggagtctcttcctggtgaagatgccatgagcattgttaaaatgaccacaaatttagaatattacataaactaagttgataaagcagcagcagtatctgggaggattgactccaattttgaaagcagttcagagggtaaaatgttatcaaacagcattgcatgctacagcaaaatcttttgtgaaaggaagagtcaatgtggccagttttattgttgtcttagattaagaaatagccacagccaccccagctttcagcaaccaccaccctgatcagtcagcagccatcaaccttgaggcaagaccctccaccagcaaaaagattgtgacttattgaaggtcagataatctttagcattttttaccaataaaccattttttaaagtatgacctttttttcacataattctatttcacacttaatagactatartatattacaaacacaacttttagactcactgaaaaatcaaaaaattcatatgacttggtttgttgtgatatttgttttattgtggtgttctggaactgaacctgcaatatctttgaggaatgtctgtaacacaaaaygggtggcttaatacaacagaagtttttggagttctgttctatagactggaagtccaaaatcaaggtgttgggaagaccatgctccctctgaatcctgtagggtaggatccttcattgcgtcttccagcttctggagccccaggccttccttggagtgtggcagcagaactccaatttcttctgttgctgtcctcagatggccatcttccctctgggtctgtgtcctcatatgctgttctcctctctgttcatgtctgtgtccaaagttttctctttttataaggacaccgggcatattggattagggcctaccttaatgacctcagcttaactggattgcatctgcaaagattgtatttccaaataagrtcacatccacagggactgggggttaagacttcccaacatatttgggggagacacaattcaacctataacagagtccctttgaaaatgtcaagtgtcaggtgctcacagcgcatggtccagctgttggtgctcacccttgctcagcrcacagtggaggctctgcctcaatctcactcttcacgggaacagctaagccaggtagtgagtaggggctatgtttgtgccaccgcaacaaacacagaaaggaagcttgtggtgtccagcatatttgccagcctaggcttcagagaccatagcacctagaatctgacaaaataaaattggaataaatccaaagtcctcttttcttttttgagcatttttaaaaatacaattgataaatttcctaactgttccttcctcatcttgcattgtggaataagtgcraacctccctgcggcatgaggcagaaaaccattgagcttatgacaaaaaacaggaaatacatgtaaaagagaccaattttaaaaaatcaggagaaattttacaaaagagatttactgccaggaaaccaggaaaactttcagaacactctccttttcctatttttaacaagactcagttgtacaaataattctgtgaaactagccatgaagtttgcacacgaatgaatatatgtagtcagtgtgtttatatatttcatttcatatatgtgtcatatatatgtgtgtgtgtatgtrtatatatatatatayayayatayatatawaaaacactgaatattgcagaaaattaaagcaaagagtaagaagagttaaccaaattttccctcaatgcrgtgggaaaagatgaaaaggagaagataggtgggcacagtggctcacacctgtaatcccaacactgagaggccgaagcaagagaatcacttgaccccaggacctcgagaccagcctgggcaataaggcaaaaccccatctctacaaaaaagtataaaaattagctgggygtggtggcgtgtgcctgtagtcacagctacacaggagactgaggtgaaaggatcacctcagcccgagaggctgaggcttcagtgagccgtgatggcacccctgcactccagcctggatgacagaatgacaccttgtctaaaaaaaaagaaaaagagaagacgtatgtaagacagtgtcaggattcaaattatgtattaaaaaaattccagaagggtaagcaaataagcccatacctagccatcactagggaaatttctgtgtttcagggatagagaaaaaaactcagattccagaaataaaatgtgaaaatgtaatacccgcaaaagaaataaatttattgacaccacattgattctacacaacactaaattgtagaagatagcacttctgttgagccaagctaatattcacatctagaggctccagatacacattaaagaataagcaaagacacaaaaattgtaccatttaagtatgtttcccargcaattaataagcaaatttttaaaaaggagaatgatgaattsctaaagaaatctcaatgagatagaaaagtggtaaaaacaaacaacaacaacaaaaaaccataaacacaaaaactggcaawgtaatcataatttagtaataatctctgtgaagtcatagaatatatcaatagaagtagaaaatgtgagaaagcaggaaaaggtaggctagacttrcagaaaagatgagtagactgactgtacagaatttgactctgaaattgagaaaataggtttaaatatatgtatcaagtgtatatatctacaatatacatgcacacatataaaattaaattcctaattggaaaaaatattaagtttaatttccaaattattagaataactaaaacagctgaatctatctgttccatatagtaaggggagggaaggaaaaagaatagcaaggaatgcatttgtctctgtcatcggaaataagccccatcatgtttgggtcaggtcattttattcattgctttctcctcatcctcatcatgggacatcgtgaaatcatgaaaaaggtagtgaaagaatkatgacaaggccgagcacagtggctcacgcctgtagtcccagcactttgggaggccgaggtgggagggtcacctcagatcaggagttcaagaccagtctggccaamgtggtgaaacaccatctctactaaaaatacaaaaattagctgggcatgttggtgcatgcctgtaatcccagccactcaggaggatgagtcaggagaattgcttgaactcgggaggcagaggttgcagtgagyagatattgcaccattgcactccagcctgagcgacagagccagactccgtctaaaaamacaaacaaacaaacaaagcaaatcaaatatataatttatttcaatccatttggtttaamcttcttgtcaaaaaaccaagtctactagacaggatcaaaagcaacaaatcttgtatttataaaaaacatgcctcaagttaaatggcatagtattakacacacacacacacacacacacacacacacacayayattaagggaatacgcaaacaaaaaatggcagaaataatatgggaaaagacagaacttaagaaagaaattgtcaagcaggtctacaaaatrattgttttattttggtgccaggtacagtccacartgaagtcaagatattaagaagtaaagtggaccaggagaagttagagcagaaatatctcttttcaatagtgagagcagaaaaagaagtagaaaagctgggaacaataggtaaagtttaggctaggccttagacttctcctatattgtaatccctctggtttgccacatrtgcatgctgtcaggaagttgatgaggtatgkamagcacaattattttccattttttgcctttaggcaccgactcattggtcactcatctgctgaatgtrtcctctcgggcaatactgcccattggagcatgaagccaccaatttgtcaacgtgagttgaaatctctttccccattcaccccaccatttaaccctagagttgtcctcctagaattacaaagaatgaatctcatccctcttggaaatggtatccttctgatatttgaagaatccagtcatatccttaaaatggctcacagcattccaaacttccaccttcacctagaaatgstttttttcttatcttaaggtgtaatttattttaaactagtcttgagctaatttaaatagcccccaatttcatcctctgttgggtgaacacctcccagtttgaagagcattttctttggtgaagtcaacaaatacaaagtcagtgaaagaaaccgcatatcctctctgcaagctgttagtatcacatcagatattcaagccatgcagctctttcttccttcttattctttgtctaaacaggatcatgccatcttccctgtgagttgtttggaagatgagctttctacattttggggagcaaagaggaatgagcaattgcaagctaataaggaatataaaatgtgtataatcctgggtttagtgatggtgtgaggaaatcagcaatttcaaacccatytggtgggagrataagtgggaacaaactttgtagaagggcaatatactggctgggcactgccctacagtagagtaggacacagtattcagttcttccaagatcagatgaaattgggtgcattcagggtggtatggctgtagatcagtatccagttatttgtattacttctgaatctgtaagtatcatgtttattatatgtaatattgtatatttgtgyttgctttgtctttattagttctgccagagcttttgttcttattatttaataaagatgttatactgggccaggtgtggtggctcacacctgtaatcccagcactttgggagtcctaggtgagcagatcgcttgagcccaggaggtcgagaccagcctgtacaacatggtgaaaccctgtctctacaaaaaakacaaaaattaaatgggcatactggcacacgcctgtagtcccaactattcgggagactgagaggtgggaggattgcttgagccagagaggtcaaggctgcaatgagccatgatcgtgccactgcactccagcctgggcagcagagcaagaccttgtctcaaaaaaaatgctatgctgtatgctttattatattaatatccaatagaataaagacacatgccttctatatagagagaactaaattaataatggtgagataacatagttaaattctcatttagcaggagaaatataaatgtgtactataggccaggcacagtggctcacacctgtaattccagtacattgggaggcccaaggtaggtggatcacttgaggtcaggagttcaagaccagcctggccaacatggtgctaccccatctctactagaaatacagaagttagctgagcatggtcgtgcatgtctgtaatcccagctacttgggaggctgcagcaggagaatcatttgaggccaggaaaggaaggttgcagtgagccaagatcatgatactgcactccagcctgggcaacagagactctgtctcaaaaaaaaaaaaaaaggaaaaaaatgctctataataatatatggacacatttagcaaagtaatgttaactacgaagagcacaactcacaatattataaaattgtaagaatatatctgtacattagtaaatattagatgagaatgatattgtgaatatttacttccggtaatttgggatttcagaaaagctattagcataatttacaataaagtataattttaagaaaccatgccgggcacgatggctcacgcctgtaatctcagcatttggaaggcagaggcaggtggattgcttgaggccaggagttcaagaccagcatggccaacatgaccaaaccccaactccaccagaaatacaaaaataaaccagatacggtggtgcgtgcctgtaatcccagctactcgggaggttgagrggggaggattgcttgacctgggaagttgagattgcagtgagccatgatcgtgccactgcactccagcctgggcgacagagcaagactctgtcccaaggttttgttttggtgaacttgcggtctcttttcccaggaattccttgtgggctaccccccaacatcaccaatggatatttcattagcaccgacagagagtattttcactatggatcagtggtgacctaccactgcaatcttggaagcagagggagaaaggtgtttgagctcgtgggtgagccctccatatactgcaccagcaaagatgatcaagtggkcgtctggagcggcccagtccctcagtgcattatacctaacaaatgcacacctccaaatgtggaaaatggaatattggtgtctgacaacagaagcttattttccttaaatgaagttgtggagtttaggtgtcagcctggctttgtcatgaaaggaccccccgcaccgtgtgcaatgccaggccctgaacaaatgggagmcrgagctaccaagctgctccaggggtgtgtttgcctgaggcctagaagggccctgcaagtgacatgcattgctgttggatcaggagatgagtatttgtttagggggagggatgtatgttgaggagggtgggaaagtaagttttgggggaagaagcatgaaattaagaatctggggtgtgcawgcacycatgcatatgtgtcttcattttgaaaagcaagaccttaattagccaagaaaactggtattttggactcacctattaatcaattgtcagggcaaagtaccagctgcaatctctctcaattatattgaaaaattatatggactttatggtcagctgtgccctaagcactttgtatacattatctcatttattatttaaaacaacactgtcttatttaagggcttgtgtttttgatggctcatcttgtctactgatgccacaatagctggcttagcagcggagtgggaggtgttatggcagatacatagggacagagaaagagcttacaattcttctaccaacccatgttagccttgtgcaaccactgagctgggaagacaaacagataaagggatataaagacggatgtaccgaggcaggagatgggcagggcttgtgttctggtcacaatcctgctgaccaaaacagaatctggcctagacaggatgaagtgaaaaaacagcagcaacaggcagatggcgatgaaagcaatcactagctgccctcatattcccatcagcactgtgacagtttacaaatgccatggcaacgatctggaagttaccacccctttccaggaaagttctaaataacacgcccctcaatttgcattgatgtgccccttaacttacctgtaattggctgggcatggtggcccatgcctgtaatcccagcactttkggaggccaagatgggcagatcacctgaggtcaggagttcaagaccagcctggccaacatggtgaaaccctgtctttactaaaaatacaaaaattatctgagtgaggtggctcgcacctgaaatctcatgaggctgaggcaggagaatcacttgaacctgggacgcggaggttgcagtgagctaagatcacacgactgtgctccagcctggatgacagagtragatatcacctcaaaaaaaaaaamacacaaaaaacaagaaacaaaaataatttacatgtaattgaagcgggcttacaggagtataaatacagttgcctgccaggagctcatatgttgctgactctgggcacattgcctgtgagttagccctgctctgcaaagggcaatgcctttctaaaagatcgctgtctagcaccactggctcatccgtgaattctgtcctgagtgaggcaagaacccttccagartaagccccaatttaggggcatgcctgtccccaaacagtatgactgtactttagtcattggtgtgcaatcagagaaatatggggaaatctgtaaaacagacttggtctcmggtgacagtctcattacctgaataatgatggtacaaatacctccctaggaaatatgtagatggagaatccaccaatactaataactccacactggatatccagagctaggagaaaatacttcatgccctgtagatttacaggtgaattttgggccatgtgctagggagaattgtgttctatttctctaccttttactaactatgaggccttcagcaggcataggatatagcaaaagaaattcccccataactaacargtactctggaactgtcctttctacaatgtgtcagcygcctccagaaatcctgcatggtgagcataccctaagccatcaggacaactttttacctgggcaggaagtgttctacagctgtgagcccagctatgacctcagaggggctgcgtctctgcactgcatgccccagggagactggacccctgaagcccccagatgtacaggtgcctctctttccccctcacatggaagtcttactcctgttgttttattttttcttctcgtgaaatcctgtgatgacttcctgggccaactccctcatggcygtgtgctgtttccacttaatctccagcttggggctaaggtatcctttgtttgtgatgaagggtgagtgtgacccagtgttgagaccaaggactcagtgtggagaatcactgagttaatccaattaaggagctgacctagtagataagaagtacccagagagattaatttatggaagggtagttttgaaataagcgttaatccaattaaggagctgacctagtagataagaagtacccagagagattaatttatggaagggtagttttgaaataagggtagggactaagtggcaccgccttcagaaaacaatgaaaaaatggcacatacaactcaatrtcagatacaaacctaaatacagtcactgatcttgggtacacagttggaacttgaaatgaatgggtacgtatttatttggaggcaaaagaacataattttataaaatgtrtgctagaaaaaaaagatgaatgagatggaaattgtttgcctcataataaggcaaaggttgttttaggaaacttaaaaccagtcaatartggaatctgtaatagtgtatgaataactatgttttaacccaattacatatcttcatgtcaagaatggccagtgtaattgttttgatgcaagatttttctcagccactttgccagctggtgacctctggccagaaacatccctgtccaggccttgctctacccaggatcaatgcaggagacacctcatctacttggcccacccaggccgtgccaggcttgtgctctgatgcagagcccatggctgccgcgactacatgctcagcctctgggagggggtgtgtgagtgagcaagtgggggttccagctggccgcgccaagcactggcacaggagcgggctccgtgcaaggcttgtggctggaccaggcatgtcacactgaagggaatgtgttggtgcccaaacaggggtccccacgaccccgaagcccagagggggtgtaacagcatggtaatagctcttagcatttgataatgcctgcagcccaacagatggcggtgtgttaacaactctgtcagttccatcgcccygctcaggcctgcatctccaaggctgacttggcctgcatctccaaggctgacttggcctgcatctccagggctgactggacctgctggtgcttcctgttgcatggaataacttccctcccctaggagacggcaaagagccactgtattacagccttcttcatacctgcgtttggtgggtcctgagttcttgtcccgcatccaagaagaacaagcttatgctgacaatagaagggtgaggagggtggagaagagttttattgagtgacaaaacagcttctcagcrgagaagagacacaagggtggaccccagatgaagtcagggggtyattctctcagtgtggctggttctggagcctttatggactcagaattggaagtgtgtgttaattggttggtgagtatgcaaaaaaggctaaaacaaagccaccactcaaaggtgggcacaacagtgcaaaaaaccaattagggaagagcaggtatatgtgaaatagatgaagagtggggatcaatcagaggaaagcacacccaacaggaagagaggttctcaagccagtccatggatttacctggaacttgtagctaggctttaaactgtcttcagcttgaaggtcgggtttcaccgggatccgccccatctgcctgtgatttgtctgcctcctgcttctaccactgtcaagtggtattattcgttgcttatgtgtatccattattcttggtgatacagtatgagtctgggggataactagattgagcaattaaggagttatttttaataatttccaaggmttctttggcatttacaaagtccaccacctaataatgatttccaatttcagaacgattttagatttcagaagggaagcagtactcaatagtaagttgagcatttcagggtggcaaagactcctcccctgacccttctttttttcttagaacacatggttcagcatgcttctgtgagcctctttctggcctgttacatttggagtggcgagaagaacagatattcctggctttgcttaccaaatcaaaagctgttctgcctcatgacccactaatgagaataagtgggatgtcagagagccatcaatgaaagatgacacctgaaggttatggctcttgtgcccatggagaagtctggttctgtgttcatgccttctgtaggtgatgctgggctatgaagtttatatggcacttcagctctgattgctttgccagtcacagggtaccatggttctttagaataaattggcctttgagtttctgtcagctactgaagaattcagatccctaatgaactaagacttttagctagacctgaacctaagacccaaatgatagtcaaggaggaaatggtagtgaggaagctgagcatctattagtgaagaaatcaagggagagatgggaattgctcayacatttgctaccacttttttttttctttaggttctgattaaaaggcaggtctgctagtcattgtgtcttggctggaaygaaagccctttggaatagcagtgttccagtgtgtkaacgtgagtagaaagaactaygtagtttggatagctctccttatttttgttttccagtgttttactgcacggaatcacttgtctggatctttacttaactaaattactgattaaaatacttctctgttggaagaatttcaagaagggtcttgtaggacttttctgacatttgttactaatctgtaaatcacttagtttaatgactgtttaattttgtggggaatgtgtggcaagaaactaaatgacataaaagtgcagcacattttagtcagtcatttatttttaattttcttataaggagtaatctttcttacattttttttttcttttttgagacagttacccaggacagaatgcagtggtgcaatcacagctcactgcagtttcaatggcctgggctgtagtgaccctcccacttcagcctcccagtagttgggactacaggtgcatgccaccacacctggctaattttttatattttgtagagatggagtcttgccatattgcccaggctggtctcaaactcctgggctcaagctatcctcccaycttggcctccaaaagtgttaggattacaagtgtgagccacygtacccagccaaattyttatgttcttttatcccctcacktatcataaacaatttagtcagcttgttttttagcctgcagtattgaatgacatagggcttcccatgtgctaggactttccatgtgtagaaaatgcaatgaagagtaaaagaatagtgaagccacctccctactttcctggagtatattttcttgttgggaagaagactaaaaacaataaaataagaaaacaaaattctaaaaattataatatataaaatggtagttaaatagggatgttatggagaaaataaaacagagttatatgataaattagtacagtggaaggagccgggatgacgaatcagtgtctgaaatgatgaggtgtcctaaatttccaaaccatccgcttaaataaaatatcccaaaattcagaaagaattcagaaactcagataaaagtacatatttgacatactaagacattactgatttaccctattctgtctattaaagcaaggcatgatttttttaaaccttttttttcttattggaaaatgtttactttaatttgcattgtgttaaaataacttacagaaatcaatttggatattttatggtgagtattatggtgaagaacattcaatacctgaggaaactcaagtatccaacaaactcaacccttacagagacacatagagctgaaaataaatatataaataaacttaggaaaaacacaagtaaaattcaagcatgagaagttaatcattgtttgatgtactaagtcttttatgtacacataattccgataaacttgggtatctcttcctaaattcatatcaaattagaagcatcaagtgcttttagggaaggaactgttctaaacagaagaaaagaaggaagaaatgatggctaataatytggaagaaagaaaaaaagcctctttggcaccatttaatctgtgtaaaaagagccttaccaatgtagtctgatgacaccactggaaatttggtattggtcctgatgataacagtcttgaatcaccaagaaacatttacattgctaaagatgatagttcatgactattaaagttcatagatttccttggaacttatggtctctgatggccaaaattttgtctgtcttgaacctcattgtcaacycaggaatcttactatgcctgatttaaagtagacaaccaaatgggtgtttgtaaaaaaattaaaaaaaattactttccaaattcattatgaacrtagctacctggatggtccaaaaacactgtctttgggcttttgcaatagactgtaatttaggtctcacaacagttagttgcctctcaacaaaagccttacagatttaaattccatccaccttagttatagtctttctaaaagaaaaaaaattatattcatagcactgtcgcaggtcactaatatttcagtcatcttaagtgaaactctaatagaacttaaaagctcttgttttctttctagaaatcttttgtccaaatcctccagctatccttaatgggagacacacaggaactccccytggagatattccctatggaaaagaagtatcttacacatgtgacccccacccagacagagggatgaccttcaacctcattggggagagcaccatccgccgcacaagtgaacctcatgggaatggggtttggagcagccctgcccctcgctgtgaacttcctgttggtgctggtcagtatccgcttccacatatcctaaatgggttcagaatatgtaggtgagaaccttcatatttctatagtgacagtcatttttgcttgtgaaaatggctttgctgtaactgtcagagacagaactacctcccaagtgaatgacaaatgggttctagataggcacactgtctcaattattggtattctgatggcctttggggtgaggagggtgggatggtaaggagagaagagggtggacagtgaagagaattggtgaggtccagattttgtagagaaatttttgaaagtactgaaaacaaatgctaaagaatgtactcttttattctacccctactatgagttgtctttatcctggagagatggatgtgctgcgcaaaaagtacatgatgatgtaatttacttcagaactgataacgctataaaagtaatttaagaaattcagatgtagggatttatactttttatgttgtttccaagggtttgttcaagccgctgactatatttagttggtccttcacctcaccattaacaaagggaactcgggaggccctggagaagcagagtctgagactgtactcttagccttcatagctccttcctttgatatattactctggctttaaacgacagtacttgacaaccgtagatgcatttgtggctgtgactgcccacacaagctccatcctccagtaaggacagaagagcattgaattataaaaggtgttgactttttaatgtgttcttttgagatggagtcttgcactgtctcccaggctggagtgtaatggcacaaactcggctcaatgcaacccccgcctcctgggtttgagcaattctcctgcctcagcttcccaagtagctaggattacaggcacccaccaccacacctggctaatttttgtattttttagtagagacagggattcacaatgttggcccggctggtctctaactcctgacctcaggtaatccayctgcctcgactttccaaagkkgtgggattacaggcatgagcctggtgctgacttttttgacctgttggctaattggacttagaacttctgtatgttgaaaaaatgactataaatcatgctgctataaagacacatgcacacgtatgtttattgcggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaacatcattctcagtaaactatcacaagaacaaaaaaccaaacaccgcatattctcactcataggtgggaattgaacaatgagatcacatggacacaggaaggggaatatcacactctggggactgtggtggggtcsggggaggggggagggatagcatygggagatatacctaatgctagatgacacgttagtgggtgcagcgcaccagcatggcacatgtatacatatgtaactaacctgcacaatgtgcacatgtaccctaaaacttaaagtataatttaaaaaaaaaaacattaaaaaaaaaaaagaaaaataaataacacagtagatagatgagaaatatatgggaaacacagcaaagggttaatagtgttatcttacaggtagcagtagtggtggttgtgrtactagttgtaaaagttaatatataatgaatacttagtaccactgttagataggctggacatggtggcttatgtctgtaataccagcactttgggaggctaaagtgagacgatcacttgagcccaggagttcaagtgcagcctgggcagtatagcaaaactctgtctctacaaaaaataaaaaaaattagctgggcgtggtagtgcatgcctgtagtcacagcttcttgagaggctcaggtgggagaatcccaagcctgggaggtcgaggctgcagtgagctgagatcacaacactgcaccccagcctggacaacaaacaagactctgtctcaaacacacacacacacacacgcacacacacaagatagcttctaatttaattacacaacaacctatgaggaggatagtattcttattgtctcattttataggtgtagaaactgagacacagagggtttaggtaacttgcacaagaccacagaatggggtagcctgggttcagccaagcaatctacttatctgtagagactgtgcwctttaacaataaataaatggtcaacggacctaaatatataattcaacaagagagaatatttaagtactgtcataatgaaatggaaagctatcaggcaaggtcccaaacaccagataatgggcaattcttaagttggatgaaggagatacatacaaagaattagaatgggccaaataactattaaccagcaggttcttggaactcagagcttagtgtaaactcctcgtgaattgggctgaaccacataggaactccttttgtctctctgaactaagactcagactaaaagcagtcccctttgccttcttgttcctagtctctttaccctatctagtcttggcctttgacatcttactgctttgtagtgagaagagacaaagaaaatttcatgatcttagagactatcgaaacagaaaaaattaaacccagtattttttccctaagayttgggatagattgcttaagataccagtcctaggccttcctaaaatggaagatgaggaactaacctggggyggtggtccaggcttggagtgacatgccatagagggttttgagacagaatagcaatccaaagagaaaaaggaacctttgagtactagcatcagagcaggaagaatatcttgggatactcagatcccctatctccccatttcaatggcccagttacatcagaggcctgattcatttcaaaaccttcctcagagcaaggggtaattgccaggtaccctttaaagccagaattaatacatataacccatatttaygctgtctcaagactaattarcatggtgttgcatgctagacaaataagttcaactccagaaaacatgtaaaaactaacagaagtttcaacttgaatatcttaagagaggcttaaagaaaaattaaactatgtgacactcattaaaatgtccccaaatcctctttacccatttccattacccagtgtcccattcattaaagcaactgctttcctagagcctagcttctctcagttccacccagactgtctctcaatagtctccccaccttctggaccttcttagttcacaagaagtctccatgccatttctaaggtaaatggagtttcttcagttctgcatagttcgatgcaacacagccttgaaagtttctgcagggaaatgcrgaaactatcttaggatgcaagatttagagaaagggtgtaaatatctttctactttggcacataaatatacagaaactgtttaacctcactagaactaaagaaatgcaaaaataacaaagtaccctttttttttattatactttaagttttaggatacatgtgcacattgtgcaggttagttacatatgtatacatgtgccatgctggtgtgctgcaaccactaactcgtcatctagcattaggtatatctcccaattctatccctcccccctccccccaccccaccacagtccccagagtgtgatattccccttccgtgtccatgtgatctcattgttcaattcccacctatgagtgagaatatgcggtgtttggtttttcgttcttgcgatagtttactgagaatgatgttttccaatttcatccatgtccctacaaaggacatgaactcatcattttttatggctgcatagtattccatggtgtatatgtgcmacattttcttaatccagtctatcattgttggacatttgggttggttccaagtctttgctattgtgaataatgccacaataaacatacgtgtgcatgtgtctttatagcagcatgatttatagtcctttgggtatatacccagtaatgggatggctgggtcaaatggtatttccagttctagatcgctgaggaatcgccacactgacatccacaatggttgaactagtttacagtcccaccaacagtgtaaaagtgttcctatttctccacatcctctccagcacctgttgtttcctgactttttaatgattgccattctaactggtgtgagatggtatctcattgtggttttgatttgcatttctctgatggccagtgatgatgagcattttttcatgtgttttttggctgcataaatgtcttcttttgagaagtgtctgttcatgtccttcacccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttttgttgccgttgcttttggtgttttagacatgaagtccttgcchatgcctatgtcctgaatggtaatgcctaggttttcttctagggtttttatggttttaggtctaatgtttaagtctttaatccaycttgaattgatttttgtataaggtgtgaggaagggatccagtttcagctttctacatatggctagccagttttcccagcaccatttattaaatagggaatcctttccccattgcttgtttttgtcaggtttgtcaaagatcagatagttgtagatatgcggcgttatttctgagggctctgttctgttccattgatctatatctctgttttggtaccagtaccatgctgttttggttactgtagccttgtagtatagtttgaagtcaggtagtgtgataaagtaccctttttttaaattgtccattaaattaacgacaaacaggtttttatgtgaacacccaataaaaagtaaggatgtaatgtaacgaatattgttgtatattgaaggtactattgtaaattggcaaaatctcttatgaaaaacaattatgcaatgtgtgtggacaataatacaaatattctgccagttagcctcctagaactgcaacctaagaaaatagtgtaaaatataaaatagtttatgcattttattaagggtttcatgagaaagaaaactagaaataaatgcacaatagaagtcattgaatatactatgatgcatctactagattatattagtttgcctttgttgtaacttatatttctagtatataaatatgtgaaaacataccagaagagaatgtatcaaaacacattttgggtactaggatttggggtgatatttttctttagttctgtattataagttttcttctgtaattgtattacttttacgagaaaaatattaatttttaaagtcttcttggcagtggctcgcgcctgtattcccagcactttgggaggctgaggcgggcagatcacgaggtcaggagattgagaccatcctggccaacatggtgaaaccccgtctctactaaaaacacaaaaattagctgggtgtggtagcacgtgcctgttttcccagctacacaggaggctgaggcacgagaatcccttgaacccaggaggcagaggtcgcagtgaggttgcaccactgcactccagcctggcgacagagtgagactttgtcaaaaaaaaaaaaaaaaaatcttctctgagtgcagaaggtaaaatgagagtatatgagtgaaatcaatggctttttataaaaaatattagtctgagtcctgaataaaaatcaggataaattgtcactggctgagaagtcctgttcaatcatgttgcatgccagagtgatgtttttgtgacttttgtcttccttttaggttcacatgatgctcttatagttggtaagttttatgaagtgtttgctgaggaattctgtcatctttaacagtaagtacctacttataatgaatgcaatgtagaaagagagatcaaaatatcttgagttataaattcaaatagaaagaaaattatgatgagtttaggccaggatatggtgaaactggcatcgtcatatgccaggttattgagtaaccttcctcaaaagttctttactatctttgaaccactacaaatgcataatcgttcaacagtgtcaaaaagtatttatttgaatgtggtgggagaatgaaacttcttctttgggttataacctggagtatgcttccagatggtgattgtgcccatttgtacaaatagaaagctacaagaccagtcttccgagcccatgtctgtgatctgcctatgtaagaagaatagttttgtaatagagtttgcttccaagggaatctctatggcatagtattcttacatccctttttatacatctggacactgagacacggagggtttaggtaacttgcccaagaccacagaatggggtagcctgggtctaagcaggcaatctacctatcagtggagactgtgcactttaacaatcaataaatggacaaaaggacgtaaatatataattcaacaagagagaaaattccagtattgtcacagtgaaatgcctgtgtgttaagccttaggcgagagacatgggcagggccatggagagccagtggccagctgtcccatcgcacttctcacttacttgtggaaaggctgatggtggactaaaggttacaaaagaggtcagctcaccccttaactataataaccctgtgggagtgagactaatgctatagaaacccagagtaaagcagaatgtatagttacatcttttaaaaaaaaaagcattggcaatctgtagtgggactggatactaagatagaatttaaaacctgtgagttatattttccacgcatttaattaccttgttttactgcctaggcactttacttggtacgatcatctttattttaatcatcattttcctctattggataattttcaagcacagaaaaaggtaagtatagccatattatcccaagaaatgtaaactgtacttaccccctcttggaagtcaaaagaaagtaaaagacaaacaaacccattgctacataaacagatgtggtaattcttataaagaaggtccttgacacacagtatagacaaagaggtattcacactaaaggaagtatataggatactaagaacaattaaaaaataataataataacaaaaaaccagcattttggccaggtacagtgactcatgcctgtaaattcagcactttgggaggccaaggtgggcagattactagaggccaggagttcgagaccagcctgggcaacatggtaaaaccccgtctctactaaacatacaaaaaattagccgggcgaggtggcacacgcctgtaatgtcagctgcttgggaggctgaagcacaagaattgcttgaacccaggaggcagaggttgtagtaagctgagattgagctgttgcactccagcctgggcgacagagtgagactacatctcaaaacacacacacacacgcacacacacacaaacacatagcattttaagcaagaattgagttttacagaaagagaaagtaggcagaaggggtttttaaaaagttgttcatgaggctgtttgatatcctagttttgctaagacattgcagatactgacctctaagcccagatcctatcatagcactagaagttagattgggtcacttatggcacacataggctgccagtggggaagaactgagactttccattgggtattttaatatatgaacaaatattttgtaattacaattaactttttttttttttgagacagagtcttgctctgtcacccagcctagagtgcagtggtgcgatcttggctcaatgaaacctctgcctcccgggttcaagggattctcctgcctcagcctcccgagtagctgggactacaggcmtgtgccactacgccaggttaatttttgtatttttagtagagacagttttgccatgttggccaggctggtctcaaactcctggcctcaagtgatccacccgccttggcctcccaaagtgctgggattgcaggcatgagccaccatgccaggctaccattaactttttacacttgaaaaaaaattccaaaaattaagatctgagtaaagaaatgtctttgacagggaagagaacatacgcagcttttgtactggttgactgaaatataacaacatcaatgaggccagaatcaataatatcaatgttataaggttgatgagcaaattctatayccataaaaaactgagggccaggctcggtggctcacgcctgtaatcccagcattttgggaagctgaggtgggcagatcatgaggtcagaagttcgagaccagcctggccaacacagtgaaacccccatctctactaaaaatacaaaaagttagctgggcatggtggcgtgtgcctgtagtcccarctactcgggaggctgaagcaggagaatygcttgaacctagaaggcggaggttgtggtgagctgagatcgcaacactgcactccagtctgggcaacagagcagactctgtctaaaaaataaaaataaaaaaactgaatttgcaacttttaagtgaacagttttctayaggaaatattctaaacaagtacagtttcctacaatgagctttacagcaatcgaagttttcgtatttcacagagatttcaatacactttttaaaaagtagtttgtcatagtagatcttgctgtaaacaacctagtcaggaactcaatttcatgggaaaatagtgaattggttgacatttaaatttaaatcattatccttcctaactaatgttctctatatcgtatggcttgacatatagatgttctttgctcttttctattacaaaaagaaaagataagtagctgggcactttaccttaacaaagtacttgtgtcaatacatttttctcttaaagtttcttgttaggtaccactataatttgtgagttatttttattttttttttgagacgagtctcgctctgtcatccaggctggagtgcagtggtgcatctcggctcactgcaagctccgcctcccgggttcacgccattctcctgcctcagcctcccacacagctgggactacaggcgcccgccaccacacctggctaattttttgtatttttttagtagagacggggtttcaccgtkttagccaggatggtctgatctcctgaccttgtgatccacccgcctcggcctcccaaagtgctgggattacaggcgtgagccaccgtgcccagcctatgacttaatttttttttttwaatttactaagtctgaattaaagaagttggggcttctaattttctgtatctataccagtctctmgttgaaactacacaagggaaatgattatctcttccttttgaaaatattcaagatactttaatatgttgaagatatttgagtatctccacccttctaactatgtcattcttcattccttatggcacattccttgttaatcaactagagggtcagattcccaagcctaactattgatttgtttcacctacataatttaagatcatttcctcatattaatcatcttcaggcataaacatgactcaataaccatttcataaaattawttctttagaaatgattatcttgtatagtttaagcaacctcagagcatataccatttcttcacattttccatctcgtaaaacctgcctactttttcatattcttttaaagtgtaatgtccatggcacaaccattctctctctgaccagtggctaccagaaatgtggcagaaagaaagatcatgatcctcgttagacttaaaggtcagggaggtaaacctcccaaacatctatgtaacccacactaaaacctattctatatgtgtaatccaggaaaatttttaaacattttctaaacttttatttttgacctgtttcacttcttgggattgtaactgtctgacgtgttcttcctgcctgtcatacagacaaaaccaattccctgagatcatggtatattgcagtaaagaaagagatgaattaacacaaggccagtcacgtggaagaactggagttatcactcaactcagtctccccaagaacacaggggctagggtttttatagatcatttggtaggaagggagctagggaatgggtactactgattggttggggatgggggtgtgggaaatgttcctcatgtgctgtgtccacctctrgttgggggccacaggaccagttgagtcatgagtcacaggtccaggtagagtcagtcagttgccaaatgcaaaaatctgaaaaacatctcagaagaccaatcttacattctacaatagtgatgttacctataggagcaattagggaagtcacaaatcttgtgacctctggccacctgactcctgagcagtaatgaattataagaactatgcctatattttagcagagttcaggtccctctcctaatcctaatcttttggcctttcattarctttcaggccctgagcaaggagggagctagttttaggaagagactgttattatccttgctccaaagttamattataaactaaattcctttcatggttagcttggcctacacccaggaatgagcaaagccggcccacctgtgaggctggaagcaagrtgaagtcagtcacgttagatttctttcactctcagaatctttgcaaaggtggtttcaggatagtgagtgcatttctctaacaaaacaccattgattttcatgttagaaataacatatagctaaaattggaaaaaagaagtaataaacttaaataatcagaaggcagaggtcccttcttttggaaggagttgggctaattaatcatgcagtcatacctccttgagtgggtgtggccaataagctaagtcattgtggctatgtgaggagggccaattattccttatctggagctcaagctttcctcacagaaagagaagggcataaagggcctcatggcaaagaagaaggaagtcatgtgggaaacacagaatatgagtggagagtatcgtagtggtcatcaagtaagaagagccgtttatcctggagctaaaaaagactgacagatatagaatagtgtagaacaagatggcctgctctatgggagagccrcaatcacaccaggactagacagtagcaggctgatgtatatctcaaacactggagacaattcagaaactgcataarcagtctgaagacttactaagaaactaaaatgaggctgggcgcggtggytcaggcctgtaatccctgcatttagggaggcctaggcgggtggaccacctgaggtccggagttggagaccagcctggactacatgataaaaccccatctctactaaaaatacaaaaaattagccaggcatggtggcgggcacatgtaatcccagctcctcaggaggctgaggcaggagaatcacatgaaccagggaggcggggttgcagtgagccaagatcgtgccactgcattccagcctggacaacaaaagcaaaattccctctcaaaaaaaaaaaaaaaaaaaaraaagaaagaaagaaagaaaaaagaaactaaaataagacagaaatagaagtaattcacacacagaaatcatctcaccttctttaaaatgctcctcaaggaggcctactttaacgatcctagtaaagatggtatgactcgtatgacccccacccccacattcccaatctttcttatcctgctttatttttttgtatacttatcgtttattataattaattaaataattaagtttcttgtttattgtctctctccctccatgaagtcggggatttttgtcctgtcttcaccaatggatacataacaaatctaaactgtccccggaacaaagagagtctcaataaatacttatcaaatgaatgagtgagctaaacactactaagagtgttaccacaaggggaaatttctgctctaattaattctctaccaagttaaacagtgcatctttaacttgtcctaagcttactccaggtttcaaggctgctccttgtactaatataccaactgtctcagtctgttggtatagatacttgggcagttataacagaaactccatagactgggtggattcaataagcatttaagctgggtgcagtggtactcacctatagtcccagctactcgggaggctgagggaggagtactgcttgagcccatgagtataaggccagcctgggcaatatggcaagaccccgtccctaaaaaacattatttcatttctaaaaaccaagcatttatttctcatagttctggtgggtagagcgtccaagatcaaggcaactgcaaattcagtgtgtggtgggactcactttctagttaatagacttcaatcttttctttgtgtcctcacctcagagaaaagcagtgagggwgctcttgcgggtctcttttctaagggaactagtcccattcacaaggggtctttgagaagtaattagatactataaattttcaacatataaatttggaaggattcaaacattcagtccattgtacaaacactgaatttgataagcacatctgcttaaatgatatcacaygtgttgatttcatgtgcttttccacctttgtttstaaattccgttaacccatctctgaattcattcaaccaagactctctcccagacaactctagtccaaaataatgtctgtctttgaaactcacatttcctgactatactattttaaaaataaactgggaggagccaagatggccgaataggaacagctccagtctacagctcccagcgtgagcgacgcagaagacgggtgatttctgcatttccatctgaggtaccaggttcatcccactagggagtgccagacagtgggcgcaggtcagtgggtgcgcgcaccgtgcacgagccgaagcagggtgaggcattgcctcactcgggaagtgcaaggggtcagggagttccctttcctagtcaaagaaa

SEQ ID NO: 13462 - DNA, 27902 bp, Homo sapiens
agatcaaggccatcgtggctaacatagtgaaaccctgtctctactaaaaatacaaaaaattagccgggcgtggtggcgggcgcctgtagtcccagctacttgggaggctgaggcaggagaatggtgtgaacccaggaggcggagcttgcagtgagccaagatcacaccactgcactccagcctgagcgacagagtgagattcagtctcgaaaaaaaaggggcaaatgttccgtttttcaaagtgagacacagcttcaataataccatcccatgtcaaattaatcccattttacagggctaccaggctgagattaaattgtaaaaagaaagtattttaattaagaaaggtatctgataaagttattttgaatgtttatagggcaagatgaagaaatgtgaattagaatacactataactgggttggacgcagtgactcacgtctgtaatcccagcactttgggaggccgaggtggatggatcacctgagatgaggagttctagaccagcctgaccaacatggtgaaatcccgtctctactaaaaatacaaaaattacycrggcgtggtgacctgcacctgtaattccagctactcaggaggctgaggcaggagaattgcttgaacctggggggcagaggttgcagtgagctgagattgtgccactgcactccagcctaggcaacgaaacgagattccatctcaaaaaaaaagaaaaaaagcaaaaaaaaaaagaatatactataaccgatattacaatgaacattatgaaattgctgatattttgctacttttataggttcatactcaaatttatatttgattacccatatataaaaaaactgacttaagaaaaaagtcaattagaggatagtcttaagtagaatatgctgaagtgcatgccctcaatccttggagaagactgtattttaagaatggccacacctacatatttatcccatcccacatgtttttcttacgatgtcacgcatactcttttcatgaagaggtggggactgcatttcccccaaccacatcagatctgtatgggtgccttgtgtccactccagccaatggagtgtgctatgagacttcagaggctagatcattaaaagaatacagactccaattagctttctttctctctcccgggatatctgcccttagaacccagccacacattgtaagaaagccagggccataaaaagaggccacgtatggtgttttggacaatggccccagcaaagccctcagcctgcagataccattaacaacagacatataagcgaaggagtctgaagatgactccagcccccagtctgaatattgcagctgaggccccagacattgtacagcaaagatgaatacgtctgattgtgcctgcctatctatagtcttgtcctatacaaatcatgagaggtattattatcattttaagccttgaagatttggagtatttgtgaggcagcaacaggtagctaatgcagtcctgttattttcaacattttaatcaacaacttgggaaaagacagacacacatgcttatcaaattagcagaggacaggactacaaacaactgccaacacttcggatgaaaatgttgggatttaaaattatgctgaaagagtagaacaccaggctaaaactgataaaatgaaattagcaacagaggaaatatatcctatttaggtaataagaaatatacattgggtgagggagaactagtttaagagtaactcatgtaaaaaccacctgagaattttcactgatcactagctcaacatgaaacaagggtatatctcagctaccacatagttacgtaactttataaaaatgatgttcagatcaaagtaagtatgagtgccactgyagtcagaytggttttggtatattacgtttatttttttcataaagaaacttttattcaaagacaacaataacctttataataaatatgcagtaactatcatttttataatgcttactgtaggccaaacactgtccaaatatttcctctatattaacttatttttggttgttttttgagatagggtctcagtctgccaccctaggctggagtgcagtggcacaatctccacacacygcaacctttgcctcccgggttcaagtgactctcccacctcagcctcccaagtagctgagactttcaggcatgtgctaccaagctcagatttttttttttggaaacagggtttcactctgtcacccagactggagtgcagtggtgcaatcttggctcacygcaacctccgcctcccaggctcaagcgaktctcmwgcctcagcctcctgagtagtggggattacaggcgtgcggcactaccgcctggctaatttttgtatttttagtagatacggggttttaccatgttggccaggctagtcttgaactcctaacctcaaatgatccacccatctcggcctcccaaagtgcttggattactggcatgagccaccatgcctggcctctatattaacttctttaatcctcactaataaccctaggaggtagtggcctttattatcaccatttcatagatcaggaaattgaggtacagaaaatgactgaccaaggtcctacagctagtaagggggacagctgggatagtattattcatacayacacacacacacacatacacacacacacacacacacacacacgtacacataaatatttttacgagacagggtcttgctctgttacccaggatagagtgcaatggcgtgaccatggctcactgtgacctcgaggtccagggctcatgattctcctggctcagcctcctgagtagttgggactagaggcatgatatggtttgaatctgtgtccccacccaaatctcatgtcgtatcataatccccagtgttggaggtggggcctggtggagaggtgattaaatcatargggtggatttctcacttggtactgcctcgagatggtggatgaggaatgagttattgtgagctctggtcatttaaaagtttgtagcaccttccctttctctctctcttcctcctgttctcgctatgtgagatgcctcactccccctttgtcttctgccatgactggaaacttcccaaagcctccccagaagcagatgccaccatgcttccgcacagcctacagaactgtgartcaattaaaccttttctttataaattacccagtctcaggtatttctttatagcagtgtgagaatggactaatacttggctaattaaaaaaaaaaattgtagagatggggccttgctttgttgcccagactgaattcctggactcaagttattttcctgcctatgcctcccaaggttctgggattacaggtgtgagccaccatgtccagccagtattctattttaaatgtaatacaggcaactaagagaagaatcagtagggtaatcagcatgcacagggttaaaaaccagatcctatagaatgattagatatctgggtaactgtaatttggggacraggacttacagacacaggaaagcagcccttcaatacctgaagagcatgtagtatgaatgacgtaaaatttaacaagatttaacaaattttctcctattcatttactgaagaaaaaaaaaaaaacccacacacttctttccttccccattttaaagttattgttagtattgatatacagcatttaagattactgacttaaattactgacttagcatgtaagatgactgttacaactcaaattatacaaaaacagattatcaagaatatttttattaaaatcaatttaagatattattctctcgattatcctagaaagaatatatgaacataataattaaacataagcttaattatataataatataaaaatatataaacctaatttgtgaagttagaagatagggtatttcatgaaccttacctgtagattcagtggtgaggaaaataaacaaggcttgcactasccaagtctgcaacgtcaacatcttgcgcggatatttctgcaacagacacatgtaatattacttttaatattttttctcttatatacacataatttaagacacaatcttgtttccatgctgtagctgtgtttctaaaaggtggtaaaattcttatgagaatgtagaaaacttaagtcttcacattatttttctttattcccactgaagttatggctatggaaaacactgctagaaaacataatttatactttaaggttaattaaaagagatatcttgtttctttcttatgtgaagtcttatattagtaaataactgtgagattaagaacttcagactgacaaatttctacatggcaaaactcaccataatatgtatccttaaaagatacctgacaaatggaaaaaaatgtttgtaattcatagcatggccaaaaattttcccgatatataaagaatgcctacaaatcactaaaaaattctaacacctaatagaacaggcaaacatatttgartagtttatagaaaaggaaatacaagtaaatcaagcatgtgaaaagatactttcaacctcactcaaaatgagagatataaattagaactactcagataggaacgcaaaatgatacagacactctggtaaacaatttgatagttcgttaccaagttaaaagcacaccataagacttggtatttccactccaaagagcgtactccccaaaataaaaacatatgcccacaataagacttatactcaaatgttcacagcagcttcattcataagtcccaaactggaaacaatccaaatgtccaccaactgctgaatgtataaacatacattcaaacaatggtagagacatataatagaatactactcagcaaacaaaaaaaaaagagtatgaactggtgatacatgcagtagtatgaatgaatctcaaaagcattacactgaataaacgaagccagacacaacaggttatacattgtataactctatttacaggaaattctttttttttttaagagatgggggtctcactatgttgcccaggctgtctcaaactcctgggctcgagcaatcctcctgcctcagcctcccaaagcactgggattacaggcatgtgcctcagaaattcttgatacggcaaaactaaggtgacagaaagcagatccagggttgcctagggctgaggtagagaaggcacacgtaaaagggcataaaggaaatctggggtgataaaaatactctatgacttgattgtggtggtgactataagactctatacatttggcaggacgcgatggctcacgcctgtaatcccagcactttgggaggccgaggtggrcagatcacttgaggtcaggagttcgagacgagcctggccaacatggtgaaaccccatctctattaaaaatacaaaaagtagcttggcgtggtggcgggygtctgtgatgccagctactcgggaggctgaggcaggagaactgtttgaacccgtgaaacagaggttgcagtaagcccagatcatgccactggactccagcatgggcaacagagcgagaccccgacacacacagacacacacacacacacacacgccaggtgtggtggtgtatgcctgcagtcccagctactcatgaggcttgaggcaggagagctgtttgaacccggaaggcaggggctgcagtgagctgagatggcaccactgcactccagcctgggcaacaaagcgaaattctatttaaaaaaaaaaaaagacyacatttgtcaaaattcactgaattctgtgtcaactgtttcaaaggcactgagattttaccttactttcaagctaacaagtcagcctaccacagtgtcatggatactggcaaaaggcatgacatttttgcgtcagaagcaaaggactgtattactcataacagtagtcagagtatcagcattttcttgcgccagctgcttgagtcccaactgtcacagggcattgtgaagtcagatgacacctgaacaggctgcttcacaggaaagaaagacagatcttaagtaaccctaaacttgaaaaatatgcaggaagcatgtctgccatttactctagagggagacattatctgtatctttgaagactgtaagtaagcctgtcctttgctccacggctctgagagtctaccttccaacattctttaaaaggtaagttggctgggcatggtggctcacgcctataatcccagcactttgggaggctgaggcgagtgaatcatgaggtcaggagttcaagaccagcctgaccaacatggtgaaaccctgtccctaataaaaatacaaaaattagccaggcgtggtggcggccgcctgtaatcccagctactcaggaggctgaggcagagaactgcttgaacctgggaggcggaggctgcagtgagccgaggtcacaccactgcactccagcctaggtgacagagcgagactccgtctcaaaacaaagttcagaaaaaaggcagccatcagggtttttgctgataagaaaygcagaaatgttagactcatgggtttcctatcaagttgtaactaaaaaatggtgaattttattgtttayaaattagaccttaaaaacaaacaaaatctgcccagataaggtataaccaaaagaaacgagtgcttaatacctccaaagacatctacaagaatgtttacagaagttttattcaaaatagatgaaaaataaaatcaaccaaatatctattaacactaggataaattatggtatattcaagtaattgaatcacagcaatgaaaaataacaacagatacatgcatcatggatgaatctcatatataatacagaatgaaagaaatcagacaggttgggtgcagtggcccacacctgtcatatcagcactttgggaggctgagggggaagaattgcttgaggccaggagttaagaggccagcctgcacaaaatagtgagaccctgactctacaaaaaaattttaaaagagaaaaaaggcaagaaagtacgctctgcatgatttattttacagaagttcaaaaagaggcaaaagtctacggtgtttgktgacagaggtcagagcagttgttttttgtgaggaagggtataaaaggggacattctgggtgctgagcatgttctgtatcttgatctggacagtgataaattcactgagctgtacacttatgagttctgttttgcagtatgtaacaaaaggtaaacaaaccaaaaattatcccaataccattcttacatattagtgttggcaaaaatataaaaacccaaaaagtatcaacagggtgttgtgagactaagcaacgaaagtatcgtcacacactacaggttatagtgtaaattggcataagcttcccaatacattgaacactttaaaaatggtcagttttgttgtttgtaaattagacctcacttaaaaacaaagaaaaaagctctacccaaacaaggcagagagccagttcggcaatatcaatcaaaattaaaacacacacatttgattctaatgattctactttattttatcctacagatatgaataaaacaacacatgtacaaagttattcactgcattgtttttaacagtaaaaggctgaaacaacctgattatgatgggacactagttaaatgatggtataccaaaaccatgtaaatgtaaatacttgtagccatttaaaaaaaatgaggaagctctatatgtacagaaacataaagttatctaaaatacattgttacattgttaaggtacagaacaacgcatttgctattatttgtgggcaaaacaatatacaagaaaacaaaacacacattcgttttttwatatatgcacagtatctctaggaggataaaagttcaaatactggctgtgacagggtatttgagagatcagggtggtagggagacgctccaccatatactctgcagccttgcaatgttgaccatgtgaatctttagtacttatgcaaaaaataaatttaaattaaaaaatacttaatgtcagctaggtgcagtggctcacgcctgtaatcccagcactcagggaggccgaggtgggtggatcatctgaggtcaggagttccagaccagcctggcctacatggtgaaaccccgtccatactaaaaatacaaaaagtagctgggcgtggtggtgggcacctgtaatcccagctacttggkaggctgaggcaggagaatcacttgaacccgggaggcggaggttgcagtgaacggagatggcgccactgcactccaggctgggcgacagagtgaaactccgtctcaaaaaataaataaaataaataaatacttaaggttcaaactattgggtactatgctcaccaactgggtgacagttcaatcgtactccaaacctcagcatcacacaatatactcatgtaacctgtacatgaactccctgaacctaaaataaaagctaaaattattaaagacaaaatacttaatgtgtaatttttttcttctaaataaaactattaactcttcttgatgagaaatggcttcctagttctgcacttggaacacaatattgttttattaaatatacatactaacttgattttatgcactccctaatcatgtaacagcttgccagcatgcccagctaattttttaaaaatttttctgtaaagatgggggtctcactatgttgcacaggcaggtcccaaactcctggtctgaagcaatcctccttctttggccacccaaagtgctggaattacaggtgtgagccactgtgccaagccaaatgtactatattcttgcaacaaagctgctccagaacaagaggtccatgaaagaatttatgattacttcaaagcaattagatttgtttgagtagtaccatggaacacaagcaaagcgaactaggcaaaggtagattccacatttcacatttagaaagtaatctttcctaatttttaaaagattgtaatggagaggtgatgaagaaacatctattatgggacttgatttcatagtccaaatctaagagatgaagacacagtaacactatataaaatattatatgcaatacagttaacttcacttggggcttgcttaaaaattgacagaattatggccgggtgcggtggctcatgcctgtaatcccagcactttgggaagccaaggcaggcggatgacaaggtcaggagttcaagacgagcctaaccaatatgatgaagccccgtctctaataaaaatacaaaaattagccgggcatggtggcgcacacctatagtcccagctactcaggaggctgaggtaggagaatcacttgaacctgggaggcggaggttgcagcgagccaagatcgtgccattgcactccagcctgggtgacagagcgagactccatctcaaaaaaataaaaaaaaaaattgacagaattgacagtagtttgcttattttttccctcctttccttctgttgatactaatatttaatttaaaattatattaatagcactattacctcacctcttgcagagttttctatgcatatattataaccatacattgcatacactaaccttccttgaaatttgcaggtaacttgagaagcttctatgaagccaaaacctaactagtaaccataaatacaggaaagattatttctgaaaaccaaaagctgtaatcattcctcaactatggtgatataacatggtagtgtgccgaaaggagctagatgatgtataacaagtattgctacttttaatgttagagaaacaaagttcataaatgatttatttaaaatagaataaattcaagattatccctatagttgttcattctcatttactttcatttccatatgttttctcaagtgagagaaaaagcagtagagttacaatggataaatatttaatggttaggctctttataaattatttttgtcacctatggattgtgatttttttttcattttctaacttaacctaaggatgaaataaaaagcacgaatatatttagatttacattgcatgtgaaaaagaatgtcaatataaactttgttactatggtaacattactattacaattgtagaacagtatatgaactaaaattgccaaatagaaggcaaaataatgcttgttgaattaataagttgcgtggggatcaagatgaagaaaatttctatatatctttcacagtacartgttactgtgaataaactgccagaagttggtaatacctacacaaaattaactaattattaaattagtttttaaattatccactctgttctcttccattagtatcaattatgagttcataacaattaacactaggatattattttacattacacaaaatgttgtcacataaattatttcactttagtctcctaatatcctaaagaatcaggtgagtagggcagggattatttattggaactttgtaaaataaaaaaacaaaaaattcagacaagatcaattacttacccaaatcacaaaattagtaagtgaaggagtagggatttgaagctaagtcttctacttctaaatgtcatgctttttccattgggtttcactgtaaagagaggagagtcttgttcagaaggctggctttgataattttattatatgtgtactttaaaaatccccatctgctcttaggcttttgggtttgcagaaagtatcctactttagatatgttctgagcttcagaataaaataaacccataaacacttgtataagagtattcaaatattctagtgctttttttttttttttttgagacaatgtctcactcccatcaccaggctgcagtgcagtagcacaattacagctcactgcagcttgaacttcccaggctcaggtaattctcccacctcagcctcccgagtagctgggactrgagatggcaccatcatgcctagctaatttttttatttttagtacagatagtgttttgccatgttgcccaggctgagctcaaagggatctgcccacctcagactcccaaagtgttgggattacaggcatgagccaccgcgcccagccctagtgctatgatttgatatacgcttgcaaacattattggctcacccacacctaatgcaaacttccctgacgtctatgtaatgtcacagaaacatgacaggaacatttatgacagacggagttctttaacaatcacatatttcttcttctactagcactaaattaagcctgctaacaactattctatgtaaccagagataaaaatccattttaagatttgttcacttaaattctarcttaagtactagtgctcctctttgaaatacaacaagtaacttcaaacttaggcaaggagttgaatcttccattattgtttcatacacattaagcctttgatataacttaataacacataaggaattaaatttataaaaatattttttaaatgtctaatgaaaagaaactgaaaaaatgccatgtgaaagtgcactataatcccaccaagagataactaccatgaacattttggtggatattcttgcaaaattttttatacatgtattatataactttacattgtataaatatacacacttttctattttacaaagatgggatcatgtaagtgagaaatgttttataacctttttcacttaacactacatagtggacatcttcataagttaatatatakagagtaattccttgtagcctttgctcaaattcacctcctcatagagatcttccctaaccaccctgtgtttcttatacccctttactgattttttttttttctacaacacttaacaccttctaaaataggctagcaaacattttctgtaaagggccagataataaatattttagatttcgtgggctttaagttctctcttgcaattagttaactccgttattaaagtgcaaaagcagccatacacaatatgtaaataagtgggcataggtatattcccatgcaactttatttataaaaatggctgcaagctggatttggcttatgggctatagtttgccaacccctgttctaaatacaatataattaaattaattttctttttgtttgttatgggctgaactgttccccccaaaaaatatgttgaagtcttaaccccagtagcacaaaatgttactctatgggcagatttaattggatgttatagtggagtataataggcctttagtacaatatgactggtgtctttaaagagacagagccaggaagaataccatgtgaatacacaggcagagattggagttatgcagctgtaagctaaggaatctcaacgacgatggctaccaccagaagctaggagaggcaaaggaagattctatccaaagtctcaaaaggacttctagcctccaaaaccttgagagaataaatttgttgttttgagccacccaatttgtggtacaggttgaacatcccaaatctaaaaactgaaatgctctaattccaaaacgttttgagctctggcattttggatttcagattttaggatttgggatgcttaactttaagtatataatgcaaatacaacacaaactgaaaaaaaaaaatccaaaatccaatatacttctgttactaagtatttcaggtaagggatactgtaacaaagggatgctctattacagtagcccctaggaaactaacacatagtgtgtgtccccaaaatagaaggtaagtgaagagtggaatggctaggccctacggcaggtgtgtgcttggctatatcttctttgatgatgtgtctgttcaaacatattgatcaactgggtttcctgttttctcattaagttttgaaagttctaagaagatattctggcctttattagaaaatggatttacgcattattttcttgtatgcttgtcttttcattcttttaacagtatcttttgacgaataggaggtttaattttaataaagttcaattcatcaatttgtgtttttgatgtatctaagaagtctttgcttaatctaaaatcataaagggcccgacgcagtagctcacacttgtaatcccatcactttgggaggccgaagtgggtagatcacctgagttcagaagttcgagaccagcctgggtatatggtgaaaccctgtctctactaaaatattttaaaaattagccgggtgtggtggtgcacatctgtaatcccagctacacaggaagctgaggcaagagaactgcttgaacccgggaggcagaggaggctgcaagtgagcagagatagcaccactgcactccagcctgggtgacaaaatgagactccttctcaaaaaaaaaaaaatataaaaaataaaaataaagtcaaaaaggttttttcctacaagttttatagttttagggtcatttaggtctcagttatttcaagttaatatttatgtgtggtgtcaagctgaaatttgagttcattttgtatatacggataattgtttcaaaactatttgctgaaaaaattatcctttctcaagtgaattgcctttgcgtctttcttaaaaatcagttgttcacaggtgtgggtctatttggctactctcaattccagggtgggcaagcttttcatgtatgaggtaggaggtaaatattctaggtttgtgagccataaggtctctattggagctaccaatctactgttacgacacaaaagcaaccatagaaaatacataaacaaacaggggtggctgtgttctaacagtactttatgaaaacagaaggtaggatgactcctactctatttgttccactgatcaatttgcttatttatatgctaccaccacactgtcgtgatgactttagccttataaatcttgaaatcaatattctgtgtgcacttaaaaagcactgctgctgctggtagagtgttacataaatggtcattacgtgaatttggttgatagtgttcaaatcttccatatccttactgattttctgactactacttctatcattgttcaaaaagggatattgaaatccctgaatataactgtggatttacttctccttgcagtttttaccctgttgtgttttgaaactatgttatttggtagatccttttgataaattgacccttttatcattaggaaatgcccttctttaccactggtaacattctctgaaatctactttgatattactatagccaattctgtcttactttgattagtgttatcatgacatatcctctcccattcttttttgtttaatctgtatgtttcttcatatttaagtggcatctttagggggtaggcagcatgtggttgtatccaatctgataatctctgctttccaattgggtgttcagaccatttacatttaatataatttgtgatatgattaggtttaaagctatcagcttcatatttgttttcttcttgactgttctttgttcctgtttacttttctgcatttatttttcttaattattttttattctcttttccttgttagctaataagctataattctttgttttcttattggttgctttaggtttatagtgtacatctttaacttttcacaatctatcttcaagtaatattatgtyacctcaggcatagtatatwatagtatacttccatttctccccccagacctttgtgctattttagcatatattttacttttgcatatattaaaacttcacattggtagctcccacctgaaatcccatcactctgggaggccaaggcaggaggatcacttaagcccagaagtttaagatcaggttgggcaatatagtaagactctcgcctctacaaaaaataaaaagttagacagctgtggtggtgcatgcctgttgtcccagctactcaggaggctgaggtgagaggactgcttgagccttggaggtcgaggctgcagtgagttgtggttgcactactgcattccagcctgggtgacagagtgagactggcacatatttactcgtgtggttaccatttctagagcttttaattcctttgtatagatccgtatttccatctggtatcattttccttgggcctgaaaaactgcctttaacatttttttgtagtatggttagagaaaagtctaaatagatttgaaaacaaaaccaaagtgtgaatgctaacaagtatttagcctaaaataagcacagttcaaaatgagaaaagatactgctaattactatattaacagaccaaaggaaaatgacagggtcattccaacagatgtttgaaaagcatctgataacattcaacaactgttcatctaaaacttaaaaataacaacaaagtgtcagaaaactaagactgaaagagaccatccttaccttggtgaaggataacaaagatgatacagggactctagaaccagattgcttgtgttcaaatttcagtccctatattttaacatcttaggcaagtttttaaatagccttcacttttacttcctttatctgtaaacatggggtaccaccaccacctacccatctaggaatgttatgatgattaaataactcattatacataaagtgcttagaatcatttggctcattgtaactactcaataaaaggttaacagctgttattattagtgcagctcttgctgttgctgccacaggtactactataagaaacctacaaggccaggcatggtggcttacgcctgtaatcccagcactttgggaggccgaggcaggtggatcacaaggtcaggagtttgagaccagcctggccaatatggtgaaacgctgtctctactaaaaatatgaaaattagctggtcgtggtggtgggcacctatagtcccagctacttgggaggctgaggcagaagaattgctcgaacccgggaggcagaggttgcagtgagccgagaatgcaccactgcactccagcctgggcgacagagtgaggctctgcctccaaaaaaaaaaaaaaaaggaagaaagaaacctataataagcatctataggtttaaaggtaaaaattagaagcgttcctattaatgtcaagattcagacaagatgcttgaagtcatcagttattcaccactgctctaaagggcttaagcaaaaatataataaataagatctaaaaatggaaaataaattgtgaatgatatgatcatctatcaagaaagagtgagaatcacatgacaaactattaggactattgagaatttaacacagtagtcaaacaaaacatcatcaaaaaataataggactatttagagtttaacataacagtcaaacaaaacatcatcaaaaaatagctctccagctggcgcggtggctcacgcctataatcccagcactttgggaggccgagataggcagatcacctgaggttgggagttcsagaccagcctgaccaacatagagaaaccctgtctctaataacaatacaaaattagccgggagtggtggcgcacacctgtaatctcagctacttgggaggctgaggcaggagaatcacttgaacccagtaggcggaggttgcagtgagccgggatgtcgccactgcactccagcccaggcaacaagagcaaaactccatctccaaaaaaaaaaaaaaaagctctcctacataccagtaataactaattagaaaatgtaacagaaggctgggtgcagtggctcacggctgtaatcccagcactttgggaggccgaggtaggtagattgcttgagcccaggagttcaagaccagcctaagcaacatggcaaaaccccatctctataaaaaatwaaaaaaaaataaaaaaaaaaatcagccgggcatggtggaccatgcctgtaatcccagctactcaggaagctgaggtgggacaaccacttgagcctgggcttatagaggctgcagcaagctaagaagccaagatcttgccattgtactccagcctgggtaacagtgygaggctctgtctcaaaaaaaaaaaaagtctcgcagaaaaaaaaaaaaagggcagtctaaaggtaaagtaaacatagcactgattggcaaatgaatagacaactaaatcaatggtacaaaacaaaacacactcaagtgtatataagaatttagtatctgattttttaaaaggttgctcatttgctgggaaaataaaggactattcaataaatagtattgggacaactggctccataagcaaaaaagaaaaaaaagaaccccatttcatcagacaaaaagacacacactcatgcacgtgcacatgcatgtataagcatacactctctctccagattaaggacctaaatgcaaaagcaaaattataagcatattgaaaaacacatagaatatgcttatgaccttagggccttttaaaattagactattttagccaaatgaaaaggtttacagagcactttgatgaacatccatgttctcaccattgcttaagaaataaaagctcaagcttttattcaatttttattccgttacaaacataattgaagccatataaatagttcttgcctttaagaagtccaaagtttagagatgcagaatatgcacaaagtgccacaggagcacagaaaatacccaattcagacaggggccagragcgcccagtcttaaaataagggtaggggttcctagatagagaaaatagcacacatatgaactctacatcatctttgactctaattgtcaagtgaagattaccaatgacaaaatcccagagcatgccagtctaaccagagytatgctatctgaaacatagctctgattaactcactttgcactagggggtggggttgggggtaatacataaaacagaacatccaaacaaaaaaagactgagcagatcaatcaaccttagagcaaagggtgaagctgattgcttaaaagaaaatgaaactttggaggcagaacattccaaatgtaacagggcaacagatttacagtgctgaaaggaatgaatctcctgctctggatatgtatacacacagctttaaaacaatcatctatatactatagccatttttcagccaatgtagctctcttattcacgatcaatcagctaatttcttattaaatcttactaagatacactagatagccgcaaagtttaaaaaaaaaagaagaagaagagactgtagccattttgactatatatatcacaagtgtttctgaagcctttcacattgttgaccatccctggttcttgaatttctcctatatcctggtttctatgtaaccagataatgtagttgaattctttcctttatcctctttcttgtctcctttactgaattctctgctagcttttatctccaggctatgaaggtacccaaagataaagtactgggcatcgacttttctttttaaataccaacttctttgaagacatgacttcaactactaccttcaaacaaaataatttcaagaattttggcttggatctttcttttaattccagttacatttcatcttcttagatattctgtctctgagtcttatcaatttaagaggtctaaaaacaatacaccataggtacatgctcatgaacacatatacacataaatgcccacccactttttttgtttattatactttaagttctagggtacatgtgcacaacatgcaggttacatatgatacatgtgccatgttggtgtgctgcacccgttaactagtcatttacattaggtatatctcctaatgctatccctcccccctccccctaccccatgacaggccctggtgtgtgatgttctccaccctgtgtccaagcgttctcattgttcaattctcacctatgagtgagaacatgcggtgtttggttttctgtccttgcaacagtttgctcagaatgatggtttctagcttcatccatgtccctacaaaggacatgaactcatccttttttacggctgcatagtattccatggtgtatatgtgccacattttcttaatccagtctatcattgatggrcatttgrrttggttccaagtctttgctattgtgaatagtgctgcaataaacatacgtgtgcatgtatgtctttatagcagcatgatttataatcctttgggtatatgccmagtaatgggatgaatgcccacacactttttaaaaagtcacaaggacttaccatttttccctatctacaaacaactcatcctcttcaactgcctaagtcaatggagtccatcgtttctctcatctaygcagtacattttagcttttctcagttacaaatcttatcctgtcttctctcccataatatctttcccacccatctcttctttttactctctaccacaaactaacctaatttggacattgatcacctcaataatttcaactgtgttcctgcttccagtctctttcctccccaccaagcattctgaacattgttggtggatcactctctctacaacacaactttaaacctgtcattcttctcctcaacagctttttaaagggtgaataataatgccaaatattctaactatttaagaacctaaaattttggctttgatgtgcctatccaatctatcttttccaatactcaagtttctctattctaaaaaaaaaaaaaaatcctttcctcagactcctccctcaagctaccttactactatacttctagagagaactgcttgcaattgcaagcaatctggcttttttactccaataatgctgaaattattcttgtagtttccaaactgcaaagcaaatacttaagctcctcattttgcttgaccacaccatgccatttataattcggtcttatctttcatcactccctactaaccatccctgtagactcagcaaaccactagacttcctctaacataccttgttctttcagtctgtgcttctacatatattattccaatgtctttcctgactctgctgtgcactacaaactgcttttgaagtatcatctcttatatggaatttccccccacttcaaacatctttgctgtcagtgtactcttacatcattccctaacaggactcagaacactgcacagtaattgtttcacatatcttgatatcctcagaatctaccatagtttgaggcacctggtggacaattaagggtgggtttttatagactttctggtatgatcttattttctatctactcgctgtcgctcaagcgtactgtatggagacgcaggatgtatcatggttaagaggtcagattctgaagccaggctgtctatgtatgacctttagatctaccacttagctgggcaaattaattaaccttcttgtgcctgggtttccctatgtgtaaaaagaggattttatcctattattattagacctacttcataatattatgaagattaaatgccttaatatgggcaaagtgctcaaaacagcaactggcacaacataagcactaaatatattgcctgttttaattaatagaccttagttactgctgatcctttccacaagctagtcctatattatgttctatattctccattctacattttgtcctccattcgctattattaatgggctgtcttcatttttccctttatccaaatcctacccaggtttcaaggccaacttctggtaaatcctttgctcattccaatccttaaatgytcactccaatccttaaacgatcattccctaattttaatatctacaggattttctgcatcactctgcatttaattaaaactgctttgcatccttgtagtttttttcgtataagtttgtcaatccaattattataaactctttgaaggtcctgattacatctcctgcacctttgtgagttcgtacagcaggtagtrattgcttagtatttgctgtgtaaaataataaagcacaataggaacctcaactctgatcattctgcctttgcaatcaaagaaacggagaarctgtgagaacattccatgcttctctaggagccaagctgcaaatgtattagggccagagaattctgactcccattaaaatgagcagctctgaaaggagggagcggggaatccctccctgccactgtagaggatttatgggttgcccttaagttcccaaaccaaattgtggcactggggtttttatgagaaacgtgtcaacatgacaaaatgattcagagcacaggatttggagtcacacagatctagktttcagmgagactcctgtttccttctctataaaggggacattttaacacctacttcacatgtatttaactttcgccctaacactgaactgaagtgcaaagccttggaaacaaatttaaataaattgaaaatactgcaattcacaaataaragtgagaacaacatttttagttacgtaagactatattatattaaattaggtggcagcagtatttataataatctaaattgcctgtgagaaaattaaactggtattgtcaatacatacttaaaataagaaaaaaatcccactacagtctgtcctttttgacactttctccttcctgtaatttttttctttcactcaagattaaaaacaaacgttcaagattatccctaaagagaaatagttggaaagcacaatttaatagcaagttggttctataaatgtaatatttcagttcatagttcaaaaatacttccaaataggaattaacatgaatttaagaaattaacataatggcacacagctaaactgatgatctgagtccgtaatttcaaattaagagttgttccaacttgaagctggcagtcatacacagtttaaagggtttgtttacagcactgtcaaaagcaaataccacaatctttcagaaaattcaccctggcattctaataactagttattttaaggcagtataattgttgaaatacttcacaaactaagccaaaatgcgtttccttctgaaggcaaaaaaaaaaaaaaaaaaaaaaggtgacgtcttatttttaacctgtgattttttttttttttcagtttcggattatgaaataaaatgctgttcatccactgaagaacagacccttgcttcctgcactatcttcaaaagtttaggtcggarraggtaaaattttaaaaactgatttgttctccttgggatacagtgagatgtggaattcgttaggaatgataattattaatagaaaagatcaaaagaaggaaagaaacgttaatagtgtttataagcattgtgaactttcaacaaagctgaaacgttacgatttcaagatgaaaaaacggctttggggaagggaaatccacctcgagaatgaagacaagtgcggagcgaatagaatttcaggggagatgaaaaggggattgggaaaaacgtgggatctggtaacaaaaaggggggtttgttcttgaagggcgttctgcggggcgggcgttaagaggggtgcgtgcgtgcgcctgggtgaagtttgtactcagggctgcgataatcgaggtgacaaagttgtggaagtagaattcggaggtscgggagcaggaaggggaaggaatgtggggatttccaggctgggctgacaagttccgggcgctgctctcagggggaagggaggtctcctcgagtgccagatagcccgtccgaaaccaccgacactctaactccagctacgcgacccagcacccggcccctcctcacctcaggccgcgccgcctcgaccctccgcgtctccacagcgcacgaaccccttggcgccaggctgggccagacccgtcggcctggcaggcgcggcccccggttcagctgcgccggggcggcccagcgcgactccgcgggccttttggctgctcgccccggctccggaacactgtcagatccttctccgcagaggtagcgcgccaccccagtcccgcggcggggcggggcgctccccaatcccgcccagctgcgcccccggccggccaacgctgcgccccgccccctaccgggacctaggcgctgattggcccctgagagaccctttgcgcccaggcattggtccagtggccgcctgtcgacgagggggcgggactccgaggggtagcgattcccgtaacgcggctcttcgcgtcccggattccggtggctgcgtccgcgtcgcctctcccagactagatcgaagggttccccccacctcccctctgtgggcggaaagagcggaatgttccatttttctgtggaataacggggtcatgaactggagcccgggtgctgcccgccgcccgctgcccccgccctcccttctcgccagggcgcctgcggcctctcttcgcggccttccccgagggactcagagccgcgagggaccgcctagctcccttggggatggggaaggcgtgggagcctmttggggaaagtgaagagctcggtggccgtgactccgcacgagactgcggcagattgtggcggcggcttctctccaagacttacgtaaacgagccttgccacagtacttttttaaattagtaaatgagtttgggtgcgattgatcagtgagccccagaggtggtggcccaccaagcgactagtgtttctttgcggtttgtacctccccgtttatgataaaaaataccgggtaaaaacctattcatcccgcctccgcccccccctttccctcagaaaatggacctcaaggctcatgatgtttgtttctccccaaaggaagatgagaatcttgagttaaaagataaggcatgtgcgtgcgtgcgtgtggggtgtktgcgtgggtgtctgtaaaagtaaacacccaaaggtagaggtttttgtggaagaatgagaggatataggaaggaaataatggtttaatgaacttaaattatatccataaattaacaattataaagttcttcattatattgaggattcagatagagtaaaacatagatcgaattttaatctcttagttgttgatcagataatttataaaagggcaaagtgggcctgctaacggagtcgcaggcaaagtagatggtgctgcagctgatgtgttcagctcttgctcctccctgtcatcctatatctaacctatagattgtgaccagattctgttctagctttgccatttagaggggtgtttattttaaracaaatttttataaaaatttgttaaattgaaaattttgtrtagatccaggaaacttgatttttttgttgttgttcacagtctcactctgtcacccaggctggagtgcagtggctggatcatgctcaccgcacgttcaaattcctgggctctagcgatcctcccacctcaacctcccaagtatctcagactacaggtgcccctacaatacctggccaatttttaaaatttttggagagacaagattttggtatgctgacccggctggtcttgaactgctggcaacaaacgatcctccggccttagtggcctcccaaagtgctgagataacaggtgtgatgcaaagatgtatttaggggagatgtatagtggttaaatgtaccctctggttctagattgcctaggtttaaatgctgatgcctctatttctcatctctgtgaccttgggcaagtcttttcaaatttcttcatctgcaaaatgagaataacaataccaacctaacaggattgttgcaaggattaaatgagttaaaatacatacagtgtttggcacatagtaggtgctctgtaagtatcagctataatcattattgaatgtctactcggtcaacacttctgaaatattttagtatcacaacatatattaaaaatgatgatattttgctggacggggaagggcaggtacacagaagtggattgatatgtcacaacacaccagcctgccttggcaccattaggaaaacaaatgactgagttagtgcttttatgggtgtctttttattggctcagctcaggtcctgctcccaagaaactcacattttatgggagtagttaaagtctgaggccaaaaggatgaatcaatattggagaagtatttttcagagcaacaggacggaagacctctgctgtgctggaattacatgactttgcagatacctctgtagagtattggccttgaaattacgaatttcagattaaggatttgttactagaaagccttgtcaaaatgcaaaggtaagtaggggaaagtagtatattaatggagaactctccatttgtgtcctgtgaccatttgagattttagatatgtcaagagcaggccgggtgcagtggctcacacctgtaatcccagcattttgggaggctgaggcaggcggatcacttgaggccaggaattcaagaccagcctggtgaaaccccaactctattaaaaatacaaagattagccaggcatggyggtgggtgcctgtaatcccagttacttgggaggctgaggcaygagaatcacttgaacccaggaggcagaggttgcagtgagctgagatcctgccactgcactccagcctgggtgacagagcaaaactccttctcaaaaaaaaaaaaaaaaaaaaaaagagattgaggaaactgtacagtgagaaagtaacatgaaggcaccaaaattacaattacttgggagtaagtgagcaaagcttaggaaattgtgccatggaacaaaggtgataaatgtcaaagacaaactttgcctgcatttctaattccctaaatctggtgctgactaggatatccctttacttccttgtctgtgcccagttatgtttctgaaattctgtgtcagccctggaattatcctcatgttctgtatcaccttaatgatttcagcatccatgttcatgactcattagcactctgacctcacaatttctcatcgttttcttttccaatcatcttcaacttcactctgtatcagcaacccacagatggagccacaccttcaacctagtcatcaatgaaattacttcccctccaaaatgctggattgtgagtttccctctctgtacctacagccacctacccccatctatctctattctgtggtcattcccattgaatctgtaatttgtcctcaatgtgacagcctgacagccagtctttcttctcatagtttatcagctgtttcctatcattttttatcttacttaccagtaagaaccccctttttttttttgagacggagttttgctgttgttgtccaggctggggtgcaatggcacgatcttggctcaccgcaacctccgcctccctggttcaagtgattctcctgcctcagcctcccaagtagctgagattacaggtgctcaccaccatgcctggctaattttttgtacttttagtacagacggggtttcaccaagttggccaggctgatctcaactcctaaaagtgatgggattacaggggtgagccaccgccccccaagaacccttttatcaaccattttaactgcactattmtcttcagttcccttgaccttcagctatgtttaccttatcaggctatttcctaactatttcctttttccttgagctatcagccccaccgtaacatttattcttagtacagaaccttgttttactcccttaaaatcaagaccatcatttgtgagcatccttgacttttctccaacttaggaagcaaatagatatttatcctctttctcttttccccactcagaggaagaaaggcccctttacttttaaaaggttaatttctcctcctctgttcttggtactactttaagtctagtcccctagttttatatttttcattattaacactaaatgactttgaaatgtttaaaaattagatattaactcagtggtgagttgaggacagcctctctgcctgtgttaaaacctttgtaacctgatagcacctaattcaccaaaattaaaaataattaaatgtctaaaaatgaagaatgttaagctacattgaaattcacttaacaaaatgaggtgagaatgaaaaatgaacttaaatttccaaactagaagacaagagaaattcatttcatagcaacaaaactcaaaaccattatgactgctatttcaaaaaatgttttgaagaatgtatattcagaaaaatcaacataccataagagtacagcctgaaaatttttgacaaaatgaacacattcatgtttatcatctatatcaagaaacagaaggcctggcacggtggctcacaccagtaatcccagcacttccggaggccaaggcgggcagatcacgaggtcaggagttcragaccagcctggccaacgtggtgaaacctcatctctactaaaaatacaaaaattagctgggcttggtggtgcattcctgtaatcccagctactggggaggctgaggcaggagaatggcttgaacctaggaggcggaggttgtagtgagccaagattgtagtgagccaaggttgtatagtgagcmactacactccagcctgggtgacagagcaagacttggtctcaaaaakaaaaaaaaaagaaagaaatagaaaatagtctgggtgcggtggctcatacctgtaatcccagcactttgggaggccagaggctaaagcgggtagrtcacaaggtcaaaagtttgagactatcctggccaacgtggtgaaacccagtctctactaaaaatacaaaaattagccaggcgtggtggcacacgcctgtagtctcagccactcgggaggttgagatatgagaatcgcttgaacccgggaggcagaggttgcartgagctgagatcacgccactgcactccagcctggtgacaaagtgagactctgtcttaaaaaaaaaaagaaacagaaaatgaccagtaccccaaaagggccctcctcccatccagttattggaaggtcataactgaccactattctaatgtcatagcgttgtacccaagcgagttagagaaaacgacacactttgagacgaattaagagtcctttattagccagcgaccgagagatagctaacgctcacaattctctctgccccgaagaaggggctagattttcttttatactttggtttagaaaggggaggggggtctagttaaaacaattttacagaaataaagtaggcaaaaagttaaaaggataaatggttacaggaaagtaaacagttccaggtgcaggggctttaagactattaca

SEQ ID NO: 13463 - DNA, 20945 bp, Homo sapiens
  misc_feature (1)...(20945): n = A,T,C or G, or insertion/deletion polymorphism (see Tables 1-2)
taatctccgaaaaggagggcctagtatcatcctcacaaccattcatccaggaggcgacagctgggatgtaaaaaccaggtgtgtctgagttgtgactttgacatgggtctctaagtaactcaaatcctgtatctcagcctggaggcaatggggtgtcagggaaggcttcctagaggaggtgacacctgcaccggatctcttaggatgataaaatgaatccagccagtgagggagcagggtgtccggcaggaggaatagcacacacaaaggcctggaggtgagaagcagcaggagggtgagagtgtggcagaagctaatttggtgtcacaggctcacaggaagaggcgggaagaggttgcagggaagtgggtaacaggagcaggtcacagagggccaaatacagaggagtctacactgactttattctctggatagttgggagccccaggaggactctggatggtggagttgcccggtcaggtgaagacggggaggttcagaaaggagccacactgtcgtcagatggctccatccacgaaggagatgaggctgggtccagtgtcaggagcacacgtccaggccgcacactgagggccagatgcgggctacagcacaggcagggagctgtggccgagctttaattatttatgaggctgtttcccagyaagactcagcactcctgcagcctggccttgcccagctaatgaactctcagccatgggagacctccctgtggccactctttattaaacctgggatggaggggtgatgggtgctgggataacaaaagagtccaaagaagcctgaacaaagtcgaggtcagtgagcacaaaactggtccacctgtctacccagcctttccgcgagaagcacagaacttcctagaggaggaagcgaggtggagtagccttaagatgtcatctcaagacagggaaatgaaggcctgggaaggacctacctaagtcaccagccagtacttgagacagtacaagttccatagctggtcacccrcattcacaccccagcagttctacacccttgggccagttacgtaacccgtctgtgcctcgatgagataggactatttcaggtacttcatagtgttgccccattttatagaatagaggaacgaggggcgatgtgtggacaatctcagcacgatgcccggtccacagcaagtgcccagacagcgttcatcggcgctatggttactgttgtgactctgggagtaaaggccaggccagagaccggaatctctgcctctgcccccagacactagggagcaacaggaaactgaggcccaggggccagctggcctacgtgacccaggcccacagccaggaatcccacccgacttcccctggctgggcttccttgggcctggctctctagcttccagctccttcctccactttgaaggttctttgagctgagaactaaagccccaggagcttttccctcttccatcccgcaagctccatctgtgtctccaaagagccaagtcccagccactgtggatgaggctcgggacttagaaggcctcagtttgagttccagctccaaccctgaggagctctgtgactttgggggagtcacttcacctctccaagcctatgtcctctataatataggaacaataccacctgtttttaaatggtaaactcygggggaatgctattagttaccatctttcaggcctagttcagcagtctcctcctccaggaagcctttcttggcttccttaaaagttccctccttccagcctcttggtattcaggggctgcattctggcccctttgggaacttggactcattttgcctcacgcagactctatctacaaattccaacccccattttgcaggcccagagatgtacaaaggtggggcagctcaagccctcttgcagggtggtgtgccaaagagggtggtcaggggtaaggcacggagactgctcagggaggagcagattttgttatcccagcacctatcacccctccatcccaggtttaataaagagctcctcagggacgagccaacagctctctctcctgcagggagaacagttcaaagaaattcagtctgggcaggtggcctagaatgcgggaagggctgaggaaagaacattttccagcacctggccccaacacagccacgtaagccccactccgtttcttcagtttccctttatggctaccagsagtccgtttctaaaggccgtggaggtgggaacactcatccatccgttcccttcttgccagccctgtgtgtctatgtgcacagccagcgttggagggacagctgcccctgtttggcagatgaggaaacaagctcagaaaagccaagccatgtgtgattactacttggtactatcagcagcgccgccaccctttccactccaagcttgacgtcattcacttttgtttaataactccctgcctatgactctaccccatgcatctcagagccatgcaggagcccagcttggccattggagctctcttggcccacctgagcgtcactcagcacccagctactttactcctccatctcgtccaaagcctcacatggagctgaaacgcaccaggcctaacatttaaagcccgtctttccagctcctagatcacactcctggtgctttccgcaccacactccccacctcagcagacagtgccctsaactcgaggcaggcagagatcctgaccaagttctgtcatcctgagctgtgtgaccttgcataagtcactcaacttctctgaggaggcatccttatctagaaagtagaatgacaagaaaatttctgcttttcacagccatcctcacaaggacagttgttataaagagccagggagataaggcataaccagcccagacacgcagtttctattccttgcctcgtcctcagtactcccactctaaggagaccacagaacaactcccagtgaggaaactcactgcaatattttaccaaggcacagccattttcataacctcaacagcactgggaaatggtccagggtcatgattagactaagaactctagagttagatgcttaagttcaggctcctacttaacaactcagtagctgctaagcaggtaacttcacagttcagtgcctcagtttttgttggtttgtttgttttgttttttaatctctaaaataggactgttatgaagattaaaggagtttatacaagataagtacttactgcagtgcttggcacagttaatggtcagcacacattagtctcattacttccaatttcgcttctagaactggtcctcaaaacagtccaatgatgttgctggggcaggaattatgtgaacccaagtggtcaggtgaggaaactgaggcaggagggaaagatgtgctagagacatagactcagtcagtctagttctgccacgcacaagacacaaagccaactttgggttaggtctgaaagtgaacgggagggtgactggcaaacagtcaaaaaccaaaacgattcaacagagagggtgcctgtccaagtgtcccgtgacccttcctgtgcagtgtggggctgtgggcctgtccacctgtcgccctcctccctcagaccccgtcagtgctccctggctggcagggctggcctgtcttggagggcgccccagcgcctggcacgcagcagatgctcccgaatgatgaatgaatgactgcccgggtctatgtctctaggagagccctgtttttctgttcccggagctacatttcttccaccgtgacaactgcctgctaactagctcccggtcccgcagacactctgaaaccctgtgcactctgagaagaaacttctaaatcagtcgcgcacgcccagcaaaggcggccggcagccgtttcacgcgtggcctcgggcttctcgggccccttccaggaaacaaactctccctcctggtaccctccttcctggtgtgccacatgactcagagccgggcagggctagcaggaaagcgcggtctgctaaccagggtggctcaaaaaggtcttcactgtgactcggcagaaaagcggcgcccgagccccgcctgcacctaccaccctaaggatatgcgcgggggtgtggccggggcggggccggggcagggcagggcggtgcccccgcgcccagggaaccsgaatactacacatccgtctgctccgcgattggccgctccggccacgggggcctatggggtggtcctcgcccagccaatcaggggccctggggagcccattcattcacaaaaactgakcaggaaaaggagcgcagtgcggcccggagctgcgtggaactttgaaacacgcgcgcgtcccgcggggccgaggcaagagtccgagagggccgtgtttcgggaagctagacctttgcagggactgccgcgtccccgcccacagctccggttcagtctccccagcatggtgcgccttcctcctccggcacactgcccggggctccgccccggccccaccagracacgccagctttcctgcccgctccgggtcgctaagagccacccggccccgagggaggcggtgcccaggcggtttcccggtcgcaggctccggcggcaagtcccgcgcaggtggcagcgcsgcggctgcagccacgtgcgcgccaagcatggtgccccccaccgttccttttctctccccgggtctgagctccctggcccgccactcacggcagtcgtcctcgtcgctgtggtctaagcagtcatcgtcctcgtcgcatctccacacagaggggatgcagcgctcgttccggcactggaattggtccttttcgcamtccttggccggccctgcgagggggagggagcgtgagctggatcagcggactcggccccactccccaccatgcagtccgggccacccggaaggacccgctggggaggaggaaagggggcgattatggagaccccgggggcttcaggcacactccatccaaagggagggcacgatggcaggggttccgtggatgtcgggccgctcggtggcacggcgagaccaggcacctacttaaagtgtcacacgacctgggtatamcctccattcagacgcactcacccgcacacgcgacccatagtcagagatctgctcagatacagcccayagggagtccccgcgcccgcgcgccaggcgcagtgggagccgcaggcacatcaccctggcaggcagccccctctctctccgccgcgcgcaggggtctgcggaaacgcattgtcaagcggagaagccgcccggctctgctcattaccgccgcggagcgcgcgtgtcaaataaaccccaacggcgagaatcacacagytcatccggaaccatgaatggccgcccctccggcaaagttccccgctggccaagcccccctgcacccctcccccaagakccgctgcccagagggcagagccctcaacaccgaggcccgcgggggcggggggccgagggcaaattcaggaatagccgcttcgcgtggagcctgtccgcccgggagcccccgatagccccgggttctggacccctccccgctccggcctcccggccgcgctttgttggtggctagggcggagcagagccgagtcagagaccttttgcacgcaccttggccgccgagcagcggatcagccgctgccgccgcaagatgctggagcygcagcagcagcagcagcagcagcagcagcagcagcgccagaagccggagagggcccggctcggggaggcccatggcgggcccggggctccggccgccgcgccccgcgctccccgcgccgccgnnnnnnnnnnnnnnnnnnnncaggttcggtgacgctcggcggcggggcgggctcaggctgggcgcgcggccccggccctgggcggccgccgccagcgcgcgcgctccctcccgctgccgcctccgccccacgctccccctgccgccgcctcctcgccctcctccctcctgtctttcgtccactcttctctcagcgggcgctccacggccctgctctgggctcgcctgagtgctgggctctgcagacgcagggatgggccaggcgagcccctcaccacggaggtagcaggtccagaggaagcagcagaggcttcctggaggaggtgacaggcggatcagaggctgagggatgtctaggagtgagcctgggcgggaggggaaatgatgttacaggacgaacaggcctgtgcagtgtgcgcgtggggcgggggagggagggataggggtgagatcccaagatgtggatgagcagggagaagctgggggcgcagggctggacccctgcacctgtcatgggctccggctgggatattataaatccctgtggctggtttggtttccgtgccatgtgcatctgtgcatgttgcacgctcatgtgatcatggggacgtgaggcaggtggattgggcctggtgcacagactattcatcgtcgttaagtacgctccaggcccctagtcagaggggcaaccagggggggcccgcagggaagacaaggaatcctcgctgtgatggagaaagacgaggtctgtggggcgggccgggcgggggggaaggggagggcacggaagggatgccatccctgccgctaggggccgcgcacctaggcccgcgctgtccgcccctgctgtcttctgcaggaaggagaaggcacctcttcctctggagggctgcagcccgcctcacccacactggggagaatgggtgcggagagcgagctgggattcgatttcagcctcagacttgtgagccgggtccaacccacacaaccttctttagagaatgagattccagggcattggccactcaaaacaaccggcctgcaggtgccaagagccagtgttaggtccaccctccctcccctcttgccccttcacctccctcgcggatgggcaggtgctgttagcccttggcctggaaaccaccctgtctcctcagcagcctcctgagccgtagtcccccaaagggcagcccagcggcaatatctgtggccaccccaccagaaagggacttagatccccagagagcccggcacggtgctcctgccatcatcacccctcctgtcccttgttcattcagtcattcagcaagcatttcaggccctgttctgtgccaaccctgtgctgggcctgcgggtaccaaggtgaatcaggcatggtgccagccccggagaggtccctgacctgtggggagacagaccattagcacacagacaacgaaatgcaggcgtcctttcacctatatgtgccaaacgcccttcaaggctcaaggatacagtggaaacagataaggttcctccctgctctcctgcagttatgtcttagttggaagagatacacacaaaagcaggaaaacaaaagattatttcaggtcatcataacttctatggaaaaaacaaaacagacccaggtgagagcaatgggggtaactgtagaggtgatcaggcaaggcctcacagaggaggtgacatttcactgaatggcaagatggatcctgacccatgaagatcaggcggaagggcattcttggcaaagggaatggcaatcaaggtgggccggggcctgatgacagggaaggagtgggtgcctcaggtgaggctggagggagttggcaaggccctgatcaccagggctttgtaggccacagctgggagtttggattctgtgtcaagcacaatggtgcctgggactgtgggataaagatagaagcccgtcttgctgcccaaactgacctatccaactcagtccctcctcctcctccactctgtggtcttaggaaagtcaatcctatctcccagtctcactttcttatctgggaaatggaagagataaggaatttctgaggttcattccaactgtaagattagtatgtgggccgaagtctagaggcagcagatgaagaaaagaaaagaaaggaaaagaggccgggcgtggtggctcgcacctgtaatcccagcactttgggaggccgaggcgggcggatcatgaggtcaggagattgagaccatcctggctaacacggtgaaaccctgtctctactaaaatacaaaaaattagccgggcatggtgtcgggcacctgtagtcccagctactcaggaagctgaggcaagagaatggcgtgaacccgggaggcggaggttgcagtgagccgagatsgcgccactgcactccagcctgggccacaggaccagactctgtctcaaaaaaaaaaaaagaaagaaagaaaaagaaagaaaggaaggaaggaaggaaggaaggaaggaaggaaaaaagagagaaatggagagcatgggcctgtgggtgagactgcctgggtctgagtctgttccttccctttctagttatgtgaacttgggcaactcaatctctgtggctctaaatgtgaaaaatgagaaaggtgatagtactcacctcacagcattgtggtgaggatatgagatgagattgtgtacgcacagcatacagtatatagtagctgcatgagaaatgttagttattgttactattattcaaacataattccctgttcacaaaaccctgatggctttccaatacccagaatcaagactgagcccaggcatcccccgacctccccaagggagaaggatgccagttgccaaagtgggcaaatccttgtctctcaacagtcccctcagcagaggtccttctggctcctctcagcctccacccactttgggccacttccccgggctcctgcagtccctgggcttccctttgccgcagccctgaccaccctgtgttgccacagtctgcttatgcaactgtctccctcgtcactctgtgagctgctggaggacaggagcccgctctcctgcattyctggattcttggcacagggcacatttgaccaatgcttgtttctgcctttattgaaggatttgtacccctaggaggactatgtcytcctcatctttgtcttcagaggataaatacaagrcctgacacataacaagcatkaggtaagttatatttacttgaaaaagttaaaagaaaaccacataaaataacaacaatagccaatatttattgtatacttgctgggggtcaggcaccattctaaatgttttaaattctttttcctctttgatccttacgacatctccatcaggcaggttttgtgtttatcccattttacagatgagtaagctaagcagcagagaggtcacacagctagtaagtgactgagccagcatgcgaacccagagggtggaagtgggaatttttcagggcacataaactggttaatttctgtgaggggcaaagggagaaagctcagtccttgaaacacacaagacaccaaatggacactgaggtcctggtaaagcttcggccacccaggtgactttggttctcccctaccctgcctctccatcctgggctgactcaagcttacagaccctgcctaccctgagtttccaaagaaaactcccaaaccyaacccaaaatgtaatgaattccccatgagacagatgtaggtgatatttcacctgctgtcaatatggcaccctgccactcccaagtcccatgttggtctccagagccatgggagccccagcagcctactctttcacactgccccccaggaactggagcttcagaactttgccaggctgtgmcctctgctaggccatgccctctgcctagaacactcccgcatgggttggcttctgtttaccgtttgggcctcacctcaaatgcctcctcctctgggaagacttctcgcctmctccacagagatcctccctgctcctctgggcccccacggcactgtgtgtcccaatctccctgatcacactggcctgtcgttgttggctcctccatccaatgggagctcctccagtaacaaacagcatcatcctggttctcactctgtccccagtgatgatgcctctccagtaccagggccagaggaccttctgtgttcacctcgcccagcctgctctggcaggccttatgctaggtgagggacacagacgaacaagactccaccttttccctggaggagctctggtctggaggcagagagagcctgggacagagagtgtcagcacagggggacaagagccagggaggggtctgctcaggggygccagattccacccccaggtaccttaggctgtgtcaccagcccagccagggtcggagaccagcagccccaagccaaacacagccaggctgcaagggcaagggtgctctctaccatccttcactttcctcttcacttacacttcacttcacttctccactgccttcactttacagaagggcagccccagtccttcacatggtactgtgagcccacggcgcacttctccatgtcactgtctctctgtgtttgtgtctctgtctctttccctctctccctctgagcaggcaaagtgtcctgattcctgtaaaagagagattctaatttattactgaactttacrtagatccaaactgccatggtttaaacgacttgttacctgtgtgacctggggcaagttacttttatgcctcaattccctcatctgcaaaacattgttagcattagctaatgtttcctaatgctatcaattacctattgctgcaaaacaaattacccaaaacttagcagcttcaaacagaaataaacatgtattatctctcccagtgtctgtgggccaggaattggggagcagcttagttgcatgggtctagctctgggtctctcacgaagttgcagtcaagatgttggtgaggccacagtcttccaaaggtttaactggggctggagtgtctgggccggctcagtcacaaggttggcaagtcccttttggctggtggcaggaggactccatttttcaccatgtggctcactccagaggactgctcgagtgtccacattgacatagctggctttccttagggagacagatcaaagaaagagaaagcaatgaagtcacaatgtcttgtatgacctgaccatggaagtcacgctccctcatctctgcaatatcctgttggttacatagatcagccctattctatgtggaagggaactacataggattgtgactcccaggaggtctgtctgggggctgtcttggaggctggctgccacacactgtcgtaggatttgtgaggatgaattaatacagtcctccctctgtatccatgggggactggttccaggacctcctgcagataccaaaatcctcagatgctcaagtgcttgatagaaaatgatacaatatttgcatataatctgtacacatcctcccgtatactttacatcatctctagattatttataatacctatacaatgtaaatgctatgtaaatagttgttacgatgtattgtttagggaatartgaccaggataaaaagcctgtacatgttcagtacagatgcaattattttttcctgaatatttctgatctgcagttgattgaatccaggattyggaacccatggatagagmgrgccaactatgtatacacttatatagtgtgtactatgtactaaaaacccttctaagaacttaagtacacactatataagtcattgctattattattgcctttgtggttgtttctgccacatagtaagaactctgtaagaattatctgcagttaccattaatattagctgcattattgctattagctgcacaatcccttcatcttgcagaggaaaggagaggatgaaggtggttcaggggttcgtagaaaagcaggacagacccagcctcggtttcttgcctcttggctgtgtgctttcaggagggtgggctcacaactgcctcctcctccactgtcttatgtaggagactgagtgggtccttctscctctctaggcctggggtgtccatccctaacctgaggggctgaactaggtcagtatatcccataactgcagccattctcatccacttgaatgagtttctctatttccccttacctgctactgtcatcccagggttccccttaaatcctttcacttagtagatttagcttcatcctaagcaataatctccatgaaatcacaggctttatatgctcattatatttttccaatacatattaaattaaatgtatggctattcacataaacaatgggcctctgtgcacccagatgtgtctcttttctctaagggccatcagctctgagctccctgtttattccaggacagatggagggcaggagccctgaccactctgcccatgatgacaggcattcctcaaggtgacttgcaggtggctcaggccctgggtgcccaccccctgagtcacatggctttcgggggcagactcagtacttttctgtttgcctttattttgggttagtttttattttttaaattgttttttatgtttttattgattgactgattgattgattgattggttgagacagggtctcgctctgtcacccaggctggggtgcagtggcaccatctcagctcactgcaacctctgccacccccaccctccaccagccccaggctcaagcaatcctcccacctcagcctcctgagtagctgggactacagatgcacaccaccacacccggctaattttttttttttaagtctttttaaagagacagtgtttcgccatattgcccaggttggtcttgagctcctgagctcaggctatccacctgcctcagcctcctaaagtgctgggagtacgggcgtgagacacctcgaaatccccttccttcctccccgccagccccagaaaccatattctacttcctgtatttatgaatttgactactctaggcaccttaggtaagtgcactcatgcaatatttacccttttgtgagtggcttatttcacttagcataacatcgtcaaggttcatccatgttgtagcacgtgtcacaatgtccttcctttttaaggatcgggaatactccattgtatatctgttccacattttgtttcttcattcatccatcaagggacagttgggttggttccacattttagctactgcgtataatgttgctataaacatgagtgtacaaatatctcttcaagtccttgccttcagttcttttgaatatactcagaagtggaattgctggatcatactgtgattctagtttttattttttgaggaaccaccatagtgttttccacagcagttgtatcattttacgttcctaccaacaatgtgtaagagttccagtttctccatgtcctggccaaaacttgttgttttctgcttttgttgttgtggttgttgtttctttgtttgttttaacacagatcctaatgaatgtgaggttttttttctcactgcggttttcatttgcatttccttgataattagtgatactgagcctcttttcatgtacttattggccatttgtatatcttcttcggagaaatgtmtattaaattcctttgcccatttttcaattgggttgtttagtgttttgttgttgagttgtaggaattcttatatattttagctattaaccccttatcagatatatggtttgcaaatattttctcccatcccattggcagccttttcactctattgattctgtcctttgatacacagaatttttcaattttgatgtagttcaatctgttttttcttttgttgtctgtgcttttggtgtcatattctgaacatacttatatgtgatcgtaatacaataaatgctatttgtagtgtgccatgattaatacttttttcctgcatgcctttgtgttttccctggaattaataattgttaccttttgctttattgctttatttctttcttagctttctatgtatttatctctctttcctccctaaactctccctcatttgtgtaaatctcctcttactacaatcacccacattcaatacagtaatccccacttatccgaagtttcactttccgcagattaatttacccgaggtcaaccacggtccaaagatattaaatggaaaattccagaaataaacaatgtgtaagttttcagttgcatgctattctgagtagcaggatgaaatctcgtgctgtccggcttcgtcccacctgggatgtgaatcatccctttgtccagtggatccgygctatagacactactctcccatcagtcactcagcagctgcytcagttcccagatcaactgtcgcaggatcgcagtgcttctgttcaagtaatccttattttacttcattatgggctccaaagcacaagaggagtgttgctggtgattccgatatgccaaaggaaagctgtaaagtacttcctttaagtagaaaggtgaaagtacttgacttaataagaaaatttaaaaaacaaaattgtatgctgtggttgctaagatctacagtaagaatgattctattcatgaaatcgtgaagaaggaaagaaatttgtgctagttttgctgttgcaactcaagctgcaaaagttacaacacctgtgtgtgatgagtgcttagtaatgatggaaaagccattaaatttgtgggtgcaagacacggacagaaacgttctgattgacggcartcaggttccaytgggggtattggaacacatccctgaggataatgggggactactgtattctaccaacttattcctcttgaagaattccctttcggatttctgactgctgagtcctggactggttgatggcaaggccagctgccctggttgtcacctggagactgtgctgcacttttctcctgggtcgaacccctcaattcctagatcccacgtcttccccttctgggttcactaccttatytgggggaacatatacccatagctttctttttgttttattttttgtttacctatttatttatcttattttattttttgagacggagtctccctctgttgcccagtctggagtgcagtggtgtgacctcgtctcactgcagcctccaccccccaggttcaagcaattctcctgcttcagcctcccaagtagctgggactacaggtacgtgccaccatgtctggctaatttttgtatttctagtagagatggggtttctccatgttggccaggctagtctcaaattcctgacctcaggtgatccaaccgccttggcctcccaaagtgctgggattgcaggcataagccactgcgcctggccccatgtatacctatacttttctaaaaggatgtgtttggggtgaaatcttaagaccttgcctttctaaaagtgcctcacatttaatcagatagtttgaccaggtataaatttctaaactggaaatatttttccctctgaattttgaaggcttgctccattgtcttccagtttctgctgaaaagtctgaggccattctgtttcctaatcttttctagagactctgttctctctttctggaagctgtgtcctcagtgggtcttttcttttaagagaagggatcccatcgccaccgaggctggagttcagtggcacaatcatcgctcactgcagccttgacctcctgggctcaaggatcctcctgccccagcctcctgagtagttaggactacaggctcataccaccatgcctgctcagccttagtgtgtcttgaagtgaatcgatttccattcactgtgctgggtacccagtgagtcctcacggacaaactaatcatcttcattttggagaaaatttaaragaagtacctctataatgattttattttttctttcaggaactccttaattattcaaatactggccctyctggagcagttctctatatttcttatatcctttttccacctatttttcatcccattttgctcttcattctggaaatgttcttcaactcttcaacagttttttgttgtttttcaaaaatttatcttatcatatttccaaaagccttttgtttgttctttgactattcctttttttagagtatctcrttcttttctcacggatgcaatattttctcttrtttctttgaggatgttagtaatgttttgttgttgtttctgttgaagtgtttctcaccatgcctaatctcttctttgtccaagttaatttttttttctgattgttgaaaagacaagccacatactgggagaatatattacagcacaaataacgcacaaagcattactatccggaatacataagtaattcttacaaattggtaagaagacaactcaattaaaaaagagcaaaagatatgaatgagcatttcacagcagaaaaatatgaatgaaaaataaaccacaagaaaagattctcagccttatagaaatcaggaaaatgtaaattaagaccacaggaagattttccatggaaaagaagtcccatagtggcaagtattggagaggcaggaatcaacagggatccttatatgctcctaatgcagtgtaaattgctgcaaccactttagaatattgcgatttcattactaagtgtaaaccctggagatacacttgcatgcaagcacccagagacaggtgcaaggatattcatagcagtgctgtttattatggtaaaaacatggaaaccaccctaatgtccttaacagtaaaattaattaattgtggcatcaccatataatgaaatcctatacagcagtggcaatgagtctaacatagctgtggctggatacagaaggaatcatagaattataatgcggagtgagaaaagcctgttgcagaagactacatacaacaggatttgacacttgtaaggctccaaaacaaagaaaattaaatgatattgtttaggttttcatacataggtgataaaagtgtgtttctttgtttttaatgagaaaattagtcacagaatttaagatcttagttacttctatagggaaggcaggggaatgggacaaggaggaagcccacagcattggtcatgctctcatgttgaagttgggttcaaaggtgttcattattaaaatgcttcataatgatgaccatacatttggtatttctaggacaatcttggtttacatctattgtctcaacataattattcagtgcaagcctttcctttctcagaaaggtcctaatgtagataataaattattttggccaacttatttcttataaaatgcaacatgcatctcttttgtatgtatctattattccataatctatacaggtgtttttgtttttttgtttttgtttttgttgtcattgttgttgtttgtttgtttttttgagacaagcctctctctgttgcccaagctagagtaaagtggcacgatctgagctcactgcaacctccgcctccgggttcaagcgattcttgtgcctcagcttatcaggtagctgggactacaggcacccaccaccacatctggctaaatttttgtatatttagtagagacagggttttgccatgttgcccaggctgatctcgaactcctggcctcaagtgatctgcccacctcagcctcccaaggctaggattacgctaagattatagacataaatcagcgcacctggcctccataatcgatatagtttttaatactggggccacagcctggccacagtctcatgggatgtttgtggtttgaccctaacaaccttgtgaaccagcctgggtaactgtccttggggcctcaatgaaccaagccctggagcacccagtccccagatccttctggccactctgactccctgtgccctggaccccacacctcacctgtcctgggccccactctgtcctctcctccacttctcactgcctgtggagccatcttccaggggccctgaaacctcacccacaatccaggtccacccagggcccctgtgccaggccccatgctgggtgatattggggaaccatcttgggggcagctggagatggaaaccgtgacaacccagtggatcaaggctatggcacagaccaggctgtgacactgcagaggagagggcttagcccaacctggggcccagggaaggctgcctggagctgttttgaagtctgacgggagtgagctgggtagggaragtggggggaagagtgctccgggcagacaggacaaagtgcagacagtagggtaaggaggcacrgtgggggacgcagctcacatgttgctgtgagcagagcacagagcacagggcagtgcctggcagaagtgggtctggaaagggtgcctcctggagccatgaatgccaagcccagggtcttggactgtatcctgaaggcagcaaggaggcactgaaggcattagagcgaagcaaggagaactgtcaggccaggtgagtcatatcaagtgaggtgagagtgaaattgggagagagaagcggaaagagacaaggcagcagagacattttattgttctgcttcrtcctggaaacccactccctgacagcctcctccccctgtcctgcacccaccacccccacacctatccatacacacactgcagagccggtaggggaggaatagctctgtggtcttgtgtgcaggtgctgctatgggacttcctgggttcacatcccaaccttgccacttgtcctacctgtgtaactttgggcagtggctcaatgtctccatgtgtccagtttccctgtaaaatgaggatgatggaagtacttacctcactgaagcttaactgagtcacaggggcctggcacatagtaagctctcaatcactgtgagccgtcatggtcactggggtgacaccacctgctctcctccaaaacagaggagactatacccaaggaagaagaaaccagagaaaggacaggaaggtttggtggcagcgactagtctcgagacggcagtccccagaacagggctggatgtgtccccaccagtagacaggcccagatgcaaggcctctgatgtgtctgccgctgcagcctccattcctagggtggtgactcaataaatatgtgctgaatgaatgaatgaatgaatgaaatgtcatgacttccaggtaccccactgatgtggtttgactgtgtcaccacctaaatctcatcttgaattgtagctcccacaatcaggtgttgtgggagggacgtgaatcatgggggtgggtttttcccatgctgttctcgtgatagtgactaagtctcacaagatctgatggttttataaagggcagttcccctacacacgctttcttgcctgccaccatgtaagatgtgcctttgctcctccttcatcttccgccatgattgtgaggcctcctcagccatgtggaattgtgagtccattaaacctctttttctttataaattatcaagtctcaggtatgtatttatagcagcataagaacagactaatacacccacctacaaataaagccctgaggtctcttccccgcccttgcttgggtgggtgcagtgagtggaatgtgtagtccctgatgcaccatctccggcccttacagtttatggctcctcactgggctgtgtccagcaacatctatcctgctgtttcccctactctgggcygtccctgctcttgccgctttcctggggagtgggtgaggactgagggacactcagccccagcctggggacccagggacgaggagacacctcgggagggctgggtcacttcaggcaattaccttcacctctctaagcctcttgaaaatgggcagaatgatccctaggtgtcagaggtatggagagcatcatgggagatgacatccctgaagtgaggcacactgtgatctgtgtgtcagcattgscaggctgggaatagggtgaacctgtgaggcacctggggtgcaagttctccctgggtctggccctgtgcttggtaaatgctgccttttactacataagggrcaagtctgtcaagagtgcctgagcaatggcctgcagccgggcctggggacagggctttcctgggctggtgatggtctgaagcccaagtggcaagaagaaaactggagccaagaggcccctyccactcaggaccagcctctccccacccctcaccccatactccccaggagcccaatagacacatcatttctcttcccctccatgagtgagctccggcggggggtggtggcctggtttcccaggccctgcccctgggacccccaacctgtctcggaggagatgccttcccagcctcaggccatagcccgcccagcccaccctgggactgactccagcacagacaccagatggcacctctgtgtgtgagcccactgtggggtgttgcrtgtttctgcatgactgtacatgtgtgtgcatatccatgtgtggagagggctatttcttcatgtggtcttgcatgggtagctgagtctgtgtgcgcttggaagtatgctatgagwgtgtgtgtgtgtgtgtgtgtgtgtgtgtgtgtaaactcccagatgtcaacttgttgcttgtgtcaccattagcatgtatctgggtgtcctggttagagggtcatgtgtatgtgcctgtgcctttgtgtaattggcccttggggtgtctgggtgtatctagatgaagagagctttgytatacatctgtgtggttgcatacttctgagtgtgttgctgtgcatttggaggggtttgtgtaaaattactaggtgcctagtctaggacttgagacaaacaagacaatcacagtggtgtgtgatgctgtggggccatggrgtttcagagaaagggaggacgaaccctacctgcagggagatggaagtctttctggargagagtgagagagccttcaggcggacggaaccgyggaacaggtgcagaagttggaaagcatgtattgaagcaaggctggagacgtctcctcacttaagaagacytgraatggcgggatataggacaggagaagtcaaaragtatgttcagtatggtcatggcttccrtggggcctgctgtgggatcccagatctaggctctggaaactgagagaaagggacagccctggtgaggatggagaacaggcagcattagctggaccagccctgccccaggtttctagggagatggatggcatagctcccacatcgttcttgggctgatacttctctttcccaggggtgat

SEQ ID NO: 13464 - DNA, 19532 bp, Homo sapiens
  misc_feature (1)...(19532): n = A,T,C or G, or insertion/deletion polymorphism (see Tables 1-2)
tctaaggtatatagatcacatatatatcatatgtgatctatatatagatcatatatatatatatgtgatctatatatatatatatatatatagatctatatatatatagatcacatatatatatmtcacatatatatatatcacattttcttcattcacccattaaytgatgggcatttggggtggttccatatttttgcaattgtgaatcatggtgctgtaaacatgtgtgtgcaagtgtctttttcatayaatgrcttttttcctccagtagtgggattgctggatcaaatggtagatctatttctagttctttaaggcatckctgtactgttttccatwggttgtactagtttaatttcccaccagtagcatagaagtgttctcttttcatcacacctaccccaacrtctatttttttttttatttttaaattatgaccattgttacaggagtaagttggtatcacatagtggttttgatttgcatttccctgataattagtgatgtagagcattttttcatatgtttgtcaaccatttgtatrttttcttttgagaattgtctgttcctctgcttagcccactttttgatgggagtatttgtttatttcttgctgatttgtttgagttttttgtagattctggatattagtccttttttgtatgtatagcttgcgaatattttctcccactctgtgggctgtttactctgatgattatttcttttcctttgaagaaactttttagtttaattaggtcccatctatttatcttgtttcttttgcatttgcttttgggttcttggtcatgaactctttgcctatgccaatgtctagaagagyttttccaatgttctagaatttttatggtttcaggtcttagatttaagtctttgatctaccttgagttgatttttgtataaggtgagagatgaggatccagtttaattcttctgcatgtggactgccaatttccccagtaccatctgttgaatacgctgtcctttccccactttatgtttttgtttgatcagttggctgtaagtatttggttttatttctgggacttctattctgttcaatttgtctatgtgcctgtttttataccattcccatgctgttttggtgactatagccttgcagtatattttgaagtcaggtaatgtgatgctccagattyattcgttttgcttaatcttrctttggctatgtgggctcttttgtagttccatatgaattttaggattgtktttttctagytctgtaaagaatgatgatggcattttgatggggattgcattgaatttgtagattgcttttggcagtatggtcattttcacaatgttgattctacccttccatgagcatgggacgtggttctacttgttagtgtcatctataatttctttcggcagtgtttttaattttcctcrtacaggtgtttaacctctattgcgggaagtcagggaccctgaatggagggaccggctgaagccacagtggaakaacataaattgtgaagatttcatggacatttatcacttccccaatcaatactcttataacttcctatgcctgtctttactttaatctcttaatcctgtcatctttgtaagctgaagatgtatgtcacctcaggaccctgtgatgattgcgttaactgcatarattgtttgtaaagcatgtgtgtttgaacaatatgaaawctgggcaccttgaaaagaacaggataacagcaattttcagggaacaagggagataaccataaggtctgactgcctgcagggccaggcagaacagagtcatatttctcttcttgcaaaagcaaataggagaaatrtcgctgaattcttttgtcagcaaggaatagccctgggaaaagaatgcattcccgggggaggtctctaaaatggccactctgggagtgtctgaattacatggttgaagataagggatgaaatatgccctggtctcctgcagtgccctcaggcttgctaggattaggaaattccagcctggcaaattctagtcatactggttctctgctctcgaaccctgtttcctgttaagatgyttatyaatgacaatgtgtgcccagcgggatgtggmacctcatcagtgattctagttttgccctctgccttgtgatcttttaytgccctctgaagcatgtgatccctgtgacccattccctattcatagaccccyrccccttttgaaatccrtaataaaaacttgctggttttgcggctcaggtgggcatcatggaacctgctgacatgtgatatcacccccggagacccagctgtaaatttctctcttttgtactctttctctttatttctcagactggcccacacttagggaaaatagaaaagaacatactttgaaatattgggggctggttcccccagtaaacctccttggttaggtatattcctaagtattttatttttttgcagctactataaaaggggttgagttcttgatttaattctcagcttggtcactgttagtatatggcagtgctacagatttgtgtacattgattttgtatcctgaaactttactgaattcatttatcagatctaggagctttttggataagtatttatggttttctaggtatacagtcatatcattggtgaacagtgacagtttgacttcctatttactgatttgtctgattgctctggctaggatttccagtactatgttgaatagaagtggtgagagtgggcatccttatcttgttccagttctcagggggwatgctttgaacttttccccgttcagtataaggtcggctgtgggtttgtcatagatggtttttattaccttaagttatgatctttgtatgtcaagtttgctgagggttttaataaaaaagcgatgatggattttgtcaaatgctttttctgcatctattgagatcatatgatttttgttttcaaatctgtttatgtgatctatcacatttattgacttgtgygtattaaatcatccttgcatccctggcatgaaacccaatttatcaccatgtatgatctttttgatatgctgttggattatgttagcttgtattttgttgaggatttttgcatctattttcatcagagatattggtctgtagttttcttttttattatgtcctttcctggttttggtattagggygatcctggcttcataraataatttagggaggattctctcyttctctgttttggaatartttcagtaggattggtaccaattctcttctttgaatgtctgattgaattcagctgtgagtccatgtgaayctgtgattttttatcrttggcagttttttaaaaattaccatttcaatctttctgctttttattggtctgttcacagtttctatttcttcctgatttattctaggarggttgtatatttccaggaatctgtctyctctargttttctagtttgtgcctgtgaatgtgttcatattagccttgaatgatattttatatttctgtaatatcagtggcattttcttccattttgtttctaattgaggttatttggatcctctcttttcttggttaatctcactaatggtctatcaattttatgtatcgtttcaaagaatcagcttcatgtttcatttatcttttgtatttttttgtttcaatttcatttacttctgctctctttgttatttcttttcttctgctgggtttgggtttggtttgttcttgtttctctagttccttgaggtgtgactttacattttgtatttgtgctctttcagactttttgatrtaggcatttaatgctatgaactttcctcttaggactgtttttactgtgtccgagtggttttcacaagttrtgtcactattatcattcagttcagagaattttgcatcttgatttcactgttgacccaaagatcattcaggagcaaattatttaatttccatgtatttgtatagttttgaaggtttcttttggagttaatttccaattttattccactgtggtctgagaggggacttgatataattttgattaccttaaatttgttgaggcttgttttgtggcctattatgtggtctatcttggaggatgtttcatgtgctgatgagaagaatgtatattctacagttgttgagtagaatgttctgtaaatatctgttaagtttatttcttctagtgtaamttaagtccattgtytcattgttgactttctgtcttgatgactttctagtactgtcagtggagtattgaagtccccactattattgtgttgctgtctatctcatttctcatgtctagtaataattgttttataaatttggaagctcccatgttaggtgcatatatgtttaggattgtgatattttcctgttggagttatccttttatcattgtataatgtccctctttgtcttttttaactgttgttgctttaaaatctgttttgactgatataagaatagctactcytgcttgcttttgttttccatttgtatggaatatctttttccactcctttaccttaagtttttgtgagtccttacacattagatgactcttgaagactgaagatacttggttgstgaatttttatccttyctgccattctgtatcttttaagtggagagtgttaatattgagatgtgaagtactgttctatttctcatgctagttgttgcctgaattccttatttttttcctttgcattactgttttataggccctgtgagatttatgctttaaggaggttctattttggtgtattttggagttttgtttgaagacttagaactccttttagyattttgtgtagtgctggattggtagyggtgaagtctctcagcatttgtttgtctgaaaaagactttatctctccttcatttatgamgcttagttttgctggrtacaaaattcttgcctggaaattattttgtttgaggaggctaaagataagaccccagtcttttctggcttataggctgctgttaatctgataggttttcctttataggttacctgatgcttttgcctcacagctcttaagattctttcctttgtcctgactttagayaacctgatgactatgtgcctgggcgataatctttctgtgataaatttcccaggtggtctttgagcttcttgtatttggttgtgtagatctctagcgaggccagggaagttttccttgattattccctcaaatatgttttccaaacttttagatttttgttcttcctcaagaatgccaatyattcttaggtcatttaacataatcccaaatttcttggaggctttgtttatttattaaagttcttttttctttgtctttktctgactgggttaattcgaaagkcttgttgtttgagctatgaagttctttcttctacytgttggatcctattgttgaaactttccagtgcattttgtatttctctaagtgtgtctttcatttccagaagttggattgtttcttctttatgatatctacgtccctggggcatttttaatccatatcctgtgtttttaaaaaatttatttaagttgtttttcacctttctctggtatctttttgagtagcttaaaatcaaccttctgaattctctatctagcaattcagagatttcttcttagtttggatctattgctggggtccagtgtggaggtggtaggggagtgaagtagactctgtgagaatccttggttgtagatagacttagtgtggtggctttctcaaatgctggttatgctagcagtgcagttgtcatgtgaacagaccgaagaccactggttagtcaagatttttcagccagtggaattagctgttttctcctttcttagagcagttattctgtcgtgaattgttgtaatgtcctgagttggttggcctccagccaggatgtggtgctttcaagagggcaccagctacaatagtagaaggtggatataagcttgccctaagttggccaagataaatattcagtttctcaggcaatgagtggtgtcataaagctcccaagagtttacgtcttttgtgattggctaccaggtgggtagagaaatgccctcaggtgtggacagggttaggcaggtctgagctcagactctcctcgggcggggggcttgcggcagccactgtgagggatggggyggagggtttttctccagccaatggaattatgttccagagggcattatggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttctttttgttgcgacggagttctcactctgtcacccagggctggagtgcagtggcgcgatctcggttcactgcaggctccgccttccgggtttatgccattctcctgcctcagccttcctagtagctggcactacaggcgcccgccaccacgcctggctaattgttttgtatttttagtagagacggggtttcatcgtgttagccaggatggtctcaatctcctgaccttgtaatccgcccgcctcggcctcccaaagtgccgggattacaggtgtgagcggcagcgcccggcgtacttttgtatttcatgctaaatctgtttcaggtctaggtaaagttaaatccttttcctgtaatctggattttcgagttccccagtggggacatgggtccggaggcaggtttttcccctctcacgctttgggaacgcacagtttttcacytgtctggtggagtttgcagtggcccctcccttctttaaaaggatctgtgaattctttcgattttctgggtattctcctgcagtggttcctttcttgagggatctgtgaagtgagttcctcaagatatttcttgtcaggtgaacagtctgtggtctctgcagggcctgtaccacccctgggcactgtatgccccacagagtgggcctctcctgtgcagggcctgggaagaggytgattataatctggtgtctgaggcctggcagcaccacactctcttcagtgagtcaggctcaagtctgagcacatctgcagagcttatgtttgctgtgttgctcatgkaaggcagggaatccaaaattgttttcttagagatggactctcactatgtttcctaggctgctttcaaactcctggcctcaagtgatcctcctgtctcggcctctcaaatcactgagattacaggtatgggccactgtgcccagcctattatcgattttctcccatttcattcagtcctcaacccaatgyactctctctttttctttccctcatctctgatgctcctctcagggtggcaactaatgacttttatacaactcaagccagtggtcactgttctgtttctgtcttatgtgtgtcattagtgtgtttgagatgcmycctctcctctttcctggaagttttctcctgtctsttgtcttttatgaacccrcttcctctctgttttcctaccamtttctagtcctctgcttttcagcctctttcttcatgtctgtgtttgtctggatgcaggagcacacactcagatccctgctatcctgactttgtgtacttttcttgagtgacctgacccaaaattagaacttcacccaccatgagcctccttccagtttatgtcactaacctaatgtagcatgacactcatccatttatttcactgccttcaaatcaactgtatgttttcccctagaagtttaaattcagtatgtctcaaacagaaaattttaccttctctcaatcacttaattatcacctttgcagkcacggatgccacaattctccacgttgcgtggttattctcgacttcttcatatccctacttctggcaygtgatttagtgattcctgtggcctctcatgtcattactgccatcaaatccatctgctgtcctcctcaccccatgttcctgccctggcctacgccttcattacttccyaccagagggcttaaaagtgctactggtcttgccttgagtccmgcctcctccagcccatccttcctacaggtgccccatccaaacacaaatctgaccgtgttactctcctgcttaagatacttcacaayttcctrtgtcctgtgggataaaatgcraacacytgccatcagcacacaaggcaggttacagtgctgcctggcccacatctcccctggcttcagtcacactgaagaactgcagttctccttgcaacttcatgcctctctgctcctgagcctgcttctcctgctggaaatgccatttcccctttctctgttttgctatctgcaggtgaacactgtccctaggaacctttcctaaatcgtattttaattttgctcctgagtagctcttgtgtataccttgtgatactcagtggtgatcaaaccacacatgtagcaatcatcttttctttgtctgttttattcttgaatttcaagtagattaaggacaaagttcccatctttagagtttcatccttattacctagagagtgaaagttcacaaaaagcatttattaactgaatgaaaattaacatttgaagtgtggaatttgcttcaaaatgtgccaacctttagttttcagattttgtaaatataataaatacaaagtracmtaagctgaaccaattacakctgtgtagcccagtctatacaccrtgtatttttctttttcctttgggattcatttctgtaggtgagtaatcctctagaccctaaactcagtgrgggaccctcaccatccrtgtgcrgcactgaacctgctgtcacactatgcatctaagtagaggactggttctccccrtgctgggctgggagggraaatcctcacttagggaccaccaaccatgcagtgtcatttggcttcacttcctcttccaggccgaaccctaaactctctgtaattcactgtaataataattcactttttgttatcaaccagttgctgcttcttatgtatcaggtaaagctaagatactatcccrtaggtctttcaaatgccaacaacttgtatttccaggtgaaactacacttgaaaactacactccwcaagacaattttgtgaatgttatgtgaatgataatacttttaaatttactctgcctaaaatgtaagtgttgtggataaaattatagaaggtatcatttttcttctaaaagtaagaatgtaacttgaagtctataaatgtcactaagactctggaggtattttcatgtccttcacgattttgttccactctgaaatatttattccatccttccacttccctgccttgctttatggctatatcagtaatttttaatgtattgtcctgtagggtttctgagatcctacaggaatgaggtaggaggactactcaatattgtttctaccaggagttgtgtgacttggacaagttactttacctctggggtcagttccctactatggaaaataagttcttctrcatgggggtgtgaagattcaatgagtaagtttagcayatagtaagtgcccaataaatattatcttactgtattcagcattaccattatcatagacggatgttaagtcttcagggacaagggaaacaacctrtatcgtccatgggtcatttctgtctttgtttcttctcactccttttcttttctttcatttgcatttctcattttctgtgttattccttcatgttcccaataaccttcctgttacctgtttgcttcctgcattctgtgtagcatcctacrtattcacccattctccatcttctccttcatgcagcagaccatgtgtcaacatatgcrgagtttgtgcagacgcacagamcctctggggagtatatgtttgaatttgatgaggaggagcagttctacgtgaacctggatgagaaggagatggtctggcctctaccagagtttattcacacytttgactttggtgctcagaggggtattgctggcatcgtcatggcaaggaagcacttgaacacccrgatcaatggtccaaacagacttgggccacaaatggcactgcctatagctgcctgttcctctcagaggggtattgctggcatcgtcatggcaaggaagcacttgaacacccggatcaatggtccaaacagacttgggccacaaatggcactgcctatagctgcctgttcctctagagtccagctggagggatgggagggcctctctgccacacatagaactagaggccatgatgcccactcatgaatgagccccttccctgagagcgagaaatcttrggtccacacagctgggttcttaggacagcagaggaggaggcattttcttcttactcaagagaaaggctgggctgagggggccaggtcaggagcacgagaagctgtgaccctgtccaggagccctaggggagcaggaggatgggcctgggagaggtggcccctaatctggtgaatataggacttggggtggtggaacctttaagaatcagccaatggcagtaggctccttgggttctatccccttttggagcccccaccgaggtaagcgtctttcccaaggagcctgtggatctgggccagcccaacaccytcgtctgccatgttgacaagttcttcccaccagtgctgaacatcacgtggctgygcaatggggagccagtcattgagggtattgcagagaccatcttcctgcccagcaagaaactcagattmcacaggttccactatctgaccctcgttcccatggccgaggacacctgtgacctccagggggagcactggggcctgcaccagcctctcctcaggcactggggtatggagcgccctccctctgccctcacggccttggcaccacctttatttcctgggcccatcgcccctcagcacctgccttcctcaatcccatgttttayggtcactttatccaaatttcaccatctcatggtttcgaatacccaacacctcccacatccaaggccagcccctgctctctgtaccttataactctgtcttcccttggtgccccagaggtccatgaamtaatccaggtgcctgagaccatggagatgctggtctgtgccctsggcctgctggtgggcctggcrggggtccttaatggcaccattgtctcaaagaccaagcgatctgacagcatccccgggtccaggggctcctatgagtcatcctataggtgtattagggacagagtggaaaagacgaggtaacaagttaggggtgaagagtgggaaagagaaacacttcaccaggggctctttgagcattactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgcactgcatccttccttagaaatcccagagtttcataaacacctgcatatgtcagagtgagacacatctgataccttctttctgtgactccagggacattcctcatctcctgacaccctcagttccctaggagcacatatcctgttcctgtaatgtgggtgcagatacctcagcttctgatcctgacaagtgttagtccagagattgttcactccactcggggtactgccctaacctgtaacatgagtacaggmgacaagcaggaaagagaatgactctgaytggatatggtttgtaatttgtaatgttaactgctcagtgactctgagggtaggatttatgtgctctgggtctgaggatttcataatgatctcgatttgaagactttctgctattctcatgacytccttccatcgttgaatccctggattgaaatcatattaattttatgytgcataggtttctcacaagtttcctgtgaagccaaaagggaaaataagacagataaagggtccttatttactatatactgycttccttagcttattatgtgacagctgaaattactacrcaaaaacaagtcagcagcattttcctttatagtttttgaggaaatgaggctgatcagggataaagatgttttaaaaagaaaaaatgattgtgtcctattccctaggttaagaagattatgagaaacatgattggttgtccttgtgtgtggcttctctttcctgactccctgactyagtccagcctctctgcagactccagctgtatttacttatatctgtgccagtgaygcccaagtctgtrccttcagccccacctctcctgraattggaggaagccrgtccccmgatggargatattatttgcaaggggagatgggcaagaggagcacagtagctttcgggaattgaccagggacaggygcccagggacacacaaggcccagaagatrcttgtaagaagccagggagactkaaggcaycaacyggatgtatmagagagctgctgtgcactgattrtgtgtatcaggagtraagaatccatcctytacacgaaaaagaaagcttacaacaaacatgtcctctaccttgaccraaaggtgtcaatatgagacgcaaaacacataacaatgttggattgttaagaaaaaaaaaaagaccagtgtttgaaaaagagtgctacaygtattgctttgctctttccccagtggggagtcatytctgtctgtaygaaaattaagacargaggcctaggctggtggaygaatgcagacttagacgacaaatgacgtctaytggatgcattcaaaagtccaagccgtatttggttaagkagtatttgtgatggcacacaaagaaaatggttaaagtgtattagattatatttatgattttaaattctgatgttcatttaacttmttaatggtaatgataaaacatgctctcagtaagrtatatgttgaattagtgctgtgggaataygggtcctatcaggcagatttgcagtctgctcaccattgaatagttaagaatagyggtctgagacataaatggatgagggcactaaacttgatttgggggcagctcactgaaatacagtcaattcagaagagtgtcatgtrtaacaggccmcattatacaatagttaacatatcyccaytttcatgsttctcttctttcctaygtktaaaccaaaatgaacttctttattaactcctactgtytactaaaaccctcagagaaaagtratgagagaygatttgrtgcatatttttaaaggaaarcaaacastyatgttgggttttgattatttgtggtgctaagaagaagggaacatggttggaggcccagtgagagaaacagtgctttgaatcaaagagcagaaygatagaaactgacttcagagcaacttcttggcagcagtatccwmttkggaagytgarggtctgtcctggarccagrtgytaacraaacacagcaaatgcttktyctaaggcacawtagtcttttcrgtgagstcaggaaccctgtgggggtaaargacaagttatcccaggttgcyrgcctccttcctktaagtccaggagagaaaaattatggtgagaggmtgcrtctyaggctgataaakaacagarytgatctctgcttccttcagcaatggagccrwgcaatgctytttccccactyrccygarrgcygasrttgaaagaggggttcatgcctgagattcccttcctggaggagcctcagtrttacaatgcacagaaargastcatatcctcctgyaacccaccccmcaaggaaatcaaagcaggaatattacctgtttatgcagatcctcgttgaactgaaatgaaagasgaaaggttatrtawtcagccattgaaaccacctcagatarttagagaaacatttccatcccaccaaattccattgmccaycactcaatggaygcyccgcaggagyctgagyacytgggacctcatgcatctggctgcattaagatcccagcctgggatcccyctctcgcyataggtcatgtttgttccccgaytatctgatwtcagtggcctctagagctttctgacatttcttttctgtcaaacccctcatcgtggaataagtgtgaatatgccaggggaaggtaagtcccgctcaccctgcaggctttctcacctttcttgctcctcctgtgcatgaagatgcccactccacagatgatgagccccagcacgaagcccccagctcccgtcaatgtcttactccgggcagaatcagactgtgcctctgggaaggacagacccaggtttagtgtcacctccaccagctgcatccctactcatgtcctgtctgagattctggagcctgatgcagcatatcgggatgaggacagtgcagcggaaaaagcttgctaagaggaaattcagaaagagccaccctcatatctggaacaggggtgtgacctcaacaaggtggcaaatgctgattctggaagttgcctctcaaaatgcctgagaagaggctaaaatgctgaaggaagagaactgttcctatgtgtgaggtcagttcctaagtgtgagggtttcgagaccagtcagtgtccctagattctctgacaagggggagaactatgaatcttcaggaacccctaagccaaggnnnnnnnnnnnnnnnnnnnnattaacaaatgtaatgagaaatgacattcattgagttgcttactatgttctaggcactattctaagtgcttctcatgtgttcacttatttacatctggagkttggttcttatttatttcatgttacagagcrggaatcagacaccgggagaggtgaagaccacacagcttcaaagtgcaaagcttggatttaaacccaggctttgggcctgcagtggctgcagtcttgtccagtatttagattatttcatctgcagtcactatctgtcttcctacattttacacagccttaattttcttctgcccgcagagtgatgttcagaacttccaatgctatgttaaacatttccagcaacgaaggacatcctatcttttgcacaatctcaaaggcaatccacctcatttctttgaaatatatatgctatagatttttggttcactayctttaacatgtcatgaaattgattaaattctgtctatgtcttgagctgaattcagtttaaattaatatgaattttgcrgagtccactaatgtgttaaccacattatatattttctgacactgaagaatcattgcattcctagaataaatctaaaattggtcaaaacgtattgtttttrtaatgtactgttggattcagtgacatggctaaaattagtccacaatcctgttctcytgtactattcttagcyggctctggaaatayaaatgaaccaacctcataaaatgatctcaaaaattctgttccattctatgttctagaatcacaygtgtaagaggcatgatctgctcctggaaatgtgggaggacrccctcatctgcaataagatcaggacagggccctttggaaggcgattctttgcttcccatgacaatttctttgatattctctactctattttagttttctatttcttcctgtagttttgacctttatatctttctagaaacgtatcckttttayctaaattttcaaatttatatgtatagarttggtcgtaagattttgcattttaaaatgtgtataaatgtcatttacccttttcgttctgaatctcctgtattttccttaggagtcttgccagaggtctcattaaagttttcaytgcctcaaaatttgattttrtcttctctatttttatatttcattgaattcagcttttgtccttattatttacatgtattttctttttgctgtttttctgcttttccatcctcttaattcacataattagctcatttgtttacagtcattttactctaacaaaattgtttaacartctgacattctatgcagcattttgaatgaacttatttcatctttctataaagactaaacatctattatgttttcagttatttcctcttcctccactatttccctgactttctagacgtctaattattaagatgtcagatgtctgtttctatccttcatttctcttcacttgtcctttacattttctattgtttactcgatcatattgtccttgggacagtttctcagtttggctttttgtttattaattacacttcagttgcaaaagtcctatttcttgtctcatttattatgtttctta

SEQ ID NO: 13465 - DNA, 23606 bp, Homo sapiens
atcgcttgaacctgggaggcagagattgcagtgagctgagatcatgccactgcactccagcctgggcgacagagtgagactgtgtctcaacaaaataatataataaaaacctggtgcggtggctcacacctgtaatcccagcactttgggagactgaggtgggtggatcacttgaggtcaggagtttgagaccagcctgaccatggtgacattcagtctctactaaaaatacaaaattagcccggcatgcctgtaatcccagctagggaggctgaggcaagagaattgcttgaacctgggaggcagaggttgtagtgagccgagattgcaccactgcactccagcctgggcaacaagagcggggctctgtctcaaaaaataaataaatamaaatttttaaaattaataataattagcaaagcatggtagctcacacgtttactcccagctactcaggaggcagaggagccgggaggatcacttgagcccaggagttcaaggctgtggtgagctatgattgcgccactgtactccagtgtgggtgacagagtgggaccctgtctcaaaaaataaaatagtgagagtagtagtgctacctcaaagggtcgctctgagggttaaaatggggtcaatgtggtaagccctctgtgcactgcctggcatgcaggcattttgttggtgaggttatatggctacctgctgcctttccaacagtgcctgccaggatgccctcccggggaaccccctgcctccgtcctgctccttctggtgggctctggtttcacccccaacgaggccttcccaggtccccattgacaatcacagccacctgcacaccctcccaccgccctccttcccccttcctgctttacttttccttccatagcactttgggccttccaacagatggtggaattgacttgttttacttgtcttctggtttatttttctttgttggtgtctcccacctctaacacatcagcttcaggagacccagaagtcttcccctctccttttcttactttatctccagtgccggtttcagagttggattgggctccagcgtgctggccctgtggcttggcgactgtcgcagtctccctgagcggcactctccccactggtccagtgagcaccgtctcatttacctgccttggggggtcgctgtgggtattcactgagagagggacacaagccaggctctggatggaaccggtttccctggcaggagctggtcaagtgtgtttgaggagcagggaggaggaggccagtagggctacagtagggtgagcgggcgacagatgagaggaggagaggcgccgggccagccaggaccctgtggtcacggtgagtgacaactcggactttgactctgggtaagccaaggtctctgagcagcggagggacaggcgctgatttaggcgctaatgggcgccctctggcggctgcctggggacagactgctgggggcgagggcagaagtaggggcacagggaggaggtgagtggatctcacccaagtcgggggcggtggagaatgctggatttaacttagcggtgaagctgacagatttggctaatgggccagatgtggggacagactaaaggatgctggcccgagcagctgcagggcgacatcttaagttccccgagatggggaaggtgtggggatgggggcgatgggggtggggagcaggactggaggtggtccggtctacagtaagatcagaactcatagcacatgttgaggggaatggatataagtgttgggctcagcaaagaagctcgtttattttattttattttaatttttcagatggagtctcactctattgcccagactggagtgcagtggcacgaccttggctcactgcaacctccacctcctgggttcaagcgattccctgcctcagcctcctgagtagctggggttacaggcgcacaccaccatgtccggctaattttgtagttttagcagagacggggttttgccctgttggccaggctggtctcgaactcttggcctcaagtgatccacccacctcggcctcccaaagtgctggaattacaggctgagctaccacgcctggacaatttcttaaaaaatttttttaaagtaggattgatagcagatgagttttctcggtgggccaggtcctctgctagggatttcaatggaatgatcccatttaaacccactacaacctcatggggctcttattgtcctcgtcttgtgggggcagagaggaaaagtccccagcatgcagagtgttggaatctggatttgtacacaaagccacgactctgaattgttcaaatcccaagactctcttccccatctctgactctgtcccccractcttcactctctctggatctctgtctaatcccactccagtgtcctgaccctcctygagctcaacctttcctcctcctgctaggaccctgccccctcayccctgtgcccttctgtctgggtctctgtccccttgtstgggtgtctgtcaccctccgctctctggttcctcgccttcccgtctctaatctcacagggctgatgtggacgctgctgtatggggggaacacctgccctgctcacagggctctgccacttttcccttccaggagggcatcctggctgtttcacccgtggacttgaacttgccattggactgagctctttctcagaagctgctacaagatgacacctcatgtccctgccctcttcgtgtgcttttccaagtcttcctattccactcagggctgtggggtggtggttgccctacctgtttttgccaaaaataaattgtttaaaacttttcttattaaaaacgttacaaartattcaattgtctgttcttacacttgggaactaaagttttaaggagaggagatttggttcagagatttctgtggcttacgcaaattgaggaaagaaccagttcattcattctagaaatatttatttgcagcacctacaagagcctgtctcctggacatgtaacatatttgagagaatacctgtaaatattccagcaacttgcatttttttttcctattgcacgatctggttattctagctaatgctgtatgatggtcatggagtctttccagtgaattccacagaaaggtacagtctaacttcacctgtgtctaggacaccaccctcttcttgtttttctcctcccattgctcctttcaagtctctcttgctggtttctcatctacctacagaccagtggtttgtctcacacacaccccccactctccctttttttttggagatagggtcttgctctgttgcctatacttgcactgttatatagatacagtggcactatcatggctcactgcagcctcaacctcctgggctcaagtgatcctcccacttcagcctctctagtagctggaactaaaggcatgcgacacgacgcctagctaatttttaaaaaagaatttttatgggaggccaaggcaggtggatcacttgaggtcaggagttcaagaccagccaggccaacatggtgaaaccccatctctactaaaaatacaaaaattagccgggcatggtggtgggtgcctgtaatcccagctacttgggtggctgaggcacgagactcgcttgaacccgggaggcaagaggttgcagtgagttgagatcacgccactgcactccagcctgggcaacagagcgagactccgtctcaaaaaaaaaaaaattgtagaaatggggtctcccttatgttgcccaggctggtctccacctcctgggctcaagtgatcctcctaccttggcatcccaaagtcctgggatcacaggcatgagtcactgtgcctgggcggtttgtctcctttatagggccatatcccccttcacagagtaatgtttgtaaattaataagtgaaatgtacaggattacaaaccgaaccaattacagttgatcctcagtatttgtagattatttgcaaatttgcatccttgctacaatgtattcataccccaaaaattaaggcagtgcttttgtggtgttttggagggcaatgcttatgcacagagctgcaacaagctaaagacctgatgtgcatatttgcagctgggctcctcttgcttcagctcaaacactggaaacaaatgtccttttcttggtttgtttagtgccatgcttttcaatttttttttttttttttaaagttagagtctcggtctgtcgctcgagctggagtgcaatggcttcatcctggctcactgcaacctccacctcctgagctcaagcgattctcctgcctcrgcctcccaagtagctgggattacaggcgtgtgccaccagtcctggctaatttttttatttttatttttatttattttattattttttgagatggagtctcgctgtgtcgcctaggctggagtgcagtggcaccatctcagctcactgcaacctctgcctcccgggttcacgtgattctcctgcctcagcctctggagcagctgggactacaggcgcccaccaccacacccggctaatttttgtttttttagtagagacgggggtttcaccatattggctaggctggtctcgaactcctgagcttgtgatccgcccacctcagccttccaaaatgctgggattacaggcgtgagtcaccgcgcccggccaaattttttttttttttttttttgagacaagagtctcgctctgtcacccaggctggagtgcagtggcgcgatctcagctcactgcaagctccgcctcccgggttcacgccatcctcctgcctaagcctccacgcccggctaattttttgtatttttagtagagacgggggtttcaccatgttagccaggatggtctcgacctcctgaccttgtgatccgcccgcctcggtctcccaaaatgctgggattacaggcgtgagccaccgcgcccggccgcctggcgtaatttttgtatttttaatagaaatgggggtttcaccatgttgcccagactggtctcgaactcctgatgtcaagtgatccgcctgcctccgcctcctaaagtgctggaattacacccgtgagccatcgcgcccgaaccctattgtaaattttaagtctcaggcgtttgccagcggcacgccagagagtatagcctgcgcggaggcccagaaaccaaagagcgagctcattccgggattggagagaagtgtgagcagagggaagtagagggatcggggagaggaggggcaggacccacgcattcggccctttgcattcagcttcattcaactaggaactttttctgcaaatcaaggaaagcttcccggaggaagtggtgcctaagctgtgctctgattcacgtttagaagctgaccagacaaagagaggtgggcgttcctggcagggggagggacttggcaaaaaccaagtggcttgagaggggttgatggttttaaaaaacttggaatgattatgtcaagggctagggatttaatgtgttgacgacggactcctattcctcacttgcttcgggaccccagctatgcccttcctctctctgggcctctcaccgattccgtttttcccccaggtaatgagcacaagctccctttttcctccagactccccccgggttgggaggatccaccgagtggacgaggagtgataattcctttgagccaatcgttggtgcctgaagccccgccttcttccctacccgtgggccaattgccgtgttctccttgaggccrgccgcttggcgagggtgggccaaaggctgcgtgacgtcgcttccggataaaccaatggcagcgattaggaggcgggtcgttttggtgatggacaggtgtttcaagacgcccctttagcgcggggctccccgggaagctttgaggcggtgctgggtgtaaaggggagggcattcctggtggattttgcccaatcaccagtcgcgcttsttgcaatagacgggcagttttccccatcccgggtcgacttgagggggcgggattctggacgccagagttggcaaacccctgacctatgatggacgtattctctagccaattactagacggtattctcagacgggccgcctccattgccaatgaaatcttccagcggggtcgcggtaggcgggccgtggaccctctggtataaggcggtcccgggggagtgaggagaaagggggggtcttggcggccggaggaggagtaggtgcgggtgaagatggcggcagccgaggccgcgaactgcatcatggaggtgagcgcttggagcgccgccgtgggcgggaggcggctttgggtcggtgtttcacgcctctgtggtggggaaagggctctaagttggcgatatggggttggaggtcccccgccgcacacgggggcgccgcacgttccacatccggggatatcgtttgaggtgacggctccctagcttccaagggccttcggcatccggcctagcggagggtcttatcccccctcccacgtggaggagggctgggggcgcttccggccaggcccccacgtggccgctgcgcggtgggtggggagggggtgtgccgagtccagtggcccggcggctccacgtgcgggacaaaggccccgcccccggccgggrakgggcgcccaggggggcggkgagggggtccgaccctcctgacgcccccagccctcctccccggggacctgggcacacgccgtggggtgtgatcgacctggggccctccacgatgtggggagtctcttgggaggagcagtgcttctcagccctttaccaacctccttccgagctccgggggcatctgttgggatatcggacccggttttgtgcgttctgggttagggactggaggaaaaccaagaatggggtcccccgccgaccccgtttcccctcccagaattctccccctcgcccagggctttaggagttgggggatggggcatgcccctgtgacctccctctgggtggtggtggggcatctagatagagattttcccattaataggcgccgtgcacccccttgtggccatttctgggtgtgtgggagggacatctttttcatggggcgtgtcctgaagcccacctcccctcggatttcttcctggcgggcggagggaggagggtatgtccgctgggaaggagttgtgggaaatatgtaggctgagagctttaccctactggagccgtttatctcccccgggtctttgtgagggtgcgagatgacctccttcttcctgaagccctgtgcagggtcctgagccctggggtcctgagagtgggtgcctgaaatggtttcgagtgaggtttggttctcgtgcagccatgtgggggaggtttcagtcttgcgtttcaagccctctggggctggggttgtctggcggtagttttcagtggtattgagaaataggcccgagtgggaaaccccctcagcacctttcttcttataggcatccccgctagcttgggagagctggagggagggtgcttggagcctagtaggtcatggcctgtgacgtggcccttcttggagacttggatagtggtcacatctggaagagatgtaatctgatggggcctctgtccttccaccccttacctatggcattggctggaggggcaggtcagctctcagctgtcaggatgcagctcccaggggtcactgtaatgacttcccaccctcttggctgtctcctgcacctggggctctatggatggaggaaataactttcccagaggtggcctcaggcttggccgcacctggaagtcttcagggcctgggatgggtgtctgaatgggggcgatggcctgactccccaagccactttttttttttttttttttgagacggagtcttacyctgtcacccaggctggagtgcaatggcttgatctcggctcattgcaacctccgcctcccgggttcaagcgattctcctgcttcagcctcctgagtagctgggattacaggcacccgccaccaggcccagctaatttttgtatttttagtagagatagggtttcaccatgttggtcaggctggtctcaaactcctgacctcaggtgacccacctgcctcggcctcccaaagtgccgggattgcaggtgtgagccaccgtgcccccaagccactttctggagtcctctcattcttagagggtccaggagctgcccatcttccctgggaccctaccttcgtgggcagagggtcataagggagggggttggttccagctggttttgtttggggctcctgagtccaaggcaggagctggggtctggggtactagctctggggaagtacccgtgtgccacacctctattctggaatcctctcagacatgagactggtttgcagaggtggcagatgccctgtgggcataycctgccagccccgctcccttctgctattcatggcaccctaggataggggtgtgtgtgtcaggaagtgtcacctaatctggaggagattaggtgatgagagggagcgacagctggcggtggtgggtgccaattcccctggcctggatgggggaggtgtgtggtcagctgcctggccagagaggggcagcgtgggggtgggccaccatctctccagccacagctgggataggagacccccctttcttctcccctcacttttcccaccctttcttaaacaccccacctcattacttgcccccttcgccaccactccccaccaagaaggagaattgctggaaacccaccccccggccagagcccaggttccgccacccagccctcccacagccactcccagtagctaatcctttttccctgttactctctcctagaattttgtagccaccttggctaatgggatgagcctccagccgcctcttgaagaagtaaatatccttttgtgagacccctccccaccctgacctccacatcaatatatcttgccacacatctggccctttcttgaggtctaaccatacccctcttgcttcaaaccagtttaccccaggcccccagacacttagtagcaacccctccaggttcacagcccccgctggcctcccccagtatcgccgctacttccttaactccacctccaacccccctttgcccttccctgtgtctgcccccattttccttcccctcccctcccyagctgtgggctgagctagagacggggtcagagagactggagagatggtaggcgtggctgaggtatcggggtgctcccctggatggtgctctgggggggtcctggaagtggaaaatggggttgttaggttttggggttcctgggggggcaagatggcaggcgggggctgtagggttgtcatggtatgattttgggggttctatactactcttcagggaaaagtagggcgctggaggtttaagaggctgtggggagcccccagatctgacccatgatcccatcggccccctcccaggtgtcctgtggccaggcggaaagcagtgagaagcccaacgctgaggacatgacatccaaagattactactttgactcctacgcacactttggcatccacgaggtcagtggggacagtccccaaggccccaatcttaggggggcttaaatgttggggaaggggtggaacctgttttcccacgcatgcgcactgcttcccctggccgcaggccgcccccctgcccctctgctgcgcacyycctagggtcgcctcgccaagccgttgccttggagaccgaggttagcctgaatctctgcaggggcctcgcgccgaaggctggggtgggagagcgcatgcgtgcctggggccttagccagaggtcgggcagggcccactggtctctgccgccctctagtgaccggcggtgggactgcgccccggctgctcccgccctaacagcttctgcacacttcagatctgactgaagacactgaaatcccagaacraagctggggtggcattctaaggaattttcttttccccctgaggcctttttcataaaattgtggcaaaatatgcataaaattgccattttttatttttagagacggtctcgctctgtcgcccaggctagagtgcattggtgcaatcatggctcactgcagcctcgacctccccggctcaggtgatccccccacttccactttcggagtagctgggaccacaggcgcgcgccaccacgcccagctgatgttcttatttttctgtagagataatcttgccttgttgcccaggctggtctcaaactcttgggatcaagtgatcctccgctttggcctcctgaggtgctgggattacaggcgtgagccaccgctcccagcctgaggacttttaaaagccagggttcactggttcttaggtagcagtggtgaagtccggccaagattggagtttagaccatctaatctgattttttaaaaagggaaactggctgggcgcagtggttcacgcctgtaatcccagcactttagggggctgaggtgggtggatcacctgaggtcaggagttgaagaccaacctgggcaatatggtgaaaccccatctgtatgaaaaatacaaaaattagccgggcatggtggtgtgcacctataatctcagctacttgggaggctgaggcaggagaatcacttgaacccaggaggcggaggttgcagtgagctgagattgcaccattgcactccagcctgggcaacagagtgagattccatctcaaaaaataaaataaaataaaaataaataaatgaataaatataaaagggaaactgaggtgcatggaagaaagcgagagggccgagctctggccctccgagctctcaggacacgctgttctccagctggggatatggggcccctcacggcgtctctgtgccattcttgccctaggagatgctgaaggacgaggtgcgcaccctcacttaccgcaactccatgtttcataaccggcacctcttcawggacaaggtggtgctggacgtcggctcgggcaccggcatcctctgcatgtttgctgccaaggccggggcccrcaaggtcatcggggtgagtctccagggtggccaggcggggccgggcctgagggatggaggggagcccatcagggctcagggattggatggaggtgatgggggcaggggatgggtctcaccctcccttcttcctgggccctcagatcgwgtgttccagtatctctgattatgcggtgaagatcgtcaaagccaacaagttagaccacggtgagcccagaaagaggatgggtttgtgggagtggagggggtgatgccctgcttccccagggccctctgaagagcagtggggtctacagatgaccacagattcagcagctcccaacccatggtcttttgggctgccggccgcctgagaatctgagtgtcaaaatcacaggcttagcaccgcagtcttaaaattagggcaagaagcactctctagtttcttgaatgagtaatagagtcacgtggttggccacggaaggcccacagtgagaagccttccctgtttcccagctgccctcctctgagtttaaccaacactaacttccagagaagtctggacctacaaacacatacatacgtaaatgcatttacattctcgtgcataattttcacgccagtagcatttcataccagcctcttgcccttggcttcttacacctgcttgtcatgtcgtttaacactttccaggatgttgcggcatccgctcttttgcatgaccaccatcataggtacatccccagcatttttttttttttttttttttttttgagatggagtctcactcttttgccaggctggagggcagtggcacgatctcagctcactgcaagctccgcctcctgggttcaagtgattctcctgcctcagcctcccaattagctgggattacaggcgccagccaccacgcccggctaatttttttgtttttttagtagagacggggtttcaccgtgttagccaggatggtctcgatctcctgacctcgtgatctgcctgcttgccttggcctcccaaagtgctgggattacaggtgtgaactttttttttttttgtatttttttagttgagacatggtttcaccatgttggccaggctggtcttgaactcctgacctcaggtgatccatccactttggcctcccaaagtgctgagattacaggcgtgagccaccgtgccatcctgaagtgatttttaaaaagagattattataatgaacgcacgagtccatttgaagcaaattcccactgtgatgtaattttcccggtaaatgcgtctgcttgtgtcttatctaatagataaaggctgttttgagaatgtgatcatgctgttacttattatatcaaaaccacccagttaaaaacaaaatcgcggccgggcacagtggctcacgcctgtaatcccaacattttgggaggccgaggcgggcggatcgtgaggtcaggagatcaagaccatcctggccaacacggtgacaccctgtctctactaaaaatacaaaaaattagccggacttggtggctggcacctgtagtcccagctactcgggaggctgaagcaggagaatggcgtgaacccgggaggcggaggttgcagtgagctgagatcacgccactgcactccagcctgggtgacagagcaagactccgtctcmaaaaaaaaaaaaaaaaaaaagtaacatcacctgatacccagtccacataaaatttctgctcctgcctcaaaaatgtccagaacgatgtatgaattttaaaactgttagaagggttcatggcttctgctcacgcrgttctctgaactgaagtggggtccccaggctstagcccccgggggaggtgaggtgaggggcaggcctcccgggggctgacgtggccacccttgtccgcccgcagtggtgaccatcatcaaggggaaggtggaggaggtggagctcccagtggagaaggtggacatcatcatcagcgagtggatgggctactgcytcttctacgagtccatgctcaacaccgtgctctatgcccgggacaagtggctggtgaggccccagcgggacgggtgcagctcgcgtgggctggggtccaggtagaagacgaaaaccacgctcaatttttcccacagacgggacttactgtgggggcktagctgcaaggtgttagaaagccacagcccaagccaggtgtgacagaccctggagggagatggtgcgatgtgggggaggtcgyaggaacaggaaatccgtagcggcgcaatagcccaggtccttaggccccagcaggcctccccgggagaggtgaggtgacggagaggtggatgaagcatacggaggggcagccagggcaggtgtgcccttgctgcgtgtggaacagcagggaggcccgtgtggaaggagggtctagaacggcagcaggaggaggagtggaggtgaggggtgacagggcgtgtgcagattttgtggaggcttatgggaccccgtgcttttcctctcagagcagctagggagggtctgaggatccccagaacctccaagggccgggagctgactggggtgcccctgggtgccctctggcggccgtgtgggaaatagaccagggggcgaggggtgagtgccgctgcgacatgagggtggcccagaccagggcaggaggccacatcttggaggcaagactcagggtagtgttgccaggccccacccttcatgcctcgccctgcccctctgtaggcgcccgatggcctcatcttcccagaccgggccacgctgtatgtgacggccatcgaggaccggcagtacaaagactacaagatccactgtgagcgcggcccgggagctggcgggcggggcctcgggtgggctgctgcgggctcaccccctccctgcctgcctccccagggtgggagaacgtgtatggcttcgacatgtcttgcatcaaagatgtggccattaaggagcccctagtggatgtcgtggaccccaaacagctggtcaccaacgcctgcctcataaaggtgagggggtgggcatggccaggtgccccctgggttgaaaccaaagagaggccatcacctggccctggcatgggactttggggcccagaatgttggcctgaggtctcagagcctgatctgccagccagaggtggtgctagaggcccasgaaagacacttcgtcctttaaatatctttgtgagcgctgctgtgtgagaaccatgcttggcacttggcttctggcggaggaaacacccaaagctggcagctaaagcccacagcccatgcacggaaaggcaggaccccagggcgatgagcggatgcacatgcacgcgggccactgcagaagagcacggggccaggctgggctccgagatgtgcctgaggtcccagctactcgggaggatcacttgggcctgggagttcaaggctgcagtgagytgtgatcacatcactgcactccagctttggtgacaatgttttgttttgttttttccttttgtttttttttacttctgagaccctgtttaaaaaaaaaaaatacggcgatgagtatttgttgagctgggatgtgtgagccgggtgaagctgggtggctgaccgggggatcctgtcggggaggagtaagttgttgagtgggggaggagaggagactacaggggcagggaccccactcgggccaccctcctgagagccaggggaactggcgcagggtttaggttggcatttgtgttgccgtttgaagccatcatgttgttggacttgtcaaggggttggggagacagtggagtggggcgcctgcattctaggaggtctggacagagttagggtggcactgccaggtttgggtgttggagaggagggagcaaggaatctgggctcraacccacatggtttattgggagccggataggcaggatgcagagtgaaggaggagccgaggctgggtgccagtgagggagggctagcaggaaggggacagcgaggtcacaggccctctgggagcttaagggagggaggaggggatgaagcgaggtggggacgcatcccggagctcgccctctcatgtcctgcaggaggtggacatctataccgtcaaggtggaagacctgaccttcacctccccgttctgcctgcaagtgaagcggaatgactacgtgcacgccctggtggcctacttcaacatcgagttcacacgctgccacaagaggaccggcttctccaccagtgaggcggggcccacagggctgggggccgttccygagccagggcggaggcgcacccacgtagtggagggggtgacagaaacgggcagaaggaaccatggggacacgcgtgttccagtgtgagctctgccatgtagcagtcacgtggccttgggcaagtgacctgagtgtgcagtgcctcagtttcctcatccacaaaaggctgacacggtccctgtctccaaagctcaatgacagggaggtgactcgcggatagcagtcccatcagctgtcatgggggtgggcattccgacagagggaacgcaagggtggggttggsgggggcagcaggccgaggccggctgacccgcccgcgcccccaggccccgagtccccgtacacgcactggaagcagacggtgttctacatggaggactacctgaccgtgaagacgggcgaggagatcttcggcaccatcggcatgcggcccaacgccaagaacaacgtgaggctccgggcagctgggtgggagggtggcagctagggcggggagtgtagattggggggggagtggtgggggaggaatggtggcagcgggggtaggggatgggggcagccggggtgggggatgggggcagctggcgggggcgagcacctctgcctattcccgggtccccaagcccctcagccccatgcctgtctacacagcaggattgcttgagcattcaccggaagttatgggcctggggacccaggctgaaaccctgccctcctggtgcttccactctagacaagggggtcagtgacatggtgatgccagttggaggtgacctctgtcaggctgggagcagggcagacaggtgttggtgtaggtgggctccagggcaagaggcagcccccagtagagtgcacggggttttctagcccagctgggaggcatgagaggagaaaggcagctttttgttttctgctcccctttctttttcctcctgagcacttggcaggagctgccatcacctgagatcagggggcttccgggggagctgggggrgcttctcggagacagggtctgggcagagatccagtgtggtgggtctgagcaggcaggaggatggaaggcttggagcctggagtcgccgggagtggtctgggttggaaaagtgggtcccggccgatgggtgcgagggtgggtggcactcagggtagtcatggaatgtggaccctgggacacccacgagcctgtgacagcagcagttgtcaactgggcagttttactgccccctccgctccccgcccccccccaggacgtttgccaccgtctgtggaaacatttgtggttgtcactccggagaaggggtggtcctggcatctggtaggtaggggccagggggctggtaaatgtcctgcagccacaggaccaccccctacaaagactcatgcagcccccgggaccacggcactagctgggaaacggatactggagagggaggaggagtcctcgggcgttggtgactttgtctcatcttcatgtgctggagggtatggggggaggagaggaagtggagacagcaggctggaccattgtgtttcactggaacgtttgcctgaggaggaagtgggcttgggagaggttttcttttttatgaaagaagcaatcactgcattgctgatgggaatcatcctgatggagaaatccaagggcaagggacagcagctgggctctactcctgagtgagtctagtgggcttgggggtgtccatgtggtgctgtcccttggcagggtcagggcagctgctagggtgggaccagcagttggggtctgcagcgtggagatgggcaggaagctggagcccggctcatcgtcgcatagcctgcctgcacccgccccccgccaccacctcctggtgggttccgccctcatgccccacctctccctgcagcgggacctggacttcaccatcgacctggacttcaagggccagctgtgcgagctgtcctgctccaccgactaccggatgcgctgaggcccggctctcccgccctgcacgagcccaggggctgagcgttcctaggcggtttcggggctcccccttcctctccctccctcccgcagaagggggttttaggggcctgggctggggggatggggagggcacatcgtgactgtgtttttcataacttatgtttttatatggttgcatttacgccaataaatcctcagctggggtctggctttgtttcctgggggcaaaggaggtttggggttcctttcgcaggtactgcagtgccagcctcagcagtggggggaccggccttggcacctgctggtggctgccattctgtggatctgcgtctcccgtcccccgtctctaggcctcttgctccccttccttggttccttctcggggtccctgtcctccacagctgtctctcagggtctttgtccaactcttttcatccctctcctgggtctgcgcccctcccctctgcggtacccgtgtcctgcctagtaggggatgggggtggctttccagcacagccagccctcaagtttcccagaacagtctccccacctccccccaacactcgacattgttcctctctggctgttttttcctgttcgggtcccttcaaggcccaactgtgcccagccctctgcagctggggacactgagtgggttgggggtgtatgtttgcaaggatagaatttctcatgggggagtggccctgcttcctcccctagaatggcttggggcttagggctggggacttgccctccatggaggtcagtgggagttgcagctgtaaggtggcagggcctacccatcttacagaggtgaagacgaggtccctctgcctctgctgcagacatggcgtctgcacccacccttccaccctcagggcctggccacggggtcctgggtcccccacaatactgtgcactcgacctggttgacccaggacaccctcctcgttgaacagccctggctacacctgcttcagtgcaactggagccctcaccggcgagtgcctgacacctcggccttttctcttccggaggggcgctcctcagtgtgtttggggtctccctcgctccacgccctccagggggccgcatgtgcacttgccctgcattgcctggcccccgaggttccagggtcycaactgtctactaaccggcttcccgacagggtgagggtgaggtcgcatctacaaccagagccagcgcttccccgccgccaccccttttcttggaatcccgctgcttagctacctgcgggtgtcattggccccgccccatttccccacgctttgaagggggcgagtctccacagacctcctagggggatagacagcagctggtgtgaccccacacacccagtgaggtctctggagccgcggtgcgggaagcggggacccgggtttgaatcctgcccctctggtgtggtgcggcctcttcccacagacttttggcctcagtgttccccgcctgggaagtggggactggccctggtacctggctccagagctgcacccagaggcgatcagcccggtgcgggaacggggcggggtggccgcaactacgggccacggatcctgacccgccctgcccacgatgactatccacatcctcatcctgctgttgctcctcgccttctccgcccaaggggacctggacactgcagccaggtgagaaacccgggtggcagcagggacagggcgggagggagaccgtaaagggcgagcgccctctcccggccgcggaacgggcaggtgatctgtaagcctccccgctggtcttggagtgcttgggtgcccacctccatcacgctccatctctcaattcggtttgaacccggttttctcccacgctccctctccaggcgaggccagcaccaggtcccccagcaccgcgggcacgtctgctacctgggcgtatgccggacccaccrcctggcggagatcatatactggattcgctgtctccaccaaggagccctcggggaaggccagccacgagccccaggacccctacagctatgggcgccgccggtggcgcgaggcggaagcccggctcggttcccaggattccggcctgcagcgagggggctagcgcagtgcccagctcgctgggtgacctcgggcacggctcgtcccctcctcggcttcagtttgcctatctgtatgttggagcttctactccacatttcttctcccctaactccagcccctgaaaccgtcttccccagtccctccccgggctgcgactaggttggacctagaagcacacgggaccaggctgggcgaagaacactgacgcccagagccgaataaacaagagttccgtgtttcagtctctgcttctctgtacctatttcgacctctcagtcgaggctgggtctctaatatacctttctctattagccatgctgcttctccctcacggaagtcccactgtctaccttgaatccaacccgctgtggcgcctttcttgccaactcaatccatgcaccttccgtgggtggttttggcgggccgtcctgacccccaaacatccctcctccctccctggcgtgaaagggctgagatttgctccggcaccctacgcgcctgacgttataatgcacctggggtgggctgcgacctcccagctgagccttgttcctcgaagagacaggagactaagagacaatgagctgagtgaggagcccaggaacccgggttccgaacagctgcgtagaatgcgagcggccaaatggtggagaatctggccgggtaaaaggagacggaggactggggatcgaacggatgtaggggattggacgccgtggctcgaagggggcggggatagaacgcggggattggaaggaggcggggataaaacccgggacctgaatacccggctagggacacgagagasaggaatcggggtttctgggtgacggtgatctcggggtgggcaggactccaaaggcccgtcgacccggtggtggactccttgcactgggattggacatatgcaagcgggagatttggggccggcgctcaaaatcggggggcgggggtggactcgggtttggaccccaggatccgatcagcggacccttgattcaacgtggtaagtactggaccccaggggctcgggctccggcggggcctggagtcctgtgtctagggttgggcgtgcaagcctctccatcacttgtcctcgacgctcgcctccgctcacagcctcagcatcccaggctgcgaggcatgcgcagtgggtgcttccttccccattccctccagcacgggcsgggggaggggacgctgagcggatgaatttatagacaccatccccctcgccttggcatgaaaagcggmaatggggtggacagcgtcaatgtctaacaggtgtttgtttcatatgggtctaaaactaatgcttttctcaagaccccgcaactcagcctggaccagtttccctcctccacccacccccgaatcttgagaatcctgtactggggggagggcactgcccccgcaccatgttcttgggagagcaggtaaaggggttaacgcgagctatccctctggcctctctatgcgttcccagaggtcccgaattgacgtccttccctcaaaacctccgggtctacaaaccaggaccctcaagacccttcaggtgcttagagaaggatgagctaggttatgtagtcctgggtcggcgcaaaaaggcagctgaaagcgtgagatcccgggtctgagggaggaggggctggggcctgggcttctgggtctgagggaggaggggctgggggcctggactcctggatctgagagaggaggggctggggcctgggcttctgggtctgagggaggaggggctgggggcctggactcctggatctgagagaggagggactggggcctggactcctgggtatgaaggaggaggaggggctgggggcctggactcctgagtctgagggcggaggggctggggtcctgaagtatgactctgcccgactcagggctccagcgtgacatggctgaagcgcaccaggccgtgggcttccgaccctcgctgacctcggacggggctgaagtggaactcagtgcccctgtgctgcaggagatctacctctctggcctgcgctcctggaaaaggcatctctcacgtttctgggtgaggagcggtgctggtcggtttccttccggggatccaggtttctgcttccgggatgtctgaggctcacttccggcatttcagctggttyatttctgggagactatcacccctttttcykagaattttgatgtctgctcccaggacccctttagcaatttctccgtggctcacttctgggatccacagccccacctgctgagaacctctgctcacttctttcacccaagaggggaactgggccccccaaaaactacccacttycagtttctagaactccatatccttcccttatggtgaaattatcatttcttcctttcatctccagcttcttttgtrgttgttgtttctgagacacagtctcactctgtcgcccaggctggagtgcagtggcgggatctcagctcactgcaacctccgcctcctgggttcaagcaattccctgcctcagcctcccaggtagccgggattattggcgcacgccaccatgcctggcttatttatttatttatttatgagacagagtctcactctgttgcccagactggaatgcagtggggtgatcttggctcactgcaaccacctcccaggttcaagcgattctcctgcctcagcctcccragtagctgggattacaggcatggattatacgcccagctaatttttgtatttttagtagagacggggtttcaacatgttggccaggctaatctcgatctcctgacctcaagtgatctgcctcccaaagcgcttgggttacaggaatgagccaccgcgcccggcccaaactcytgctctgtycctgttctggaatgcgcatgcccaatgtgtaaccagcacccatgtctgtcccagggtttctggttctagaactcttgcactgtctccatacagggactccctgcttgtcacatcctctgtgtgtgaactggggtctggaacacctgtggggtcatgattgagtttgaatcctgactccaccgcttagtagctgtgtcatcttgggcaagcacctctcttggagtcgcagtttcccctcgtggaaaacatgggtgttgacagcacctccctcacaggatagccttgaagactaaattaattcttctatgtcctggcccatggcgaggtctgagtgttagcttctgatattgttcttcattcattcaccatatatttatggggcatccggtaagggcctggccctctttagcatggagaacacagcagatatcaacagacagaatcacgcctgggcactgcgggctcacggctttaatcccagcactttgggaggctgaggcaggaggatcacttgagcccaggacttggacaccagcctggrcaacatagggagaccccatctctattaaaaaaataaagacaggtcgggcacggtggctcatgcctgtaatcccaacactttgggaggctgagacggacggatcatgaggtcaggagatcgagacccttctggctaacacggtgaaaccccgtttctactaaaaatacacacacacacaaattagcctggtgtggtagtgggtgcctgtagttccaattactcaggaggctgaggcaggagaatggcgtgaatccgggaggcggagcttgcagtgagccaagatggcgccactgcactccagcctgggcgacagagcgagactccgtctcaaaaaaaaataaaataaaataaawaawtaaataaataaataaataaataaataaataataaagacagaatcctgcttttatrgagttctcattcgagttgggggagaaggcaataaaacagatgagcaaaacagaaggcaataaaacagatgagcaaaatatagggtatggtgacattctatagtgtcatctgatattgatggkgacacatgctatggtgaatgataaatcgggtagagaagagtgatgtgggggtgttgcagttaaataagggggtggcaggccaggtgcggtggctcacgcctgtaatcccagcactttgggaagccaaggcagacagatcacgaagtcaggagttcaagaccagcctggccaatatagtgaaaccccatctctactaaaaatacaaaaattagccgggtgtggtggcaggcacctgtaatcacagctacctgggaggctgaggcagaagaatcacttgaatccaggaggcagagattgcagtgagccaagattgcgccactgcactccagcctgggtgacagagcaagactccgtttcaaaaaaaaaaaaaaaaaagggggtgggagccggcggccaggaggatctcctgaagc

SEQ ID NO: 13466 - DNA, 43943 bp, Homo sapiens
  misc_feature (1)...(43943): n = A,T,C or G, or insertion/deletion polymorphism (see Tables 1-2)
aatgaacaaatgaattaattagtacatattctatgtgttagtgacaacatgattgttattgaataaattaataacatataccttatctacaccaggccctatgctagataaacactaaaaatatgaaaatgaaggcatagccctgccctcagcttcttcaatcttatcgtttggcacagtttcagccgggtttagagttttctcctcttgccaatcatcatacggctttccttattttcctgagagatacacatcctttcacatataaagtgtagtttaccatagcatacaagcacactgggaattttgcattacagattacgtactttctgaagtattaaacacatcatttctacaaagtgaagtggtgatacgtttaataaggttggagtaattttttaaaacagcccccataacatttatgatccagtttactagaaaattggcctactcaaaatattttgcacagtgaaacatttgtaatgaaaaaagaaactggcaattttttaaagctccttcctagatttaaagttttttttcactgctgtttgcacatttcagatcctgctgctgggggctctgacgactgggcttatgaccaaggaatcagatattccttcacctttgaacttcgagatacaggcagatatggctttctccttccagaatcccagatscgggctacctgcgaggagaccttcctggcaatcaagtatgttgccagctacgtcctggaacacctgtactagttgagaaagctgatggccttgtttcaaaattctcatttttcatttcttttctttcttgaattcttattttggtttgcctggatgttttgcagatcccaatctttcttttaagcttctgggtctattaaactaggtagatcttttcgtattgatcataataaaagtgaatcattactattggaaaacttgacatatggtctacttctttggggaaacactgatgtgaatgaatgactaagcaagccgtgcacagtgaggatccggtcagctgtataggagttaacatcctggggtgctggctgagaccatcagggtgtagatgcactgattatagtgggaggcttgtgagctaagaagaaatgtaaagggaaatttaggactgttaaacctggcatacatgaaaagacaccatctttcttggtctagctttcatctcagctcattaaagttattttatcggctgtctactacatgccatgcactttgctaagcaattgaagatggaacaatgaaaaagaaagataacatttctgcccttaatgggtgtataggccctttggaaagacagacattacacaaataattaactcattaattaacaatttattaattagtaatctaatttacattaatcaaataagtgctggatgaactacrcaaaaagaacatacaaaaagtctacctgcttgatgtacgggagaagcctccctcagaaactgctgtaacctragaaataagtcacagttagctagacaaagggagcaccgcttccaggcctgtggctatcccaaaagtataagaagaaagccagtgagggtgaaatttrgagagctgaggaaagaggagcatgtgtacaggctggggagggtggtaggaaccatgtcaggcagagcttagaggtcacgttaaggactggggacactggtctaagaacaatgmaaatccattgaagatattaagtcatcaatgacatggttacagtgtttttggaacaccaactaggctagggtgtggaaagcagatcagaagtgagacaagaggataccagggaccctgactggaccacttggaccaatgaaagtggcaaaaatcactccagaacttgatgttttccgggattggaattggacatgctgtgttgggaagtattgtgccaagttcaaattttaaaatagaatgagatgtattaaagttacgatttgggggcatctcttacttaaaaatgatagactattaactcattactttctatagactttctgtagtctactttcatagactcttaacttattactttctatatggcttcaagaaaaatgagactccatatagggagggcatgatgtgctaaaatatctataacagtgttctattcataaagagaatccattgaagtaacaacggtttgtgaaagttgtcaagccaaagaataattaattgcattaattgtccactaggtggtagcagtgcagctgctacaatgtgtcacacactcatcttcaaactcatttagtaatacatcatttaaatagrcagagaaccatatgtgaaaaaaaaaaatcccattaatttgtcagcaacattggtggtaatttaaaaatagatgtaatttagctaaatattcttcctcctactctttaagttatatccactttgtgtattggagggctaacatagccatagttacctgagtgaggtaatcttgctggaggtgtatcattaaactcctgttccacaggatactcccttgctatctctggcaagtaacaccaacccctgactaagggaagctgtggcccaaagtatggaaatcttggcaaaccacaaagaactctcctaattccctaaattgaatgctttaaaatagaaattaggaataatatatgtggactgcttktttaaaattccaaggaatttttaagggtaagaacaaagaataggaaagcaaatatgcaaatattcttatttgaaatcccatgtatctgagatgtcctgcacctgagaaatttttactatgaccactgtctactgaaagttaacaggaagctgggtagaatttccacttgcctgggcaaaaccaagaaaaacagaaagagaaatctgccttagtcttcactgtagtagtatctgaccagctaatcagagactgctgtgagtccacccagccttgcccacctgagagccccaggttggggggatacctcttcttctccctcttttatcccactcccaccctgagatcccagagcaggctctgagcctttccttcagctccaagctctcagctcccaaagcaacagtgaaccaacagcacaagagtagcccctgaatctttctttctcaagtggtgtgggtagaaaatagcaagactgattttctcatctggattatggaattcctacatacctagaatcatatgccatttgttcatcttattctgcaagctgacctatatgaattggtcaaagagagaatttctagaaggaaaagaaggcagaccatarcaagttaacatgttaatttgggggcaaaaagggttctgctgagtgataatgattaaaaatatatagagaaaagcatagctaaactatatggtgatattttaaatcatggctagacgtgcactactacaaataccatagaaagtgcagagctcaagaaagatggaaaattatggctgcatgaagtattcacctctaagtcactttttaaagaggttgatttaatctgtgaaacatcacagtcttacatagtcaatcctaaaatgatacggggtttgacaattattcatcctacccacacatatgccaagaccttttataaatcttgatgcagtaatataaggcagcactgatctatgcttgccaagaaatagcgcttgttctgagaaaaagctctagaacattattgaaatccatctattgtatttttcttcagaggctaaatagattggagaggcagtgggagtctcaaacacatcacatrtttatatcatattccagaaagaagaaattgccaatatgtaatctattaagaagccaaagatgtacttttatttattaacaaagtcttatcctgagaaataccaargtcctcaaagcactcacctagattccccaaataaaataaaagtgttcttcctacttgacctgaaaaacagacatagaagctttctccacacaattttaaaaccagtcacagaggaaacagcttcaagaaaatataacagaattctaaaattaagaggatttctatttttcctctttcacctttcctgtattttccagaatcattttcaatgggcatttataatttttagaatsagaaaataaaactctaaaaagcaaagctataacattaaaaaaaattmttgaagtagtccacatgaaaacaaatacagagacatattttatccctaaaggtcacggccaccactttaatctaccacatgatctattttgataccggttctgcaggctggcagtggcccactggaagtctctgttgacagcacatgaacattttatcaactgtctagagagcatggacgtgttttttagcacctaccacgaagtccctaacatatcctgtctcactaagcctcacagccacttgttagagtcacattagcattcccattttacaaatgaggaaaccaaggcccagaataactaggcagcctgctcaaggggatgtagctagcgtgtgggagccacattgaagtgatgtctgtcgaaacccaaagtcaaggtctttctttttcactgttccctggtcaaaagtatctttagtcaaaagcaatggagcaagcatttgctttgggagttctcagtgctggtgagcttgcccagtgtcaagaacatgaaggcatttgtaaaaccctcctcttccttacctgcaaggctggagccggaaaatccatttggggaaataaaaaaaagtcccgagttctaccacacacccatcagatagagaagaatggaattactgctgctgtatatataacaggggcgtgtctccaaccacactattttgatagtacataagcgtgactctgagaagttttatctacagtcagctatacgtttgtcaatgtgaagaggtggttttcaaaaaggaaattctaataagttaactgattagataaattcacttactcttttaggttacctatgattctaggtaaaggtgttattctcccataattaaccaagttgtgttcaagactaaacatccctccagagatggttgtgaatggtctataggtggctttcattaattcaactctcaaaaggcattatttggcaattacagcatccaggctctgaagacagtgtccaattaataaacattacagcattgatattttcttgctgtcaggtagttctcaagttgccttagaaataggggtcacctctgaggacagagagaagagaagggcaaagagttagggcagtgctttaggtctttagtgtttatttctttacccagagaagtacaggaaaaatataacaaaaatgttatcattgtaaaatctaaatggtgaacatttcaatgttcgccatagtacttacagcatttttagtacatttatattttgtaatttaaatttttggggktttttttgcctcccaagtagctgggattaaggcacctgccgccacgcccggctaatttttgtattttttagtagagacagggtttcaccacgttggccaggctggtcttgaactcctgacctcagatgatccacccgccgcggcctcccaaactgctgggattacaggcgtgagccaccgtgcccagtcaatttaaatgtttttaatttcacaacttacattctagcttcaaaaatatattttacattattacgaaccactcaccaagattttatggccagatacccaaattcatctcagtctccaagtgcaaattttaaaactaatttcttccatcattcaattcaagcagaatggtagagtagtattttagaacagatagaactagtaaatcccagctctgtgaacatactttctytgttaccttggccaagttatttgctaaaggcatttgcttcccatcctgtatctgtaaaatgggtatttcctattgcaaaaggtagataagtagcatgtgcttggtgggttagtgtttttccctctccagctggaaaaaaaaaacctggtgtgggggaagaaggggaacagtttgtgcaacagaaccctaagaggaaatcagctgctcatcaagataagggctgaggcataaaactgccagagggtctcaaggcaggcaaagaagaaccatgaggctcatcctgcctgtgggtttgattgctaccactcttgcaattgctcctgtccgctttgacaggkaaatcttacttcctgtgttccagtctctgtgtagaagagaattaaaggttgtttccttacagttcactttttttttttcatttgcctccrcaaagggagaaggtgttccgcgtgaagccccaggatgaaaaacaagcagacatcataaaggacttggccaaaaccaatgaggtaagcatttagagggatattttatcttttcttactgttctctaaaagatgcttcttcttattttactgtcaatgcccatgggactacaaaagactattgaacataaggggaaagcaggagctatctggataattcagccaatggccaatacttcacctgttctggktttggtcttggtttccaagactaccacttctgtttttcctcccaaaagcttttcaaacaccagctttttcaaggtaaaactatgaaatcaggagctgttcttggcctccttatcagggcatctttctcttgcctacgggtgccattccctctccattctccccactccgaccctcatctcctctggtgccataatttctcttgagtactaactgaaaacgttgaggcactggctaatatcaagatgtgaccctttccaagagcaggtacattttcaaataagacttttaaagttagatcaatcctttaaaatccaacagcctaatataattttatcatgtattcagctgctcctatttatgttgcaccagccaccttatatatgccatttcaaattctccagcagattctcaatgtcagggttataatgtaactcatttgaaacagaagagctaaagtgcaaagacaataaattaaatgaccaagattacacatcaaatttaaacccagaactgggtctgggatttattccagtcaaacatacagttacctctacatcaaatcaatcaaaggccctgcctattctaactcccaaatgtttctcaaatccacacattgccctccattccactgccactgccaagttcatgttcactctacctcttgcaaggagaatttccatagtcccttaactagcaatcagggctctagtcttgactcccacaaagccaactctgcattgcaacctgattgctcactctaaaacttgacaattgcattcctccgtttgagggtcattactaagaagcagcctagtacggaaaaagcattttcttcaaagtcaaacgcttacattcaaatccaagctctacgctagctctgtagccttaggcaacttactcaacatctctgggtctcaatttcttctgctataaaatggggataatagtcatagctacttcctagggttgctacaaagactaagtaagcgtttgatagcacttagaagcaggcctgccatattaagcaccatagaagcgttttttgtttgttattgtttttgttttgagacagagtctcactctgtcacccaggctggagtgcagtggcacaatctctgcagcctccgactcccaggttcaagcgattcacctgcctcagcctccctattagctgggattacaggtgcccaccaccatccccggctaatttttgtgtttttagtgaagacggggttttgccatgttgcccagctggtctcaaactcctgacctcaagtgatccacccgcctcagcctcccaaaatgctgggattacaggcatgagccaccatgcccagtcagaagcattttcttttggtattggtatagcattcaaagcgttttatgatctgccaaactaccagcctcttcaatatcctgctcctccaccttcttccacacccttcaagccccataaacaccaaaatctcacccaccttggccctgtacatcttttctcatgaaaatgtgtttctctcccttttgacctgggtaagtcctacttatttctcaagatccaactcaggcagtgtctcctgcaggacrtctcttctgttcatcaactctcgtgactcagttttggctgctccttgtgctcctggaatacccggttccttcctctggcattggttaacatgtgggaaacatgcatgtatgactctgtgttccacaccaaacctttcacatctcataagtcccttattagtctctacaactgtggcacccagctctttgcctcctgcttaatacatgaaagttcactaagctctaagctcctgctgcacattaccctgctagaacacagaaatgtctattgtgataagatggctctgcctaacttgcctttgcatcacactacatctctcatatgtccaactcatgatgtagctttttgatcaaaataaacattggttggttcatagcagcctcatattgtcacttgattgacctcgaggtagagggggactcaaccaagaaacagccaggcagacctgaacacatacacaagcaggggtggaaattgagcttttccttcacatttcccaggctggggacttgtacttcatttagtttcacaattgagtatgattttgaagaaccacaagaactggaatcttttcaatgtttgcttttgtttttgttttttgtgttttttctgagacagagttttgctcttgttgcccaggctggagtgcaatagcgagatctcggctcactgcaacctccacctcccaggttcaagcaattctcctgcatcagcctcccgagtagctgagattacaggcatgtgccaccatgcctggctaattctctatttttaatagaagtggggtttctccatgttggtcaggctggtctcgaactcccgacctcaggtgatccgcacctcagccttccaaagtgctgggattacagtcgtgagccacaacacccagcctsgaaattattttgatctgaatgctatacttctgagctcatataccaaatttttgaaattgtcagctagaggaagagaaaggaaaaaaaaaatctgcacctgttaactgtcttcatgccccagacctcaracctatttcacaatcttcacaacacttcccagtggaccctcatttgccccattatttcaggagagaggagtaaaatttaaagagtcctagtaacttgcccaaggacatattgctagaaaaatgactttgctgggggtctatgccaactgtttgatacaatatcttgtatcaggatttccagagtttatagggacatcaggttttgaggactaactaacyagatatttaacttaaatttccaattagaggcagattctgtggctagatgaattgtgatcccattcaatcccaaaattgtggaagaaaaaaattaaccaaaagatctgcccatcctttttaacttgatagacctgaagtccttaaaaaaaaaaaaagtgatcaggcactaggaaggtttctttcctcctccctaatattcaacagttcttaaatatatttgcaaaaatcccataaacttattaaaagaagggtctgtatcttagttatgctgagccccaaattcctttcatggtgtatgagacatgatcatttcttaatcaataagtgttgggtaagcaaataaactctgactaacattgagcttatctctgcagcttgacttctggtatccaggtgccacccaccacgtagctgctaatatgatggtggatttccgagttagtgagaaggaatcccaagccatccagtctkccttggatcaaaataaaatgcactatgagtaagtccttggcaaatattgaaatttgttggatattcaaagttttgggagccttgaagtagaggaaagtattacaatggacctatttttaattgggccccccagaacgaaagctctttctgtaagatacagatcacagttacttccaaacacattatcraagcctgtttacagaggtgatagaatcaaacttggcagttcaacatctaccttacatttgctcttagctataagaataacaattacctatatctaccatctccaaaaccagcccctcataagcacagagcccacatgagcaggcatgaatggtttagccacatgtcatcactactgacaggtaatcggcccagatctcatgagctactggcgctggcctccttttatrtatttgaattttcctgawacataaaaggagaccaaaaaaaaaagtcattggtatgtcagaaatacagcaattggtatgtcattggtatgtcagaagtacagcaattaaaaatatacaataaataattctttatgaaaaaaattcttcctcagagaaagcacaagcagagcagtagaatacagtttaaatcaaagagaaaagaatctcaaatagccaaagatgcagaaatgagtcattctggccccacagagaagtaagagaaaatctgaatataytgagcagcaaccatgggccatgcccagtctgggccctgggcagtgaatgagaaggaagcccagcaatgaatatcataaatcaatgtgtaatttagaaaataaaatgtgttggccatgcgcagtggctcacgcctgtaatcccagcactttgggaggccaaggcaggtggctcatgaggtcaggagttagagaccagcctggccaatatggtgacaacccatctctactaaaaatacaaaaattacctgggcgtggtggcgtgtgcctgtagtcccagctactcgggaggctgaggcagaagactcacttgaacctgggaggcagaggttgcagtgagccgagatcgcgccactgcactccagcatgggtgacagarcaagactccatctcaaaaaaaaaaaaaaaaaaaaaaaagaaaatgtgtttttatactttcaaacatttcatagtttgatgtacagagggatcccattttaacttccccaggccatgttatgccaggattcccctttgttgagaccctcattgtcaaaacactgctaaacactagttcattttttttttttgaacttgccattttatacctccattacctgacttggtactttaactcaaaaggtctgcttctggctgagataaagaaagagcctgttgatgtcagtgatgttatattgcagagcaggatttactactgctcaccatwaacttgattttatttatgatattgccacaatatctcaaataaactccattgaaatttaaaaatcacgtacataagtgagcaaaaaacattcttattcacggctttaaagataacattctattatttgtgatggttattgatgactttttcggttttgttactgtttcaagaaggttgtgrcagaaatgtaaaagttaacaaattgaaaatatataattcacgctgtgcacatgtaccctagaacttaaagtataaaaatatatatttataaaaaaaactaattgataccagcttttaacccttttaacttaatayactaagtttttctgtttttataaatcacatcattaaaattagacacttcaaaaatgtaactacaagactgcagaaatttgtattacattatctgtttacattaaggttcagataatgtattgactctttcatctaaaagaaatcaaccctctatcttaaataacccctggttactgtgtctcttgttttgttttttgagatgaagtctcgctctgtcacccagactggagtgcagtggcgcaatctgggttcactgcaagctccgcctcccgggttcacgccattctcctgcttcagcctcccgagtagcttatactacaggcacctgccaccatgcctggcttttttttgtatttttagtaaagacggggtttcaccatgttagccaggatagtcttgatctcctgaccttgtgatccactcacctcggcctagccaccgcaccaggcctactgtgtctcttgattcacttcattgccagctttctagtatatgtgcctaaattattacactcttcactttacttcaataatatagacctggtctggattcctatgataaactaattcttacaaagcattcagcccaaggtaaaataaagtagtggtgtggccaaattttatataatttggcttgaacagcaaggtaaagaattaggtattatgttttccttaatagccctataacgcagttacaatgtagaaaatgtatctagaaaagctagttgcttggcatgagcatgaatagtggagtaaatcactgtaagacacctaggcaggcagctagcatccttccaatttatcaaatagctcacatcagccttttttctcctttggtcctctaggcctcttctatcctgaaatgattctgattcaactagatgtctaaatccagatcctcaaattagtgtgtttttcactstgtcttatgacaaaggagtttcttgctttctacrtcaagtaccaaagtgttaaattacctayaaaaattggttttatcaaattaaaacatgaattctacaaagyggcccaaatcagccacagttatgggaaagccaaataattagatagttacctccctcagaaatataaatatgtaaagtgataagtgcagacaagaactacttaaaatcttgtctccaagtactaattatatagataattttatttgcatattaattatatgcattacttggtgtcagtcagtaacagaaaagagttctaagaacagaaacatctggtcggacccaggcaccaggctgaattaaaccatattaaaaggctggtttgacacaaagatttacttacacacccttcattagacagggtatatcaactactatttagtttaaagcatctgtgtggtttttctttaatttttagaaaattaagttagtaagccagattttattttaaagtagcatacttgtttctttttttacttatttacaaaatcataaaaggccaagttcaaaaaacaaacaacatggatatactaacaaacccaaacagactggcaaacaaatatcaaagggaaggcacgtccatcggactgagcctctggggcagacactatacttggaytcagcagttaaaaatcctagtgtttttaacattgttcacattttagacagtcaatttttaacattgtcttttctttgatcaaaggttaaaattagaaaataaagagttgttaatgaaaggtaactcagaaamcaactattaatataataagaaaactcaaatggtacaattaagtaaaatcttacgaggatccatataagattatgtgagaaatgcaaaagagatctatgccaaactgacacagtgataatcaacacctaatattaatgtctaactgcctaataataatgttcagtcagatacaaattcatattccagggatatacacagtcctatcmagtgtttcaatcaaatcattctaatgtgtcattccattcatttttttcttctgcttcacatttttacgtattacttacctaagagtataacatgcatgttatactacaacatgctacatggtacaaatgttgaagttacaattggtcatgtgacaaacaggagtgtggaaggtaggaaagtgggttctgaagcaacgctgtctgggtccagtcccactgaagccatgcattagatactcaacattggcaatttatttaactttgctttacctcatacctcatctataaaatgggaataataatggaatctatttcataggggtttcatgaagattgactgggatcgtaaagttgctgtctgcctggtcctttacttctatgaatacacacacamacacacacacacacacacacacacactcacacagaaacagggaataactagaggctatcaccagatgttccattttcctcccagtgaataaatgagtagtattcctcaaactttgagaaatccatgtcagtaagtgtagaatttgatgtgtggtaaccaaattagggagttaccagggggatattgaatcttagggaaacctgaaaccatgctttttgaatagcaccatatcctgatgtaatgtgggcatcaggagaatccagtcccatttataagtcaccctgacagtgactctgccttcctgaaacatctttccccagtgcatgcacgcgcgcacacgygcrcacacacacacacacacacacaccccagagcctacgatagtcacatatattggcccatagttctccagtcctttgttgctttctaaaagcagcaaaggatgggagccttgaaactgtcaaagtagaatttatctcatctcttctctgaacctcttacttgctccctgaccttgggacacagacttccatgagagttggttgattgggccaactgtgcaccaacctccgaagactaaggagagtrcagatctgacggcaatacccaaggatttcactctcatgatgaaggcactattgtacaatggctcacagctacggtgctgatgtcagaccctccaggttcaaattccaacttctgtattttaacagttgtgtccattttggaaactggccaaaccttcataaaaacaagagctgataatggtacccagttaatcatgttgagtgataaaatgtaaatacagtgctgagaaaagtgcctggcacataagaaaggttcagtaaacattaaacatttgtattattcaatactcagtgataattatttatcctttcacctawatttaggaattttcttaaacaaattaagcaaattttggagctcaaaataatatttgagaaaaagtaatttggtttcatttgtttatgcctggctgctggttagtagaagggcttgtgaaaataacatctggccccagttcttaatttccagccttaggcttaatttctagtccctatcagcaacaatctggcaccgttctgatgttctcatgcagctrcatcatttgtggaaaggttgtacttcaactcacactgttttttttgctttgttttgtttggttttgttttgctgctgttatcataagagctaaattgatatgtgtaagtctaaaaatattcttagatacaagcttcctgtgactaattaatactgccttatgttacaaatcaacctctgggaccataaaatttctcttctgcctggtttctccacttctattaatgcaggtggagcaaaagccacgtgccctttttagagcttaaagcaattagttatgtctgtaatgaccacccaaaatataatttcaaaccttcccgggttttgtgtgagtttcagtgcaacatgctccacctgattccaaaattgctgtcacaagtttattttctcagaaatcctaggttcatcataagtcaaaagcaaagcatacagtgagttagatatgatgtacataatgatgtgcttgtcagtgctgctaataggaatcaatattcatgagcagtacttggtcccatgtgctaaataaactctaattaagggaatacagcgtttgtgttccacatcagaactcagatcagtcagtcaatcagcaaggagaaaccaacaagtagagtggagctcagcagtgtcagtgtcatagctcattattataagaaattgaagaaatcaaagagtcaaacatctacataccatcaaagcctgctttaaaaacatgttatgactgtaaaatggttgtcgattttatgacccaacttcactattattctgaagttcaatgggagcctgaggccaccaagcacttaggttttacttcatttcatcctcaccacaagcctggtcaccacaattgtaaaagttggaaaactgaggttcagagggtaactaagccacccaagatcacatgttcgtattatgtagctgaactggggttggaacccaagaaggtctgaacacaggtcactcactgcttccttatttgataagatttatagtgacggaaagagtacatgatattgtcccaaagactagagtgaatgttaaaaaatagacttcttcctgcacccaggactcactgctaacagcagaaaaaaaaatacatgtgcatttcattaccaaaaggtgagtaattcctttatttatatagagtcaatgagaaatgagataagccaaataagaaaattgttcagataagtacgacttcaagaaatcctttctttttaatatttttattgaaacatttccattataacgataattttctgccctacaaaatagagtatattgaatatggtttacctttgggtaaagaattatcattatcaatatgaattttcatactgtgctatgagaccactgacccatgttttctaagtccttctgtctagggagttttttaacttttctctttttttttctttttgctgtcagctatcacctactgataacagtgtgttcgctgcttgctttcagcaagtcattttccctagatccaatgcattccttctgggttaaacaagatttttagaacagtatctaaaataagacagacaagattttttgtgagggtatttgtaaatctcctacagctgtaaaataatatttaacaaaataaggaatctaataataggttttaatgcaaccatacatcaacggacaataatttgatcatataaattgatactgccatattaatctcaaagtggcattcaacatcattcttaacagtgaaagataagttttcctgtaaaaagcagaaaaaaagaatgccgtctatggctactattatttatcatagttcagagagttttccaatgcaaaacagcaaggaaaaaaagaaatagttattaagaaaattagaaagtatagatattggcagaagaaataacacagaaaataccctaaaaacataactaaaattcttaaaagtataaagatagttttttaatctaataaaatagctaagtgtaatcaaagtaaatggttttttaatatatgaatactgtaataaccaaaaatgtagtgagaaaaaaagtcaaaaaactggtaaaatatatatatatataaatagatgatcaaaatacttaacattttactgaagaatcaaagatacaattatgttatgatccattattaataaaattcttatatttatttataatttaatgtctatcaaaaaatcccattttttctgatcattctaattcctaaaatgattctgataagacattttttttttttttgagacagagtctcctctgtcacccaggctggagtgcagtggcacaatctcagctcactgcaacctccacctcctgggttcaagcaatttttatgcctcagtcacccgagtagctgagactacaggtgcccactaccacacctggctaacttttgtatttttagtagagatggggtttcaccatgttgcccaggctggtctcaaacttctggcctcatgtgatccaactgcctcagcttcccaaagtgctgggattacaggtgtgaaccaccatgcccagccaagacatttatttaaaataggtgaaattactcaaaatttttggaaaaaaagaataagatacattatccagtattaaattttactgtaattaaatatgatttggtttctattaagscataagaaaaaagattaatgaagcaaatagaaaattcccagacaaaataaataaaatacttgcatatatgatgatgacattttttaaaaataaatcttgaaatgaggcagtttgtattcaaattcccaactccatctcatacactgtgagtatttaaaccttctgagcactaacttccccatctgtaaagtgataatactgacaagattaattaaataatgtgtataaagcagtacctggcctgtattacacatatggatatctgaatccaagtgaaaacgtcatgtaggcagttggatgtgtaagcctagagttcagaggagagtcaagtataagtgaccatcaggtgaccattacagccactggactccataaaatgatgacatgagatggctcagaaagagatgaaaataggaagatgaggccgggagcaatggctcacgcctgtaatcccagcacttcaggaggctgaggtgggcagatcacctgaggtcaggagttcgaggccagcctgatcaacatggagaaacccygtctctactcaaaatacaaaattagctggcgtagtggcacatgcctgtaattccagctgctcaggagaccaaagcaggagaatcacttgaacccgggaggtggaggttgtggtgagccgagatcacaccattgcactccagcctgggcaacaagagtgaaactccatctaaaaaaaaaagaaagaaagaaagaaaaaggaaataggaagataaggtgtaagccgtaagcctcttgaccctcaacattagtctcctagtgatttttcccacctcttatttcacccccttcaaatcatgttagccattttctagatccatcactataggcacgttgtttcaacactttgtacctcatttttctcatctgtacaataagcataataatctaatgtgaagattaaatgaattaataatgtacatatggaggtcagagcgatgcctggcacaaggtagtgctaagtacctgcttactattataattatcattattattcaagtttctcccagctcagaaggtgtgaaattataaggtatgatctgtagatgtgtgcatgaaagaatcccttgttgcctgtgtttatgtggatgtagatgtgtgtgtgttttggagaaggatggggagtactatagcagtacaatacgagccacatgcataattttaaaattgtggtaaccacattaaaaaagtaaaaagcaacaggtaaaattaactgtagcaatacattttatttagcccaatatatctgaaatttttattctacacaacataaaacttattagtgagatagtttatatcatttttatactatcttcaaaatctggtgtatattttacacatacagcaatctactcttggacaagccccacttcacatgtcctgtatgcacttggggctagagactatcacactggacagcacagctctagataaatggggagatcagaagccagacacatgatatgtctaaaggagatagctagaggagaataatgaagaaacagagcaaacttgattaaagataaaggagaaggaagagaaatttctgcaaatgaaagataactgtgttttcctttctcatgataaaacatgtattttatcattcccctgtcaaacagaatcttgattcatgatctacaagaagagattgagaaacagtttgatgttaaagaagatatcccaggcaggcacagctacgcaaaatacartaattgggaaaaggtacagtaaaaaatgcctgtacwtttttttaagttacccttaatatttattgtcattttgttttcttttattctaatttctcaaaattgattttgctcttaagattgtggcttggactgaaaagatgatggataagtatcctgaaatggtctctcgtattaaaattggatctactgttgaagataatccactatawgttctgaaggtaaaaataactcaagaaccactaattcttattactgttgaaaaacatgaatttaaaagttactttgtaacacaactaagctaattctgagctaawacatattatctctgaaagaatatttaagctctagacatccattaaagaatagaaatgacaagcggttttggtggaaccaagaaagtgtctggataaacatttgtcagagattgcacagtggacaaacccaaacaaatatttcatcccacagctttattacaagagtccatgatgtctctggtataaaaaaaccctcaycccttaaaatgcagtgaaactgatgaatgaatgtcatgaagggaatttaaatatcatagcatcataggactgtagaacagtgtgttaggcatttcaaccatggattgcttgagggttccctatatcagagccaacaatttccactccattgctgctggatttttgcacatccaaagatactgctccctgaagcagccacttaacaagtgagaagcccatccacatcccaaacccccattcattcattatctccaaccactcaaaacaaacctgcactctcttcaaaatgacagccattcaagtatccagtactatttcccttccccactccaacacaacacaagatcttctccattccagggtaaatatccccagtttacacaaccagaaaaacaaaaggaagtggcagaaacaaaagtgactttataataaatttctcagaacacaggatgttagtaataaaataaaaacaatggactacaaatttttttcaaaatcctaccagctgccctgacactagaaaaattttttgaaaaatatgcattgtaatagattatgaattatgtatagacatttaaggatatgtcccatggtcccttctgagaacaatatgtgcatacatggttctcattcaacaatagacaggggaaakaattgctttgagaatatgaatgagttattggtcaacaagggatcaatgtgtgagtttgttcaaaacaatatctcaagtttayttttaaatagattggggaaaagaatgaaagaagaaaggctatttttayggattgtggcattcacgcacgagaatgggtctccccagcattctgccagtggtttgtctatcaggtaagtgaatcagaagactcccaattctcctttgactgccaagtctccagcacttcactaagtggcgacatctttccaaacacgcaattccacttagctagaagagcccatacttggtgctgtcagggaagaaacgctctgaattttactcatcattacagtttttatgaaattgacaacttccctccaaacaattcttaaactcaagctaagagtttatgaaactcacacttttcttgggctatcacatgaaagtttttactgtagtcaagtatggaaaatctgaaacaaccttcacataacctacaaatgtaacttttcttcaatgagctcaaaacatagatatttaattttaattcctctttagataatacattggccrcacatgtacttggaattttaatatttaagtttcctttctgagtgaaaaataactcacttttttyttttttttttttttgagatggagtctcactctgtcacccaggctggaatgcagtggtgcaatctcgtctcactgcaacctccgcctcctgggttcaagcaattctactacctcagtctccaaagtagctggaactacaggcatgcgccaccatgcctggctaatttttgtatttttagtagagactggattttgccatgttggccaggctgttatcaaactcctgatcccaagtaatctgtccccctcggcctcccaaagtgctgggataacaggtatgagccaccacactgggcctacaattcacttttttaaaaggtttatctagtttatatattcaatattcctctcactctattgccaatgtattttgactcctaccatattttaattttctctttctgtcagcttttgcacatggcacagtggtgaaatatgtgtaacaatggttttctgggcatagatatttttctagaaaagaatccaccaggaagtgacctgtagttacttttgctctcccaactgagggccaagagctccccctactcaacacataaaggaatgcacatcacaggtctacaaaaaatcttgtctccaattcagatgtacctagaaggacttcccaagagtggtgagagagattttaggtagctacagaaagtgcatgtgattagagaaatttcagtcagatatagaaaaaaaaaagttgttcaatctctgaattcttgggtattttattaatacaattttttatttaatcctgcttataactatctcacaaattctctccaatattttcatattcctgtgcttacagactctatctatatttatgtaaaagatgtgagagaatcaattaaaaataagttgtattacaaattttccatttggcttccaatctttctatgaaacatatctctcatgctacatttggaatgctataagtctcgataattaaatgctcctttaaagactattcatttccattaatgtcactagtctaaataagttaggtttttttcccctttaaactatatggattgtttatttttgttcattttagggaaaatatgcttgaaaacatgtgaccttgggaagtgactcaagttattactattataaccacagctttccacataatagctaaacttcataccaatagcttaattttttttcacctccgacaggcaaccaaaacttatgggagaaacaaaattatgaccaaactcttggaccgaatgaatttttacattcttcctgtgttcaatgttgatggatatatttggtcatggacaaaggtactgctctctactctcttgyttgcatttagatattatttgctggctttaatacacaatgttatgcattcagcttagggtttaggtaactagttaattctaattcagaaaagtatattttttaaaatctcagtttcaaattaagtatgatttcttggttgcataggtatccttgaaataatataaaatttttgctgctgaagctagttatgtgggaaaatgaaataaagtagtaattacagaggaaatgtatgattgcattatatgatatggcatatctagctaagaataaagccaattaattgattttaaaacaaaaacctttgtatttcatcaattttgaatagaatttgaggtagaatcattgtatcaaaaaaaataaaagagaggtacagatacctatttgtctttttacagtatattttattatcctgcttttgctaaataagaactctcaggcagacactgtcacatcaaattattttctgcaaataatgctccaacagtaaaaatttgacctgcattatatctgaatctatatatggtgaacaagctaatgaagttataatttaaattatggttaatttcagaacaccgttagtcatcttctaatactgtgaactaatcaacagtgtttaaaattaactgaattatttcatcaaagcctaaggatataatattaaaaaccatgattctgaaaatactacaaattataagaaaacaatatttttttctttttataataaagggcctcaagttaactagatagatttcaaataaagttgcagacacctgcagagagaatttgaaatgatcaaattgaaaaatgcaaactgatcttgtgtaaacacttacgtcattcaatctggcagaaccgcatgtggagaaaaaatcgttccaagaaccaaaactccaaatgcatcggcactgacctcaacaggaattttaatgcttcatggaactgtgagtagcagacttgctatcaaggaaaattgctataaggaatatttaggtcccaaacttaactaaaacacctacttgttcagtaaaaatagttatgctttgagtgagtgttaacttttgtatctataacatgaaagacaatcatcactaccattgagggatgtcttgctgtgtggaaggaaatgaggaggaagggactgtttatcaaaccatctcttacttactatatctagtttgctaaaaattaagcacaatccaaatgtataaaaattcagataatctgaataaagacctcagattcctctgcttcctgatgtgagaaatgtcagtggctaaaagcaacatacagacagtttttcagatatttagtgaaaagagtcatctggagcaaagaaagtgaaaaagtttaacagaaatmcgatgataagcagaggcctgctacatcagacgatgctttagttgctatacaactatgacttcatcactgcacactttcaaggagaaattaccattgccccaatttatatatttcttctgtgcctaattttgttgaaaacatcacctgagcttttaactgtattctaccataatgaacatagaagagcagcagctatctctaattgagagctttctgctgaaaaaggctgaagaaacttgtgcccagggaaggtaattcacaccagcccccagcgcattagagctggggttgaattagaactggagtgtatctggctccaagtcatggctgcttctgatttattactcctgtggccttgggaaaggacaaggaagtaaacaaggcttagaatattccagtgggctaagtctgttacaatctggcatgtgtgtgcaatgttaatctgtagtgactatgatacaagagacattgaagcagccctgtaaacatgagaggcaaaaacatttaaaacattctgtgaatctataatacattagaagaggcaggagctatatggatggggagcagactgtggtctcatccacctatgtcttctgcagccattcctaacaccaatgacccatgtgcagataactatcggggctctgcaccagagtccgagaaagagacgaaagctgtcactaatttcattagaagccacctgaatgaaatcaaggtttacatcaccttccattcctactcccagatgctattgtttccctatggatatacatcaaaactgccacctaaccatgaggacttggtacgtagacaaaagtttgcacttcatgcatcgacaataccattgactttcagtctgttcttcattaacttgggtatgttgaaagaatttcacattttaatgtcaaagaaaagaactaatgaaatttgccttgaagttaaaatcatgatctttagattgatttttcaytgataaaagtatatagataataaattcctttaatgtgattctcaggaggaaaaaaaaatcaggaagaaatgtctaggaaaggcataatagaagtctattacaacacagctcattgtggggtttaacatttaccatgggttgtacggtaaaaycatgcacggaaaaagcccaatagaatagcaaagacatttactagtcctgccccccagatatcagatttaagaagatacattgtatttttatcctgatcaacttggaaattatattcttttacaatccaaagaagattataaatgtttgtgaagcttcttcactaagaatatgttatctttccaaaactatgatccattaagcaccattttgtttataaaaactgatttgataatgtgagctttaaaaaaaaagtctgcatatgggttccaatgaatcacaggaagtgacagagtgaatgggtgcatagagggataaatattttgaattgctatagaagaaaataaataaaacagaaaaagtttagtggcccagatcccatggtgattggcaaatatagcactttcagtaatagctgtggtccaaatactgcctcataaaatattttaaaatttttaagaggttacaattttcattctgacctcagtccattgtatttagcacaacagcatttaatgttaattggagcagagacytgaatcagtcattaaaatcatctccatatatacaacaaagaaracataccagcaatatatggcccatagtcatttattatccaatgtaggtgataatctgagggcgtgagttcaattaatgcataccaatgtacagcactgtgatttcaatccactgttaggaaaatgatattatgggttaaaaaaaatacatatccacaaaaaaaaaaaccactttgagtaaaatgagagttcttgcatagcaactaaattgattaagaaaaaaattatttattggttatatacgttatatgtatagtcttttaaaaatctttgtgagtgcaaatatgttagtaactatattccattaaaattcattctgacaatcactctcatagcacaaaacactaacgtgtattaaaaggtcatgacaaaatgccactctgaaagagacaccctaattaacaactattttaaaaagcggtcaaccacccttcttcccttggtatgctgaagtcagatgagtagagaagatcctgtagcaatatgagcctgttagggaccaaggaatgtaaaacatggaagaaaatggagaaactgtcagaagagacaattatctgaagccaaaaaaattgacaggaaaaataatgtatattttatattttagaagaaaggaatgaggagagagagagaaagaagagtagaaacacaaaatgagatatggcattactgtatataatcgactgcatatttaagtctttttttttttttttttttttttagacggagtctcgctctgtcaccaggctggagtgcagtggcgcaatcttggctcactacaacctccgactccctggttcaagcgattctcctgcctcagcctcccaagtagctgaractacaggcacatggcaccacccccagctaattttttgtatttttagtagagacggggtttcaccatgctagccaggatggtctccatctcctgacctcatgatctgcccacctcagcctccgcaagtgctgggattacaggcgtgagccaccgtgcccggccaagtctttatacttaccacatatattactgaaaataagtttctcgtttaaccatttattttattttgatcttcaaatgccaaatacctggtaaatttgacttttttcatccctagtaatttacatatttacatatatatatgtakgggctttggttttgttaaaaccaggaactgaattccggcttcaccagttgcaactaaccaggaaatagtactgtccatctcatagggttgttatgagtcttgaaactaaagatcaagggataagcacagtgcctaacctgtaagactccattaaaaaattgcatacatacataattacatattccttggtatttacacagtatcstattatttcactmtaactttcctttctctccaggccaaagttgcaaagattggcactgatgttctatcaactcratatgaaacccgctacatctatggcccaatagaatcaacaatttgtaagtcattcctcttatttactgagcccttttccctaattattttttacaaatattaaagaaaattatggaatttgcaatttaggttagagcatctggaattgctaatttaaattctactttttacaggatattctgaattatacgtgaatctaggggatagattctgaccttttcttgggataagatttttctagaaacaaattatactgaacttttacagggttacaaggtcaacggaagctattaagtcaagacagatttacagtttactttatctaccttcctgtttcccacctgtaccaccaacaatgttgtayccttccaggaactaatgagaattcactggagtgagaaaaaaaaaaaaattagccaggcatggtgacctatgcctgtagtcccagtttctctggaggctggggtgggaagatcatttgggcctgggaggtcaagactgccatgagctgtgatcgtgccackgcactccagcctgggcaacagagcaagacctcatctaaaaaaaatcacataaaagaaattagatggagtagagtctacattttttttaaccatttaactttaactggactctttcttacttgccttgtctacatgtaagtatggtcttttccctagctgaaaaacagctaggataggaaaacagatagaaaatcagtttcagctcctctggtcgtgtaaaacaagttatctctccttctcacttgctccttctcactatgttcagccgaaatctgtatggtgaactagaagggagatcacaagactctagttctgtcacttttgtttcatactctcagcaccatttcttactcttccctatttttaaatttatgttgtctttgtgtgtttttaagttattgacttggatttcttggccttgattttcttgtctcttattctatataaaagaaatcagtaatttttttttctgtaaagggccagatagtaaatagctttggctttgtggaggtacagtttctgttgcaggtactcaaccggagaatcatagctcaaaaacggccatagacaataagtcagcaaatgggtgactatgtgccaataaaacctcattcacagaaacaggaggctgaccaggatttgccaactcccatactttayactaaataatatctgcaaatttttatggagtctttacaagttaggcactgtgcttaccccttgattttcacaatctcaagcttcacaacaaccctatgaggtggggagtagtatttcccagttattagtaaccggcgaagctggaactcaatctcagattttaacaaacaaaagccctgatcctgaccactgcacatactgtttgtgcatttggattttgtagctgaaatatccaggattttctatttgcaatgaacagccaaaaaatccatttgagtatcaccgaagacaattaactcagatcctgggaagtgagaccactttctgctcttacagcaactcccactaagcttagtttgggaattatttagtaaaaactaccttttctccaaaccaagttcaagcttcagttcttagtctcaaaatttatacaaaattccccatgaaacttctcaaaagcaagaattatgcttcagatttcctcttagaccctgtaacatatagtacagtgcacggcatggaacaacagcagaattagttcccataaacttgctcaatgataatggtgtcctggcttattcaaaagaagtgaatgtgagttgaaaccacaacagtactggacttgattaagcctgcatcactctctagaccaaatatccaacagtgtttagcattaagactaccatttaacttttaaaaatttcatgaacaacccttccaccaccaaagatacactcatatttttattacacttttagaatctgtgcattaaaaaatacatatgtgcatatgaattcaggattccttgcaacaattttacctgaccacagtttttaagtcactttcgtattccaagctgaaagtataaactttgaactgaaagtctacatcctcagcaattgcgatggaatttgaaaatgccggaatcaacatatacagtttctaggacttacttattagatgcttctttggcagaactggaaaatgactaaaaaatggacaagtccctttcctygagcacattcattaacaatcacctatcaaccagtcactgttaaggtgctgaagaaaaagtgtagtgatacagatgatccccagcatccacatagatcttgctacaacctagccatgctggggactcattacacayacaggtggatgaccacaagatttcaaaatacatgttatgtacccagctatgtgagtggacaaaaagtaagcaaagtaaagaacaagaagacagactagaagatcagtttaaaatggcagcccacttagtagatactaataaatagcagggccagattggccacccagacaccacatgagagcaattcctctaagcaagaaaaacccacagatagtcttagaggcaaagaacaaagcattccaaacaggaacaaactttgcaaaaggcaattaaagcatcaaataattatccgtgtgtgtgtatccacaaaagtatgagaatacagagctgtgcatagcattgcattaagacctcttaatgaacaaaaatatatggtgtacctagctagcaggctagcactttggagctttcagagataaatgagaggacttaggacacaataaactactcttaaggaagtcacattctaastggaaggagcrgagagccaaaactaccatagctccatgccatcatgtgtcactttcaaaatggaaagatacagtcaagagggattactattctgtttaactgtgcagcattatttaaaatttttattacattatactacaacattttaaaggcattgagatttagaaagaattgcctttgtcacgcagtgctgcagcagcttgataaacgatcaagatttctagaacagactgctttaataaagcatctgatagaatgttaatcaaacatgcatgagaaacagggtagcaaagcagttgacttggtaagaataaaaaataaaaatgtgattaaagtttagtcattccaataacctgattgtcacttaacatgtccccagatttaggaacagcatctagcatttgtcagtgatttcctgtcttcgacttgatgaagacagaaaaaaaaggactgggggagcattttttaaactcaacttatggaggatctctggcctttagaaaaaaatatatatatgtttgctctttgaacatgagaggcaaacatatcagataagttaaaatcataaattttgaaaccagggagaaacataggcaatgatctattccatggttctcaagcctgacttcccattagaatcatcaggaagctggccaggcctggtggctcacttttgtaatcctagcactttgggaggctgaggagggcggatcacaaggtgaggagtttgagaccagtctggccaacatggtgaaaccccatctctactaaaaatacaaaaattagctgggcgtaatggtgggcacctgtaatcccagctactcagaaggctgaggcaggagaatcacttgaaaccagaaggcggaggttgcagtgagccaagatcacgccactgcacttcagcctgggtgaaagagcaaaactccatctcaaaaaaaaaaaaaaaaaagaatcatcaggaagcttttaaaatacatgaatgattatacccccagcccccagagattctgatttcatcagtytgaggaggagctcggcactcaatttttttttaagtaccttaagtgattctaagatgaaactagggttgagaatcgctgatctaagcaaaacttctcatttatagactgaaattcagatacagaaatatttcatcactttagggcagaagaaaaacaaaaatcagcattcaasaccagagttaaaatggtatacctaccactttgccccaaagcagcaatattgagatggcacaaaaaagtaaatagtaatgtttaatgtgaaatgattatatttgcatataaacagcatatccaatccttcatcatcttagaaataactaaacatagtacctagtgagcaagaatagttatttgagttgataagaaccaagattgcattagtaataaaattcatctgtgagtcacatcatgaattaaaaagttaatttcaaagtacatttcttgtagcttcctttgtgtaccaaaattgctagatctaccactgattcycaacccagtgctctttttccatattctacatattctactttttcaaaatttacattctgaaaaagaaaagttaagacttgtagttcataacaccagatctctacttactaagagacattcaaactgatattacagagaaaatatttcagtgtatgcccatgtatctctggcttcagctcttgcttctaatataattttcacttagtattaatataaaagtacaggttatyatattgaatacatttaaataatattttttaaaacgatacaatttttcagaaaacactgtatcaagtaagcaataaatgcagcacacattaagtcaccarcgtcactttatatggatccctttgggctgaaatcasatttctagtttggtacggtttcattttgatttgttctcattgaatttgttgcaaccaatattgtgccttgaaataagtaggaaatattttcttaatgttgaacatactcagaatatgctgtcaacaaaaacaaaattatcttatagaactgagtaaagacttggtattggctagwatatagagtggcacataggtagcacagtacaatgattaacaacatgaactctgaagacaccacctgggcttgaatcctgattcgaccatctactagctatgtgtttttcagcaagttgcttaatctctctgagcctaggtttcttcttcggtaaaatggtaattgttacttacatttgggataggaattaattaaatgagttaacatgcataaagcacatagaagggtacttggtatttagcaagtgattattactgtattttataaaygcatacacatgttttagtaggtacacatggagataaagaaaaggctaagtatcatgttaaacaaattaagttctggccaggcacrgtgatgcacacctgtagtcccagctactcaggaggctgaggtggaagtatcacttcagcctgggacgtcgaggatacagtgagccatgatcatgccaccgcactccagccaaggtaacagagcaagaccctgtcacatacacacacacacacacacacacacacacacayacacacacacacacacacaaattctatatttttttctcaaagtaaaaacttgcaatgttgtatttactttatgacttgatatagttttgtttgcaaatttaagatctagaagatatgaaatgtattctacttcatagcatcacataattatgaaaaatcaaattccatatattctcaatcaccactattaatcttaatgacaaactccacataaagtaaatctctcaaaatagaatagccatgccctttaacccttggaaatcacagcagtttactcgactgcaaatagagagctactgcaactaggaactggccaagtttattaaaatgtctaacatatcctaaattacaagacataattcctatttactttacctcctttgctaccaagcttgcatcttagygtgatttctttctcatgaacttaaatccaactagctaaaagtggcaatctgtttgatcactgaagccagtctctatatttcagctcacgtgctccataaattacatgcaatatttgaccctgttaataacttcttgccattcctttggcttccttgactttgaactctactggttctcttcttcctcctcctcctttttttctactctcccactgactgcttctaaaagtagacattttccaaaaaatagggtacaatatatggatacttcctcaggttctctcctcaggtccctcctcttacttctgactctcctcatcaagaaataacctctatccccacaggctggaatccctcatttgttacctagggcaccaggmaatcaccttttacccactaagtgaaccaaccagaccaaaatagcaatgcaaaggctttgaaaactatattgtcagctgagcacggtggctcatgcctgtaaycttagcactttgggaggccaaggtgggaggatcacctgagaacaggagtccgagaccagcctggccaacatggtgaaacccggtctctactaaaaatacaaaaattagctaggtgtggtggtacgcacctgtagtcccagctaytcaagaggcygaggcaggagaattgcttgaacctggaaggcagaggttgcagtgagctgaaatcgtaccactccacttcagtctgggcaacaaagtgagactctatctcaaaaacaacaacaacaacaacaacaaaaaaccaaagcaaaactgtctgggtgtggtggcacatgcctgtaatcccagcactttgggaggccgaggtaggcagattgcctgaggtcaggagttcaagaccagcctgaccaatatggtgaaaccctgtctctactaaaaatacaaaagttagccaggtgtggtggcaggcgcctgtagagaggagaagcacttggacctgggakgcagaggttgcagtgagccragattgtgtcattgcattctcgcctgggtgacagagtgagactccatctcaaaagaaaaaaaaaaatactatattgtcatcagtatcacaagacasaaaagtaggccagggcctgtttactaaacctgaacagggtgattacctgctaaattgaagatttaagttacaatttattatttaatgtaatagctaaaatgtccagaatataatcaaaaatcgcttgtaatactaaaaacaagaaaaattacagcttgaatacaaaaagataatccacagatgccaacactgagatgattgcagyttcaaacattggaaaagaatttcaaagttgccatcattaaaaaaaaaatgcctcaacaaacaattacagatggccttgaaacaaatgaagaaatggaaactatcatcaaagaaataaatataagatacaaaaaggaaccaaatggaaaccatagaactagaaaatgtaataacttgaacaacaaaaaaactggaagggcttaatagcagaataaatatgacagagggaagaatcagtgaacttaaagacagagcaatataattcactcgctctgaagacagaaaataaacaaaaataaataactaaacaaagcctcaggaacaaatggcataataaaatatccaacattcatgtcatcggtccaaggaaaagataaataaagggaacaggagctggaaaaaaaatgtttgaagaaataaaagctgaaatatcctacatttgacaaagacataaactaacatagtcaagtagctgagtgaaacccaaacaggaataacccagagaaactcacatcaaagtacatcataattaaacttctgaaaactagacaaagaaacaagtcgtaaaaggaatcagacagaaatgatctagagttaaaaacagttccagtgacagcagatttttcatgtgaaaccatggaagtcaaaaggaagtgacattttctcaagtgctgaatgaaaacacctatcaaccctaaattcaataaattcaatgtattgcaaaaatattcagaaatgaaggagggaataagacattctcatacaaagggaaatcagcagatgtgtgccccgcacacctactcttaatggctaaaagaaccctctgaacaagaaggaaataatcacagcaaaaggcttggaactgcagagaggaaggaagaaaaatggattcagtataaataaataaattaaataatagactatctttctccacatgatgattgaatcaaaaattgtaagtctgtttgatgtgatgttcaatgtatgtagagaagtactcaagacaattgtactttaaaagtgggaagggaaaaaggatctraaaggaagtaaagtttctacacctcacttgacatagtaaaatgtcaataccattagactgtggtaagttatgtatgtgtattatagtacctggagcaaccattaagaaaactaagcaagtgagactataaatcaatcaaatggaatcctaaaaatgtcatgtaaccaagaggaaggtgtaaagcaagaaaaaaaagataaagggataaaaacagaaagaacaaaaaaaaaaaaagaaataatggcatgtttaagtcatatcaataatttacctacacgcactaattaaagacacatgggcagaatgaattttttaaattataattcaacaatatgctgtttataagaaactcatttccaatataacaacacagataagttgaaatgagaatgatggaaaagatatactatgccataggaagaatagctacattaagtatcagataaagtgaatttcagagcaaagaaatttgctagtgacagagacattaacaatgataaaaggatccatcccaccaagaaaataatgatcctaaatgtgtgcacaccaatttcacctatgatgtctatgccaataatttaaacattcatttttccaagctctttcttgaatgtctgattgatgttaaaygtatcactttgtcttcctttgccttttctttttcccatcccaatgctctctgagttcccatttaacagtatgttttttccagctacccagattgaaacatcaatcatttttatgaaatcccaatgtttcttatgtagaatccctcagttgtttctaatgtggtgactctaccctagtcaggctttcatttcacactacttcataactggtttctattcttttcaatccagattaacaaacctaaagtactagaaggcctccaaaagaaaatctaaacacctagtcccgattcacaaggttttccaagctttactcacaaactctcactgctccctttgctctggtccagctggatctcgttggtttctaacaatgcctccatgcttttctatccttgtagttcactggctagaattcctttcttccatctccagctgaaaacacactagcctttcttcaaggctctcctccaataccatctcctccatcatgaaggcagtatttgagctggcactgggcatgaaaggccatactcctcatcaagaataatctcttttttcttttaaatcttggtaaaatattgtaccttttctatggtacttagcatattctgctctgcctctattgacttataccttgacttctgcctcctaaattgtaagttactgaagacaccagtggcatcttctgcatttttgtaccctgcaacaattactctccccrgtgccaagaaatgtgtcttgtaaatattaaaggtttaataaatatttggtgaccaatttaagagccaacactatctcttcatcaaaatatcccttctctctttcatcgcagctttgaattcttatctttcaaatttttcagatctttcaaactgttattattagttaaactcattacttgtcctagaacataaatgccttcacatacaaaaaaaaccttttatatcacataaagcaaaatgtgagcacataaatgcaattatgatatgtatatgcacttgtatatgtatatagcctctagatgtgagttatatgtatataacctttagatgtgtgtttatatttccaatgtttttaccaaaaaatagaaccttgagttaaatttcataaaagttgacatggaaattttgaattaggagattaaatatgtctttaaaataactaaattacattttcttggtcttttgactatgaaatagtttaccctagcaacatgaaaaacaagagacctaagctattagaagaaatgcarttctatgtatcttgtgtgtatagtttttccctggtggttttcaacgaccagtgactccttagctggtttcctcagctgctagcacttgctctgggtacttgtcctsaacacgtccatctgcaacaatgtgtgcctaggaaataaactcaacttactactcacccaaccaaaatgtaattttttaaacgcagcacacactgggtggattccaaagtcatgattatgctttactatgcactctgtactattcagaccactactctcattcattactgcaattaactgcacacataactattttttattgctaattatacaccactgatttccactttaaaaaaacattagcatttgtctctaattaaatatttactgcttgtgttttacagacccgatatcaggttcttctttagactgggcttatgacctgggcatcaaacacacatttgcctttgagctccgagataaaggcaaatttggttttctccttccagaatcccggataaagccaacgtgcagagakaccatgytagctgtcaaatttattgccaagtatatcctcaagcatacttcctaaagaactgccctctgtttggaataagccaattaatccttttttgtgcctttcatcagaaagtcaatcttcagttatccccaaatgcagcttctatttcacctgaatccttctcttgctcatttaagtcccatgttactgctgtttgcttttacttactttcagtagcaccataacgaagtagctttaagtgaaaccttttaactacctttctttgctccaagtgaagtttggacccagcagaaagcattattttgaaaggtgatatacagtggggcacagaaaacaaatgaaaaccytcagtttctcacagattttcaccatgtggcttcatcaatttatgtgctaatacaataaaataaaatgcacttaatgctttaaaattcatctttttatgataaacwatattctctgtatttctctatagcattaataatcaatattaatgccattcattcagtctgttaataagaaataatatcttcaattttcaaaaacataatttgyctatctttttctgatagaagtagacattgtttatatcttcaaaaaagcaaaaggatgtcctagcaggaaataaagtggttcatatagagatgaatctcagtcctttaaataaccgatccagttctcatcagcataatgtacattaaattcaaaatagtttaatttaacctgccataatcagaagaaaccacctgctaaaacatctgtttgccggtacagacacagacaagacagtctggtcagctgtgacccctgccctcctaatggatagaaaggaaacctggaaacrtactgtaagttgaggacggaaagtcatgttgaccaaaggcaatcagggtaacttgctgcatttgtaccatttatactcctattatttaagatagtattattggatagcttctccccaacaccaatacctcaatgtgtgatcaagtggcaacagtggcagtgtytacattcccagaatccagacacagatgcccaccacaggactgactataatttgagggacaagtagagagttccttgacttccagtaaacttacttctcagaacaccccagacagttttcaacgactgggaaaggtcctgagaagtcaagtcaataaacaatctgggacatgccycatgaatcctttagggacacataaaagaaaggatggcatcaaagctacaagatgatggtgtgttctgatartcatgaggtagataaaagtttcccatgcaaaattgtccaggaaaagcaaatgtaaactaacaaaattgctttacaaggggagaaggggaaggtgacagagtcaagaaastaaaagagaaaaatgtggctatgagattatattgtctgattaaaaatatggtatctatgtctaaatatttagcattccaaactagcttcagaacgtgggaatgtaaatttgtttcattatacatgccatattggmattatatactcattcacacttachcaaatgagaaaggactgaaatatattctaaccctaaaattcatataaatacctctaattccattgagcctttagatggaggagataaaagagataatcccaattgcagaatattrtcccatgtccatccattattcagtttataaagacacaaaagttgaacacactatttgaattattatgcagcttaatattttttctcaatcagaaaaaaaattagcctgagtggctaaaaataaaaaatcctaacaagatctcatcctaattaaatagtttttgaatggcatctgagggcatttacttctttsactgcatatgaattgtgaaaataaatatgtgaagacaaatatctacattaaagttaaaaaactaaaattttaccttatttatgagaaagtttgagtggcaagtgctgtgattcttcccttttcatttctcatctatcagtaaaagggctttgtacccaagttacaagttgtgctatcacataacaatattcttgacagaggccaggcacrgtggctcatacctgtaatcccaacattttgggaggccaaggtgggaggatcacttgagcccaggagttcaagacaagtctgggtgataaagtgagaccntatctctacaaaaaaataaaaataaaaaattagccagctgtgatggcacatacctgtggtcccagctacttgggaagttgargcaaaaggattgcttgagcccaggaggtcgaggctgcagcgagccaagatcacaccactgcactccaacttggatgacasagcaaaactctgactcaaatatacatatrcacacatacacacacacatacatatgtgtatgtacatakatacacaaaatatatgtgtatatacatatatacaaaatacatatgtaaatatatatatatcatcattcattttccaattttcttrctataaaactcactcaagaggcattgtttcatattttgaaaatgtgttcttttatrgcaatatctaattgttgaggtgcacatctgagatgtacatctctattatgaaaaaatgaaacatcttatttttacttatgcaaataaatgtttccagtaagtsttatgactccamactgatctttaaatgtcatatcagaggtcccttccccacatttgacacawtggatatgttctttgaccacagaagtgctcattggctaagtgaacattaggcttactgacaagagtatctgtttctcatttaacacaaacatctatgcctgattttctttagatgaaaaaataaagaagtaacccccaaagaaacttagaacatgtcactgcaaagacacaaattttctctgtcctcatgttctctcctagcctccttatctcaaaaaaaaaaaaaaaaaaaaaaaaaaaaaaaaaaaggtttaattttttttgacctttccaaagggacggatgttgggcttttctggacccggaaaaaggtcaaggacaaaaaactttttttggccccaccatggggttcccagggcataaactaaccttttatttttaatataaaaaagggaaaggggaggttttcaaaaaaaaaatatgcttgggccccccaaatttacagggaagttttgcagtataaagtaaatgtaaaattccccaggatataaatcatacaaagcaccaccagcaaggaacctaactaaaatactcattaatttgaccatcaaaaaaacccaagggagtctaaaaactgttcctgaccattgaccctaaaaaactgcatagggtcctcaaaaatctctccttttttccttgccctttttcttaattctattctccctaataaaaggttaaaaccaggcagtttaaannnnnnnnnnnnnnnnnnnntccccaggatataaatcatacaaagcagcagcagcaaggacccttacttaaatactcatttatttgagcatctaaaagacgcaatggagtctagaaactgttcctgaccattgaccctcagagactgcatagtgttctctaaaatctctcctcttttccttgccctctttcttcattctattctcccttataataggtctcccagttttgaagcaggcacatggccatacaaataaaggttctatttccaaactccttgcaaayagaatcrtaggattgactactcaaattttctcataagtaaaataaagttttagtgttttaactttaatatagataytagtcttcacatattyattttcacaattcatatgaagtcaaagaaggaaaatactctgggatgccattcacaaactattcagttagaatgaggaatggtcttgttaggattttttatttttagttactcaggtaatgttttytctctgattgtaaaaagaaatattaggctgggcgcggtggctcacgtctgtaatcccagcactttgggaggccraggcgggtggatcackagttcaggagattgagaccatcctggctaacacggtgaaaccccgtctctactaaaaatacaaaaaattagccgggcrtggtggcgggcgcctgtagtcccagctactcgggaggctgaggcaggagaatggtgtgaacccgggaggtggagcttgcagtgagccgagakcgcaccactgcactccagcctgggcgacagagcragacwctgtctaaaaaaaaaagaaagaaagagaaaaacagaaatactaactcaagtaaaatggtgtaaagcttttgtaccttttataaactaaataatggatgcacacaggacaatattcaataattggactattctgktctatgagttgtaagaagcagcatcatattgcaaagtccagaaagctcacttcaaagacctctggaacactttggctcttttttctctctcttctttttggctgcaatataattgtgatggctgacgctgagcagtcatcttggaccacagatgatcttgaaaactgaagcaaagaaaatgacaaaaggagcctgggcctttcaggacttcaccaagcagggatgctaatcaaggcttggaccacctaccttaggatttgaacatgaaaaagaaatgaaggtcctctttagtgaaaccactgttaatttggattattattctttacaatcaagcctaatcctaactgatgtagcaagccagaaacaacaggtataacagttccagatgtgtcacagatggaaatccttggaggataatgtagtgttatgcaaaatcacagagckagaaatcaggaggtttgggcttgaatcctgactctgttactgaatgatatctagcaagacactgtcaccttttacctgccctgcttatctcatagctttttattaaaatttgagataatagatrctcaccaagttaacccactaatttccactttgtatttgggacaaagtacacttgtcttaaaaggagttggctcaggtggttcctacttgaggtaagtgttggacagtatcaaaacaacaggtgcaattgctgctctcaagtgtggttcttcaccaagttccactacgatggggtataaagtaatgtgtgcatgtgcatgtgtacattttcctgtgtgcaaaattttcatcagattcttacaatatgggagttatggaccctcaaaagtttaagcataattgaatacaaaaccaaacataatttgaaatcaygttttcacacattaaagtaaaaattaattttaactctggaatttttgtttgtatagtcatttgccccctttttatttttgtttcttactattgattttttctttgttttatgatgatcttttgaaaagaatataaaatttcccttagatggctggaaaatataaaacagttttactgaacaaaaycaggaaaattaaatatctcaaaattgtacgaaatgattaaattctgccaacttatttgtaataatattgtggtccttacaaatgatgtaatatttttaactgggcatgctatgatattttgagggatccttacatgtttccctcaaaaaacattaacccaccgaaatgggaaaagcagtrttctattattagggaagaacaaactcatggagaattatgtaaagttcagattacctctggttgcataagatgcctccttttcattcaattggtgacatacagaaaattatgcgtggaactcaaattaagggaaagaaatacatggccccttccaaactagaagattttattgcataaaaccactttgaaagctacattttctaaatagttaggctaatatgaatacatggcaatatttcaaagattatggctttacacttctttctactcctttttaacacaattgtatttcatgattaaaatgccaagccatttttctataatgagtcataatagcatcttgaaaatttcgkcagcatatatataggctactgtcagaattttcttaggcaaagcttttgggagactctcttgcatttcattgtcacaagatccattataccaggacagatctcagcctgcctgagtaatatctatctgagggttataattttgtcataaaaatttactctcacatgaacttagcataaaaggtctccgtccagaaaacaggaattgaaatggatatattatcacttaaactgcttttttgctcacttatccttcaattacaagcctcaagttcactggtgtcaagagaggttaaaccagaaaaatgtaaaacaatttttgaaatatgtgagggaaatttgacacttaacattccaaatgcattattattgccatggtatcactgaagtgtgctattgcttcattttacgtggtggattaaaagcttaaaagactactcatgaaacaaaaaaaaaagatccatatgtaccatttcatatataaaacaatttgcgagaactctgatttttttttcttattcaaaaaacctctaatttcttttttttttaatctctactttgcaaaacttagagagataattaaattttcacagggcaaagagtggggaggtgagaaaggcaagttttgagaattgcaatcatac

SEQ ID NO: 13467 - DNA, 16963 bp, Homo sapiens
tgtctctgtctccttctctcggcctctgccccgttccttctctccctcttgggtctctctggctcatccccatctcgcccgccccatcccagcccttctccccgcctcccactgtgcgacaccctcccgccctctcggccgcagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgygcggccgcctggtgcagtaccgcggcgaggtgcaggccatgctcgrccagagcaccgaggagctgcgggtghrcctcgcctcccacctgykcaagctgystvagcggctcctccgcgatgccgatgacctgcagaagygcctggcagtgtaccaggccggggcccgcgagggcgccgagcgcggcctcagcgccatccgcgagygcctggggcccctggtggaasagggccgcgtgcgggccgccactgtgggctccctggccggccagccgctacaggagcgggcccaggcctrgggcgagcggctgcgcgcgcggatggaggagatgggcagccggacccgcgacygcctggacgaggtgaaggagcaggtggcggaggtgcgcgccaagctgraggagcaggcccagcagatacgcctgcaggccgaggccttccaggcccgcctcaagagctggttcgagcccctggtggaagacatgcagcgccagtgggccgggctggtggagaaggtgcaggctgccgtgggcaccagcgccgcccctgtgcccagcgacaatcactgaacgccgaagcctgcagccatgcgaccccacgccaccccgtgcctcctgcctccgcgcagcctgcagcgggagaccctgtccccgccccagccgtcctcctggggtggaccctagtttaataaagattcaccaagtttcacgcatctgctggcctccccctgtgatttcctctaagccccagcctcagtttctctttctgcccacatactggccacacaattctcagccccctcctctccatctgtgtctgtgtgtatctttctctctgcccttttttttttttttagacggagtctggctctgtcacccaggctagagtgcagtggcacgatcttggctcactgcaacctctgcctcttgggttcaagcgattctgctgcctcagtagctgggattacaggctcacaccaccacacccggctaatttttgtatttttagtagagacgagctttcaccatgttggccaggcaggtctcaaactcctgaccaagtgatccacccgccggcctcccaaagtgctgagattacaggcctgagccaccatgcccggcctctgcccctctttcttttttagggggcagggaaaggtctcaccctgtcacccgccatcacagctcactgcagcctccacctcctggactcaagtgataagtgatcctcccgcctcagcctttccagtagctgagactacaggcgcataccactaggattaatttggggggggkgtggtgtgtgtggagatggggtctggctttgttggccaggctgatgtggaattcctgggctcaagcgatactcccaccttggcctcctgagtagctgagactactggctagcaccaccacacccagcttttyattattatttgtagagacaaggtctcaatatgttgcccaggctagtctcaaacccctgggctcaagagatcctccgccatcggcctcccaaagtgctgggattccaggcatggggctccgagcccggcctgcccaacttaataatacttgttcctcagagttgcaactccaaatgacctgagattggtgcctttattctaagctattttcattttttttctgctgtcattattctcccccttctctcctccagtcttatctgatatctgcctccttcccacccaccctgcaccccatcccacccctctgtctctccctgttctcctcaggagactctggcttcctgttttcctccacttctatcttttatctctccctcctacggtttcttttctttctccccggcctgcttgtttctcccccaacccccttcatctggatttcttcttctgccattcagtttggtttgagctctctgcttctccggttccctctgagctagctgtcycttcacccactgtgaactgggtttccctgcccaaccctcattctctttctttctttctttttttttttttttttttttttttttgagacagagtcttgctctgttgcccagcctggagtgcagtggtgcaatcttggttcactgcaacctccacttcccagattcaagcaattctcctgcctcagcctccagagtagctgggattacaggcgtgtcccaccacacccgactaatttttgtatttttggtagagacaaggcttcggcattgttggccaggcaggtctcgaactcctgacctcaagtaatctgcctgcctcaccctcccaaagtgctgggattacaggcatgagccacctcacccggaccatccctcattctccatcctttcctccagttgtgatgtctacccctcatgtttcccaacaagcctactgggtgctgaatccaggctgggaagagaagggagcggctcttctgtcggagtctgcaccaggcccatgctgagacgagagctggcgctcagagaggggaagcttggatggaagcccaggagccgccggcactctcttcycctcccaccccctcagttctcagagacggggaggagggttcccaccaacgggggacaggctgagacttgagcttgtatctcctgggccagctgcaacatctgcttgtccctctgcccatcttggctcctgcacaccctgaacttggtgctttccctggcactgctctgatcacccacgtggaggcagcacccctcccctggagatgactcaccagggctgagtgaggaggggaagggtcagtgtgctcacaggcagggggcctggtctgctgggcctgctgctgattcaccgtatgtccaggagctggagcagcaccctctcagagcctcagtttccccagatgtcaatgagagaatcagcatcagccacatctcccacctgaagaatcgaaccttgagttctcacctttaagaatttttttttttttttgagacagtgccttgctcagtcgaccacgctggagtgcagtagcacgatcatcaatcactgcagcctccaactcaagcaaccctcctgcctcaacctcctgagtagctggggccacaggcacccaccaccatgcctggctaattctttcttttttgagatggagtctcactctgtcgcccaggctggagtgcagtggcaccatcttggctcaccgcaacctctgccccccgggttcaagcaattctcctgcctcagcctcctgagtagctagaattacaggcgcacaccaccacaccaggctaatttttgtatttttagtagaaacgaggtttcaccacggtggtcaggttggtctcaaactcctgacatcaggtgatccacccgcctcggcctcccaaagcactgggattacaggagtgagccaccatgcctggccatattttaaacttttttgtagagatggggtcttactatgttgcccaggctgatctcaaactcttgggctcaagcagatcctcctgccaaagcttcccaaagtagttggattacaggtgtgagccaccacgccccaccaacctatgaagatgtctaagcagacagggtgccctatctcaccacatccccagtcagatccagaggtgggacaaggatgggaaggaggttccagaacaaaggctggcagggagtcgtatgggacaggagctgacccagcaaccatccacagagacatcctggagcctgggaaggagaaggacaaaragcccccttttttaaattttttttatgtttttgagacggagtctcactctgtcacccaagctggagtgcagtrgcacaatcttggctcactgcaacctccacctcatgggttcaaacgactctcctgcctcagcctcctgagtagctgggaccacaggtgcacaccaccatgcctggataatttttgaatttttggtagagacggagtttcaccatgttggccaggcaggtctcgaactcctgacctcaagtgctccgcccaccttggcctcccaaagttctgggaatacaggcktgagccactgcaaccagccagtagcccccatctttgcccctcgctgagccctactggatgttcttggttatgcgacagtttccccatctattaaagagaaacccctatagcagaggggaggatgaggttggaaaagcaggagcattgttatgctattcttgtggggtctgggaagcagacatctgggtggatgtttggggggtgctgggcttagttggggaagtaggggggcccctggggctkacagggactggaagctctgagctggccagagggatgttgcaatcctgccagggtcttgtctatgctgtccttttcacaaccatccccctactgccaggctgacacgtggttgcgggggcacaaggccagccaacctagagtctgaggctaggcggaggacaccctccccaccagctgccagggtcactggcggtcaaaggcagctggtggggaaggcattggactccagccttgggggacggatgtagtgatggtgggaagcaggcttggtgccaggaggggcgtcagagggtgaataaragcagatagagtgtttgggggaggtagccagccaaagggggtgaggcccggtggaagggaagaagggacatacacgcagagctttgcagctgagggttttaattttttgagatggggtctctgtcccaccaggctggagtgcagtggcacaatcacagctcactgcagcctcgaactcctgggctcaagcaatcttcctacctcagcctcttgagtagctgggactacaggcatgcgccaccacgctcggctaatttttgaayttttttgtagagatgaggtctccctatattgcccaggctggtctcgaactcccaggctcaagtgatcctccctcttcagcttcccaaagkgctgggattacaggcatgagccaccatgcctggctaatgcaggtgaggtttttgcagtgtcatccagctaaggcgacccgttcccctcccaaaaaagggagactgagaaccatgaagttaagagcccagagaatatcacggtggtctggggtgcttcaagggctggtctggaataaattggaggtggcacgcagggtaggagcgccgggccaactgggagacccagcaacataaaggaaaagttgttggggctgaggaggcttgctgagagaggggaagtgagggaaagaggtgatctagggacacggtgtgaatgagggggggatgagatcacagggttattactgggagacccctgagggaagatggccacagggacaggacaaggctgtcttcttaagggaggagaccacccctcatattgtcttatgcccaatttctgcctccaaagaaagaaaaagtaaaaactaaaaggcagaaatgaaatccacaagcagacagcccgcgccacaccctgggcctggtggttaaagattgacccctgacctaatccgttaggttatctatagattacagacattgtatagaaaagcactgtgaaaatccctattctgttttgttccgatctaattaccggtgcatgcagcccccagtcacgcatcccctgcttgttcaatcgatcacgaccctctcacgtgcacccacttagagttgtgagcccttaaaaggaacagggattgctcactcggggagctcggctcttgagacaggaatcttgcccattccccgaacgaataaaccccttccbtaactcagcgtctgaggaattttgtctgcggctcctcctgctacattctgagtggggaaagggactaaggtggtctgaggaccccacagagtcaggaagattgagaggtgagagtgctgaacggggaggggctttggggctaagggaagtgcccgggaccccacctgaccccaacgctcacgggacaggggcagaggagaaaaacgtgggtggacagagggaggcaggcggtcaggggaaggctcaggaggagggagatcaacatcaacctgccccgccccctccccagcctgataaaggtcctgcgggcaggacaggacctcccaaccaagccctccagcaaggattcaggttggtgctgagtgcctgggagggacacccgcctmcactctgcaagaaactcaaaaagggagatgaggggatcgtgggagggaggtagggagggaggagggtgccactgatcccctgaacccctgcctctgcctccagrgtgcccctccggcctcgccatgaggctcttcctgtcrctcccggtcctggtggtggttctgtcgatcgtcttggaaggtaaaagtgggatgggagaattgcggagttggagatttggaagartgaaggtggctacaggcctggggtcccggcttagaggacctctgagagctccggggccccttctgggtcgtggttgcctcatcgtggtcgggtgggtctccaggttctcccaggctcagtcccgcaggcgccaaatctgcgcaggagagcactagcaaccgatgacgtattgaggcccacacctctgggattggytgtcctgcttcgacagccttgaaagtgggtaagctgggtrgggggctctgggagaggtcagtgctgagtaaggcaattcccagcagcttgagccccaccaggtcactccagtattccyccccattctttttttttttttttttttttctcttgagacrgagtctcgctctgtcgccgaggctggagtgcagtggcgcgatctcggctcactgcaagctccgcctccctggttcacgccattctcctgcctcagcaggactacaggcgcccgccaccgcgcccggctaattttttgtattttcagtagagacagggtttcaccgtggtctcgatctcctgacttygtgatccgcctgcctcgacctcccaaagtgctgggattacaggcgtgagccacygcgtccggccattcctccccattctaaccacatgatccccaaggatctctatccatcccggtatcccaacctaagggggttccaataacaaatttttggccgggcagggtggctcaygcctgtaatcccagcactttgggaggccgaggcgggcagatcacttgaggtcaggagttcgaaaccagcctggccaacatggtgaaacttcgtctctactaaaaatacaaaaaaattagccaggtgtggaggcacgcgcctgtagkcccagctactcgggaggctgaggcaggagaatcacttgaacccgggaggcggaggttgcagtgagccgagatcataccactgcactccagcctggctgacacagcaagactccgtctcaaaacaaaacaaaacaaaaatagctgggtgtggtggtgcacacctgtaatcccagctacttgggaggctgaggcaggagaactgcttgaacccgggaggtggtggttgcagtaggccgagatcatgccactgcactccagcttgggctacagagcaagactccatctccaaaaaaaaaaaaaaaaaaacaaattttgaacccctgcccatcttcctggcaggcccagccccagcccaggggaccccagacgtctccagtgccttggataagctgaaggagtttggaaacacactggaggacaaggctcgggaactcatcagccgcatcaaacagagtgaactttctgccaagatgcggttagaacccttcccagggcacgggagagctggggtgtgtttttgggtggagccctggcagatggtccaagatgaacagattgaaaaaaaaacaagtcctggagaggctgacaacatccctctggtcacacagctagatctcaaggtgctcagacttcaaggacagtttccctgactcccatccaggccatattttaaaagatggtcttgggctgggcacggtggctcatgcttgcaatcccagcacttagggaggccgaggtgggctgattgcctgaggtcaggagttcgagaccagtctgaccaacatggtgaaaccttgtctctactaaaaatacaaaaaaattaggcaggcatggtggcgtgcacctgtaatcccagctagtcgggaggctgaggcaggggaattgcttgaaccaggaaggtgggagttacagtgagccaacattgtgccagcctgggtgacagaaggagactctgtctcaaaaaaaaaaaaaaaaaamaaaaaamcaagatggtcttgcccaggtatggtggctcacacctgtaattccagcactatgggaggctgagatgggaggattgcttgagcccaggagttcgagaccagcctgaccaacatggcgagatcctgtctccatttaaaaaaaaaaaaaaaaagatggttttgtgaggtaatgaaaatgaaggccccaagcttggccagacctgggtccccaggctggagtagcaccccttcctgtgtgatcttgacagagggrcattactgtgagcctcagtttcctctcctataaactggtggttctacagggaagtaaaggagcaggcctacagggtgtctggtacatgtagatgctcagtatatcatgaaacccacccttgccccctttggcaagttagagagtcattcrttctttcaaaaatatttactgagcatctgctaagtgctggaaactgtttcaatgtggggaataaaacagtgaagaacgtgccgagcacggtggctcacacctgtaaccccaccactttggaaggccgaggtgggtggatcacttgaggtcaggagtgcgagaaccccgtccctaatagaaatgcaaaaaaaattagctgggcatggtggcccatgcctgtagtcccagctccttgggaggctgaggcgagaggattgcttgagcccaggagatctaggctgcagtgcgccatgtttgtgccactgcattccagcctgggtaacagaatgagaccctgtctcaacaaaaaaagaaaagaaaagagaagaaaagagaaaagaaagacagggagggagggaggaaggaagggagggagggagggaaaatagagccaggcataaacttagaaagatcgtttggaggccaggcacaatggctcacacctgtaatcccagcactttgggaggccaaggcaagcagatcaactgaggtcaggagttcgagaccagcctaacatggagaaaacccctgtctctactaaaaaaaaatacaaaaaaattagccggggcgtggtgcattcctgtagtcctagctactcgggagcctgaggcaggagaatcacttgaacccgggaggcggaggttgcagtgagccgagatcatgccactgcactccagcctgggcgacaaggcgagactccatgccaaaaaagaaaaaaaactcctggcrcggtggctcacgccagtaatcccagcactgtgggaggctgagcaggcggatcacgaggtcaggagttcgagactagcctgctcaacataatgaaaccctctctgtactaaaaatacaaaaattagctgggtgtggtggcaggcacctgtagtcccagctactcgggaggctgaggcaggagaatggcttgaacctgggaggcagaggttgcagtgagccgagacagtgccattgcactccagtccaggtgacagagcgaaactccatctcaaaaaaaaaaggaaggcattggtagcaagagatggcaggccttgaaagccaggccagggtgaagtgtttctttttttttttttttttttttctttttaaatttttttttttgagacggagtctcgctctgtcaccmaggctggattgcagtggcctgatctcggctcactgcaagttccgcctcccgggttcatgccattctcctgcctcaccctccckagtagctgggactacaggcacctgccaccacgccagctaattttttgtattcttagtagaatgtagaatttacttagtagaattttttgtattcttagccagcatggtctcgatctcctgacctggtgatccrcccgcctcggcctcccaaagtgctgggattacaggcgtgagccacggcgcccggccttattttttctttttgagatgtacccagactggagtacagtggtgcgatctcggcttactggaacctccacctcccgggttcaggcaattctcctgcctcagcctcatgagtacttggaactacaggtgtgtgacaccacacatggtattttttgtatttttagtgaagatgacatttcaccatgttgcccaggttggtctcraactcctgacctcaagtgatcagsctacctcggcctcccaaagtgttgggattacaggcgtgagccaaatgcccagccaagggtaaagtgtttagacttcaacgtgctttggtccatctgggaaactgaggcacagaagttggcccacccagcccagcggtcctcctaatcccacagacagtggggatggagattctgcaaggggaagaggtgggagtcaggtagcaggcagaatttggacagcctgggaggtagctgcacacagtgacccccttccttattcctccccacagggagtggttttcagagacatttcagaaagtgaaggagaaactcaagattgactcatgaggacctgaagggtgacatcccaggaggggcctctgaaatttcccacaccccagcgcctgtgctgaggactccckccatgtggccccaggtgccaccaatraaaatcctacagaaaattctctcctgagtgcttctttactctggggaakgggctgcgggagagggtaggggcttccagagagggcagggtctgcaggagagggcaggggctaaaccttaggtactcctcacaagccctccaatgccctatctacttgccctgtgctgaggatgttttaactccatggtctcaaaagagtcttcctaagaaccctgcaaactgggccttattaatcccataagggcattgaggcccaragaggtgaagttacttgtataaggtcacacagccaggaagtagagaactggaactagattgaaccctcagcctagcaatgtcactatgctacacttttcctrgtgtggtctacccgagatgaggggctgaggtttttttttgtttttgtttctgttttgaggcagactcactctctcccccaggatggagtacagtggtgcgatctcagctcactgcaacctccacctcccaggttcaagagattatcctgcctcagcctcccaagtagctgggatttacaggtgtgcgccaccacacccagctaatttttgtatttttagtagagacagggtttcatcatgttggccaggctggtctccaactcctgggcttaagcaatcctcctgccttggcctcccaaagtattagaattacaggcgtgagccactgtgcctggctcttatgtaaaattaaaccacatacacatgagaaacaaccctatgtaattaagatttctttctttttttttttttttttaagagatggagtcacccaggctggagtgcagttgcacaatctccattcactgcagccttgcaacctccaccacctgagttcaagggattctcctgcctcagcctcctgagtagctgggattataggcatgtgccaccacgcccagctaatttttttgtatttttagtagagacggaatttccccatgttggccaggctggtctcaaactcctggccttaaatgatccacccgtcctggcctcccaaagtgctgggattacaggtgtgagccaccgcacccagcttaagatttcataagaaaaatatttgtaagccacatatctaataaccggttaatattcaggctgggtgaagtggctcatgcctgtaatcccagcactttgggargacaaggcgggcggattacctgaagtcaaaagtttgagacctgcctggccaacatggtgaaaccctgtctctactaaaaatacaaaaaaattagccgggtggggtggcacatgcctgtaatcccagctgcttgggaggctgaggcaagagaatcccttgaacccaggagtcgaaggttgcagtgarccaagatggcgccactgccctccagcctgggagacagagtgggactccatctcaaaaaaaaaaaaaattcaaaatgtataatatacaatcctagttgggacatcaaacactgcagccactgtggaaaacagtatggggtttcctcaaaacattaaagatagaactctcaaatgatccttcaatcccacttctgggtatttattcaaaagaattgaaatcaggaccttgaagagatacctgccctcccatgttcactgcaggtctgctcaatacccaagatatggaaacaacctaaatgtttatcaacagatgaatgggtcaaggaaatgtggtctctacatgtaatggaatgtaacgcatccttaaaaaggaaaccctaaggccgggctctgtggctcacacatgtttttttttttwaattttatttatttatttatttatttatttattttttattgatcattcttgggtgtttctcacagagggggatttggcagggtcataggacaatagtggagggaaggtcagcagataaacaagtgaacaaaggtctctggttttcctaggcagaggaccctgmggccttccgcagtgtttgtgtccctgggtacttgagattagggagtggtgacgactcttaacgagcatgctgccttcaagcatctgtttaacaaagcacatcttgcaccrcccttaatccatttaaccctgagtggacacagcacatgtttcagagagcacagggttgggggtaagatcacagatcaacaggatcccaaggcagaagaatttttcttagtatagaacaaaatgaaaagtctcccatgtctacttctttctacacagacmcggcaaccatccgatttctcaatcttttccccaacytttcccccctttctattccacaaagccgcgattgtcatcctggccggttctcaatgagctgttgggcacacctcccagacagggtggtggccgggcagaggggctcctcacttcccagtaggggcggccgggcagaggcgcccctcacctcccggacggggtggctgccgggcggagaggctcctcacttcycagacagggcggttgccaggcagagggtctcctcacttctcagacggggtggccgggcagagacgctcctcacctcccagacggggtcgcggccgggcagaggcgctcctcacatcccagacggggcggyggggcagaggcgctccccacatctcagacgatgkgcggccgggaagaggcgctcctcacttcctagatgggatggcggccggacggagacgctcctcacttcccagactgggcagccaggcagaggggctcctcacatcccagacgatgtggctcacgcatgttatcccagcactttcggaggtcaaggcaggaggatcacttgaggccaggagttggagaccatcttggccaacatggtgaaaccccgtctctactaaaaatacaaaaaattagccaggcgtgcgcctgtaatcccagctactcagtaggctgaggcrtgagaatcgcttgaacccaggaggtggaggctgcagtgagccgagatcatgccactgcactccagccggggcatcagagcaagactcaatctcaaaacataaaaggaaatcctgaaactgggcacagtggcttatgcgtgtaatcccagcactttggaaggctgaggtgggaggatcacttgaggtcaggagttcgagaccagcctgggtaacatggtgagacaccatctctaccaaaaaaagaagaaagagaataaataaatgtataaatattactccctggggttaatgcatccccttctcccccaaatcaaccctccaaactcctatactctcctgtcttctcactcagcagcctgttagaactcaagtcagattttttgttttttgttttttgagacggagtctcactctattgcccagcctgtgcagtggcaccatctcagctcactgcaacctctgcctcccaggttgaaccgattttcctgctcagtctcccaagtagctgggactacaggcgtgtgtgtgccaccacacccagctaatttttgtatttgtagtagagacggggtttcaccatgttgcccaggttggtctcgaactcctgagctctagcaattagccctccttggcctcccaaagtgytggggttacaggcatgagccaccatggccggcctcaagtcagattatgctcttcctctgctcagaactctcctgattctctcagagtaaacccagaagcacttaccaaggcctacaaacgggacactatgccgtccacgatcgcctcctccctgtctctctctccatcactcacaagcaactctttgctattcctccaatgtactgggcaggttcccatctcagggcccttgcagttactgttcctcttgcctggaatgttcttccccaggggtccagatatctgcctggctccctcctcacttcctccagttctcttccaaaatcatcccctgccagacgtggtggcacacgcctgtaatcctaactctttgagatgccaaggtgggaggattgcttcagctcaggagttcaagatcagcctgggcaatagcaagaccccatccgttctaaaaataaaaataaataaaaaataaaaaataaaaattagctgagcatggtagtggacaccttggggttccagccacgtggcmggctgaggtaggaggatggctttgaatcagggaggttgaggctgcagtgagccatgttctgaattagatactggtgatgatcgtgcaaccttcccaatataggaaaaaccactgaacagtacattttcaaagggtaaatttagccggacacggtggctcatgtctgtaatcccagyacttttggagtccgaggcgggcagatcacctgaggctgggagttcaagaccagcctgaccaacatggagaaaccccgtctctactaaaaatacaaaaaattagccaggtatggtggcgcatgcctgtaatcccagctactccagaggttgaggcaggagaattgcttgaacccgggaggcagaggttgtggtgagccgacatcacaccatcgtactccagcctgggcaacaagagcgaaactccgtctcaaaaaaaaaaaaaataattaagaaattagccaggcgtggtggtgggtgcctgtagtctcagctacttgggaggctgaggcatgagaatcgcttaaacccggcgggtggaggctacagtgagcctagattccaccaccgcactccagcctgggcaactgagtgagactccacctcaaaaaaataaataaaagggtaaattttatggaatgtgaatcataattcaatttttcaacatgcgttaggagggacatttcaaactcttttttaccctagactttcctaccatcaccsagagtatccagccaggaggggaggggctagagacaccagaagtttagcagggaggagggcgtagggattcggggaatgaagggatgggattcagactagggccaggacccagggatggagagaaagagatgagagtggtttgggggcttggtgacttagagaacagagctgcaggctcagaggcacacaggagtttctgggctcaccctgcccccttccaacccctcagttcccatcctccagcagctgtttgtgtgctgcctctgaagtccacactgaacaaacttcagcctastcatgtccctaaaatgggcaaacattgcaagcagcaaacagcaaacacacagccctccctgcctgctgaccttggagctggggcagaggtcagagacctctctgggcccatgccacctccaacatccactcgaccccttggaatttcggtggagaggagcagaggttgtcctggcgtggtttaggtagtgtgagagggtccgggttcaaaaccacttgctgggtggggagtcgtcagtaagtggctatgccccgaccccgaagcctgtttccccatctgtacratggaaatgataaagacgcccatctgatagggtttttgtggcaaataaacatttggtttttttgttttgttttgttttgttttttgagatggaggtttgctctgtcgcccaggctggagtgcagtgacacaatctcatctcaccacaacctkcccctgcctcagcctcccaagtagctgggattacaagcatgtgccaccacacctggctaattttctatttttagtagagacgggtttctccatgttggtcagcctcagcctcccaagtaactgggattacaggcctgtgccaccacacccggctaattttttctatttttgacagggacggggtttcaccatgttggtcaggctggtctagaactcctgacctcaaatgatccacccacctaggcctcccaaagtgcacagattacaggcgtgggccaccgcacctggccaaatttttaatttttttctagagatagggtcttactgtgttgcccaggctggtgtcaaactcctgggctcaagcagatcctcctgyctcagcttcccaaagtggtgggattataggtgtgagccactgcgcccagtcagtagccccctctttgcccctcactgagccctactggatgttcttggttgtgtgacagtttccccatctattaaacagaaacccctatagcagaggg

SEQ ID NO: 13468 - DNA, 27032 bp, Homo sapiens
ttgagttcttgctctgcgcctggccatgccggctcacagtagtcaccaagacaacccagttccctggggttgccatttgggaatgatggcgcctttcatctggatttctccaacacaggtttcaaccgcagcggaggtggtggctatagccagaaccgctggggtaacaacaaccgggataacaacaactccaacaacagaggcagctacaaccgggctccccagcaacagccgccrccacagcagcctccgccaccacagccaccaccccagcagccaccgccaccacccagctacagccctgctcggaaccccccaggggccagcacctacaataagaacagcaacatccctggctcaagcgccaataccagcacccccaccgtcagcagctacagccctccacaggtgagagaatgagtgtgtgtttgtatgtagtgatcgcacgtgtgcttttgaacctgagcaagttaggtggaggcggatctggggaaatcaacacatgccccagctactggtcttcactctaacctctagcctgcccttctttctccctggccgtgatcttgactcagatggaccctacacattcccagatcccctccaaacccaggagtaaatgtagaccttcccagaacctgctcttctcccaccaccctcaaggggatgggctgtaagcactgatccctccagcaagtacattattcttggctagtgtcactaacctcactaaatccccaagaaagcacttgactggagtcaccccttgcccaggctggctgacctctttgtcttttggacataataaccagggcactaaggttgctgaggacttgccctctgcacagagagcttcaatcctgagcagctccaggctcagttcccrttcttggaaagccagtgccctggctctggtatgcacaggctcctgtaaaccagagaggttttcagttatcgcacagccatttcccaagcactttcctcatgccgggcctggaatcagctgccaggaraccaatggatggttcccaggcccagctaactagaatatttcttagaacaagagttgggcaggcacagatccaaacccccagccccacaacatcctgtttctgtgagcttggacaaatagcttcccgtctctgggcctcattttcctcataaaggtgttagtagaagtcccttccaaggtttgttgtgaggaatgggtggcactatagctctgggactaggcagacctggggtcaagtcctttttccttggcccagaaatttcatcttgagcctcagtttctttctctttaaaatggggctagtgggacctacccctaggttctatatggagattawatgatgtaatgatccaacctgtacttgggaagcacttagtcaattgccactactgtttctcagcagatcttccagtaacaactaccaccacctgttgagtacccagtggtttatacacacaagcttattggatacccagggcaagctaaaggagttgttcttgttctattgtgattctcattttataaaaaagaaaactgagatttcaagaagtgccgtgtaccttgctccctgggggtctcagagctggggttagagtccacatcacagccctggggcttgcccttcatcctgccctaccatggcatggagctggctctcctccttctcagcccacaaacaatgtccactaggcaagggaagggcccctgtgggccaaccacttaaaaaggccctttttccatcccagcatttcacatctgcagatttcctctatttcacagagctttggcttttttccctccactttccagccgagttacagccagccaccctacaaccagggaggttacagccagggytacacagscccaccgcctccacctccaccaccacctgcctacaactatgggagctacggcggttacaacccggccccctataccccaccgccaccccccacygcacagacctaccctcagcccagctataaccagtatcagcaggtaggtgccagactgggggccaactggatggagagacttccatgggcccctcctgggtgtgtattcccagacttaagtccctgcttatccctaaaaagacagcctgctggcctcggcctggcgttcatctggtgcagccattccatttggtcaacacttctgcactggttgctaggtaattggtatcctagccccctccacagtctagcaagtgaaggggaagggctggcctaagtaccaggggcctcagagtcctctttcagcaccatagacagggggctccaaatcctgctgcaggttggtgcccaggcccccatacctgttactaaatcttttgactatgatatctagctatacccaaaaggcactgggttgacaagctgagacctgggcttcagtccctaactgcctacctgtgtggtgtcaggtctttccaaggtgccttgatttctctgtcaggggacctgtgttcaactgttgtcactgcagctgtctctgccctaggtgagggtggggctggtggggaggctaaatgtgtggtggatgcaggacaacttggtgttcttggtttctttccccagtatgcccagcagtggaaccagtactatcagaaccagggccagtggccgccatactacgggaactacgactacgggagctactccgggaacacacagggtggcacaagtacacagtagccagtgtgacccagaggctcccggaggcccctgccggcttcctccaccagcgcctgcctcggcccctcctctgcccccgccagatcccgtggtgctggggatggggtcatcccagggctgcctccctccagcccactgcctcccctctgaggggcttccttcccctccatagggccaggcatttttttctggattcaaacaggcaacaatgaccttttattttctgtttgtccccacctccccagccttccacctcctgttcttcctaccttcttcctttttgactaaataatccccacctcccttgatcatacagtgaggctacagtgactgaggggagaatcccctcctgttcactctcccaaccctgctccagcccctcagcttcccagaccctcatgcagttggttgtaaattctcccaggagctgttttactgtctacttttcaggattaaaaaaaaaatcaaaacttaaaaaaaaaaaagtttaaaaagcaaaatggggagggggaggaagcagtgacttttttttggtaattatgygcttttttttaatttttagaatttgtctttttactgtgggtgggctgttgatatttcatcaagataagcatttctttcctgagttcaggtgactgaggaagagccacaaaacaaaacacaacaaaaccaaaccacagaatcatctttaacccaactttttatacgatgccccagttccccataactttgcacacaagcttctgtgttcagttgaattgtaactgctttttgtatttggagagagtgactattgaacttgaaaccttttattccgggcgtcttggtagtttctggtgggattcagtgggtgagagggaagaaggggaggttggggggctccttcccttcagaacttgaagttyctcccactgcctcctctccagtggtctcccaggtgccagacccaaaagcttttcctacagtgataccctttatttttacttccccttgactcatatgttttaacatgattttaacaaactgcacttattaagaaatgtgtttgccctgttttgtttggtttcgttttgttttctttgaataaatgacatggcacctcctagcaggaaggaagcagggttgaaaccctgaagtgttactgcagttggccgttaattggggtgggggcctctttaaagggaaattatttactcattcattaamcaacttaactgagggattcatgtgcctggccccgattttggtgctaaaaatgcacgcttaaacaagggtccctggtttaaaatccactagttcatttttaaagtgcttctcttgttctctacctctcacagtctraaatccctccaggagtttttgagtaaaggacatggaacaggcctctaggtggagggatgggtgggactgatggggcagagaccagggctggtttgtttggcatcatcactgggcatccacagaccacctgcctcaggcctggcctstgtgcagcacggaggacagttcctgcctgttctgtgtttggggctcatggggattccaggagcttcatgtttcagccagtgtgtgtgagccacctgctgtgttcttcagctgtcctggacagtgctggggacatagtatggccacggcagtcctggaccccgttctcacagagctcccactccagagagaacaaagacctgccagcaccaagtggtcagctgtgagagcctggggtggtgtgcagggagggcttcctggaggagtgagccagggtaaaagactccagattgcatccccatggcccatcttccccttccttagcaaccttatgtcttcgttccctcatacatgctgtgttcctggctccttgtgagagacaatgctgggccacaggagaagccaattcagccccaatcttccctggtgggagctcagagccttgtgaaggggagaygggcaacaaaaacaagggagggaaactgactagtctcagaatctcgggtagggcatcagaacgtgagaaggaaccaaggttggtggctaaaagggaccctagaatgcgccagagaggaggtggcagggcctttagtctggaaagtccccttcccttcatgtccatatgctgggctacagcgccctctgctggcctctcctggtaatgcctaggaatctgggttggtaaatagggacctccttggctttcttccacaactccagacctcaagggaatgcaaatggggaagctcttcctctgttctcagccagtttttctcacacgtctcatctccagtcccttgatgcccactcccttcagaataaaggaggtcaagccacttactatggcttatgaggccctgcatggcctagcacctggtaacatcgctggcgccctctctttctgctccccctttgaatatcaaatcagtgtttattttgttmtgaggagccataagtcctttttggaacccacaaatgatgccatgaaccactgcattggagaatacagaggtacatggaattttgcataaaaattcatgaggttctcaaaacctccacagcccaatcatggctttcaagttagagctcctttcctatgccctgaccgtagtgaagtgcttgcagcaaccagaaccgtccgtacgtgccatcctcctcaagactcttccctaccttcctcttaacccagctcctactcgttcttcaggtcttagcttgagggtaccctcccagaaagaaggcttccttgaccctccagcctggggtggacagctccctcagccctctggatccatcaaagccctggccactgagtgacatgtctgtctactctgctggtaacacctaaatagagccccacccatcccatagggaaataaggaccagagttgtcttgtttcacacctgtagatttcctccaggtcctgggaacacaaaatgggaagttctatctcactatccatctcatgccagccagagacagggtatgatgacggaagtaagccaggctggtggctcacgcgcgtaatcccagcattttgagaggctgaagcgggaggattgcttgaggccaggagttggggactagcctgggcaacaaagtgggacccctggctctacaaaaaaattttaaaaattagccgggcgcggttgtgcgcgcctgtagtcccaagtactccaaaggctgaggcaggaggatcacttgagcacaggaatgtgaggttacttgaactgtgatcgcgccactgcattcgtctrggcgacaaagcgagaccctgtctcaaaaaaaaaaaaaaaaaaaaaaagagtcaaggcttagtaatattcctgaattcctgaaggagttaagaaaggaaaaggacaagcgggggtctaaacgagagcacgaaccctcagcgtatgacggctccaggctccgggggaaagtcctttagccatccatcccaaaattaagcacgctgggagctggagtcacagcagtgataaaacgaacaatgattctggttcctactgactgacaggagaggtttaagggtctctcactctccggggagcccctttccttcctggctgcggagggcggagcccgagagaggcacgcatgcgcaatgcaacgtctgccttaggcccggaacttcggtgcctgggcgcagcggtgcacccggacccggaacattctcaggcgaaagtgtctcttgygtgcgtgggccggaggttagtgtgcggggcccgccgggcggttgaaaagtycgagagaatcaggatggaggccgtggcgacggcgacggcggcgaaggaacccgataagggtgagatcttggtcacgcgcaggcggcgggtgggtgcggttgcggtgtctctaggaaatgattcccccaggaacgcgaagtaggactcgttttagggggacacccacccccctcagctttaccggtcctcttcactactttgcccagattattccctcccttgtcgcgggctgaccttcttttcctccattccttccccccgaaattaacctcttcccagttccagaccaatcctttccatgtccctaattcatttccttaccaggctaactctcaaattaacagaaacctctctaccccggcctaattcctgcattgcctcagaccagcccttctcaaattacctccttccctgtaccaagctgagccttcccttgctctctagacgaatcctcctacctttccaggctaaacttctacctgcctcatgcaaacttatcccaatctaacgattccttcatttcattgtaactcccgtttcccccaaagtccgaaatccagccaggctcctttcaaagtccttactcaatttctgtgctttcccacaaccttcaaagtaatccgacgtcgggtgaggtgtgattggaakcgtggctccaacaccactggccaagaattggtaattgtggaagccagatggagatgattggtatatggaggtagggggagaattgtcgttgtactttctacttttgtgtatgtttgaaattttctaaaaataaaaaatttaacctaaaaaaagtcttaaggccgggtgcagtggctcccgcttgtaatcccaacactttgggaggccaaggcaggagagttgcttgagcccaagagtttgagaccagcctgggcaagagagagaaacctgatctctataaacatttaaaaattagccaggcctggtggctagggagtagctaggacaagctactcaggagactmaggtgggagtgtcactcgaatcctttgagattgcagtgacctaagattattacaccactgcactccagcctctgcagcagagtgagacttgagcccaggagtttgagaccagcactggcaacatagccagaccccatctctacaaaaaatttaaaaattaaggccgggcccggtggcttacacctgtaatcgcagcactttggaaggcggaggcaggaagatcacctcaggtcaggagttggagaccagcctagccaacatagcgaaaccccatctctactaaaaatacaaatattagccaggcgtcgtggtatgtgcctgtaatcccagctactcgggaggctgaggcaccaactggaatcacttgaacccgggaggcggaggttgcagtgagcagagatcgcaccactgtactccagtctgggtaacagagcaaaactctgtctcaaaaaaaaaaaaattagccaggtttgatggtgcattcctgtggtcccggctactcaggagtctgaggcgggaggatcacttgagcccaggaggtcaaagctgcagtgagctgtgtttgcactattgcattgcagtctgagcaacagagcaagaccctgtttcaaaaaaaagaaaaaaaatttgtctcttggccccatctgtctccttcagagagtcatgtatacttggtcttcatttcctcgtctcctgctcacgactgtctgacttttctcctaagaaactgctctgattagggtctgcactgacttcccccatgttgttcaattcagtccccccattcaggtttttgtttgtttgtttgttttttgagagagtctcactctgttgcccaggctggagtgcagtggcatgatctcagctcactgcaacctccacctcccaggttcaagtgattcccgtgcctcagcctcccaagtagctgggatcacaggtgcccgccactatgcctgtctaattttgtatatttttagtagagatggggtttcaccatgttggccaggctggcctcgaacttctgacctcaagagatcctcctgcctcagcctcccatagtgctgggattacaggtgtgagccaccacacttggcccattcaggttttttttcttactagactggactagaattaaatgctgttgatccttccatcctttttgcatgttttcctttggcttcagcgacaccacagtgcctgatttcctgcctgtctctcaggctgctccttctcagcctgactttgtttcccaggggtgctgtaacaaagtactacaaactgcatggcttcaaacaacagaactttattctctcatagttctcaaggccagaaggctgaagtcagtgttgctgaactgaaatccaggtgtctgcagggtcgtgcttccccacaggctctgggagaaaacccatttcttgcctcttccagccagtggtggtttctggaattccttggcatgtggctacatcactccaatctctgcttccccttttgacgttgccttctttttttttaagacggagtctcgctctgttgaccaggctggagtacgtgatctcggttcactgcaacctctgcctccggagttcaaacaattctcctacctcagcctcctgagtacctgggactacaggagtgcgccaccacacctggctaattttttgtatttttggtagagcgccatgttggccaagctggtcttgagctcctgacctgaagtgattctctcaccttggcctcccaaagtgctgggattacaggggtgagccattgcaaccggcctctttttttttaagataacagtaatgggctccagggattacgatgtagctatcttttgcacagccagtttttagcttcagaggcatgtcctccccgcatctgtgcagtgctttttcctggaccctcttgtcatccctctcccactcccctgtgccctccccagtccctacctctcatttctcttggctttggttcttgtcttgattctgatgacacccacagctctgtctccagcccaacatttctctcctgaggagtctggaggcccgtgtagcagcagtcggaccattcccctggatgcctcccttacttccagcacgtcagccctgtggctcctccactcagcctcctgacatctttctgattcgctcactcatgatcctgttccttcctccacagcccctgcccttgtccagctcagtcttcagctgcatcagtgatttaaatcctccctgatacacacaacacatgtatgtcacctgtgacttctttcctccccaacccagccacgctgcttaaagttgtctctatattctgttttcacgtatttcctgcttgccgcaggcttgctccctccactcttgggaaacaagtctcaccaaggtttgcccagcgctccgctttcctgttttctttccatttttttgagacagagtcttcactctgtcacccaggctggagtgcaatggctgatctcggctcactgcaacctctgcctcatgggttcaagcgattcttgtgcctctgcttcctgagtagcagggattacaggtgcccaccaccatgcccagctgatttttgtatttttaatagagagagggtttcaccatgttggccaggctggtctygaatttgtggcctcaagtgatctgcccacctcggcctcccaaagtgctggattacaggcatgagccatggtgcccagccagctttcctgttttctttgcccatattattgttgatcctgactgtctcccacatcagactgggtgctccctgagggcaggagctggactggattcatcctatggatcctcagcattgcctgacttagggcctctcagagatttagtgtttttttttctttttttttttttagagttttgctcttgttgcccagactggagtgcaatggcacgatcttggctcaccgcaacctctgcctcccaggttcaagctattctcctgcctcagcctcccgagtagctgggattacaggcatgtgccacaatggctrattttgtatttttagtagagacggggtttctcccagttggtcaggctggtcttgaaatcccgacctcaggtgatccacctgccacagcctcccaaagtgctgggattacaggcgcaagccaccgcgcccggcctaagatttakagttattaaagagtggttgggtgaacgcatgaatgcatgagagagtgaatgaatgagtaaacaaattagcaaatgtattaacgatttaaagaattgagtggatcaataagtcaggcctcagggcctttgcagtagttgttgcctctgcctggaattctcttttccaagagacctcatggcttaatccctcaccacctgaggtctctaatcaaatgtcacttttttggcaaagccttctctgagccttccatttaaaattgcagccttggccaggcatggtggtttacactgtaatctcagcactttggaagcctgaggcaggaggatcacttgaggccaggagttcaagaccagcctgggcaacacagcaagaccctgtctctaccaaaaaaaattaaaattaggccgggtccagtggtgcacgcctgtaattccagcactttggaagatcgaggtgggaggattgcctgagctcaagagattgagaccaccctgggcaacctagtgagaccttgtctttactgaaacttttttttttttttttaatttaaagattggcagggtgcaggccaggcgcagtggctcacgcctgtaatcccagcactttgggaggccgaggcgggtggatcacgaggtcaggagttcgagaccagcacagccaagatggtgaaaccctgtctgtactaaaaatacaaaaattagccgggcatggtggcaggtacctgtaatcccagctgctcgggaggctgaggcagagaattgcttgaacctgaggcggaggttgcagtgaatcaagattgctccactgcactccagcctgggcgaaagagcgagactccgtctcaaaaaaaaaaaaaaaaaaaaaaagattggcagggtgcagtggcacacacctgtaatcccagcactttgggaggccgaaggggagtggatcacctgaggtcaggagttggagaccagcctagccaacatagcgaaaccctgtctctactaaaaatacaaaaattaaccaggcatttggcttgtacctgtaatcccagctagttgggaggctgaggcaccaaccacaataacttgaacccaggaggcggcagttgcagtgggcagatctcacgccattgcactccagcctgggcaacaagagcaaaactccatctcaaaaaaaaaaaagaaaaaaaaatttaaagattaactgagtatggttgtgcatgcctgtagtcctggctgctcaggaggctgaggtgggaggattgcttgagcccaggagttcagggttacagtgaaccatggttgtgccattgcactccagcctggcaatggagcaaggccttatctcttaaaaaataaaaataaaaataggccagtcacagtggcttacacctttaatgcccagcactttgggaggccaaggcaggaggattgctggagccctggagttcgagaccagcctgagtaacatgtcaataccctgtctctacaaaaaatttaaaaattacacaggcatggtggtatatgcctgtggtcctagctacacgggaggctgagatgggaggatcgctcaagcccaggcggtcaaggctgcagtgagctgtgattgcgccctgcactccagcctgggtgaccgagcaagaccctgtctcgaaaataaaataaaattgcagcctcctccacctcttccctcctccttccctgtttatttttccgcataactccaggaaacacctaacacattatgttttcggtaattatgttgctaattgtttgtgtcccctactgaaatgtcaacttttgctcactgtggtttctctagtgcccagaacagtgcccagaatatagtcagtgcccagtaaatgtgagctgagtgagtgamtaagcccccagtcccttcccacactcccatctctgaactaaccaatctctcctttcctcaggctgcatagagcctggacctgggcactggggtgagctgagccggacaccagtcccatctaaaccccaggacaaagtggaagcagctgaggcaacaccagtggccctggacagtgacacctccggggctgaaaatgcagcagtgagtgctatgctgcacgctgtagccgccagccgcctgcctgtttgcagccagcagcagggtgaacccgacttgacagagcatgagaaagtggccatcctggcccagctgtaccacgagaagccactggtgttcctggagcgcttccgcacaggcctccgtgaggagcatctggcctgctttggccacgtgcgtggcgaccaccgtgcagacttctactgtgctgaggtggcccggcagggcactgcccggccccgcaccctgcgtacccgcctgcgtaaccggcgctatgctgccctgcgagagctgatccaaggtgtgggggccagatgggcgacagtgggcacatatggggagggaggggagactgaggcagagggaattagagaaaagaatacaagagcagagacagagatcctgggagagaagttctgagacagagacagggacacaggaagagactgagacagaaatgtaaagtaagggggagagatagacaggggtccagggaagagaatgggacagacaatgagaatagatcagaatttagtagatgtyagaagtggcatttcagattggtaggctgaggacacagtacacagtgctgtgataattggtcatacctaaggaacaaaacatgagatccctacctcataccatatacagaggcatcaggggaaaccaaaaggagtatgtacatgaccttggggacacagaagccttctgaacaagacacackgtgaaaaccatgaaggaaaaaaaagatagctttttgaccatgacataattaaaagcatccttgtgaccacaacaccagaaccaaagttaaaagatgagagtgaatgaagcagagtgagttaagttgccgttagggagaaggcacaagttatagagaggttcacagagaaagagagagaggctgggcatgatggcttatgcctgtaatcccagcactttgggaggtcaaggtgggtagattacttgagctcatgagttcaagaccagcctgggcaacatggcgaaatgctgtctctacaaaaaatacaaaaattagctgggtgtggtggcrccctagctactcagaaggctgaggtgggagaattgcttgagcctgggaggtggaagttgtgtgagctgagatcccaccactaagctctagcctgggcgataaagccagatcttgtctcaaaaaaaaaaaaaaaaaacacagatgtggaaatgaggatgaaaacagaaggaagatgggccgggcacagtcactcaagccggtgatcccagcactttgggagggcgaggtgggggtggacctgaggtcaggagttccagagcagcctggccaacatggtgaaaccccatctctactaaaaatacaaaaaaattagccacatgtggtggcaggcaactgtaatctcagttacttgggaggctgagggaggagaattacatgaatctgggaggtggaggttgccaaaaaaaaaaaaaaaagaagaaagatgaatgaggtgggggtaggtgacagaaactgaaaaaagcaggaaagatagaaagatggagataaaggaagagatggagagagatccagagccggggtgggtgataatccaagttggggagaaggagggatagaaactgaatctgctagaggctgggcacagtggctcagacctgtaatcccagcactttgggaggccgaggcaggcaaatcacttgagataaggagttcaagaccagcctggccaacatggtgaaascccggctctactaaaaatacaaaaaaaattagccaggcactgtggcaggtgcctataatcccagctactcaggaggctgaggcaggagaatcacttgaacccgggaggcggaggttgcagttagagttaatcgagatcacaccactacactccagcctgggcaacagagcgagactccatctcaaaaaactgagtctgctagaggatgccacaaacagctgggggtaagattgctggcaggagtggggaagytgagcaggacagggacagtcacagcctatggtgctrcagaggccaggagtccgagcagtttctttgccctggactctgaagacacggctaggaccagtggaggggagggaccagggcaggtttaactgttatttgagggacagagtcactcgtgcagaaacaggcagccaggggtgatgcagggaactcaagttttggggtagtggggaagccaggcccacctgaggggttgctgcatagaggagcactcgagagaggatggatctagggccttccaccaccaggaggctttcccagggatacacgggcagatgccccacctgacctgatcccttgcacacacatgccaaatccacgtggatgtacacacatacacgccccacagtgaaggcgtgtccactgccagccagactagggccccacaaacaggcacacaacctagagacacacaacytctgctgcattgtcctgcatgctgacacccagacagacaggtgtctgtgggcatatgctgggcctcacaggacatgtgtgtgtacataggccatgyacacgtccatgggcaggagcttgtgcatcgtgcctggacacagttgtacacgagctccagaccgtcagagcctcagaggccaggatgtagccaggtctgcccatgcacacacatgcttggatgcatgaatacatgaatacacaggaagatagaggctgggccacatacacacactcgggtgcctgcacgagtaatcacatgcacgtgacctcaggtgcctgcatgagtgcttgcgcacacagcttcaggcacctgcatgagtattcacgtgcatgcctcaggcgcctgcattattcacacgcacgcctcaggcgcctgcatgagtactcacgcgcacctcaggtgcctgcatgttttcctgtgtttttgaatgtgtgcatacacacasttggactgtgtatgcacatcatcccacaagcatgatcacacacatacccacatggacactatctgctcagtcgctcaccccatgcccaccctgtctctcctctgtgcagggggcgagtacttcagtgatgagcagatgcggttccgggcccccctgctatatgagcagtacatcgggcagtatctcacccaggaggagctcagtgcccgcaccccaacccaccagccccccaagcccgggtcycccgggagacctgcttgcccgctctccaacttgctgctccagtcctacgaggagcgggagctacagcagcgtctgctccaacagcaggaggaggaggaggcctgcttggaggaagaggaagaggaggaggacagtgacgaggaaggtgagggccagtagcaggragaccccagattccagacaccccagccctaggcctgtctgtctccacttcatggcagcaggctgggcccccaacctgcaaaagccgacattgcgtccctcccctgcccagcctgactctctgtgtatgcccttccaaccgctgcagcatccccatcccccactctgaggcaccaaatgaaccctcgcctccaggtctggacaggctgttccctccgccaggaatgcctctcctcccacccttcmggtctcagatcctgacccgaggatacagtctccagagcactatatggtcatgtgttttatgygtgtccctggagggcagggaccagggccatctctgtcactagtgtgttcccagagccacccagcgcaaggctgggcacaggagcagcagctctctgtggactctgtgctcagtgcctgcccgagtgcacccgcattcacaccccctctcctctccctctgcagaccagaggtcaggcaaggactcggaggcctgggttcccgactcggaggagaggctgatcctgcgagaggagttcaccagccgcatgcaccagcgcttcctagatggcaaggacggggactttgactacaggtgctcctgtgcctccacctccccatcccccagcccagcatcccacggcctttggtcacatgcagagcccttaacaagctgtgggggtctccctttgtggagctacaaggccccaaaacagttccaggatgtggggttgaacagccaaaggaagaggctgggtgacctcggactagccttgtccatctcagaccctcagtctcctcacctctaaggcaggggrtggacagggatgacatatagctcagtatcaatgaaaccctgaaacacttccctcctggcaatggcagaggctactaccccaagccccccaagtctccctaggaagcccaacctcttccgcttcaccttggacctcctcatgctgcaggaagtaacccctggcaaagttcatgcccggcatggaggggcctgcactggctgcccccacagttacagttgttcatttctccagtagcaccccagggctgagacacgtgggccacctgctttggaaaaggacccaggagagtgatgtgtcagtcaaagattggttttgtcatttaaggtagctttgccttgtggtcccaaacactgggcccagcagcagaggaccctccttggtttcacatccagccccgatgacatgtgaaatgtgtgaccacacataagcggaccctacgtccgtcctgaggtgggctcatcaggaaagtgggaattgtgattgcccctgccgtggggcccagccatggtcaccagagcctcytcccattctgggatccctggctcttgaatggaatctggctgctccacttccagccaggcaggcctgctcagagccccagttcctgcacgcaaagtggtgagcagagggcctggaccatggggaccctcattcagcaggcatcactgctgttcccaagccagggcccaggaggaaattgggggtggcagggaccacagtgtgttgcctcgggagggcagcagtggccccgacktgtcccccatccgtgcattcagttggcatgtgctgagcatctgtgatgtccacaggctctggggataaggcggggaccaaaaccaacgaaaggcttccctgcctgaaaaggggtcccactctagtgaggaagatctagaattttctagcacttcatggtgatggggccatgaggaaaagtgaagcagtgggaggggagtgacagggtggctagggaaggcctctctgaggggctgacagcaaaggcctgcaggaagtgggaggagcattcctggcagaggccatagtaggtgccagagcccccagcagcaccaaggggcagaaggggctggagcagtcgcaaggggtcgcaagggggtaggagatctctgagtggccaaatcaagctaggcttggcaacccaagtgcgtgctgctgggtttacttgctgccttagggcatgggcagctgtcctgcctgtggtcagctctggctaatcccggcctctatccactggagggcagtagcaagcccccagtgatgacgtcaaaatgtcaaaatgccgtgggggcaaaattacccccaagtggttctttgttgagagccactgcctgcttgagaatgtaagcccatgtgtcgccacattttacagctttttaagaaaaactagagctttggggttttttttagacagggtctcctttgtcacccaggctggaatgtggtggtttgatcatagctcaccgcagccttgacctcctggcctgaagtgagcctcccgcctcagccaactgagtaagctgggactacaggtgctcaccaccacgcctggctactttttcaatttttttgtagagacagggtctccctttgttgcccagggctccaactgctgggctcaagccatcttcctgccttggcctcccatagtgctgggattgcaggcatgagccaccatgcccagcccagagtttttgtgcaaactctgatttggaaaatgttcccttgagttttaaaccctgagagttttaaacactatctcccttgggagggtcagctctgacggctgccagcacatggcctttgacatcagggtgccccaggcctttgacctgggcatccgagggtcccagggagacccagtccttgacagcctcctcctcctgcagcacagtagacgacaaccccgacttckacaacctcgacatcgtggcacgggatgaggaggagaggtactttgatgaggaagaacctgaggatgcgcccagcccagagctggatggggactgatggccgccacccttcccaccgcctgccccatccccatccccaacaaggcagctgattccaggcctgctcagtgaccctttctctagggggacatcagggcagtgccccacaacccacacacaccaccatctcactgggtstagtctcatctcagacaacccccacccccactgtttctsgggttccctttctcatctctcccaccctgtctcctgcctctgtctttcttggtgtctgtctgggcttctttctgtctctttctgtctttctgtctctctccctacccccgctccctctttccagtgctctggctggctgtctctccctttctccccctctctctctgccttaggctctgtctccaccgcagggcccaaggtgaaagtcctccccttgccggaggccagctggcagggcctttcgtggctggaagtggccagtttggttccggtgctgacccctaggccccagcgcagctgcctcccgtgctgtctgtctccccctctctgtttatgtctgcgctgtgtctcacactcagagcctccttgcttctgttaggttcccatctctccttctgcctcactctgggcctcttctttctacttgtacatttccacctctctaggcctctgctctcactgtccctctctgtctgtctctcagcctttatctctgggttttgatccccsactccaggctctgggccccttcttcccccttccctcaaacctggctgctataggcagcagaaccctgaccactgagtaatacagccccaggggagggaggagaccccaggcagggaggatgggggcagctctcttctctccccaggacccaggctgtggatcacggggcctgccagcttgagtgtagagggaggggggactctacccttctcagccccaccagcccccctctgcccaaccacaattttcccttcctccgccttcctctcccwctcctgtttacactccccaaatgcrcacaggctgttatcatgggtcctgagtcatcccacacacagcctgccccagcgtccctgcccccagctggccgcagggcccgccccrtggagccccctgccgccctgggctaatgggagccagatggccgcctggtgactcagccaccgggcctgtgggaacccaggcgtcccgccttcccatgcccccacacccggctcctgctcccccagcagacacacacaggagggcctggccactgttgagggggcacacagggcaagggtcaccaagtcggggcctagggactcctcatgcctctgagatggaatggtggtatcctgccgtggccaagcctgaaggaccctcaaaactgcctcctggagtccacggttcctgacctccgagcctcagctatgccctctgggtcaaccagaattagagccagacagggaaagtgagagctggatggaggcagacaagatgctcagagcgactattaaagaacgaaagcctctgctacggagcgcttctgtcctctgtcaggcccgagcgaagtgcctgacaccgggttggatcctcagatggccccatgaactagtgaagtgggtcaaaggaggcctggaaagatgttgcttcctcaaggccactcggccatcagaggcagaaatgaaacaggaacccaggcctagaatcacaaaggtcctagaaaccacttggctgtctggcctctcaggtgtcagggccatccagagtgagacagcattggagggacaagtgtgcatgcagatgtcctcagacgggaaggtttgagaagggtcagatggtaggcgggcctaacaagggctccstgctagccactgtcccgcacacagacaggatcaggtcatcttgatatggagatcagtccccaaatcactgaattgtcccagcagtgctatgccctaggtactaccaatatcactcctctatttcccagaggaggaagcagcagctagactccaggaccttggggtcatayctctcagaaagccaagagtgcaggatgagagctgtctgtctcttacctgcctgtatttgtgccccatttttaaagagcagagggcctgggccacaggaaaggtatcagcccttggtgataggcacattttttaccartctatcatttggtcattaaatttgtttacaatatactttgctatacgtaaatttgttgtgtaggtttttaaaaagcgatgagagacacagaaattgagtcagaattagggttagtcagatggtcaagacgtgagcatctagctgacagacagaggtggagccagtcccagggacagggattagatggggagacaggaagagaggtggagacagagtggggtagggatgacgggagacacaccccctggtcactgcctctgagacctgggggtggtgggccccagggcgggtgcctcccatccccctcccagttctcccggggtcggggtaggtggaaaggctgagtcagggagggcgggccccgctgggagacaacccctaggtgggcatccggcccccacccccgtgtctcctgtccgtcctggccctggcctggctcgctggcctggccgmcaccccgccccccacgtctgacacctccatgcgtcctgccaaagcaagctgcctccctgcactcttccccctccagctccagtcactctgtccctctgtcccccgtcccttctccctgcttctgtgcgtttctttccagccctctgccttcctccctcaccgccactgctctgtcttctcgttctgtctccacacctctggctgtcggtgtctccccgtgactttccgtctcccctctctctcctcccttgtttttcccatgcctctccctccctccctccctccctctcctccccaccttttccactccrtgtccccagccattctccatctctgttctcagctcctgtcacctcgtttccccatccctttctctgctggagtctccctctggggggctctgtcctctcctcactttgccctttccctctcgctgctgtgtgtcttggcccsccccccgtgccccccatctcctctgtctcccacactctgggaagcccggctgggatatccaggttggagcctcactggcggccactggaaacccagaatgaggggtcatcgcctctcgcccacccagaaagggcgcaggagggggcagcaaggttgcggggcctgtctggccagaaggaaatgtctgtgctgtggcctggtcacccccgcccccaggacctgctgggctgctgccgcccccggccggggctgaggccgagtaaacacagcaaacacagccgccggcagcctgggatatttataccgaggctgggcgtgggtccagtgcccaccacagcccctgccctgccctgccttgcctgctgccacagccagctccgagccagcgtggcaccagccggcaaggggacgcgccgcagacacagcctgcgctgggtatggaggccaacaggcactggccgctcatgatgcaggcggctycatggacgcaccctgtccccctcccctgaaaacaccagcacacaatgtggacccacactcgcagctgctcacaaacacacatccacccctgctgagaacgcraaatcccctcaacgatgatgcaaaacagacccacacaactccacacactgcagtcaccagcctacatgtgggaacacagcatgcagacaccaccttagcacctgctcacagcacccacaggctgggaacaccagtccctgagatggacacacagccccgaagtayagccctccctcacacagacaaacactgagaaccacaggaagcatgctggatgcacaccaygtagacaaacatgctcagaataccagcgacacatgcactgatcacagtgcaacccagaaacaactcaactcatctgcctcatatgtaagaaacacacacggccgggcgcggtggctcatgcctgtgtctcagcactttgggagaccaaggtgggtggattacaaggtcaggagttcgagaccagcctggccaacatggtgaaatcccatctctactaaaaatacaaaaattagacgggtgtggtggtgggtgcctgtaatcccatctactcgggaggctgaggcaggagaatcgcttgagcctgggaggcggagcttgcagtgagacaagatcgcgccattgcactccagcccaggcgacagagcaagaccccgtcttacacatatacacacacactcactcccctctcctggagaaacaccattcccacagatgattaacatatgcagaaaacaccacatttcaagtcaaacttacacttaaaaatgcacaaatttacactcagaagaacagtgaagatgttgagaaaaatatcagacacacaatatgccccagatacatggccgacttgcagaatcaaacagtgccagagcataaaacccacagaaaatacaacagcttgcccagcagaaatacaaaatgcagacgcacaccccagaaatgcagcgcagccacaaacacacggagctaacacgtgctggggacacacayagacaagaccatccataccaaacagcacacaggcccccagaacacccatgccagacgcagctcacgccacaaagcttggaatcacgcacacaataagttcctgaacacacaaatccgaatccacactggaacctcaaatactctgcatgtccagagactaagggggaaggggctttctctcacccaccaatctccccactcccccttgctgacccgggtcccaggcccgtcttgggggcgggggagggggcaggaaggcctgagctggcctcccccagcagcttcctgccccacgggggctggacaggaagctggggctccagccggaacccaggctccccccacgacttccctctgtggccccgggccgcctgcagaggcaggggcggggcagggggaggragcggggagccccaaaccccctgccctgcccctgcggtcggccacaggcgggggcagacttgtcccracggggctgagccacccatcgggcctgggtgccagggtggcagggcaggggcagtgcgcacgcggccagaggaaggtgctgagcccacagtttcccctccccgccctgtggggctgtgccagctcagccggcagccctgggcaggtgggcggggtgtgtcatgagggcgtgttgggcaggccgaccacaccgcgaatgtgcagccagcacttgtcctcaggccgaggcacgagctggggctgggcatgtgagggccgcgtctgccaccctgggggtgtgtctgctccgtctgggaccctgggtgtgacagtgtgtctgggcgtgacgtgacggggtcgctgcaatctgtggggccctgtgggactccccaggctggaattgtgcgtgtgtggcggagggtgtgggatgtcagactgagtgggtaagaccgacctgctgtctgtgaggttgtgacgtgtcagacctctgtgtggggtgtgtctggtgggactgtgacaggtccgactgtggacatgcaccctggacctgtttgtgactgtgaacccatggaggaggaggtggctgttgagggatccatttcctgtccgggctctgatgccgtgatgcgtgtgcgtgcatgacactgtttgaatcagtgtctggtgtgcggtggttgcgaccatgaccctgtggaatatatttgtatatgactgtgttgtgccaggtccctattgaagtctctgctcgtgttgtgtcccagtgaggctccgaggctgggtggtgtttacgtgatgggctgacactttctctatttgtatctgtgtatatgtgggctgcagctgctgccaaatgacacagcccatgtgttacgggccctgcaggartctctgtgtgtccacggcggctctgagaggtgaatatttgtgtagtgtggggcaccgtccgtgtttcccgccgtgtgagtgtgtctgcatgtgtacacgcaccacatcctcatagggctgcagcgattacagccgagtcactgtgtcctakcttgtgactctgcctcttggggccagacctcagcatctctatacctatccatttgttggcatgtccttgcatagtgaactcctgcctccccactcctccctcagccctgtgtgctttgggacctgaggccagaggagtaaccacatttctacccctatgctgagctgggagggccccaggtccctggcacccagacccagtgctgccaacagctctcatgcccacaggcaaaggaaccgcagcactcatactgtccttcctcccaggacaatcactgggtgtggggaagtgaaacctaggagaaagagcagaaactgagaggcaggagaaagaggaagcaggagagaattcacaagcaggaccatagcagakgggaagaaatggagacagcagagggagacccacctgtggctgctgccatttcttgcctggacagctggtctgtctgtgctcaccctcaccctgacacttctgtccactcccaaccatgagcaagacggcggaccctctgagcgcctaggtcaaaccctgccatggctcctgtcttccttgagtgcaagttctttttttttttttttttgagatggagtctcactctgttgcccaggctggagtgcagtggtgcgactttagctcactgcaacctctgcctcccctgttcatgcgattctcctgcctcaggcccctgagtagctgggactacaggtgtgcaccacaatgccagactaatttttttttgtattttttwtttttatttatttatttgagatggagtctcactctgtctcccaggctggagtgaagtggcgtgatctcggctcactgcaacctccacctcccaggttcaagcgattctcctgcctcagcctcctgagtagctgagattacaggcgtgcgccaccatggctaatttttgtatttttagtagagactgggtttcaccatgttggtcaggctggtctcaaactcctgacctcgtgatctgcccgccttggcctcccaaagtgctgggattacaggcgtgagccactgcgcccagcctttttttgtattttagtagagacagggtttcaccatgtggtccaggctggtctcaaactcctgacctcaagtgatccccctgcctcagcctcccaaagtgctgggattgcaggtgtgagccaccgtgcccagtctttttttttttttttttttaaagatgcagtcttggctgggtgcgctggctcatgcttgtaatctcagcattttgggaggccgaggcgggcggatcacctcaggtcagaagttcgagaccagcctgaacaacatggtgaaacttcgtctctactaaaaaaaaatacaaaattagccgagcatggtggcgcatgcctgtaatcccagctacccagctacttgggaggctgaggcaggagaatcgcttaaacccgggaggcagaggttgtggtgagccaagatctcgacattgcactccagcctgggcaacaagagtgaaaatccgtctcaaaaaaaaaacataaaaaaaagatggagtcttgctttgtcacccaggctggcatacagtggcacagtcagggctcactgcagccttgacctcccaggatcaagtgatcctcccaccttagcctccagagtagctgggaccacaggtgtacattttttaaaagtgttttgtagagatagggtctcactatgttacccaggctggtctcaaatgcctggattcaagtaatcctcccatctctgcctcccaaaagtgctaggattacaggcgtgagccaccccgcctggcctgaactactatcttttattgtcttcttcactatcccccactaaagcaggttcctggtgggcaggaactcctcccttaacctctctgggcttgtttcctcacctttaaaatgggtgttatcagagtccctgcatctcagagtgttgctatggtgactgaatgagttcattaatgtaaggcacttcaacagtgcccaaggtgctcaataaatagatctaactacagtagtgttccccactggtcccctgtgccttgatgccgggcaaaggaatagtgcagacaggcaggaggaggcagagagggagagagagggagtgggagtgggggaacgtcagggatggagacccca

SEQ ID NO: 13469 - DNA, 21442 bp, Homo sapiens
gagatcatgccattgcactccagcatgggcagcaagagtgaaactccatctcaaaaaataaataaataaataaagtaaaataaatacattgaaagaaaataggatggtgattaccaggagctgcagaagaggggggaataggggagttgttttgtttcaaaaatgtgtttactttgcaaaaattttagttttgcaacatgaaaatggttgtggagattggttgcacaatgtaaatgtacttaacactattgaacaatacagttttaaacagttaagatggtaaatgtgtattttaccacaattaaaaggcttatttatttatttttatttatttattttgagacagagtctcgctctgtcacccaggctggagtgcaatggtgcaatctcggctcactgcaacctccacctcctgggttcaagtgattctcgtgcctcagcctcccgagtagctgggactacaggcgctcgccaccacgttcagctgattttttttgtagttttaggagggatggggtttcaccatgttggccaggcttgtctcgaactcctgacctcaagtgatctgcctgcctcggcctcccaaagtgctgggaatccaggcatgagccactgcaccgggcctttttttttttttttttagaggtgcagtcttactttgttgcccaggctggagtgcagggtgccatcatagctcactgcagcctggacttcctgcactcaaggcatcctcyggcttcagcctccaaagtagccgggatggccaggcgcggccatacatggcaaaaccccatctctactaattagctgggcgtggcggcaggtgccttcaatcccagctacttgggaggctgaggcaggagaatcacttgaacccaggaggcagaggttgtggtgaggagagatcacaccattgcactccagcctgggcaacaagagtgaaactctgtctcaaaacaacaacaacaacaaaaatgaagtagccgggaccgccggctgtgtgccatacttggcttaaaagcattttgtttttgagacagggtctcactcagttgcccaggctggagtgcagtggcacaatcacagctcactgtagcctccaactctcaacctaagcgatcctcccacctccgccaccagagtagctgggactacaggggcatgccaccacacccagctaattttttgtattttttgtagtgatggggtttcatcatgttgtccaggctgctctcaaactcctggattcaagcaatctgcccgccttggcctcacaaagtgctgggattacaggtgtgagccactgtgcccagccccatattctattggttagaagcaaattacaaaaactagccatactgaagggaaggagaattaggctccacttactgaaagggggctgcccaagcatttgtggatatattttaaaacagcttcaggccgggcacagtggctcacacctgtaatcccagcactttgggaggctgagtcaggtggatcacttgaggtcaggagttcaagaccagcctggccaacatggtgaaaccccgtctctactaaaaatacaaaaattacccgggtgtggtggcacatgcctgtaatcccagctacttgggaggctgaggcaggagaattgcttgagcctgggaggcagaagttgctgtgagccctggcccacagaacgagactctgtctcaaaaaaacccaataaccmccccccccaaaaaaaaggtgacaggttttcactctgtcacccaggctgaagtaccttggcatgatcacagctcactgcagcctcaaactcctgggctcaagggatcctcctgcctcagcctcctaagtagatgggactgcagacatgtgtcaccatgccctgctattttttttttaaacgttttcgtagaaatgagggtctcactacgttgcctagtctggtccagaactcctggcctcaagtgatcctgttgctgtggcctctcaatgtgctgggattacagacagccatgaaccaccaggcctggccaactttcgataatgtggttagataattcaaacttaaagctgttggaactttaaattattccaagccttgagaggaatgttgctatgtagcctgagtcacgtagcatgcagttacaacttctgctttttcctgtaaatgattaagaatgaccaagcagtgccagagataagatcacctcagaacattactcctaggccgggtgttgtggcctcacatctgtaaccccagcactttgggaggcagaggtggatcacttgagcccaggagtttgagacaagcctgggcaacagagtgagaccatgtctctacagaaaaaattattgaaaaattagctgggcatggtggcacacgcctgtagtcccagctactggggaggcttaggcaggaggcttgagcctgggcgttcgaggctgcagtgagctgtgattgtgccactgcactccagcctgggtaacagagcaagatctgtttgttgttgttttgttttgtttttgagactttgtctcactcttgtcccccrggatggagtgcartggcacgatctcagatcactgcaacctccgcctcccaggttcaagtgattctcctgcctcagcctcccgagtacttgggattacaggcgcccgccgccatgcccagctaatttttgtatttttagtagacacgaggtttcatcatgttggccaggctggtcttgaacccctgacctcgtgatttgcccgcctcaacctcccaaagtgctgggattacaggcgtgagccaccgcgcccagccccagagcaagatcttatctcaagaaaaaagaaaggagaaagaaagaaagaaagagtactcctcctcctatcagaatgttaacgcaatcttccctgcagcatagcaagatgtactaatgaaactgttgtaacatatgtactggtcctgtagcctggaataaactctatagttaatcatattttcctttcttttcttttttttcttttttgagagtagaagtctggctctgtcgcccaggctgaagtgcggtggcgygatctcggctcactgcaactgctgcctcccaggttcaagtgatgctcctgcctcagcttcccaaatagctgacaccacaggcatgtgccaccacacccatctagttttggtattttttagtagagacagggtttcgctatatgktggccaggctggtctcgaactcctgacctcagggtatccactctccttggcctcccaaagtgctgggattacgggcatgaaccaccgaatccggcctcaatcatattttctgaatctcattatttatagttgacgataatttattttcttttatttaacatgtatacatgggagccttcagaatgaagacctcagccgggagcagtggctcatgcctgtaatctcagcactttgggaggccaaggtgggcagatcacctgaggtcaggagtttgagacctgcctggccaacatggcgaaaccccgtctctactaaaaatacaaaaatgaggcaggaggtgccagccaggttgtggagagccttgtcatgcatgataagactttggcttttaccctgagtgaaatggggaccactggacgggtctgagcagatgggacctgacttaggtgttcacagggttccagctgcatgtggggtgcaaactagaggggttggcaaaggggaccccagagacaaggtccctgtcatagtccaggtgatagatgaacttggacagatcaaggtgcagggcgacaaagaggtgagaagtgggatttagggtgtatttcaaaagtagaggcagtaagatttcctgatggacaaaatgggggcttgagaaaagagaatgcaaggctggtgccaccactaggggaccaggggccccaagagctgaaaggttagagctgtctacctcacccacacagcatccagaaataaataaataaataaatacattttccccagctccagcttaaaggacagaaagatcatttaaaagtgaaacctctgccaggtgcagaggctcactccagcctgggcaacagagcaagattctgtctcaaaaaaaaaaaaaaaaaaaaagtaaataaataaaataaaaaagaaaatacaaaaagtagctgggcccaggcgaggtggctcatgcctgtaatcccagcactttgggaggctgaggcagaaggatcacatgaggccaggagttcgagaccagcctgaccaacatggtggaactccatctctactaaaagcacaaacattagctagatatagtggtgggtgcctgcaatcccagctactaaggaggctgagrcagaagaattgcttgaacctgggaggcggaggttgtggtgagcagagatcatgccactgcactccagcctgggcgacagagggagactctgtcaaaaaaaaaaaaaaaaaaaaaacccggccggtcacggtggctaacgcctgtaatcccagcaytttgggaggctgaggcgggtggaccacctgaggtcaggagtttgagaccggtctggccaatatggtgaaaacccgtctctactaaaaatacaaaaattagctgggtgtggtggtgcacgcctgtagtcccagctactcgggaggctgaggcaggagaatctcttgaacccgggaggcagagattgcagtgagctgggatcgcaccactgcactccagcctggatgacagggggagacgccatctcaaaaagtaaaaaaccaaaattataacgagggtacaacatttcaataggataacatttatattaawcaattcaayggaatacttcactagttgatatatgcattattaatggggtctccctatattcgaacttctggcctcaagagctcttcccgcctcagccttccaaagggctgggattacagtyatgagccaccgcgcctagccaatggtagcttgtaaatactttgtatctattggcctggctgggtggctcacgcctgtaatcccggcagtttgggagggagaactgggaggatagctagagcccaggaggtcaagacaagactgggcaacatagcaacatagcaggactccatctcttaaaaaaaaaaaaaagaattagccagccgtggtggtgcatgtctgtgataccagctacatgggaggctgaggtaggaggatcccttgaacccaggagttaagaggctgcaatgagctgtgatcgagccaccgtactccagcctgggtgacagagtgagacccttttaaggagccttgatgggacctgatgactggcttgatgtgggaaatgatggcatctaggatggcatccagggacaacatctccatttcttgattgataaatcaatcaataggaaagaggattttctgcaaataagggaatcttagttcctcatttctcttcgctaccccaaccgctccttgctcagaatcaagcagtaacagtgaacttggtagtagctccgagaaggaagttggacttatccaacttccttccttccttgtccttgagaaacctaggggaactctaaaacggaagcagaacccactccccaacttctccactctctgaatgaggagtgatttttttgctttgttttccagttacaaggccggggatgtacacgaggtcctggaaggaattcccccttggtcctggttcaatctctgatttgtgatcccggaccacagagagctcttcggtggggtaggcgcagcacggagcagttagggatttgcttttttggtaaagaaggtatctgggagaaactgcactcaaacttcctcagccacactcaacatggcagcttcctagccacgcccaaaatggcggaaccctttgccgtagctggagagacgctattttcccaaaatggagcggaggaggaaaatgtccatcacagcttcaccccgccccccgcagacggctagcaccaattagtagcgcgcagagcgagtacaaagctaggggaggagcctgctgttgccccagcaacaaccacggaaaccaagacgagcgcggtcgcggaagtatcrcggcttacatatctcgcagccaggcgggtcctgggagaggcgcgagccaggcctggtcggcgcccgcggaraaaagaagcagtcaagcccatgaactacaaccccggttgccgctttctcctctcctaaccgttaagtgcgctaaggtaggaatgacgcatgcgctgcgcttagaggcggggttaagtcggacctgaactcataacgcatgcgccttatggagcttgctgggggagggaagcggggtggctgrcgtgacgcggaaggcgggtcttttgcgctcgtgggcggagccatagccccttcgggcggggctttccgccgacctgaacccgaaaaggttattttggacttcccagagttaaatgctggttccccagacaagggtccccccattttttccaggctttcatgggttggcaattaggatctgtggtcaagacctcagcctcaggggtgtgacgaagctagcttggaatcctagtactaccctttacttgctgggcctcagtttccccccytgtcaaatggagataatacasttacctcacagggttgtgattatatttttcccctcccagggccatggctgaggtgcacgtgatcgggcagatcatrggggccagcggtttctcggaaagtagcctcttctgcaagtggggcattcacacaggtattcccccaagcctggttcatttccacaccaagacccctagcctagaggctacatgctccttcctccaccccttaacgcagactcttaacctcatttccatcagttctcagtactccaggcccagcccacaccctgtccacatgagtctcaagctcccatctttgtgtgtgtgaggggtgggatacagacagggtctctctctgcgcccgggctggagtaaggtggtgtgatcatagctcagtgcagcctcgaactctcgggctctagtgatcctcccgcctcagcctcctgagaagctgggactacagacacgcaccaccaaatctggctaattttttttattttttgtagagacagggtctcgctatgttgcccaggctggtctcgaactcctgcgctcaaacaggccacccacttcagcctctcaaagtgctaggattaaaaacgtgagccgccacgtcccaggaaagtaattttgttcatgcttccccaactgaggccctatagagtcatggtatagtgtaatggttagggtcatgggctgccagatctgcatttaaatattaactcccccacctattaattggagacctttggactcgaccactttgagcctcagtttccttgtttcaaagtgaagctaatagtagctaagaagcagcacaggtttgaggttaagagcacagactgcctgggttcaaaaccagttattgcttgttaaggcacccttgggctgattatgtgaacttgggcacttctcttcacctcgacttccttgtttgtacaatgagagtcatagaaatatttacctgttgaagttgtcatgagtactaaacgagtatcaacagcacttagaataggaatagggctggaataggaagtgctcattcagtgtttgcctggcttatacaagactttgatggggtcttgtttgtaaagcctggggtatgttgttgcgtggcacagatgaatgtctatgaaacagatgtggccatttggcattatcatgtcttcaggcctgagtcctagtccctttttttttttttttttttttttttgagactcgttctgtttcccaggctgtagtgcagtggtgcaatctagctcagccttccaggttcatgccattctcctgcctcagcctcctgcatagctgggactacaggcgctcgccaccatgcccggctattttttttttttttgtatttttagtagagatggggtttcactgtgttagccaggatggtctcgatctcctgaccttgtgatctgcccatctcggcctcccaaagtgctgggattacaggcgtgagccactgcgcctggcccttttttttttttttttttttttgagacagagtctcactctgtagccaagctagagtgcagtggcacgatctcggctcactgcaatctctgcctcctgggttcaagcgattctcctatgtcagcctcccgagtggctgggactacaggcacccgctaccatacccagctaatttttgtatttttagtagagatggggtttcaccatgtcggccaggctggtctcgaactcctggccttaagtgatccgcctgcgtaggccttccaaagtgctgggattacaggtgtgagccactgcgcctggcccctgggtcctttttgattctacaggtaagtgaggtggaagttgaaattcccaggaaatcggaaccctccagctgatggatgaggggcaggctctggagtcagacttggtttccaggttggaccactcaccttctctgtgaccctgggcagaggctgtcccctcttggagcctcagtttcctcatttgttcttcatagggctgttgggaaatcttgcttttaaggagcctgacgcagggcctggtgcttccctcaactcagcccagaagggagtaatgactaacctgatttttattatttcagggagttgctggggatgttgatccagccaagaatactgaggcagttggatgaaaggcttgggctctgcagttagagctgagtctgaatccagtcccatgatgggaccttggtctgctatagtcactgctatgtcaccagcatggaaaacagtgcttggcacatagcaggtgctgaataaatgttcatgaactcaccttctcagagcctgtttctttacctgttaaatggggattatattagctcccacctcctaggatcacttatttgtccaagaaacatttattgagcaccttctgtataccaagagctgggtttgtggtcttggggatccagcagtgtgcaaggtccctgttttcctgggccatacagtaggggagacagaaaataaataagcaggccaggcgcggtggctcatgcctgtaatcccagcactttgggagtccgaggcgggcagatcacctgaggtcaggagtttgagaccagcctggctaacatggtaaaaccccatttctactaaaaatacaaaaaaaattagctgggcatggcggcgtgtgcctgtaatcccagctactcgagaggctgaggcaggagaatcgcttgaacccaggaggcggaggttgcagtgagccgagatggtgccattgcactccagcttgggcaacaagagcaaaagtctgtctcaaaaaaaaataaataaaataaaataaataaacagataaacgagtgcagttgggtgtggtgactcacccctgtaatgccagcactttgggagactggagcaggaggatcacttgagcccaggagtttgagaccagcctgggcaacatagtgagacmcccgtctctacaaataaataaaaaattagcaaagcatagtgctgtgtgcctgtcgtcccaactacttgggaggttgaggtgggaggattgcttgatcctgggaggtcaaggttgtagtgagctgtgattgtgccactgcactccagcctgggtgacagagggagatcttgtctccccccacccccccaaaaaaagaaaggagcaccgtgattccagacagtggtaagtgctaggatgaaaagaaatgatgtggcagggactagtgtttggtgaagagggtcagggagaacccctctgtggaagtggcacttgagctgggccctgaaggatgaaaacaaaagctagggatggggacacccaggagcagagctttctaggcagagggaacagccagtgcaaaggccctgaggtggggagtcagaagtgggacagtgaggccagagggtgatgagggagggggagagtgatgggagatgaactcagggaggggagcaagagccaggccacgtgggccatggtggagggtctgtaaactggggggtgaggaggggattaagagtcctagagggtggattaaatgaatggatgcttaaagtacttagcatagcatctgggatttagttagtactyggtgcattttctttttttcttttctttttttttttagatggaatttcgctcttgttgcccaggctggagtgcaatgggaccatcttggctcactgcaacctccgcctcctgggttcaagtgattctcctgcctcagcctcctgagtagctgggactatgggcgtgcgccaccacacccagctaatttttgtatttttttagtagagatagggtttcagaatgttggccaggatggtctcgatctcttgaccttgtgatctgcctgccttagtctcccaaagtgctgggattacagacgtggctaattttgtgggtgtgtgtgtgtgtgtttttagtagagacagagtttyaccattttggccaggctggtctcgaacccctgacctcaagtgatccacctgccttggcttcccaaagtgctaggattacagatgtgagccactgcgcccatcctaatttttgtatttttagtagagatgggatttcgccatgttggccgggctggtctcaaactcctgacctcaggtgatcagcccgcctcagcctcccaaagtgctgagattacaggcgtgagtcactgcgcctggcttgtttgttcattttttgagatggagtctcactgtgtcacaccagctggagtgcagtggtgcaatctcggctcactgcagcttytccagcgattctcgtgcctcagcctcccgagtacctgggattacaggcacctgccaccactccagactaatttttgtatttttagtagagacgaggttttgccatgttggccaggctggtcttgaactcctgaccttagatgatccacccccccctaagcctcctaaagtgctgggattagaggtgtgagccactgcgctcagccttaatttttatattatttgtagagatggggttttgccatgttggtcaggctggtcttgaactcctggactcaagggatctacctgccttggcctcccaaagtgctgagattacaggtgtgagccactgtatcctaccactcagtgcattttagctatcattatcacccctcagtaggatcgaaattgttatgtgtgtttcaggatgcgctcctggagggtacccttggccccatcttaatccttggactaggcttgwaaatatggggtgagaatcgtaataaaatgatattgaagacttatcccgtgctcactatgctcattacccattcatggattaatgggttaatggattagtgggttatcatgggagaggaagtggtggctttataaaatgagagagagagacgtgagtggcatgttagcacactagccttgggactctctgaagagttccagcaagaaggctcttactagatggggctcctccaccttggtcagtctcctataactgtgagatagaaattccttttctttataaattatccagttttggatattatgttaagagtaacagaaaacaaatgaagacaatgaggaatgcattattactcagctcattttatagatggggagaccaaggcagagaaagctaacttgcccaaggttgcagaggcaggaagaggtagtgccaggatttgaacccagatacttggttccagagtccatgcttcgtaacccctaccagtagatgccacagagaaacagtcctayagccacagcggcatccccttcccratggctgcctcccacccctctatgtcccggctctcactgcaggggcggcatggaagctcctgtcaggcgtgcgggagggccaaacgcaagtggacaccccgcagataggggacatggcttactggtcccaccccatcgacctgcacttygccaccaaaggtcttcaaggtgggtatcacacctggacccgggkccaggctgaggggagggggccagtagcctctgaggtccctggggctgggaacaccaagacctgtccctgctccccataccacgtaggtcccttttgcagccaagtctggccctggagaggctgagctaaggccttcccaggcctgctcaataggcgatcccaagtttgtatgattagggcagaggccagggtggagcaggaggtgggaaggtggggggtcagggtgggaggggaggtggcattcaagtaaagagacaaaacgagagtctccaataaagaggaagccgggaggcagggtctgagagaggcaagggctgtttctccaggaagggctcctcggcttgaaagtagagctgctgctcaaaggggaaatcagtactgggggaggagcggcatcagaaagcctttctagtagaaaatgtgggttcctggagatgagttgattctgagaaattgcctaggtaaatgtgccatatatttcaccaatataaagaacgtctacctggtacctgccctgtgtccagcctgtgttgggtgatgccagggagacattgaggatcaaggcagtgtcccttagccttgtcctcacagggttcaccgtcctatggggggacacacctctctccagacagtggcacctcagagtgggcaggactaagataggtgatttggagaggctgtgggagcccagaggaagtggctgactctgtcagggaggtcagagagggcttcctggaggagggggcttctgaactttgctgtgaagggccagcggagctaataaggcagagggatagaagaaggttctaggcagagggagctacgtggaagactcaaaggggaaagtgagccaagggcatctagtggattgagggagagcgggacggcagaggggaaaggcagaaggggacaggccatgcagggccttgagtgccaggctgaggagctgaggccatctcctgaaggcacttgggagccagagcaggtaatggacaagtgagatttcaccttttttttttggagacagagtttcactctgttgcccaggctggagtgtagtggcaagatctcagctcactgcaacctctgcctcccaggttcaagcaattctcctgcctcagcctcacgagtagctgggactacagccacgtgccaccacatctggctaatttttgccttttttttttttaatagagatggcgtttcaccaaggtggtcaggctggtctcgaactcctgacctcaggtgatccacctgcctcggcctcccaaagtgctgggattacaggcatgagccaccgcgcctggctgagrtttcacttttaaataatctttctgtcttttaagctggagctggggaaaaaaaaaatctttccggtgctgtgtgggtgaggtgggcagctctaacctttcagctcttggggcctccagtcccccagtggtggcaccagccttgctttctcttttctcaagcccccattttgtccatcaggaaatcttaaactgcctctacttttgaaatayatcctaaatcccacttcttacccttttctcgcccagcaccttgatctgtccaagttcttctctcacatggactatgacaagaatcttgtctctggagtccccttccccaacccccctggtctgcaccccacatgcagctgggaccctgtgaacacctaagtcaggtcccatctctgctctgctcagaaccctccaatggtccccatctcactcagggtgaaagccatagtcttagcatgcatcacaaggctctccacaaccaggctggcacctccttcccgtctccccacctcattctgctctagccatgctgtccccaccaggcacactccgtctgggctccagccatactgtccccaccagacagtccccccccagggccttggcacttgctrttccctctggctaggagcactcttcctctagatggccacatggcctactcccttccttccttttagcatttgctcaaatgtcaccttcttaatgaagcttccttgatccycttcttgctaaagcggtatccccaccctcaccctacccagctctgttttccctcacagcaattaccaccatctratctaccctataatttgcttatttactacattcgttgtctaggatatcagcttcacgggggcaggaatttttgtctgccatccatgttcatgtctgccgtgtccccagctagctagaacagagtctagcacaggagaagggatcagcatgagatgagatggggctggatctccaagggctttgactaccagactgaggagctgaactgtgttctgaggacatgggcaaagctatggaaggagagaaagatgcttccagatgccaggtggaaggtggattagagaggggcaagaaagaaggccctgggcccaaagrgagcagggcagggacatgaggagggaaggcaggaggtgtccctgacaaggcccatgatggttacctggggactggaggagcaatgggctgccctgacatggggtcatggaggaggataacacagagaggaaattcagcagaggtctgattagaagggccttgaatgttgaagaggttggactttatactgagggcactggggagctatggaaggatccttagcaggggagtaacatggatttggaaagatcactttggctgctgtgtggggatagataagacggtgggagcctagaaaggaggctgggttggaaactctgggacagaaacccagagaggaaaagactgggcctggggtctccagtgagtatcagggagtggggaatcagcaggagtctggtccccacccatccctcctttcccctctstctcctttcctgcaggctggccccggctccatttccaggtgtggtcccaggacagctttggccgctgccagcttgcaggctatggattttgccatgtgcccagtagcccgggcacccaccagctggcctgccccacgtggcggcccctgggcagttggmgagaacagttggcacrggctttcgtgggtggtgggccgcagctgctgcatggggacaccatctacagtggggccgaccgctatcgcctgcacacagctgctggtggcaccgtgcacctggagatcggcctgctgctccgcaacttcgaccgctacggcgtggagtgctgagggactctgcctccaacrtcaccaccatccacaccccggacacccagtgatgggggaggatggcacagtggtcaagagcacagactytagagactgtcagagctgaccccagctaaggcatggcaccgcttctgtcctttctaggacctcggggtccctctgggcccagtttccctatctgtaaattggggacagtaaatgtatggggtcgcagggtgttgagtgacaggaggctgcttagccacatgggaggtgctcagtaaaggagagcaattcttacaggtgtctgcctcctgacccttccatcyytcaggtgtcctgttgccccctcctcccactgacaccctccggaggcccccatgttgacaraccctcttctcctaccttgtttcccagcctgactctccttccgttctgggtccccctcctctggtcggctcccctgtgtctcatcccccggattaagccttctccgcctggtcctctttctctggtgacccacaccgcccgcaaagccacagcgcatctggatcacccgctttggtggcgcttggccgccaggaggcagcaccctgtttgcggggcggagccggggtgcccgccccctttcccccagggctgaagggacccccctcggagcccgcccacgcgagatgaggacggtggcccagcccccccatgccctccccctgggggccgcccccgctcccgccccgtgcgcttcctgggtggggccgggggcggcttcaaaaccccctgccgacccagccggtccccgccgccgccgcccttcgcgccmtgggccatctccctcccacctccywccgcsgagcagccagacagcgagggccccggccgggggcaggggggacgccccgtccggggcacccccccggctctgagccgcccgcggggccggcctcggcccggagcggaggaaggagtcgccgaggagcagcctgaggccccagagtctgagacgagccgccgccgcccccgccactgcggggaggagggggaggaggagcgggaggagggacgagctggtcgggagaagaggaaaaaaacttttgagacttttccgttgccgctgggagccggaggcgcggggacctcttggcgcgacgctgccccgcgaggaggcaggacttggggaccccagaccgcctccctttgccgccggggacgcttgctccctccctgccccctacacggcgtccctcaggcgcccccattccggaccagccctcgggagtcgccgacccggcytcccgcaaagacttttccccagacctcgggcgcaccccctgcacgccgccttcatccccggcctgtctcctgagcccccgcgcatcctagaccctttctcctccaggagamggatctctctccgacctgccacagatmccctattcaagaccacccaccttctggtaccagatcgcgcccatctaggttatttccgtgggatactgagacacccccggtccaagcctcccctccaccactgcgcycttctccctgaggacctcagctttccctcgaggccctcctaccttttgccgggagacccccagcccctgcaggggcggggcctccccaccacaccagccctgttcgcgctctcggcagtgccgggggrcgccgcctcccccatgccgccctccgggctgcggctgctgcygctgctgctaccgctgctgtggctactggtgctgacgcctggcssgccggccgcgggactatccacctgcaagactatcgacatggagctggtgaagcggaagcgcatcgrggccatccgcggccagatcctgtccaagctgcggctcgccagccccccgagccagggggaggtgccgcccggcccgctgcccgaggccgtgctcgccctgyacaacagcacccgcgaccgggtggccggggagagtgcagaaccggagcccgagcctgaggccgactactacgccaaggaggtcacccgcgtgctaatggtggaaacccacaacggtgarctcggaggggcaggggagccgggaggggggcccccagggggcgccggagtgccggggccacgggtaggaagtgactggcagaagaaactggctggaggaagaggacaccccggggcaaagggaacgtgtgatggtgggaggggggtgtccgaaagaggatggcactgagccccctaccacccaggtgtctggtcttggagaggaggagatagcgaagtggaccgcttctagagtgcgacagaaacatgcggggtcgtgggggcagtcccctagagggagacaagmratagggggagggtagaaggctccctcttccmggacgcgttgaatggggggggggtcgtggggtgccaggtgcagagaagggagcctggtgtgggagaagcgaagaccccagcatttgggaaaggagaggcgctggagaaagttgacccagagcttgggggtcctgaggtggaaagattcaagaaggacagaaaagctagatgaaggcaaccccagagggtgccaggaaagtgagagcggacccacttccagaggctgccaggaacacgcgggatgcgggggtgggggagagtcgtagaaagagaaacagaggtgcgtgtgataaatgtggggagaaagggacgggaggttattggaaggaggaggcaagcgggagaggagcggagactcgggagggcgcccgggatgcagaggtgtcctcggtgtttcacacagggacgtgagggacagagtggggagmccagcggaggaatcgagcttccagaagacctagagtcctgggtcatgggaagggctttaccgagaggggagacaggcgtgggaaaggtggtgtgagcggggaggaggagagatacccagcgccatccacgctgcgagcagcgagcccccccattccccgcaggatgcaggggaatgggctgagcggagtccagccgcaggggaagtgctgggtggggggtgactctacaagaccgaggtgagaaaaccaagctgggaggagtgagaaagccccacgtgggtgccacgcgcggggggaggagcctgcgcttccaccaaggggcaggaggaccccgctgcgctaaacgctggcagtctggaccccaaagtcccagttcctctcagggtggctggggaaaccccagcgtccggcggcctcatccycctcccttccctttccttcccatgcccccggcggrggcggggatcgctcgcggagcccggggcgagacggggcaggtctggtccccgccctcctggctgcggcgcctcccgccctcctcaccccagctacgggcggggctcccactcagccggccccgtcggcatccatgcgaggacccaggcgtcccgcgtggttcagagccttggggaagatccctcaggtttcactgactcttgggcggtgtgggcttgcgggttccctgcccatttctgcgccagtttacagctccagcccaatgacgcgcactccgcacccaagtctcagccttaccttatcttccgtggcttcaccttcgttgtagaggttcctttaacactgacacctccaatcctcttctccccaacaaatgcacatgtgtctcgtctcgcacgtgtctccccatctgcctctttcttttcgtctccgttagtctttctgtccacgcatgggtctcctggtttttgtctctccgactattttctctccctttctatttttctcctccacggtcckgttgcctcgtctccgtctctgacatctccccgcctctccctctctgcatcaccctccaacccttcctctccctcctctctgtcttcctccctatctgtcttccccagccaaggctctgcctttcctttggggtttgctgagtaacctccgggccaagaatagggcttactggggctgggtggggagggagactggggaggaggaggaggatcgaagggggccgtaggggaggggtttcctctgcctttctcaccagtctcttttcacacccccactatgggaggctggaagcagttgccccagttgatccagcagttcatggcctgttccctcatccccatccccaaacttttcctaaactagaaaataccttggctgggcgcggtggctcacgcctgtaatcccagcactttgggaggccaaggtgggtggaccacctgaggtcaggagttggagaccagcctggccaacatggtgaaacccggtctctactaaaaatacaaaaattagctgggcggggtggcgggcggcgcctgtaatcccagctacttgggaggctgaggcaggagaatcgcttgaacctgggaggcagaggttgctatgagccaagatcgcgccactgcactccagcctgggcgacagaaactccatctcaaaaaaaaaaaaaaaaaagaaaagaaaacaccttaattccttttctccccactacagccattcctacccagaatgaacttcactttccctaaccagctggggaagggagttaagggtggaaaactaataataaaaataagtagaagaatcacttaggggttaagagcacagtctctagctgggtgggtgtggtggctcatgcctgtgatctcaacatattgggaggctgaggcgtgaggatcccttgagcccaggagttccagcctgccgtgagccatggttgtgctactgcacttccgtctgggggacagagtgagaccctgtctcttgggggaagaaaaaaaaaaagcacagtctctggaatgagacagcttgagtttgaatcccagtctgcagctatgtgaccttggggcaaattacttaatctcggtgcctcagtttctcatctattaaacgggtataataatagtataaggttgtgaggtttaaatgtcttcatctttgtaaagtgctttagatagcatctggtaaatagcgctgttttgtggttttttgttgttgttgtttttgagacagagtcttactctgtcaccmaggctggagtgcagtggcgcaatctcggcacactataacctctgcctctcaggttcaagcgattctcatgcctcaacctcccaagtagctgggattagagccgtccggcaccatgcctggcyaatttttgtatttttagtagaaacggggtttcaccatgttggccaggctggtctcgaactcccgacctcaagtaatcaatccacctcggcctcccaaagtgctgggattacaggcgtgagccactgcgcccagccagcactcttagacgtatacatgattgagtgaccagtgtatgcagaattggtgccacatggcttgacctgggtcatctaatttcccactataatactggaatgggttctagagtcactctgtcttgtcttacacctggctcagagagaggaattcacttgcccaaggttacacagcrcttaaattaggagagtctgtgtgggaatgcagggagcttaatgttattgctgtttttcaaagaataacaggaaactgacattcagaaagagggtgttaactgcccatggtcacacagccaagaggcagcagaggcactatctgagtccaaagcctgtgcctttgatccttactctgcattttaggggctcttgcatttggggcaaggaaggccagagcaaacagagtggttccccttggtgccagccttagtcgacttgagagatgatgctacatgagagaggaatgyggttaggacctattttacagaggaggaaacaaacctagggggagaaaccacttcctcaaggtcacacagctaaaaagtatcacagtcagggctgggcgtggtggctcacacctgtaatcccagcactttgggaggccgaggcrggtggatcacgaggtcaggagatcgagaccatcctggccaacatggtgaaaccccatctctactaaaaatacaaaaattagctgggcatggtggcatghgcctttagtcccagctgctcgggaggctgaggcaggagaattgcttgaaccctggaggcggaggttgcagtgagcagagattgcgccactgcactccaagcctgggtgacagagcgagtctccgtctcaaaaaaaaaaawaaattcatttaaataaataaataaataaataaataaataaataaataaataaaaggtatcagagactgactccaccccagagctgtcagctccaaaactcctagagttgggagcaccagctcccctcacctctgccaaacccctgatcgcctcccttcatttctccctgctagaaatctatgacaagttcaagcag

SEQ ID NO: 13470 - DNA, 19143 bp, Homo sapiens
ttaattatgtcagaagactatttactaaatgtggaaaaatcaataacactctaagaagaatgtttacccagcctaggatccaaacaaacactctaaagccagggaagtttttgaaaaatacaagctccgtgtctccagcaaacataagggaggttttactccttttcatttttgccttggcagggatgggccctgggggtgtgggctctgtctctgctcattgcaatcagattgacatgactgttgtccactgatgtcggccacgtgtcagcccctgcaggaagcacttaccactaggacctcttttaatttaatcccactgacaggacagcggcatcatgactcttatcctccctgttttgtaaactaagaaaccaaggccccaagaagtgaaagtgttggtcccaatcccaaagccagcaactggctgaggccccagttccagttgcgggagtagagtcagggtggtctcaggccaccgtgtcctggtgtgataggaattcactgttcctgccaggtgcttttctgagcttcttttaggtatgcactctcttagccctcacaaagccctgtgagagtcggagacagctgagggtgtggagtcacagatagctgtaccatataacagtggacagagtggctcagacgtgaccttagtcacacagctgtaagtcacagagtgggattgtaacccagtgcagacaggttccagcctttctctctctctttttttttttttttgagacagggcctggctccatcttccaggctggagtgcagtggcttgatcactacaacctctgccttcctggttcaagcaatcctcctcccacctcagtcctccgagtagctaggactacaggcacacaccaccacactccactcatcttttctctttttttttaagtagagatgaggtctcgaactcctgggctcaagtgatccactcactttggcctcccaaattgttgggattataggcaagagccactgcccccagcctctatccctctcaatgcaggacagatggtcaatcgatgagcctcccccaagggcagacgggtgtcctcgagtggggttgcctgcagcaatcctggcatctttgtgcccagggtgaacyttgtagcacccctcacctctgtacaacacaatractttcagaaatcatcatgtcataatcaatattagtgattttcctagttttttaagttttaaagcaaacrattaataaaggacaaatttcaattttacaaaaatgttattcaaattctgttaagcgcctcatgtatgaactaaaatctgtactgacaaacaaaaatatcaggtctcacagttttcactctgtttctgttttaaactttgaacacaaaatccctaagtggtcccatagaatgacaggtcacagtgactccagttctgtttcatttcctccaccatttctgtgccactgttgctcattgtgagtctaccatataccatgttatgccaggaaatacgcagtgtgctttgtttccctttttaatttaatttttagttacaaaaaaaaaaaaaaaggaaaaagacaggcyggatgcctgaatgatccacaaaccaattagtctgctcccaaataactgagattaaactcgccccatatttgagatcagaacattccattccagcatcgtgcaaagtaaatttttaaggcaatttaaaaagaaagctcagagtactcataaagactgcagaatacacacaaatggtgaggagccttttgctcagggtacatgccatgctgttaggctcgccatggttctagaacacctaacgtggcttccgtccaaagatctgccgagaaaaactttttccatctccttctgctgattcctgctgtttaagtatcggtccttggagaggtctggtataatctgctctctaaataaaatgggatgaaacaccatccatggggaatttagtatgtgaggtgcagaattccctcaaagtttgcattcagactatcttaaattctttgtaaaactccaccaaatccctcccaggaaaagcaagctcttcatcctcccctgaggtcgaagcaccatgccctcagcctctacgaatcccctgaacagcctytaaggagcgtcccctataggtgggagcggacacagaagggcggggctggagctagagaacctagctgtaagtgtcccaggtgaattaacccacctgagcccagcagggatcagccaaagggtgaagggacacagtggaagtcagatgtgggggacaaggaataggaaactaccctgtgtcttggcagtcagcgggtcaatttgggatgaaattgggtgtgtgcagtttagacagaggtttgcttacatgtgcagtatgtcgagggctcagcaatggtctcagtgtccactctcttcccaacttgctttctccctaattccagaggggagagttaagcatgatttcacttttattaatgttagagcaagaaagtttccagaggccctgttcccacctctgcatttatagatgagaagtggggctgagttaaccaagttactgaaaataataaagtaaaatccaaggacccccagggcaaggcagtttctgcattttacatagtctttctcactgttggtgctttacaaatacttccaaggttaatggataaaaaacagagtatatgtcttgctagttcattttcttctttaagatgtcatcacttggctaagtgaacagtaattggtttgaaagttcccacatggaagatgaataacttacagctaaagaagatatcttgacaaagatctgggggtcagagtggctaacatgctgaaagtcactcatttagcccatatccttaagcaccaactaagtagaatgctgagcgaatgctgcakatcacaatctacctctgaggaatctacctccgagctgcacaaacaggggcctagaccacgagaacggctccctgctatgagtggatgctagggctgcagaattgattttacagaatgttaagaagttacctgcttgtaaataaacccttagaaatgaagcttctcccaagcagagaacaagactgacccttgccaaactcaaatgcatggccagctatattgactgggagccagggacaccagccttccctggacccctcacagctggctgcttacccagctctggtggcacacttagcgtcccgaggaggcaggtcacaaggacagggggtctgggagaccctgagccccaagaggcaatcccctgtgttctcagaaccaggtacctccagcggacacagccttccaggaccccagctcccggcaggagccatgcagtccttctgcgtgcccggtgcccttccccccacctccacccagccccgaraacatctgacctggactccacagcctggaaacctgcggccacctgctgagggcccccccacccactgcttgggtccactgaccagtccccttccacatgtaggcctcatgccagccctcagtgtttccccgtggatttcaagacgaagcctcaagccttcattactggggttcacagggctccatcttcccctgcatcctccctcccactgcctgggctttggtctccctgcccttcactcactctctgtccccagggcttctgtacatgctgttcccccatcccgacaccattccacatctgagctgcttctcctttagattccggcttgactgcctgtcttctccagaggagtctctcctaattgcccatcccccagtcaggatgccacccctgtatcaaccacgacctccccgctcccctgtgctgcctgcaataaagccatcagtgccgtgacttgttcaaagttgtccactctaacaggactccaggatcacagaggcagggatcccctcctggaatccagtgcctcactcagtgcatagcagggtcttaatcaacaawtgttagatgggtggatggacaaacagatggatgaatgaaggggcacagggagggtctggtggcttctatggagagttcccaaaatgtctcaaatatctttgctaaaatgcaaggacttaaggcacattcttaggaggtatccagctggagtcagagatgcctccttgtcccttggggagccagcgagctcctagcccccgggacaactcaacatctccatggaggccactgtggtggtcgctggtgccgggtccacaggcgttcactgtgttctccaccgtggcgcttcttcccctggggccctcacggtcagtgcagagcaccaaagagttgccgctgtgtagagaattcttataattgtgcattgcatccattttgaatctaatttggaccctctcctaccagaagcagggtttattgctcttgacacggtgtctagggctccaccccctcccagttcctcaatgcggccaacccagatatctgccttgtacacccacctcctggtgaccatttccctgtgggacaggcagatacagcccatttgatggtctcagtgactccacaccccacagggacttcccagacatgcygccatgcccacctctcagccacagggaccccacggagcccgtgtctgtttgctctaaacccaccagtgagaagtccccttgggaaacctgcttgggaaacgtcctggaccccaataaaggcttaggacccaggtctctctctctcccttcacccccctccaggtgagtgtttgtgacccagacagctccccactttttgctggccccgtggggtgcactgccctctccctgggatctgtaagtgacacggtgcttgtgttgyttcctgtgtcttcttgtgctgcctcctgcatctcccctgacccacaccccaacccaactctcctcccatcagggatctcttasgaagtggctgtcttgataggaataaactggacatgggtcagacgagagccacaagggtgtctgtccatagaaacaagttttatgtgagagagacccctggtcactgggcagggmtagaatttatagtcagtctctcaaagtgagagatacagcctgctaccaatgacaggggacttggagagcagtggagcctctccctcagctgagatggtgytgaggtgtggtcccctcaggcccccagagtttcctggcactggctccagcagcccagggtcaccttctcagcaagtcatcatgggttggcttcctccttgtctgtttcacttcccctcccacataaactagtctccccaaatcctgtctcagggtcccctcctgggggatcccaaccaatgagcaaargtctgtggctgcargaaaagcacactgtgagtccctggcttttgccgagtckcggtgtcgcrggagggcctgcccgggcttcgattcccgctccctgcccagatttccggcccttgctaggaatcctgagccgggggaagtgagcctgcaagccctgcgccacgaggccggacacattttcattttctttctgatgctttttgtgaccctgacacctcacaatgcaatatttccactatgaaacccccagaactgccaaatttcacccaatttggattaacattatcgaggagcttggcattatgttgaaaacccagacattcccacgacccgtatcctatttaaaaaatgcctgtctatttaaggttcacgatgggaggataaaagaaaaaaggctcccaaagtcaacagagaacatgagctaggcaaaargaaagtccagtttgcttctaaaaaaggctgaaaattataaccatccatggccttgtgtcttaagtctcagaattttttttttctcttttggtggtttgcaaaccaaagtggaattttattatgggttactaagggagcttcctcgagttcctagcccccaaagcccctgctcactccatggcatgcctccgaggctcctcatgccatgagaaagagaatggagccaaaatcaagccggcagtatctcggggctgtaacgtcttccccccgtcgctgtttccacagtgctgagccagggacccggcagagctgcctgactccttttatgaacaacagcaccgtgatgaaggcagcaggagtcagagaactattcattgcaggaagccccaacatccggtgagaaataagaagtacaacagtacaggatgcgccttgggtcaggggracgtggaaagccctcagcctttgtgtccttctctgcgccggagtggctgcagctcacccctcagctccccttggggcccagctgggagccgagatagaagctcctgtcgccgctgggcttctcgcctcccrcagagggccacacagagaccgggatggccacctccatgggcctgctgctgctgctgctgctgctcctgacccagcccggggcggggacgggagctgacacggaggcggtggtctgcgtggggaccgcctgctacacggcccactcgggcaagctgagcgctgccgaggcccagaaccactgcaaccagaacgggggcaacctggccactgtgaagagcaaggaggaggcccagcacgtccagcgagtactggcccagctcctgaggcgggaggcagccctgacggcgaggatgagcaagttctggattgggctccagcgagagaagggcaagtgcctggaccctagtctgccgctgaagggcttcagctgggtgggcgggggggaggacacgccttactctaactggcacaaggagctccggaactcgtgcatctccaagcgctgtgtgtctctgctgctggacctgtcccakccgctccttcccakccgcctccccaagtggtctgagggcccstgtgggagcccakgctcccccggaagtaacattgagggcttcgtgtgcaagttcagcttcaaaggcatgtgccggcctctggccctggggggcccaggtcaggtgacctacaccacccccttccagaccaccagttcctccttggaggctgtgccctttgcctmtgcggccaatgtagcctgtggggaaggtgacaaggacgagactcagagtcattatttcctgtgcaaggagaaggcccccgatgtgttcgactggggcagctcgggccccctctgtgtcagccccaagtatggctgcaacttcaacaatgggggctgccaccaggactgctttgaagggggggatggctccttcctctgcggytgccgaccaggattccggctgctggatgacctggtgacctgtgcctctcgaaacccttgcagctccagcccatgtcgtgggggggccacgtgygtcctgggaccccatgggaaaaactacacgtgccgctgcccccaagggtaccagctggactcgagtcagctggactgtgtggacgtggatgaatgccaggactccccctgtgcccaggagtgtgtcaacacccctgggggcttccgctgcgaatgctgggttggctatgagccgggcggtcctggagagggggcctgtcaggatgtggatgagtgtgctctgggtcgctcgccttgcgcccagggctgcaccaacacagatggctcatttcactgctcctgtgaggagggctacgtcctggccggggaggacgggactcagtgccaggacgtggatgagtgtgtgggcccggggggccccctctgcgacagcttgtgcttcaacacacaagggtccttccactgtggctgcctgccaggctgggtgctggccccaaatggggtctcttgcaccatggggcctgtgtctctgggaccaccatctgggccccccgatgaggaggacaaaggagagaaagaagggagcaccgtgccccgygctgcaacagccagtcccacaaggggccccgagggcacccccaaggctacacccaccacaagtagaccttcgctgtcatctgacgcccccatcacatctgccccactcaagatgctggcccccagtgggtccycaggcgtctggagggagcccagcatccatcacgccacagctgcctctggcccccaggagcctgcaggtggggactcctccgtggccrcacaaaacaacratggcactgacgggcaaaagctgcttttattctacatcctaggcaccgtggtggccatcctactcctgctggccctggctctggggctactggtctatcgcaagcggagagcgaagagggaggagaagaaggagaagaagccccagaatgcggcagacagttactcctgggttccagagcgagctgagagcagggccatggagaaccagtacaggtaaagggggccctgagtgaccgggggaggggatgggcaggcatgggggcactgactacagtacaaagaggtggcagcaagagcargcccaggtttcctgtgggcagacacaccctggtccttgcagctgacccctcaacctccccccacgccaggcactcgggcccccttagagcatactgcccatctgcagcacggccgcacgtggggctctctcccaaggtggggacgtgcaggcacagaggcgccatggcttccaacgctgtctgttttgtttcccatagtccgacacctgggacagactgctgaaagtgaggkggccctagagacactagagwcaccagccaccatcctcagagctttgaactccccattccaaaggggcacccacatttttttgaaagactggactggaatcttagcaaacaattgtaagtctcctccttaaaggccccttggaacatgcaggtattttctacgggtgtttgatgttcctgaagtggaagctgtgtgttggcgtgccacggtggggatttcgtgactctataatgattgttactccccctcccttttcaaattccaatgtgaccaattccggatcagggtgtgasgaggcyggggctaaggggctcccctgaatatcttctctgctcacttccaccatctaagaggaaaaggtgagttgctcatgctsattaggattgaaatgatttgtttctcttcctaggatgaaaactaaatcaattaattattcaattaggtaagaagatctggttttttggtcaaagggaacatgttcggactggaaacatttctttacatttgcattcctccatttcgccagcacaagtcttgctaaatgtgatactgttgacatcctccagaatggccagaagtgcaattaacctcttaggtggcaaggaggcaggaagtgcctctttagttcttacatttctaatagccttgggtttatttgcaaaggaagcttgaaaaatatgagaaaagttgcttgaagtgcattacaggtgtttgtgaagtcacataatctacggggctagggcgagagaggccagggatttgttcacagatacttgaattaattcatccaaatgtactgaggttaccacacacttgactacggatgtgatcaacactaacaaggaaacaaattcaaggacaacctgtctttgagccagggcaggcytcagacaccctgcytgtggccccgcctccacttcatcctgcccggaatgccagtgctccgagctcagacagaggaagccctgcagaaagttccatcaggctgtttcytaaaggatgtgtgaacgggagatgatgcactgtgttttgaaagttgtcattttaaagcattttagcacagttcatagtccacagttgatgcagcatcytgagattttaaatcctgaagtgtgggtggcgcacacaccaagtagggagctagtcargcagtttgcttaargaacttttgttctctgtctcttttccttaaaattgggggtaaggagggaaggaagagggaaagagatgactaactaaaatcatttttacagcaaaaactgctcaaagccatttaaattatatcctcattttaaaagttacatttgcaaatatttctccctatgataatgtagtcgatagtgtgcactctttctctctctctctctctcwcacacacacacacacacacacacacacasagacacggcaccattctgcctggggcactggaacacattcctgggggtcaccgatggtcagagtcactagaagttacctgagtatctctgggaggcctcatgtctcctgtgggctttttaccaccactgtgcaggagaacagacagaggaaatgtgtctccctccaaggccccaaagcctcagagaargggtgtttctggttttgccttagcaatgcatcggtctctgaggtgacactctggagyggttgaagggccacaaggtgcagggttaatactsttgccagttttgaaatatagatgctatggttcagattgtttttaatagaaaactaaaggggcaggggaagtgaaaggaaagatggaggttttgtgcggctcgatggggcatttggaacttctttttaaagtcatctcatggtctccagttttcagttggaactctggtgtttaacacttaagggagacaaaggctgtgtccatttggcaaaacttccttggccacgagactctaggtgatgtgtgaagctgggcagtctgtggtgtggagagcagccatctgtctggccattcagaggattctaaagacatggctggatgcgctgctgaccaacatcagcacttaaataaatgcaaatgcaacatttctccctctgggccttgaaaatccttgcccttatcatttggggtgaaggagacatttctgtccttggcttcccacagccccaacgcagtctgtgtatgattcctgggatccaacgagccctcctattttcacagtgttctgattgctctcacagcccaggcccatcgtctgttctctgaatgcagccctgttctcaacaacagggaggtcatggaacccctctgtggaacccacaaggggagaaatgggtgataaagaatccagttcctcaaaaccttccctggcaggctgggtccctctcctgctgggtggtgctttctcttgcacaccactcccaccacggggggagagccagcaacccaaccagacagctcaggttgtgcmtctgatggaaaccactgggctcaaacacgtgctttattctcctgtttatttttgctgttactttgaagcatggaaattcttgtttgggggatcttggggctacagtagtgggtaaacaaatgcccaccggccaagaggccattaacaaatcgtccttgtcctgaggggccccagcttgctcgggcgtggcacagtggggaatccaagggtcacagtatggggagaggtgcaccctgccacctgctaacttctcgctagacacagtgtttctgcccaggtgacctgttcagcagcagaacaagccagggccatggggacgggggaagttttcacttggagatggacaccaagacaatgaagatttgttgtccaaataggtcaataattctgggagactcttggaaaaaactgaatatattcaggaccaactctctccctcccctcatcccacatctcaaagcagacaatgtaaagagagaacatctcacacacccagctcgccatgcctactcattcctgaatttcaggtgccatcactgctctttctttcttctttgtcatttgagaaaggatgcaggaggacaattcccacagataatctgaggaatgcagaaaaaccagggcaggacagttatcgacaatgcattagaacttggtgagcatcctctgtagagggactccacccctgctcaacagcttggcttccaggcaagaccaaccacatctggtctctgccttcggtggcccacacacctaagcgtcatcgtcattgccatagcatcatgatgcaacacatctacgtgtagcactacgacgttatgtttgggtaatgtggggatgaactgcatgaggctctgattaaggatgtggggaagtgggctgcggtcactgtcggccttgcaaggccacctggaggcctgtctgttagccagtggtggaggagcaaggcttcaggaagggccagccacatgccatcttccctgcgatcaggcaaaaaagtggaattaaaaagtcaaacctttatatgcatgtgttatgtccattttgcaggatgaactgagtttaaaagaatttttttttctcttcaagttgctttgtcttttccatcctcatcacaagcccttgtttgagtgtcttatccctgagcaatctttcgatggatggagatgatcattaggtacttttgtttcaacctttattcctgtaaatatttctgtgaaaactaggagaacagagatgagatttgacaaaaaaaaattgaattaaaaataacacagtctttttaaaactaacataggaaagcctttcctattatttctcttcttagcttctccattgtctaaatcaggaaaacaggaaaacacagctttctagcagctgcaaaatggtttaatgccccctacatatttccrtcaccttgaacaatagctttagcttgggaatctgagatatgatcccagaaaacatctgtctctacttcggctgcaaaacccatggtttaaatctatatggtttgtgcattttctcaactaaaaatagagatgataatccgaattctccatatattcactaatcaaagacactattttcatactagattcctgagacaaatactcactgaagggcttgtttaaaaataaattgtgttttggtctgttcttgtagataatgcccttctattttaggtagaagctctggaatccctttattgtgctgttgctcttatctgcaaggtggcaagcagttcttttcagcagattttgcccactattcctctgagctgaagttctttgcatagatttggcttaagcttgaattagatccctgcaaaggcttgctctgtgatgtcagatgtaattgtaaatgtcagtaatcacttcatgaaygctaaatgagaatgtaagtatttttaaatgtgtgtatttcaaatttgtttgactaattctggaattacaagatttytatgcaggatttaccttcatcctgtgcatgtttcccaaactgtgaggagggaaggctcagagatcgagcttctcctytgagttctaacaaaatggtgctttgagggtcagcctttaggaaggtgcagctttgttgtcctttgagctttctgttatgtgcctatcctaataaactcttaaacmcattgattgtgaacttgttttaatatatttcacgacaactcgaaatacctggcagaacttgctttcaaggtcattacatttatccatctcccctttcaaagagttgctaaaaagaaggtaccttgtggctgagtttctgcacctgcacctgctggaggcgacagggggcgctgggctctgccttccttcattacctcagcaaatgtgtaccctgcccctcagcgtgctgcccttggggacatggaatacagagggctgggctgcactgcgcccagtgtccatggcagctgagtccactcatccatggccccctcatcactctttaattctctgcatcttgtaaattacatgggtgatgcctggcgcagaattaaacatgtccaatggatgcgatgtgaaaacactgttctataattatcattggagcatttatcactactttgtcagcaaagccctttcagtttatttaactaattggacaggcagatcagatcgctggttgtttggctgcacaaatctcatggtgattccaagtcaggaacagcagatggtggtcaattctgagtcagcctgcttttaagattgtgcaaaaggctgtggcaaaggcacaggacttaagaagaacaaagggttctgctctgttatgctaayggtacaggacacttgcaataaatatccattatttagggttaaatgcagctgatcctgttagaagtctattcattaacaacatacacttggaarttattcctcgatatgaacaaccatggctgttcccccaacacacacacccacacacataaacacacayatgcatgacacagagatatgcatccacaaacacacacaacacacacccacaagacacacacccacaagcacacacagttctaacatccttctgtgtcgtactggaacacctgaggccagtgtttctcaatttaggaaaagcctatgaaagaaaacaccaacttgtgatggttacattttttggtgacttttgctatctcactaaaatttcttaaatgctaggtaaatcattcgcaaacaaataatttgccaagaaaaattaatttgcacacatatctattgcacaatgcagagtacatttgtgttgctatcatcagacaaaatgcagattacaatgagagactcagacatgtactatgtaccttctgtgggattgaacatgcattgagtgagcctatcaagttctcagctgactcttgtgtatattcagcaagaggagatacagagagcagagatgataaacttgaaaaccagagaagtcggagtcagcctttccctgaattatatttgacattacaggtgcttagaaacagaatgactaatgggtttacccttcagatcctctgaatgcctcctaactctcccttttcagaggaaattatgaacagctcaacagtgaaaaagtgaagaaagaggcagagagagtaaaaggtatagatcaagtgcaatcatttttccggaactgtgattgacttaagggtgctcagcatgcagctcaggcacaggccctctcctgagtccccaggagaaccaccaccaaactctccatgagcggttgtccctctctgagttctggtagttgggttctatttgaggtttgtcgtgattaacttggatgatgatgttctcttgtggttaaaattggttyatagaattcaactgagtggaagaaaggatggaagggaggaaaagaggaagggaggaagggagggagagggaggaagggagggagagggaggagggagggagagggagggagggagggaggaaagaagggaatgaatgggaaggaatgaatggtagggagggaatgaataaatgggaaagagaaggaaggagagatgagggagagaagagagagagagaacacaaaagggggtagaggaatgtcccaggtgtggtggtcacaatcaggtctcacaaagctrggcttggagcctgagaaggaagggctgagtttctcagggcgtgccggtgcgaatttcaggccacttcgttctgctggccttggtgaggcccagcaccctcctgtcaccttcctgcaaagcctgcttgcctctgccactggccttacgcctgtccacatagttcatattgtaagrtctgaagccaagcctgtgacctgtctctgtggggctcctactgtgttcaagtatcatgaaataatgaaatttgtgaggtggaagaaaataattgggacgtctaccttctttctccagggtctggctttcccaaaaacgttatatcacaaatgttttacttcattgttgaaatcgctgcctcctgtcccrcgtgtgtttgtcggggtgtcacgcccttgtctgctttccttctcatccgtcctgcaagtcctcatgccctggcctccatccaggccytcatcccccatggctgtggcttcgtcagcttctcctcggatttccaccagttttgtcttctatttacagccgcgtggtgaagggactaatatgtgtttggcagatttcrtccttcaccrataaaaaatatacctttttgaaccttttcacttcaaattatattatatatgactttacaactgatatacccgattcattctgctgcatctgatgaatatctggtattttttccctaaattcagcyttctggtgacacttcatgtttgtctcttgtaaacaacaaagctggatttcactttttttttcttttattcaatcaaaagtctttgtcttttaatgggagaattcaatctattcacattcattaaggttactaataaatttgtactgacttattttatatgttccatttataatgattcattgggatttctagcctctctctcgtcaattattagattgattaagttttctttgatctactttttcccttaatattttggaattgatatagactatttgtattcttcaaatagtcttactttttcacctcacatactaaagcctatatcttctattaatgtcttgtgttaattaatagctatctcctccctctattccccaaaatacccagcaatctgttatttctatttcctgtcctctcaggttacccagattcccacaccactgcccacctggattgcatctgaattttatttttttattgttatacatttttacaaccaaaacctacttggatgccatgagtttttgttgattttttctcatcttcacctctgattcccagtactgttggattcagttatcacgggagtgttttgttttgagttgtgtctttttctgagaaggtcatgcttgcatgaccagaaatgcctttcccttccgcaagttgaatgatgcctcacctagacatagatttctaggctctaaactgttgtcctgtagaactctggagatatccagcctttgctttcttgcatacgttgttactgatgagaaggctgatgtcaaataatgtgttttctttcatggaccatttctttcttttttcctttttttttttttttttttttgagatagagtctcgctctgtcacccaggctggagtgcagtggtgtgatctcggctcactgcaacctccgtctcccgggttgaagcgattctcctgcctcagccctcctgagtagctgggattacaggcacacgccaccatgcccgactaatttttttttgtatttttagtagagacggggtttcaccacattggtcaggctggtctcgaactcctgacctcatgatccacccacctcggcctcccaaagtgctgggattcgcccggccttctttttcttttccatttttccccgagtgctttggcaattttcttattctctgttgagttctgaggtttcgcttcaggttgcaggtgtggttcctttctggtcccgcctgcamtaggtgagctcttcccagcacaggagggcatttccttctagctgtatttgaacctgagcatgtgtctgaatcctctggaacctcctgcagggctccttaaaacggaacccctccctcagagcttctgacttggccgatctggggtggagcccaagactgcatttctgctgatgctgctggtccaggaaccgcccttggagaaccgctgcttcatttggtcttgagtgatcttctcttattcttgttagtataccttcttgttcattgtcttgactctcttattttggaaacaattttagatggttctttccttcctcactttgtacctatcttctcccagtgggctataaggctgggccttctctccagcactcccagcgatccttgctctgctctactgtttttccaaaacaccaatcaccttccaccctggtttatgatttctgtttgtacactatgattgattatttagtatctgtatttatttactagaatgtaagagccaacaggggcacttttttgtcttttggtttctgatataccctaggcctctagaccagggcctggcatactgtggtgctcagtaaacacatgtggaatgcatgactgagctgggggttggagcagtgtaccaggtagggtgggctagcacaccctcctggtgggcctgtgtgagcctcgatgctgtccagggcctcttcctccaccatctgccacctgtsccctgtctccagctcatggcacggcctgcactcaagtcttcactattgctgctctgaattgtggcygccatatccagctggtctggggctctttgcactccagctcccagaaacagagcctgagagaaggactcaccatcctgtggttcactgggaagcacagggaacagtggtaatggcatcaagtggtgacatcactgtagaaatcctgggaaatggtgcaaaacatgccagggtcatcacatctgaaagccaagggagtggtgtgtagatacccattggtaatgagtagagggctgccctgggtggagktggcgggtaattcccagcacttccagatgaccacacatgtgggcaaagtggccttccacacttaggatggggaaaccttcaggtacagatgcaggccctggcaggtgtacttcacctgagcacagtgaaaagtgcaagcacgatttgttgagcactggcagcctccagcacacagctgtcctctaaactcagtgcagacagtcctccctgcctctagaggtcatgcctccatttccccaggaggagctgtatccatggggatggatttctctctcaggagttttctgctggcttttatcactttattccttgcatgataggtcagtggctacatgacttgtgtcttcctgagagactgtaaggcactcaagagcaacgggtacatctgtattgtgccttgctcacagtcaagcctcaaaagattttttaaatacaagaccccggatatgttattttataccacatatgttattaaagcaatgaagaggaaaaaaatcactgaccttttactatgtaccaaatgggaaaatagtatttgctattgagaaataggtagtattaatatctccattttatagttaaggaaattgaggcagagagaagatgagtggtgaattagatgaatgaaatcttacactctcactcttaatcactaggcttccctgcctcccattagacatgaataggaactgcaattgaaaaagtgtcaaccagcaaagagtggggagatgagtgggcctctcagccagtttcagataggaaaagcagagtgttaagcaatatgggtatttttaataatatgttcaaacaaacttacttgggcttgtgtatgtaccccccaaamacacacacacacacacacacacacacrcrcacacacactggggtagaactactcaaaagccctctgatcagaaagattgtgcatcctgagacctgccttgcctgctctgagggcagatcccagggaacgcaccctcacagtccccccacgtggctatccccagtctgccttggtgagagcaatgtgtttgaatgcagtaggagaggaagggaagtgggaatgtgcaaatcgccccatggtccc

SEQ ID NO: 13471 - DNA, 13682 bp, Homo sapiens
acgagggttggggaacaggtggttagcacttcatcctcgtctccctcccaggttagaagggcccccctctctgaagacccccactccctgggatgctacaatccaatgatggaagatggcattagctacaccaccctgcgctttccmgagatgaacataccacgaactgggtactgagggtaccaggagggtgaccctgcaccctgggagggaggcgggaggaaaagctctgtcccgcctgccctctttgtgccaggcccatgccaggcaccctgatacatgctctgcctcattcccrctcggcaacaagcctctgrgtaagggccagtctccagaagtggacctgctccttcaagtcagcagcacacatgcscagtccgttcttatcacaaagatcaagasctcrtgatacacacccacgcctactccctccacgcacatttgcacgagctcctactgtgagctttgggcactggggaggccacaggttttacataaggggctgaggttggggtgctgttgggggctctgggtgttgagagggaggagagttcgtgggagatgcttcatgcgtggtcgtctatctgccctgtctctcagagatgcagagtcctcagagatgcagagacctcccccggactgcgatgacacggtcacttattcagcattgcacaagcgccaagtggtaaggaggrtctccccaggtctccccagaggggctgtggaaggctggggacagggcctggcctcagtggtgggtcccacataggaaggagttgggtaggcatccgtggtggcagaggttgggtgttggagacggttgctccggcagagctggccagagccaggcaggtacctccaggtcctggatgccggccacagccagtttcctgacacgaggacacccgcctgggcttttggacccccgggtggaatgaaggagagaatgcggagaaaagcggcggtggaggctgrcgacagtggggccaggctaaccaccatgcggttttctcagggcgactatgagaacgtcattccagattttccagaagatgaggggattcattactcagagctgatccagtttggggtcggggagcggcctcaggcacaagaaaatgtggactatgtgatcctcaaacattgacactggatgggctgcagcagaggcactgggggcagcgggggccagggaagtccccgagtttccccagacaccgccacatggcttcctcctgcgcgcatgtgcgcrcacacacacacacacgcasacacacacacacacactcactgcggagaaccttgtgcctggctcagagccagtctttttggtgagggtaaccccaaacctccaaaactcctgcccctgttctcttccactctccttgctacccagaaatccatctaaatacctgccctgacatgcacacctccccctgcccccaccacggccactggccatctccacccccagctgcttgtgtccctcctgggatctgctcgtcatcatttttccttcccttctccatctctctggccctctacccctgatctgacatccccactcacgaatattatgcccagtttctgcctctgagggaaagcccagaaaaggacagaaaygaagtagaaaggggcccagtcctggcctggcttctcctttggaagtgaggcattgcacrgggagacgtacgtatcagcggccccttgactctggggactccgggtttgagatggacacactggtgtggattaacctgccagggagacagagctcacaataaaaatggctcagatgccacttcaaagaaccagtgaactcttttcagtctgtggagtcagagtggggatgaggagaggggaaagtcttcatggggcctggggggaaggaaatggagtcacagtggtttactgatcaaaccagcagattagagagtctggtgtcttgttaggaaaagcatactggctttgcagacagacaaacatgagaacttgaatcttgattcttcggcttaactagcccggtgatcttggcagggctcgccagcttgcctgagtctcggcttctccatctgtaaagtggagagggaaaggccactgcctaccacgcaggtggcccacgataggaagtgaggcatcgtcttctatatgctggagccacattgagacccagcacagaagccgaaagtcccccagaaaaccaacctccatcctttatttgcatttttcgaagaatgtgaaaaggggaagccgattcaaaacagctcttcccaaaagtgacgctacccarttcttgcacaacccatagctgccagagaaagtcttgaagaccagccaccctgagaaacctcacagcttttctgtcattcgaggtcctctgcacccgttctctaattctgttcactgattcagactttccagttaggtgycccagctcccctctccgcttctcgggtttgatctttctccacccattcacctgcttctgcaaaggggctaaagcccattctccttagagggcaggkgtgtaattatctgatcatcagggagattggctcctggcacgtggcaggtgtccccaaactgccaccttcctctcccaccttcctttccctcccatctctgctcagtacccggacggtaactctaggaattatggttcagggaggccttgatcgccccatcaatccactttgtccctggtttgattctygtgagcaccattaacttttctggaggaaggtgaggctttaagaactgtttaaagcccaggcgtggtggatcacgcctgtaatcacagcactctgggaggccaaggtgggcagatcacctgaggtcaggagttcaagaccagcctagccaacatggtaaaatcctgtctctaccaaaaatacaaaaattagctgrgcgtggtgattcacacctgtaatctcagctacttgggaggctgaggcaggagagtcgcttgaacctgggaggcggaggtagcggtgagccgagatcacgccactgcactccagcctatgcaacagagtgagactccgcctcaaaacaacaacaacaaaaactgtttaaatgagacaggagggtgttggggtgtctgtgcccaaaatggggtctggtgtcattcaactctttcttcattcattctgcacacagatactgagcacctggaaatgcacccagtacagagccagttgttaggacaccaaaaagataaggcgtaggaccaaccttggggatctctagtcgagagccgccaagggtttttaaggcmagataccctggagggagctgaggcagtcctaagcctgaagggcctggcttaagctccctggcaaccatcgagcatcttccccttcccaccctgtccctcagcacagctgctgacataaacctactacatggctgattgaccatgagatatggccatcaatagacattgctgaggcgtgaagagcaggtgaagagcaggtggccaggaagctagggggccaggactccagacgcaggccgccctccacaaccccagctctcacagtcctcccagggtccagacaatggatcgtgcatttaggttcccaaacasctgctgtgcaacgtgtagtagacaaagcagaccaaagcctttgccctcaggaggccggcattctagctcaggagccagccaagacgatgtcgcactgaagaaagacaacaaaagtgagattcacaggagggatgagtgtggctgaggcacccgggaaggccctcggagaaggtgaccttgggcaaagatccagacgccaggtgggtggggccaaagcagagaagatctggaaaacccaatggctccccagggcttcgctcttgctgcaggaggggaaaccacactgctgtggattcttcctccattctgtccatttctcagttcccaacaacacactgaacagtaggaggccagttctccgctcacagcgggcgctgcaccccaggtgckgctctcgagaaaaaggcgagcatggaccaatttagtggctccgaggtatgaaaagcagtgagatggtgtctttgagggagttagtgataggctgagacccccttgctgtcccccctgaagcctggtgaccagagctgccaggaggccacacagagagaggtttatgatgggggacctggaattcggaaggggcagagtggtcaggtgacccatacacgcctgagaaaactgatgtggagagctgtgttgtcattctgaggcaggaaatagagacagactgacagacagacagaaagacacgggcacattgagagacagagacagaatcacagagcagagctggcttctcaccagcaggcgtgggcacacctgagagagcatccagagaggttagaaatcttccttaggtcctcctgggaggctcaggtgaccccagtgggaaacatgaaaggctgggaggacttccagggctgagagaaggaagctacgcagccggccggtgccacattccctgtgccttggggagtgtcccccagtgtccccagccatgcaccctggggggagtcggcttggacatctgtgccaccccttgacaggcagagtgggggccacaacctgggccctccagtgctggtcagcagaggctgcccccgccccttgccttcctcctcccgctccttcctccagccctgggaaggtcggaagccaccaccatggggctagtgcggaagcagagggagaacagaggggccctcctcgcaaaaactaaaacaagcccacagcctgtgcagaaccgcacccgggtgtgatcactccttaccccacacacccactgccacttggagatggcttcatggctgcagtcacagggcaccctgtgttgtcaggggtgagccagtgaggcccgggacctgcccaggggtgcatcaagggtggagaagacctggccccagcgcaggtgtgaacaggcaggagggctggggagggaatagcgctgggttgtggccgagcccccaagccctgctcttgagaggcactggctacacactcggcccctacccagacaggaccccaattcctccctggcccctctgtgttcctgcatcttcccagcccctcacctcctctggcgtggcctcacctccagccgggatgccccattagctgctcacccaagctgctagaacctcaggctaatggccctgtcacccgccctcctccccttccggctcactgcccatcccgggcatcctccatcagcccgctgaggggactgctgagcctcagagacatctggcagcaccaggaggtgggtccctctctctgtggctcctctcttcacctgactgttccccagacccccagaccccctgcccaggtggcccctgagaactgctaagctcaaccgtgacatggatggggccyrgctgacccttgggctctccctgggggacccccttttcctgtccctggccacaccctcaccttatccacacccttctcctccctgctgccccgccggctttccaatgtgggtggggggtgggggcagctcctgccttgccagggaaccagggagggcagtgggctcaggagtcaaactcccattcccagggaaggctcaggctgtgggcccagccctgttctgaattctctccacccctcctccccacagagtctcagaaatcgagaagctttcttcctctgggacctgtgcgccacatcctatctcctgtgacgctgcaggagcttccctggttttaagaggtgacatggtggagagaaagcacaggactgggggccacaggycctggcttctcatccaggctccgctgctccctgactgctgcctttctctgtgggcctcgtttcctccctgatcccaccaggtgaattgtaattctccacacagggctggaacccgcgagtgatcccaggagcccctcctctccggggccccaagatctgaggacagggagccaggttgcacacaggagccgtgcaggccaggacggcggccccatggacctgcccccgcagctctccttcggcctctatgtggccgcctttgcgctgggcttcccgctcaacgtcctggccatccgaggcgcgacggcccacgcccggctccgtctcacccctagcctggtctacgccctgaacctgggctgctccgacctgctgctgacagtctctctgcccctgaaggcggtggaggcgctagcctccggggcctggcctctgccggcctcgctgtgccccgtcttcgcggtggcccacttcttcccactctatgccggcgggggcttcctggccgccctgagtgcaggccgctacctgggagcagccttccccttgggctaccaagccttccggaggccgtgctattcctggggggtgtgcgcggccatctgggccctcgtcctgtgtcacctgggtctggtctttgggttggaggctccaggaggctggctggaccacagcaacacctccctgggcatcaacacaccggtcaacggctctccsgtctgcctggaggcctgggacccggcctctgccggcccggcccgcttcagcctctctctcctgctcttttttctgcccttggccatcacagccttctgctacgtgggctgcctccgggcactggcccrctccggcctgacgcacaggcggaagctgcgggccgcctgggtggccggcggggccctcctcacgctgctgctctgcgtaggaccctacaacgcctccaacgtggccagcttcctgtaccccaatctaggaggctcctggcggaagctggggctcatcacgggtgcctggagtgtggtgcttaatccgctggtgaccggttacttgggaaggggtcctggcctgaagacagtgtgtgcggcaagaacgcaagggggcaagtcccagaagtaacgccactgctcggrggaaggagcatggggcaggagggcccggctgcttctccaggcccctgcggggggctgcttcggaggaactgcagggcagcctggcccggaggcctccctggagccactcaagcagagagcggcgcctgctgagggcagcaccccagtcaagagaggagcaccgagccagagcacggtggcagggggaggtaagtttgcccctgcacgtgtcgaggaagtttgtcccttcctcgcctatctttctctcccctctgcacgtcctcacctgcctgtcttccgtgggccgcgagcagaggccttgtacttacgggaaggaggaggcagtctgtttctgacycacaggaactgccactccggtgatgcacttgaggacagctactctgaaatcagttcccaggagagaacatttgatttccgagtaggagaggaggcaggaggcaggataatgacgctgttataccatgtgaaactcgcaagggggcagccttggagcttggaacggaggctggcaggaaaagatgcttcagccggggagggaaaatgcaaggtcccgcagtgatgggcaaaggctacggagttgactcttgaacaacgtggggatggggtgccgaacccccacgcagtggaaaatctgtgcatgactttgactcccccaaagttcaactactaatagcctactgttgaccaaaagctttacccagtatataaacaattgagtaagacatatttgaagccaggcacagtggcttatgcctgtaatcccagcactttaggaggccgaggcgggaagactgctcgaagccaggagttcaagagcagcctgggcaagatagtgagacccccacctctacaaataataaaaataaaaataattagctgggcgtggtggtgcgtgcctgtagtcccagctactcaggggtctgaggtgggaggatcccttgagcccaggattgaggctgcaatgccatgatcgcaccactgcactccagcctgggtgacagagcaagatcctgtctctggaaaaaaaagaaaaaagacatattttgtatgttatatatattatgtgctgtattcttacaataaagtaagctagagaaaagtacatgttactgaaaacattattagaaagagaaaataccttcacagcactgtgctgtatttatcaatactgtaagttttgttgtctgtttataagagaagttgtctgtctcaagcggcagtaaccgcggctgcagatctcaatctgtggtagatatcaagcagttcaacccttttttataatgtcatgacttttctttgcttcttggaagcagctctggcatcactagtggccccgcatttggggccaagggggttattcaaagtttacggtattgcattaaacatggtgaaacatatgcaatgactatgaaagatcactttttacttctgtacacagtgtactggcgagaactgctcaccaggaggtgattagcttcacgtggtgttggaagcagatactcaacagttgagctcackgagaaagcacaggaggtggctacgaaattattataggagtacagtatgtctacagtaaatatgcacttatgactttaatactgcacatctttatgtttgcttgcatttctcttgacttcaaatggcatcaaatagagtttgtgtttgcgtgcatatatttttgataaattttaacttttttgttttgttttgtttttagacagagtcttgctctgtctcccaggctggagtgcaatggtgtgatcttggctcactgcaacctccgcctcccaggttcaagcaattctcctgcctcagcctcccaagtggctgggattacaggcacctaccaccacacctggctaattttttgtattgtaagtagagatggggtttcrccatgttggccaggcctgtctcgaacccctgacctcagttgacccacccgcttcggcctcccaaagtgctgggattacaggcktgaaccacggtaccctgccaattttaactttctataagagatttgcccagcctgggcaacatggagaaaccctgtctttaccaaaaatacaaaaaatttagctgggcatggtggcgtgtgcctgtagtcccaggtacttgggaggctgaggtggaaggatggtttcagcctgggacgcagaggttgcagtgagccgagatcatgtcattgcactccagcctgggtaatagagccagatcctgtctcaaaaaaaaaaaaaaaaaaagctttgtatccattttggcatacatagactagtatgtrtggcagtaaatagactagtggcagtaaatagactagtacctacatatattttttgtattcgtggcatacttaacttttgcttaattttwaaaatatatttctaggcttgtagttcctctgtaagttttttcaaattgttgcaaatctctgaaaatgtttccaatgtatttattgaaaaaaatccacaagtaagtggacctgcacagttcaaacctgtgctattcaaaggtcaactatatagtctgtaatacgtgatgggtgtcacgctgagtgtctacagtgagtgttgtctcacttcagcttcacacaacgctgtggtttagccttgccactgccgtacggatgagcgggtgttcactacacgaaggtactgggcagaggagcaaacactgactaaattctagcctgtgctttgctcaacaagccacatgcctgccttgcttgcatcaagggaaggagtattgtgttctaatttgaagaaatacaccagccactccttaggcagcacttggtgcgggatgggctcctctggaaagggagcacctaatttgcacaaaggtgctgcaccaggtagctacgatcctggaatgggatgaagaaacttgcctaaggccctacagcaaggaaggggtaaaagcaggatgtgatccttccaagcagaacccccaagagccaggggacatttgggaaacctgggggtgtgggggttaaccctgtatttgtggtccatttcgcaaaggatagcatcccacatccatgagagggaggtcagaagggagtggctgtggctgtgaaggagacagacacctgggcacctgctctaaattacagcaatgccatgcacatgatgatgtattggagcacaacaaatggcagccaccagctggggtgcacgcaccaatttctacaaatgagctctgttcaggctgaaatgtctacgcatgcaaggatttttcttgtaattgatgatatatccccagcgcccagaagacagagtggcacgcagtaggtgctcagtaaatgttcgctcaatgaatgaatgaatgcctctactagccttccaaagaaagttctatgtctgttttatcaatatggaaacaggccagagaaattaagtaacttcttttggaagccagaaacaagcccggcacttgtgcagtgacaacaccagggaatttcagtaaaaacccaaactccaccccagggagccccagtgcctcctcccrcatcacagggtgccagggcccactctctttgactcctgctccatagcccctgctgggtactgggctgcttctcccagttcctcctgcctccccccacttagggcaaatccagtgcctccctggggcccaggagactcagtgtgatccaccccaggcgcctctcactcctgtgagacccaaacctcctatcagctccccyagcaggccaagtctgtgcacccgtgactcccctgccccartgttccctccagtggctctttgcctcttcagtatccaygtcttcatgatccttcccctactccatcccccaagccctcaccaccaaatgtaatgtaaacagcatgacarcaaaaactttttgttcacaactgcgtgktkttttttttttttttttttttttttaracacagtctcactctgttgctcaggatggagtgcagtgacacagtcatggctcactgcagccttgaattcctgggctcaagcgattcttccatttcagcttcccaagtagctgggaccagaggcacatgccactaaacccagctaatttcttttttctttctctcttttttttttttttttcccctgtggacatagggtctcctcatgttgcccaggctagtctcaaacaacctgtgctcaagcaatcctcccacctcagcctgccaaagtgctaaaattacggacctgagccaccgtacccagcctactgctgcacttttaacagcttaattgaratattatgtacatatcatcaaattcaccaatgttaagtgtacaattcaatgatttttagtaaatttactgaggtgtgagtccattaccatcagctagttttaraacattttcatgaccctagtaaaggattttacttcatgttcatttaaacttaatcttgggccaggcggggtggctcacgcctataatctcagcattttgggaggctggggtggacggatcacctgaggtcagtagttcgagaccagcctggccaacatggcgaaacctcatctctactaaacatacaaaaattagccaggcgtggtggcgggcacctgtaatcctagctacttaggaagctgaggcatgagaatttcttgaacccgggaggcagagtttgcagtgagccaagattgcaccattgcactccagcctgggcgacaacaagaccctgtctcaaaaaaaaaaaaaaaaaaaaaaaaacaacttaatcttcatttctacctccatcccccagacaaccacgagtctactttctgactctataactttgcctattctggacatatcatataaataaatgaaatctgacaatatatgtacatggtcttttacgtctggcttgtttcactcaacataaggctgtagtgtgtatgggtagctcattccttttctttgccaaatagaattccagtatatggatgtgccacttttttattcactcaccagctgatgggctrccaggtaacatttccactgttggtgactatgaccaacactgctgtgaacatttaggactgagtctttaagtagacctgagtttccacttctcttaagtaaatacctacggtggaattgttggatcgcatggtgaatttatgtttaactttttaagcaactgccacctgctttccaaagcagggacaccacctcccattattctcaccagcagtgaatgaggcccctatctctctacattctcgccgaccataggcattgtctgactttttgcttgtggccattctagtggatgtgaaatcatatctcattgtgccctgtgattgtttgaatgaactaatagatcacctgtgaaactggacagcacttgggtttgaaccctagtggtgacatttcacaagctgtatcacctggagcaagtcacttccctacggtgaaggacaaggattttatgacataaaagcgttgccctagaagcagtgtctgctatggattatgtgcccatgaaaaggcagctgctgtcatcatcrccaccaccattattattgttattattattacattgtcaccccagagataatcctgcaccagtgacagggaaaatagcagctggcatcygctgcctgctcacgaccacacgccaggcttccgtcaaaccactcaacatgtattagtaatcttttaatcgacctacatattgttttaatttgcatgtgttaatgcrttgatctatgagatgggtattatgatgagctctgttctgcaggggagaaagcagaaacatggagaatttaagtcatttcccccaaatcacaaagtcaggaagaaacagacctcacggagctcgctctctgtcattgcatcacacttcctgcccttacaaggcaaattggataaatgccattctagagaagcagacaaaattcaagtgaagaaggggagaggaagacgtcggctggggcctgcttagagcatcccagctgagactgcatgaggagggaggcacgcagttgtggaatttgttccccttttagcatgctgaccagccctggcaacggagctcaaggcatctwtgtgccactgctcaacagtgagtgacgtcatgggcacggccaggtctttatcagttctgccggataaatagccaactgcactaggtctggagagacagcaaggtgctgtgcggcagagcatttggggtctcaaagaagcaggtgagcctgggcccgaggggctgggtggaggagcaccttggtgcttctctgctggggaagggacaggggacagggcatgctcaggaagacaggcaggctgaccccgcctggaaggcacccagagacaagaggggtgggcgtagtgacctcgtgcccttttaggggagatgctgctggccagaggccgttagggcccccactaccaactccatgttactctctctcaccagtggccaccaccatggatacaggccccgaccagtcctacttctccggcaatcactggttcgtcttctcggtgtaccttctcactttcctggtggggctccccctcaacctgctggccctggtggtcttcgtgggcaagctgcagcgccgcccggtggccgtggacgtgctcctgctcaacctgaccgcctcggacctgctcctgctgctgttcctgcctttccgcatggtggaggcagccaatggcatgcactggcccctgcccttcatcctctgcccactctctggattcatcttcttcaccaccatctatctcaccgccctcttcctggcagctgtgagcattgaacgctt

SEQ ID NO: 13472 - DNA, 50529 bp, Homo sapiens
  misc_feature (1)...(50529): n = A,T,C or G, or insertion/deletion polymorphism (see Tables 1-2)
gagcgagactctgtctcaaataataataataataatattccatattctattgtatggatagaccacattttgtgtatccattcaccagctgacggatatttggattgtttcttctttttagctattatgaataatgttgctaaggagatttrtgtacaagtgtttgtgtggacatatgttttcagttttcttgggtataaacctaggagtggaattactgggtcatgcrgtaactctacacttaactttttgtggaactgccamttttccaaagtggctgcaccattttactaaaggctaaatttttttttttttgagatggagtctcactctgtcgcccaggctggagtgcggtggtgcgatctcagctcactgcaaactccgcctcctgggttcacgccattctcgcgcctcagcctcccaagtagctgggactacaggtgcccgccaccatgccaggctaattttttgtatttttagtacagatggggtttcaccgtgttagccaggatggtctcgatctcctgacctcgtgatctgcctgtctcagcctcccaaagtgctgggattacaggcgtgagccaccgygcccggccccctaaaggctaaattttaataatcattacaatcttcaggatctgactcttgcttcccatctctttccctgtcttttaccacaagcagtagctccaccagtaaataccactcatagctttctcatgcacaccatgctgtttcttgactctaggcctttatttctgcttcaactgcctggaaaamctgctagcctccactcccttaagacaactcagtggtcacctcttctctaaagcccttctcgtccccattcctgcttcctcaggaaaagataggtgtctcttcctctccacacctatacacatagctattaacaaactttaaatgtcatgacatactggatttcataactatgcttcttcatctgcctcttgcactgggtggaattcttttttccttttttttttttttaaaggcaggatcttgctatgttgcccaggctagaatgtagtggcctgatctcagctcactgccacctccacctgctgggctcaagccatcctcccccctcagcctcctgagtagctggaattacaggcatgtgccatcatgcccagctaatttgttttttgtatttttttagtagagatggggtttcaccactttggccaagctggtcttgaactcctgacctcaagtgatctgctcrcctcggcctcccaaagtgctgggattacaagcatgagccactgctcctggcctcaagagctcattctaatgccatcttttcaacaaataccttttctgatcatccccctcagcaaaaaaaaaaarrraaaaaaaacctstcatgggactcgctttcattatcatatttaaatttacattttgtttacatacacatctcttcttttttyyttttttccagtcttacccctgtataaactggatgaagctgctgccratttaaccaagtgggaatcccagtgctaattgtctgctggatgggatatctttattggagcagattaacatagcctcamatttgtggtttgtgaccactgatttagcaaatacattgtttttcttttttctttttctttttcttttgagacagggtcttgctttgttgcctaggctgaagtgcagtgtcacaagctcagctcactgcagcctcgacccccaaggctcaagcaatccttccacccagcctccacagcagctgggactacaggcacatgccaccaacgcctggctaatttttttttttttttttttgtggagacagcatttcaccatgttgcccaggctgatctcgaattcctgggctcagctgatcctctcgcctcaacctcccaaagtgttgggattacaggtgtgagccactgcacctggcgaacatccttttcttttttgtttttttcctttgagacagagtttcgctcttggtgcccaggctggagtacaatggcacgatcttggctcactgcaacctccacctcccgagttcaagcgattctcctgcctcagcctcctgagtaggtgggattacaggcatgtgccaccaggcccagctaattttgtatttttagtagtcagggtttctccatgttggtcaggctggtctcgaactcctgacctcaggtgatccgcccaccttggccccccaaagtgctgggattacaggcctgagccagcatgcccaaccaacattcttttctaaagcatgttggtcagaagcagtccaccacggaggggatgaacaacagtatacagtcatggtctttcatcagggctatgttaattctgttctctgtcaygatgtaatctaaaaaatgtggaccatttgcacattctgcagagtatcacattggtccaccatcttgtaactttacatccttcagacgtctttttttktttttttttcttttttttaaagacagagtctccctctgttgcccaggctgaagtgcatggtgcaatctcagctcactgcaacctctctgtctcccggattcaagcgattctcctgcctcagcctcccgagtagctgggattacaggcacacaccactatacctggctaatttttttgtatttttagtacagacgaggtttcaccatgttggccaggatggtcttgatctcctgacctcgtgatccgcccacctaggccttccaaagtgctgggattacaggtgtgagccaccggacatcttttaagtagaatgaagactacttagaggtaggaaccaaccctaccttggtgatttttgttcctccaaatatctttgcacataataattcaatatttattcaaagaaaacgttatatactgtttcataccacaaacaagattgttctgtccttgaaaacaaaaccttttgtatctttgaatcaggaaatattctataaatgcctattgacctaytaatttcctcttccctaacaatcagatactctaccaggatatgtagatatcttcttcagggcaccttgcacttagcagagtcccaaatattttattttctccactctagcaccaccaaatcatgtaaagtatacagccactcacatttcacatcaacytctccattcttatgcatagctccttccagccacccctctgaaaactgactctcctaaacatttccgtaagacccaggatcatgttttcatatatacccatcaatccatttatccaaaacccacttgtaatttaacaagtgctttttatttttattgaagatggggtcttgctatgttcctaaggctggcctccaactcctggtttcaaaggatcctcccacctcagcctgcagagtagctgggattataagtgtgctccaaccaccatgccccgcaacaagtatttattaatctaacttcacttttatggagtttttkttttttwaaatatagagatggggtcttgctatgttgcccaggctggtcttgaactcctggcttcaagcaatcctcatgccttggcctcccaaagtgttgggcttacaggtgtgagccactgcacccagccctaacttcactttttttttttttttttttttgagacagtctcaccccagttgctcaggctggaatgcagtggcatgatctcagctcactgcagcctcaaactcctrggctcaggtgatcttcccacctcagcctcttgtgtarctgggactgcaggcacgcagaaccatgagtagctggaactacaggcatgcagaaccatgcccagctaagttgttttttttttttttttttttgagacagagtcttgctctgttgctcaggctggagtgcagtggcacgatctcggctcactgcaagctccacctcccaggttcaagtgattctcctgcctcagacacctgagtagctgggactacaggygtccgccaccactcctggctaatttttttgtttgtttgtttttgtattttcagtagagacagggctgtgttagccaggatagtctcgatctcctgagctcgtggtccgcccccctccgcctcccaaggtgctgggattacaggcaggagccaccgcacccagccactttatttttagtagagacggagtttcaccatgtcgcccagaccagtctcaaattcctgtctccaagcaatcctcccacctcagcctcccaaaatgctgggattacatgtgggcaccattctgcccagctgtaattyttaaaaattattattaaaaaagaacaaaacacatagatgccctagactcaactcagctctactgatcaatctttaggggttaggactaggcttttgaaatgttaaaacacccagaaaactgatgaccagtcaggcttagtatccsccatctctaccattcatatggtacttaatgtttcatatttaaatggaaaggacacctcacacttttttgtttttcctatagttcctactcagagaatatgcctaataaatattttatgagagtagtacagaagtatgactccatttttctcttatatttcatttcagtgtggaaggctctttaraaacactattaacataacagcattatgtcaaaaagcgccaataacattctcaccaacttttctttttaaaggmattaggtatagctagactgtaaaaggcaagtggtgtgaagcccaaacctaaratcctaaratctaggatgagtcaagacttcatagtctacatgagtagaggcagcatctaraggaaaacaaaagtatgtggctatcaaattccaaagaagccccattttattacagagaaaatacaaagccgtttcctcacagggaaaagtacagtttcccttctccagggtgacagatgagccttttccgaagttctcagctttctcttctatcgaaacttcccatgtcggttaaagtgtttgtagaratagcggatgcgtttattaaggttgtgcaggtcatcagcgaayattctacttccaaccattttcctctttcggatacaacgttgcaattcattccctttccaacctcgaagccatatgggccccctgatcagttctttggggtgcttttcaaagtttcctgtgtaatgtgagagaacacattagatccaagacaagagaactcatcctacaccagctaagctttcaacccacggttgcatcttgctgagcagcacctatagacaaggmacattacagtacagaacaatagcacagactctggagccagactgcttggggttaaaattctgatgctgccatttattaactytggaaaaaytgtttatttttacttatgaagtaaaaattatacgaggggactcagaacagtgccaaacacaatgtaarcagctacataagtgtttgctcttactattgagcacagtaccactctctacacaggaggaaaagatagtcgtyacagcstaattgccattctgaaattgtgtaccacgtcgaaggtcaagtcttacccaggatcccgatgttgtcatacactccgaacatggcccttttctcgttccaacgatcaaccactttggggggcgggagagtgagccttataccgatcaatctaggcacacctggggatgsggaagggagggaattaatctgagccgcctattatactacgaagcagttatcggggtgcctacatcagcyacttaccaagagagaagcttctgcacgccagaggcacccagtcccacaggcgcctacctgccccggataagaggttccctgccatttctctagtctccccccttcaacagcacaccaaataagcccaagaagatgacaggaaccgtcccygccaacttcacacgagtactaaggcgaagacagccatcttgggccttacccaggyagctgtgggcrcaccgcccacctacgccccatccgcaacagccacragccccgccccccgggttccggcmggaggggcctctaccaccctycccgcctcagtgcttccggtccgcctgccggaagttttggagcgccggacaagctgaggtccgcgactcgtcgctaagattccccaaaactgagatttcaagaaaattcaccctttccgctttctttggcgyccttcaaccgtgaaggaaatgaaggttgagaacctggaacccgcttccaawgaccaagccctttctctgtgcctcacaacagtcttscgctgtagctgtttttattacccctattttactactggggaggagatttgaggtcctgaaagtgaagtgacttgctggacgtcacttagcagaggagatggcgaaacctggattagaggcgatgccttctaactcccagcgtggacttgcctcctttcctgggggtgactgaatgcccagccagggacgcgacgtctctggccagcagaaatacggcctcctccccgccgactgggcaaagggggaccttgcggccaaggagggattcgcaggcgggccgggggtgggagcgggggccggagccggagccttggcccgcccccgggcggcgctgtgattggccggccgctccggcgggcgtcgcgattggccgtcctgcagccgttgagatttgaactcggtatttgtggctttgcccgcgcgttgccagactcagaggcggccctttgcctctgcctgccggggattggccggattctccgccgacttgaaaactgccttgctaattggtgcgtgttgtgcacgcgtgttttttccttttcatttcagcctgactgccggaatcagagccgcgggtgagatccccaggtaagatgtggtgttgcaggtcgtaaaagagtaggaaagtcgagtacatggcagtgtgacccagtcttgggcaaaatacaataggcctagtaggtatatccctggggcgcgatgtgtgagaaactgtaagtctgacagatccgcaacggaagwtgttaagcaaatcgcttaacagatccgcaacggaagatgttaagcaaatcgcttaactttcttacttcaatttccgctctgtaaactcatttgtattattatgcacctcatgggattgaggttaggatacttagatcagatatgatacatgcaaacagcctaacagacttggcacaggataaataaatcatcattgttaatgctcttaccattctggtgcaggaagcccactagcccatgctggggcactgttttggcctcagacgagatcagaccattctctctatacttaaggagctttgcacataaaaatggaaataatagtactttgcacattaatatgccactttatagttctttaaacaccttcgtactgcttgatttgtttgatcatcagagcaactttrtgaagtaatcagagtttagtaaccctgtttttacagataaagcccagaggtttaagtgtcaagaccaagtgccaaagtcactactagaattagtttctagtccagggtcaatctcagatcccgtaagataatgttactagcttgctataaaactaaaarccattatatatgttgggggtggggaactaacaaaaccagatgatgttactagcttgctataaaactaaaagccattatatatgttggggatgggaaagtaatagaaccrgatacgaagacaggtcttgaatatagaccctgactttttcactgtttggtttctagccctgtgagcctgtaggagtagaatggctccccaaatgtatgagttccatctgccattatccccagaggagttgttgaaaagtggaggggtgaatcagtatgttgtgcaagaggtactgtccatcaaacatcttccaccacagcttagaggtaagagtccatagctgtcactgkacytagctctttcaaaggaccatctcacatggaattgctacattgtcatttctgttccactacaccaggaagcatcataagagcaagaaacatgtttttcctattttgctgttttatcctaaaattgcatgggatgcatgacccaaagagtacattcattaacttccttttctggattagtcaaaaacagtcttggtgtatgtgattactctttggggaaaagttattttccatctttaccccttactgtgtgtcaaaattaagtcctggtggatttaagagttataggagtggatcgctttttcagaatgtctcggacttaactcgacctgtttttggtaatacctttttggagtctttttggatgtgcaattatggggacaaaaacccataatatatatgtaccactgcaacactgagcaatatatgtacagtgcagtcacctactgaaacctgtaaatgatcaaaagcaccttttgcattaccagaaagacttcataatgtccttgtacttgttgggagcggtcttgtagcagttagcttgctttggagaggtatagagattaaagactggagccaggctgcctggatttgaatcctggttctaccactctgaccttagacaagttacttaattgtctcagtgccttggtttcgtcatctgtaaatatagagataataaccaattcmtttgttatcacctacaagaagaagggttggttaatgcagcagctcgacartatggtcctagcttgtctcctcttggcttttctttcatggttgctagatygcaacttctttttgwttttcttttttttttttttttgagacagggtctcactctgttgcccagactggagtgcagtgatgcgatatcggctcaccacaacctctgcctccccaggctcaagcgattctcctgcttcagcctcccaagtagctaggattacaggtgcacgccactaccrcctggctaatttttgtatttttagtagagacgggatttcaccatgttggccaggctggtcttgaactcctgacctcacatgatccacccaccttggcctcccaaagtgttaggattataggcgtgagccactgcaccagtctagatggcagcttcttsctctaatgtccagaagtggaaaaaggaattttctttttgtactttttattctttattttattttgaaagacaaggtaaagactctcttgcccaggctggagtccagtggcatgawcacggctcactgcagcctcaacttcccagactcaagcaatcctctcacctcagcctcccaagcagctgggatcacagacatgcaccaccatacctggctaatttttaaattttctgtagaaacagtgtctccctatgttgcccaggctggtctcraacttctgggctcaagcagtcttcccgcctcagcctcccaaagtgctgggattgcaggctggaatgcagtggcctgatcacagctcactgcagcctcaatctaccaggctcaagcagtcctcccacctcagcctcccaagtagctgggaccacagacatgtaccaaagtgctgggattgtaggcatgaggcaccatgctcrgccagacttttttgttaaaaactaaaacacctacacacattagcctaggcctacacagggtcaaggtcaccaagaagtcactagacgatgggaatttttcagctgtattatatttttatgacaccactgtcgcatatgtggtctattgtttaccaaaatgttacagggcacaggactgtacaggtaagagaaatagaattacccagactggtttaactgatcaagcttattacctaggagcctccctaaacttgagcatatcaaccatttggtaagcaaggaagaaggcagagtgtggaggttgcctaatggatggcaaaccaacagtgtccacaggtatactattctgtccatatcatgtggatatatgtgtcaccaattgaacatgctgcatactatgacaaactactcttcacttattataatgatgcatcatttttttaaatggtcaccttttttttttttaagttctggagtacacrtacaggatgtgcaagtttgttacataggtaaacgtgctgtgttggtttgctgcacctatcaacccatcacctgggtattaagcccagcatgtattagctatttttttcttatgctccccctccccccattccaccctctaacaggctccattgtgttgttcccctccctgtgtccatgtgatctcattgttcagctcccacttgtaagtaagaacatgcagtgtttggttttctgttcttgcattagtttgctgagtccctgcaaaggacatgatcttgttcctgtcacttttttgttgttgttgttgttgttgagactgagtctcccttctgtcacccaggctggagtgcagtggcgcaatctcagctcactgcagcctccgcctcccgagttcaagtgattctcctacctcagcctcctaagtagctgggattacaggcaatgccaccacgcccggctaatttttgtatttttagttgagacagggtttcaccatgttggtcaggctggtctccaactcctgacctsatgatccacccgcctcgacctcccaaagtgctgggattacaggcgtgagccaccgcgcccagccacttttttttttttttaaagagtcttttgttttttggagacaaggtctcattttgttgcccaggctggagtgcagtggctccatccsagctcactgcaacctctcgggctcagccgcccgagtagctgggactacaggcatgtgccaacatgcactgctaattttgtgttatttgtagcaacgaggttttgccatgttgcccaggctggtctcaaactcccgagctcaagcgatctgcccacctcagcctcccaaagtgctgagattacaggtgtgagccacygcacccagccaagagtcctttttaaaacaattgcattgctttgatgattttggtgtttagaatcctgaatacaacttctcctataaataagatcaaatcatttaattcatttaacaagtatttactgatcatgtgctgtgtgccagacattgttctaagcattgataatacaacagtaaacaaaacagacaaaatgacaaagttcttcctttcaaggttcttaacaagtaataaacaagtaaatatgtagtacagtaggacccttatcccaggagatatattccaagacccttattagatgcctgaaactggaatagtaccaacccctgtatatactatggttttttccctctacctgcctacctatggtaatgtttaatttacaaattagatacagtaagagattaacaacaattctttttttttttgagacggagtcttgctctgtcaccgggctggagtgcagtgctgtgatctcagctcactgcaacctccgcctcccaggttcaagagattcccctgcctcagcctccygagtagccggaactacaggcgtgagccaccgcacccagctaattttttgtattttagtagagacgggtttcaccatgttggccaggatggtctcgatctcctgaccttggatctgcccacctcggcctcccaaagtgctgggattacaggtgygagccactgcgcctggcctgtttaacaataatattaataaaatagagcaattgtaactatgccagcatcactacccttgcactttggggccattattaagtaaaataaaggttccttgaacagaagccctgcaacagttgatctgataaccaaggtggctactaatgggtgagtagggttgcatatacagtgtggatatgttggacaaagggatggttcacatcccaggcaggaggcggcagggcagcaccagattttatgctactcagaatgacacacaacctacaatttatgaattgtgtatctctggaatatttctttctttctttctttttatttttttaagataagggtcttgctttgttgaccaggctggagtgcagtggctcaatctcagcccactgcaaccttcacctcctgggctcaagcaattctcctgcctcagtttcccaagcagctgggactacaggtaagtgccaccacgcctggctaattcttggggggtttttttgttgttctggagacggagttttgctctgtcgcccaggttggagtgcagtggcaaggtatcggctcactgcaccctccacctcacaggttcaagcaattctcctgcttcagcctcccaagtggctggaattacaggtgcccaccaccacatccagctaattttttttgtattttttagtagagctggggtttcaccatgttggccaggctggtctcraactcctgacctcaggtgatctgcccaacttggcctcccaaagttctgggattataggcgtgagctactgtgcccagcctatttctggaatatttcatttaatattttcagacttgagattgaccacgggtaactgaaaccccagaaagtgagaacacagattggtgaggaccactgtgtgtaagatggttgtaagagccaaagagaaaaataaagaagacagtgtggccaggcgcagtggctcacacctgtaatcctagcactttgggaagccaaggtggttggattgctcaagctcaggggtttgagaccagcctggccaacatggtgaaaccccatctctaccaaaattacaaaaaagttagccaggcgtggtggtgcacacctgtagttccagctacttgggaggctggggtgggagaattgcttgagcccaggaggcaggggctgcagtgagccatgatcatgccactgcactgcaacctggccacagagctagaccctgtttcaaaaaagaaaaaaaaagaagtgtactgggaatggtggcttgtccctgtaatcccaaccacttgggaggcagaagcaggattgttaaggccaggagttcaagaccagcttgggcaacatagtctctaaaattaattatacaaagcttaaaaataaataatataaagaagaagatagtaggacctgtcatttcatgttggatcatcagagaaggcttkctgttacgtcacgtttgagcagagaccttaagaaagtaaggaaataaactatgcagattgttagggaagagcattccaagcaaacagaaaagcctatgcaaaggccttgaggtgggcaaatgccaatagagttggagtgcattaagctaggaaaaagagattaggtaggaagtggtacagattattctagaatcttgctcctcaaaatgtggtcctcagatcagcagtgttaatatcaggatctcatgatctgggagcttrttagaaatgcaggatgtcaaggcccaggatgtcaaagctgctgaatcaggaaatctgtattttaagaagattcccccaggcaatttggatgcaattataagcttgagaagcactgatctctagagcctcgtagatcatggcaaaaacttgaacttcagtgtgaatgaacttgaaagccattgggttttgagcatgggagtgacatggtctgacattttaaaagattcactggcgactgtgttgagcagagactataagaggcaaggagagaagcagggatactagttaagtggctaatacagtaataccaagtagattggactggagggatagcaggggaagtggtgataaaaygactcaggatatattttcaaagtagagcttttacaggaatgctgatggattggattggattatagggttagtaaaggaatytgagatgagaatgattacaaggctttttttttttttttttgacagtcttgctctgttggctctgtcacccaggttggcgtgcagtggcgtgatcttggctsgctgcaacctytgcctcccaggttcaagcaattytcatgcctcagccacctgagtatctaggattacaggtgtgcaccaccacgcctggctaattttttttttttttttttttttttttkaggcakagtctcgctctytcgcccaggctggagtgcagtggcaccatctcggttcactgcaagctccgcctcccagggtcacgacacctggctaatttttgtatttttagtagagatgcggttttgccgtgttgtccagtctggtcttgaacttctggcctcaagtgatctgcctgcctcggcctcccaaaatgttgggattacaggcgtgggccaccayacccggccttacaaggctttttgacttgagcaactagaagaatgaagttgccatttactgagatggggtagcatatgggarggagaggtttagattgttggttatgtgagtgcagagttcaagggagaggttgtcagctaaagatacacatttaggatttaatactcagcgtgtagacagcacttaaagccatgagattgcagtgagtgtagatggagaagagcagcagtttgaagaccaagacctgagacagtccagcatttagaggctaggaggatgaagaagaaccagtagaagaaattaagaagcagtcattggggcagaaagcgaatgaaggagctaaatggacgctaaataaagagagtgtttcaaaaacaaaagagaggtcaactgcagattaactactggatttattgatgtcatagtcactggyaaccttgacaaagctgtttcaggagatggtgggggcaaaagcctgctaggaataggtttttaagaaaatggaatgacagagattagagatgatgaatttacataatgtatttcttttaagatgggcagcattatgtgtgtctatattgagtaggaatgatcagagagggaaaagctgatgctgcagaaggaagagggaacagttgttggagcagtgcctttagtaggtaagagagtacgtgatctggtacacggggaggagatggctttatcagaacatggacagtttatccacagtagcaaaaaaaaaaggcagagtgtatgtatgggcatagatgcaactagtgcaggtaaatatagagcttggggcagttgaaagttctcttctgtctgcttctgtttcctcaataggaagggaaagcctttaactgagrgtgagtttgggaagaaggtcatggtgttatgagcagaggataggtgtgaaataattgcctagaagaaaacgaatagacttgggagtacgaatgcccacttcaggttagtagtcatgagtttaacgtaagactagtcagcttgtttctgtgtttttctyaggccatttttatttgtgtggtcacatgaatggagtaaccagaaagttgrtttaacctagatttgccaggggagtatgtgttgttgttgttgttaattagtggaataagttacaagtatcacagtatctaacaataggggaatagtaaattaagatagatataaggccgagtgtggtggcactgcctgtagtcccagctactcagaaggctggggcaggaggatcgcttgaacccagaagtttgaggctgcagtaagctatgatcctgcactgcacttcggcctgcgcaacacarcaaaccctgtctcaaaaaaaattgtttacaaaggtgtttttgttgttgttgttgttgttgttgctttttttttgagacggagtctcactctgtcacccaggctggaatacagtggcactatctcggctcactgcaacctcctcagttcaagcrattctcctgcctcagcctcctgagcagctgggattacaggcgcatgccaccacacctggcttttttttttttttttttttgkatttttattagagacggggtttcaccatgttggtcaggctggtctcgaactcctgacctgatgatccacctgcctcagcctacaaagtgttgggattacaggcgtgagccaccacgtctggcctacaaaggtttctaatacacttactgtaatgctaaattttaaaaagcatgacagagaagtgaatatgtgatacaagctcaacaatggaaatacgatgtatagaaaatggactgagaaaaattatgctgttataactgaatgcctgagactggatatttataatgaatagaaatttattggctcacatttttttctggagactgggaagtcccaaatcaatgcaccagtaactggcaagggccttcttgctgcattgtcacagggcagaaggcagaagggcacaagtgaacccactccccagagccctttttataatagtatgaatatatcggtgaggggttgggcacggtggctcacacctgtaatcccagcactttgggaggccgaggcgggcagatcacaaggtcaggagttcgagaccagcctggccaatatggtgaaaccccgtctctactaaaaatacaaaaaattagccgggtgtggtgacgcgtgcctgtaatcccagctactcaggaggctgaggcgggagaatcacttgaacctgggagccggaggttgtagtgasccgagatcgtgccactgcacttcagcctgggtgacagagcgagactccatctattttttttttttttwaaaaaagatggtgaaaccccgtctctactaaaaaatagaaaaattagctaggtgtggtggcaggcacctgtaatcccagctactcgggaggctgaggcactgaattgcttgaacccaggaggcrgaggttgcagtgagctaacatcatgccactgcactccagcctgggcgacagagcgagactccgtctcaaaaatatgtatatatatttgtgagggtggagccctcataacctaaacacctcccattagactccaccttccaacactgtcatgttggggattatatttccaacacatgaattatgaggggcacattcaaaccatacagcrtgctaagtgttgttctgactggtttgcatrsactatctcattcagttttgacatatatatatacatatatatatatatakatatatatayayayatatatataccattggtccttgaacaacgtgggggttagggatgacaacccctgtgcagtcaaaaatctgcatatgtaagttttgactgccccaaaacttaaacacttatagcctactgttgaccagaagccttacaagtaacataacagtttttttattttgttttgttttgtttttgacagagtcttgctctgtggcccaggatggagtgtggtggcgcgatctcggctcactgcaacctccacctgctgggttcaagtgattttccggccttagcctcccaagtagctgagactacaggcatgcaatattgcacctggctaattttgtatttttagtagagatggggtttcaccatgttggccaggctggtctcaatctcctgacctcaagtgatctgtccacctcggcctcccaaagtgctgggattacaggtgtgagccaccgcgtcgagccttaatacatatgttttttatgttatgtatattatttactatatttttgcagtcaagctagaggaaatgttattaagaaaatcataaggaaaatacatgttcagtattgtgctgtatttatcgacaccataagtttacatgatgaatcatgtaaaatggcaggcaaccacagctgcagacctccgtccatggtaccatatgaagcaatttggcttttcttgtaatgtcatgactcttttctgcttcttgggaacacttccagcatcactagkggcacttcattatgggtcccatggtgtyatgtaaggtttatgatactgctttagacacatgaaaaatacctgaggaaccacaggagatcacttcttgctgccatatgcaatttttgttttgagacagagtttcactcttgttgcccaggctggagtgcagtggcatgatctcgactcactggaacctccgcctccccgggttcaagcgattctcctgcctaagcctcccaagtagctgggattacaggcatgcaccaccatgcctggctaattttgtatctttagtagagacagggtttccccatgttggtcaggctggtctcgagcycctcacctcaagtgattcacccgcctcggtctccaaagcgctgggatttacaggtgtgagccagcgtgcccggtctgccatatgcagtttactggagagacgaactgctcactggaagatgattaacatctcagagtttttaagcagatacttgcaacatttgagctcaccatagtatcgacaagaggcggctatgaaattattacagtactacagtgtgtactgaagtgaattttatgcagttatgatttaatactgcatctttaggccaggtgtggtggctcgcgcctgtaattctagcactttgggaggcctaggcaggtggatcacctgaaatcaggagttcaagatcagcctggccaacacggtaaaaccctgtctctactaaaaattcaaaaattagccaggtgtggtaaatataaaaattagccgggtgtggtggcatgcatctgtagtcccagctcccagggtgactgaggtgggaggatcgctggaacctgggaggcagaagttgcagtgagctgagattgtgtcactacactctagcctgggtgacagagcaagaacctgtctcagaaaaacaaaaacaaataatattgcatctttatatttatttccgtttctcttgggctgtgaatgatgtcatgtactgtctgtgtttgtgtgtgaggttttttggtgttttttttttacatggggtctcactgtcacccagcctggagtgcagtagtgtgatcacagctcactrcagcctcagcttcctaggctcaagcaatcctcccgcctcagcctccagaacagctaggactacaggtgcaccccactgtgctcagctaattttttattttttgtggagatggggtcttgccatgttgcccaagctggtcttgagctcctgacctcaagtgatcctcctgcctcagcctctcaaagtggtggggttacaagtgtgaactatcacatccagcctgcatcaagttttgataagttttaactttataatagacatatatatttggccgggcacggtggctcaacccctgtaatcccagcacttcaggaggccaaagtgggcggatcacgaggtcaggagatcgagaccatcctggctaacaccgtgaaaccccgtctctactaaaaaagtacaaaaaattagcygggcatggtggcgggcgccggtagtcccagctactcgggaggctgaggcaggagagtggcgtgaacccrggaggcrgagcttgcagtgagccgagatcgcaccactgcactccagcctgggcgacagagagagattccgtctcaagaaaaaaaaaaaagacatatatattttatggtagtaaatgataaaatagactaggatctacataaattttatgcgttcatgacatatgtagctttaaaaaaaaattagccagatatgrtagagcatacctgttgttctagctactcaggaggctgaggcagcccgattgcttgagcccaggaatttaaggctgcagtaagctgtgattgtgccattgcactccagcctgggagacagagtgagactttgtctcaaaagaaagaaagaaaaaattccagtatatttactgaaaaaaattagcatattagtggacctacacaattcaaatcrtattgttcgaagattaattgtagacatacatakgtgccttacttttctccagtgagagggcytaaaggcagtaatactctaatagaaatgagtgcaagtaatgcctagaatttggcttctacataccattattccrtaatagccaggattccaccaagaatggttgattacaggactgggccagggaaaatacaagatgagcccagaacatcttttattttatttatttatttatttttgagatggtgcctcaccatgttgcccaggcggatcttgaactcctgggcccaagcgattctactgcctccacctcccaaagtgctgggattacaggcttgagcccagcccatctcatgatacaagacagtcagggaacaaaaatgaagggaggctgggtgcagtggcccatgcctttaatccgagtactttgggagtgttgggaataacactcaaaatcctaaggaaaatgaacattcaaacaaaggattcttaggaaagcaattttacttctctgcagaggggtgcctctccttggccagtcgccgtgaaagcacacctgaacaaaggggcacgagagcctttattcctgacgcaagtcctgcccctgtacccttttcccatttgccggggtcgggttgcacaattagcccaattggctaaacatctgaactttctttagataaggtgggcacataagggagagaggggaaaaggtgaaggggtgtctgcaatgatctagagagctagtcttctttccaaataagggaaggaatagtaatagtaagaaatagtaagaaagaaaataaagaaatagtaataaaggaaagctagtcttctttccaaataaggaaaggaatgtgagctggtactgataagcctggtactgtggcgtgtccaggcatgtaacaaaggcagaaacgaaaaaaagagaaaaaggaaaaaaggttgtgggggagtgctatgaattaaagaatagaggattgatcaggctatttgaagagaaacctcatcatatcccacaggaggctgaggcagcagatcagttgatcccaggagttcgagaccagcctgggcaccaaagtgagaccctgtcgctacaaaaaattaacagaaaaaaaaattagctgggccgggcgcagtggctcacgcctgtaatcccagaactttgggaggccgaggcaggtggatcatgagatcaagaccatcctggctaacatggtgcaaccccgtctctactaaaaataaaaaaaattagccaggcgtygtggcacgcacctgtagtccyagctacgtgggaggctgaggcagtagggagtaggcagtaggatcgcctgagcccaggaggtcaaggctacagtgagctatgtttgcaccactgcattctggcctgggcaacaaagcaagaccctatcttgaaaaaaacaaaaaaatggaagcatgttcaaaggacacaggccaagttgaaggagatygcagagaccaagtatgggacaatttgagcaggaaaataaatagtaatagtaatggattaaagcacagaataagacaaatatccctaagtccattctgctataaataagtgaataactaaataaagggaaagggacagctaatcgttacaatagcattcccattagtaaatgtagaaggaataatagagatagaaaatcaccatttagtaaacaccacagcagtaattgtggcaggcaagaatcattcatggatgcttcaattagtgggcaaaaatgtgatgtgaaacaggacatttacgtagtctgaaagtatcttcccacaaaaatactggttgcaaaggggaaaataataatgttacagtggagaaatgtggcagacactacgaagtgatcaaagttaacatcagcagtaataagacattcacttcatgcacctcttgatacgatgcctgaggaccaaccctcccttctgctgtaatcttacgaaaatacataacttcaatataatcgcgagaaaacaggccaacccaaattgagggacattgtacaaaataagtgacaagtactcttcaaagaagtgtcaagatgatgaaagataaagactggaggagaggaaggagacctgacaactaagtgcattgtgggatcctgaagcagaaaaaggacacaaataggataaactttttttttttttttaaaagatcctgagtttgtgttccctcctaactactgtaagttggacaagtcatataactactctaaggtgtaaagtaggcgtggtactgtctgcttttgctcaggtgtggtgaagctcaaacaaggctttaattgtaacacaaatataagatatcatcatcatyattttattttatttttttttgagatgagacggagttttgctcttgttgcccaggctggagtgcaatggcacgatcttggctcactgcaacctccacctcttgggttcaagcaattctcctgcctcagcctccctagtagctgggattacaggcgcctgctaccacacccagccaattttttgtatttttagtagagatggggtctcacgatgttggccaggctggtctcaacttctgaccgcaggtaatccacccgtctcagcctcccaaagtgctgggattacaggcgtgagccaccatgcccggctctcatcgtcattataggttacattgaagtgaactgtttgtctcttttttgtgattctaccaataaaagcaataaacctagttttctgccatggatagaatttactgaaaaggtttctcttccctccaaattgatttgttttttycatcttcatagcttttcaggctgcctttcgagctcaggggcccctggctatgctgcagcactttgatactatctacagcattttgcagtaagtgaaacacccaactggtactttaaaaagaactggtgactgtttgtcctaactgtgcatgttagtcctgaaattccaagttataggttcacygataaatgcctctggatattgatatctctgatgagcatgtacccagcttgccaccgtatttattcagttgaacaatttcacgtgtatttttaaacattcgattccaygggttagatctgatctgttagaaggggctctgcaggctccttcctgtctcacccccacactttctttccctcatagtcactttcgaagtatagatcctggcctcaaagaagatactctgsaattcctgataaaaggtgtttatgggtcagggrgtaggggatggaaggtgtttgttatcgtttgtttgtttgtctgtttgtttgtttttcctacattttgtcagccacatgatgatancaaggctgttgtgattcagttggtttggctaagcccagggacctttggcctgttaaaggtctgtaatcttggtgggcgatacagagttatgtgtgttcactgtaagggcagaccaacaagaactttttcctacttttgagctacctctttttaataggggtgattcttccagttgctggagagaaattgtggtaactggagtgagagagtaggaacagggcatgttcagggtatcagggccaagggtcctaaaggacttagcttgtgttatggccactgagagatgaaacacagatctttggtaatctgatggctgcaagtgctgggtgttttgaagttggggtatatgaaagaagtgagtgaaactgactccaagattctgcccctcacagtggtatcccrccactcccaggagcttccagctatcctggatgatacaactttgagtggatcagatagaaacgcccatctaaatgccctcaaaatgaactgttaygctctgatacgtctcctggaatcctttgagaccatggccagccagacaaaccttgtggacctggaccttggtgggaaggtaatttggagttttgggctcacgttatatggggtctggggagatasgggaatagatggaaaagaagggaatccaatgatccacaaatcctttctgtcctcattgagaatttaggagaaagaactcaaaagtgtcacacgttttcttcctggacaagtagcgctgtggaacttgtaatatttcttccgtattaccttctatgttgtcttggtactagattgtttgggcactcagactgacagatcttgacccacttttttcccttattttttcctcaatgtatacatgatcctttttagggtaagaaagctcggaccaaggcagcccatggctttgactgggaagaagagaggcaaccaattcttcagcttttaacacagctacttcagttggacatccgtcacctgtggaaccactcaataattgaagaagaatttgtcaggtgggtagggaggatggctacagataatactgagctgtgagagtgaggctctgttgatagatatgccgtttttttgkttttgttttttttttgtggggggacagagcttcactcttgtcgcccaggctggagcgcagtggttcaatctcggctcactgcagcctctacctcctgggttcaagcrattttcctgcctcagcctccygagtagctgggattacaggtgcccgccaccacaagctgatttttrtatttttaatagagacgggttttgccatgttggccaggctggtcttgaactcctaacctcaggtgatctccctgctttggccccscaaagtgctgggattacaggtgtgarccaccacgcccagccagaagtctatttttaaaataagtaaaataagtttgatggaagaaggttgtgattttaaatcagctactctaggcccggtgcggtggctcacgcctataatcccagcactctgggaggccgaggcgagtggatcacctgaggtcaggagttcaagaccrgcctggccaacatggtgaaaccttgtctctactaaaaaaatatgaaaattagctgtgcatggtggtgtgtgcctgtaatgccagctacttgggaggctgaggcaggagcatcacttgaacctgggagagggaggttgcaatgagctgagatcgcaccattgcactccatcctgggcgacaagagcaaaatcccgtctcaaaaaaaatagatagggccaggcgcggtggctcacgcctgtaatcccagcactttgggaggctgaggcaggtggatcacgaggtcaggagatcgagaccayggtgaaaccccgtctctactaaaaatacaaaaaaaaattagccgggcatggtggcgggcgcctctagtcccagctactcaggaggctgaggcaggagaatggcgtgaacccgggaggtggagcttgcagtgacctgagatcgcgccactgcactccagcctgggcaacagagcaagactccatctccaaaaaaaaaaaaaaaaaaagatagatagatagatagacagacagacaaacagacagacaagctactctagtaagacttctttgagatggtgacatttgagcaaagacccagaggaggtgactgagagctatgagaatatgtggaggaatagcaagggcagggaaaaggaatagcatatgcaaagaccttgaggagggagcgtgtccagcacgtacgagcaatagcaaggaggccagagagctgacagctgagagcaggtacgagggttaggccgtgaggccatgggagcagtggggagccagaccgcaggttyttgtgggccatcatggkgactttggcatttcctcagaatgaagtggagccactggggagccacaagcagggaggtgaggtgacctgacttgtacttcaacagggccatcctagctgttgtattgaaatcgactatggagggaaaggggaagcaagagaccagttaagaggctgttccaataactcaagcaagagatgatggtctcttagaccaaggcgtggcagtggagatggggagaagtagttggattctatactttttccttaaggtagagcttacaggatttgctaacagactgggtgtgaggtgggagggagagttcagtcaaggatgactctcccgggttttggtctgagcrtttggaagactggagttaatggtaactgagatagggagaaggctgtgaataggtgttttgggaggaagatcagatgttctgttttggacatacaaagtttgaggtgtttattagccacgtaaagtcagatttggacgttgaatatatagatctggagttcaggagagaggtctgagctagagataacacatttgggaatataatagtattcagagccgtgagactgaatgaaatyaccaaatcagtaagtgtagctaaaagagcaggaatccaaggactggtaccctagggcactccagcattaagagtgaggatgccgggtgcatggctcacgcctataatcctagcactttgggaggctgaggcaggaggatcacttgagcccaggagtttgagatcagcctggacaacatagtgaaactgtgtctctacaaaaaatagaaaaattagctgggcatggtggaggctgaggtgggagcatcacctgagctatgaggaggtcaaggatgcagtgagccgtgattgcaccactgcactccagcctgggcaacagaggcagaccctgtctcaaaaaaaagagtctgaggaggaactagccaaagaaactgagaaaggagtcttgttcttgtgtcctggaagcgagataaagcatatatttcaaggagaaagtgagtgattaactgtatcacatgcagctgtgaaagaccacttgagatgcagattgaatcagtcgttatatttaggaatgagaagtcattggtgactttgtcttttttttttttttttttgygatggagtctcgcaatgtcgcctggcctggagtgcagtggcatgatatcagctcactgcaacctccacctcccaggttcaagggattctcctgcctcagcctcccawgtagctgggattacaggcgcccaccaccacacccagctaattttttgtatttttagtagagacagggtttcactatgttggccaagctrgtcttgaatgcctgacctcgtgatccacctgcctcggcctcccaaagtgctgggattacaggcatgagccaccacacccggccaactctatcatatttttatgatatatttaggttctttgtcagcatcacaactggttgaaagttggtaatcttgaaggaaggagtacctaactggggtcagcaaagcaaagcaacttgttatagaaagtaatggctagaataaagaaaaccctgactttgggagcagtagggatagaatgaatgaggcagggctctgatacarttggatycagacagctgctttcatcatctcaaactcttcctttctcagtttggttactggctgttgctaccgccttctggagaatcccaccattaatcaccagaagaaccgccccactcgggaagccataacacacctgcttggtgtagccttgacccgttataaccatatgctcagtaagttaccagtcgctttgccccgccttttttgtattgcccataatttctcatgtttaatgcttccacaggtgctacagtgaagatcatccagatgctgcagcactttgaacacctggcacctgtactggttgcagccgtgagtctatgggcaactgactatggaatgaagagcatagtgggagagattgtaaggtgactcttccttctcgaagtttctcatgcttattttccttggggagggaataaagaaagattggaaatacattatctgtgcaacagtagattccttcagatattagatacctgtcttaccttcccttactgggaactgaataattgatctatgttgctatggctgtgttttcttccctgtgtagagagattggacaaaagtgtccccaagagctgagtcgagacccttcagggacaaagggctttgcagcattcctgacagaactagcagaacgtgtcccagctatcctgatgtccagcatgtgcattttgctagatcacctggatggagaagtaggtggtccactaggggtcactragctttttctggggattttaagtccagygttgaaaggctgtttcttaacagaacaagaaagtagctttgacaagttgtctagatttatcattgtgacatttcctttctgtagagaagcaggtcaagtttgttgaataaggagctctttattaatckgttaatctttcaattcacattgcttttatccagttctggtaagggagatgacatttctgcagcttaagtctagtaagagcaactcagctttgattttttttttttcttggaggtaggatctggctctgtcacccatgctggagcatgatcatagctcattgcagcctygatctcctgggctcaagcaatcctcccacctcagcctcccaagtagctgggacttcaggcacatactaccatgcctggctaatttttttagtttttgtagaggtggggtcttgccatattgcccaggctagtctcaaactcctggtctcaagcaaccctcctgcctcagcctcccaaagtgctgggattgcaggcgctaccatgcttagccttcagctttgattctgagtcccatctgttcctcaggataaagcgtcttcccaccagctggcttgccttgcttcctcaaacaatgaaytttcycaaatcaacccatgtcatctctctcaattctcttttatgcctgaatgctaacctggctgattcccatrctgatgttgggcactcctaggtgaatgtcaaggacaaagacagtccacttgttcatctcatttactttaactttttgtgcaagaccctattctctggttcttagcctggcaaaaccttaaccctgctctccactagattatgtattggacttgctggcactcttaaggctgatttccatgtttctgtctcattttctgtcagtaaagcatctgaaggagagtgggagggaaaggaggggatatttattagtaaggattaaagactttgaggccaggtgtggtggctcacgcctgtaatcccagcactttgggaggctgaggtgrgtggatcacttgaggtcaagagtttaagactagcctggccaacatggtgaaatcccatctctactaaaaatacaaaaaaaaattagctgggtgtggtggcgcgcacctgtaatcctagctactcgggaggctgaagtgggagggttgcttgaacctgggaaatggaggttacagtgagccragatcgcaccactgcactccarcctgggtgacaaaacgagactctgtctcaaaaaaaaaaccaaaaaaaaccacacagacgggcgcggtggytcacgcctataatctcagcactttgggaggccgaggagggtggatcacgaggtcaggagtttgagaccagcctggccaatatggtgaaatcctgtctctactaaaaatacaaaaattagctgggtgtggtggcgggcacctgtaatcccagctgcttgggaggctgaggcaggagaatcacttgaacccgggagtcagaggttgcagtgagccgagatggcgccacagcactccagcctgggcaacagagcaagactccgtctcaaaaacaaacaaacaaccacaataacaaaggctttgagacctcagctgaagggtagttaataaatgcttttcaaatgtgtgttggtgagtggatgtgatttttttattcagctactaccatgctttcctgtgtgagccctatgaggaaaaattggttttggcccttgttctagcattctytgagcaacaagtcctctttgggattcagctttctcctgtgaccttgggagtgaatacctaggcagttaatggaaaaagttatggccaagcacaagcaagcttcgccttgactaaaggtttgacccctctatgcttctctctcttagaattacatgatgcgtaatgctgtgctggcagccatggcggagatggtgctgcaggttctcagtggcgatcaactggaagcagcagcccgagacaccagagaccagttcttggatactttacaagcccatggccatgatgtcaactcctttgtgcggagccgtgttttgcagctcttcacccgaattgtccagcagaaggtaaccarcttmtatgtggcaaaaacatatggtacctctccatataccagtgtaaagaggaatccagtgttgaagataaatatctgccccaaagaggtctagaattcacatttttattatcagtagtaaaagtcttcctctaccaaggacgaggatatctggctccctttaaggactstaatgtgtcttaccactacaaggagtactcctaatctatattctgtagaaagggtttttagagtgagtgggtagctcagtttagagtatacttaaagatcatcttgaacaaaatggatgatgtgggacttgagcagattcttctcttcctaccctacacaggctctccccctgacacgtttccaggcagtggtggctttagctgtgggacgtctggcagacaagtcagtgctagtatgtaaaaatgccatccagctgctggccagttttctagccaataatcctttctcctgcaaggtaagtagacttggtccaccaaaagagaaggaattaaatggaaacagggatgaaattatgtcatttactgaccctgctattcattttacctgatagcttastgatgctgaccttgccggaccactgcagaaggagacccagaaattacaagagatgagggcccagaggcgaactgcagcagcttgtaagtagttactgccttggagtcctaatgccagacaggcttctccttgcagtcagaaactctagtgaaagagactaagtgacactctcatttagctgcagtgctggacccagaggaggagtgggaagccatgctgccagagttgaagtctaccctgcagcagcttctacagcttccccagggagaggaggagattcctgagcaaattgccaatacagagacaactgaagatgtgaaaggacgcatctatcaactgcttgccaaagctagttacaagtaggcaaaagaatgggatattcttcgtgatctgtttatgtttagagttaacctttgagaaacttacataatgtgtcttttaaattaactgcacacagatatgctgccaccaggtgatggtagatgttttcatgtagtaatggtctgaccataggcctagtccacaattaagcatgtgtttctactttataaatgtttaaaaaaactactgaaacaattaaatgttaacartattataatcaaacatgagtmctccttcaattgaagaagagcacctataaataagttctagttgtatgatcttgaataagttgcttaactttctgtgcctcggtttcattatctataaaataagaaattgattagatyttatgatctctaaggactttctaattctaaatttcatgaactaataatatcaaacatgcttaatactaccttaatyttcaaacctagtatgaatcctgatcttagagaaaagatttctcctagtgtttttgtgactctagaacttaacaacaaaagcccttacagccgtcaacaagtttttkktttttttttttttttttttttttgagatggagtctcactcactctgttgcccaggctgcagtacagtgacaygatcttggctcactgcaacctctgcctcccaggttcaagcaattctcgtgcctcagcctcccaagtagstgggaccacaggcgcgcaccaccacaccgcactaatttttttatttttagtagagacagggtttcaccatrttggccaggctggtcttgaactcctgacctcaggtgatccacccatctcagcctcccaaagtgccatgattacaggcgtgagccaycgcactcggctgccaacaagtattcttaaacctcagccacaagttatttgttatttatttacttcttacctaattgggctgaattttttttttggagacggagtcttgctctgttgcccaggctggagtgcagtggtgcgatcttggctcactgcaacctccacctcctgggytcacgccattctcctgcctcagcctcccgagtagctgggactacaggcgcccgccaccacgcccggctaatttttttttttatatttttagtagagacggggtttcaccgtgttagccaggatggtctcaatctcctgacctcgtgatccgcctgcctcggcctcccaaagtgctgggattacaggcttgagccaccgtgcccggcttgggctgtttttagaaggctagagagtggcttgtttgccctatgactcccttatgttactttagtgtctctctttttattttgctaaagcaaaaatagagactatagttttataagtgcatgttccaccaagcattctagtattttctcctgtcaattagaaaaggattgtttgtttttgagacagaatctcactgttgcccaggctggagtacagtagcgcaatcacagctcactgcarcctctcactgtagcctcaaccctgctgggctcaagcgatctcccacattakcctcctgagtagcctggttaatttatttataatttgtagctgggattrcaggtacacaccaccaggcctggcctttgccagcctgggcaacgtggcaagaagataacatgtagacaagcagtcaaacatgtattctttttttcccccttttatatgactgatagaattctctgcccactgatctaccatcttgtttttttcacttaactatgtgtctcagtggtttttaaaaatatttatggctgggtgcaatggctcatgcctgtaatcccagctacttgggaggctgaggcaggagaattgcttgaacccaggaagcagaggttgcagtgagctgagattgctccgctacactctaccctgggtgacagaggaagagtccatctcaaaaaaaaaaaaaaatttatagatggccaggtgcagtggctcacacctgtaatcccagcaccttgggagcccaaagctgstggatctcttgaggccaggagtttgaggccagcctggccaacgtggcgaaatggcgaaacccatctctgctaaaattacaaaaattggccaggtatggtggcacgtacctgtaatcctagctatttggggagctgaggcatgagaatcactcraacctaggaagcagaggttatagtgagccaagatcatgccactacacttcagcctgggtgacagaacaagactctgtctctaaaaaaaaaaaaaatatatatatatatacacatatatatttatacataaatagtttcccactctcctctttttttgagagagagagtgtctcactcttttgcccatgctggagtacagtggtatgatcacaactcactgcagctttgatctcccaggctcaagtgatcctcccacctcagctccctcgagtagctgagaccacaggcacacaccatyacacccacaggcacacaccatcacacccacaggcacacaccatcacacccacaggcatacaccatcacacccacaggcacacaccatcacacccggctaactttttttactttttgtatagttgggtctccctgtgttgcccagactgatctcaaattcctgggctcacgtgtccccattattttttatgactacatagaatcttattgtctggatgtgcctgaattaactaattattgaaagtttattgtttctaaacttaggaaagtttttaaacaggtgtttggagtaggtttatgattttaaaactttaaaaagccttattggagtttttttgaagactgtagtaatgccttgtaggttcagaaataggaaaagtgtttgcagatgagcagtcaggggaaaaaaataggcaaagtgttttgagccctaccccttagtaggtgctgtaacaactttttaagcatgttaagtgctccttttctctgggcagtaggtccagggacttgatagaatcatgaggtaagctcccttacaaacggctgcagtgacattcttctgggtactgacaggctggtgttctttcagaaaggccatcattctcactcgagaagccacaggccacttccaggagtccgaacccttcagtcatatagacccagaggagtcagaggagaccaggctcttgaatatcttaggacttatcttcaaaggtaatcattttccttcttcagtcaataaataacacatgtcaactggtatttactgagcattaactttatgccatcattggcctggttaacagaacctggtgctgaagagcccagagatgaattggcattacttttgctctggaatggaagcagcccacgggcctaagattgatagtcacagggtgactgtccagaccatagcggtctttaggtatggtttttgagaaatttagatattttagagtaagttttaatttcatatcttcacattgtgaaaagagatatccagggccagatgtcgtggcttatgcctgtaatcctaacactttgggaggccaaggcaggaggatygcttgagcccaggagttgaaaatcagcctgagcaacatgacgaaacccccatctctacaagggataccaaaaaaaaattagccaggtgcggtggcacgcacctgtagtcccaactgctcaggaggctgaagtgagagaatcaccttagcccggggaagttgaggctgcagtgagcggtgatcattgccactgcacagcctaggcaacagagtgagaccccatctcaaaagaaaagaagaaggaaaataaataagtaaatatccaggaatgttgacagctgttggattcccctgtatccccttgaacgaaaccatcctgtacttctctaactccttaggcccagcagcttccacayaagaaaagaatccccgggagtctacaggaaacatggtcacaggacagactgtctgtaaaaataaacccaatatgtcggatcctgaggaatccaggggaaatgatgaactagtgaagcaggagatgctggtacagtatctgcaggatgcctacagcttctcccggaagattacagaggccattggcatmatcagcaagatgatgtatgaaaacacaactacaggtatgccagagtccctttctataaggacagccttggggttcttttggattttttaattttttaaatttttattaacaatagagatggggccttcctttgttgctcaggctggtctccaactcctgggctcaggcaattcttctgcrtcagcctcccaaagtgctggtattacaggtgtgagccactgcacccggccatggatcttggagttcttttccatattttattgatatatctatctgctcctttaaaaggcaggggttctcggctgggcgcgatggctcatgcctgtaatccctacaaaactgggaggccaaagcaggaagacaggttgaggccaggagttcgagagcagcctgggcaacatagcaagaccccatctctacaaagaaacaaaaactaactgggcgtgatggcacrcacctgtagttccagctactcggaaggctgggcaggaggattgcttgagcccgggagtttgaggctacagtgagctgtggtcatgccactgcactctagccrgagcaacagaataagaacctgtgtcttaagaaaagaaaaaaaaaaggcaggggttctttttttctgtttgcttcctctagccacttacagcttatacattttaatgcatatagtatttcatgataaggcatcataggaggagtcgacattctcagggaaaatrcggaaggcctccatttgcatcttgctacattcagaaaggttctgtcgttaggtattgggggagttttgtgaagtagataggtgacatttgtacatgttctctcagtggtgcaggaggtgattgaattctttgtgatggtcttccaatttggggtaccccaggccctgtttggggtgcgccgtatgctgcctctcatctggtctaaggagcctggtgtccgggaagccgtgcttaatgcctaccgccaactctacctcaaccccaaaggggactctgccaggtatatggggtgcttttgcctttgctgacttttccaaggtcagcttctcacaggacttcccttgtctcctaaaggaagaggtgcatttctccaggggagttccagatccataggcagtccatcatagtggggcttagggtggggctcggtttccagggagagcagttttgtagcactgtggtgggatagccctaatcactgtttgccaagttcagcttcccaatcttatagtgaccgctgatctctgctgttcccacagagccaaggcccaggctttgattcagaatctctctctgctgctagtggatgcctcggttgggaccattcagtgtcttgaggaaattgtaaggcttcctgctttctctttctttattcattcaacaagtattttggwtgttttttttttttttttttgagacggagtcatgccccattgcccaggctggagtgcaatggcacaatcttggctcactgcaacctccgcctcccaggttcaagcaattctcctgcctcagcctcccgagtaactggaattacatgcatgtgccaccatgcccgactagttttttgtatctttagtagagacggggtttcaccatgttggccgagctggtctsgaacccttgacctcgtgatccacccgcctcarcctcccagagtgctgggattacaggcgtgagccaaagcgcccggcaacaagtattattgagttattactatgtatttagcaatttacttagctccagaaagaagtatargactatttgctttcatgttcccaactttaaaggaaccaacagtmtagttggtagtgaaaaaccacagaacatttttagaacaatgcagcaggtagataataaagtgccagaatgagttgtacgggtaatggttgtcatagcaataataacaacctcacttatatggtattgaatatatgacaggcactcacacgttactcacagtaacttgtttaatcctcacgacagccctgtgaggtagcattatctgcattttacaatgagaaatctgaggcacagagaagttactgaacttggctggttacagctagttagtggcaaagtttgagattcaaactcaggcaataagagctctagaaaacatactcttaacttctgtgttctactgagggatacagagtaggaaagagagcggtttggggtagaatggtcaaggaagcttcctgaaggtggtaggacttaagctgggtcttgaaagatgagtaggatttagagaatcagagcaaggagggagggcatttcaaacagaacccaagaaagagcacagttcacattgtagaacaaagaagactgtgttytggttcaaattatctggaaaagaccaggcgcgatggctcacgtctgtaatcccagcactttgggaggccaaggcagcagattacctgaggtctgaggtcaggagttcgagaccagccyggwcaacatggcgaaaccccacctttactaaaaatacaaaaaaattagccaggtgtggtggtgggcacctgtagtcccagctacttgggaggctgaggcaggacagttgcttgaacccaggaggtggaggtagcagtgagccgagattgcgccactgcactccagcctgggcgacagagggagactctgtctcaaaaaaaaaaaaaaaaaaaaaaatctggaaaagataataaagttgtgaatgtaggttggaactaaactgtggaagtccctgaatgacttcaggagtctaggactttaactgtgttagccaggcacccagcattttagtgagacattctgctttgtagcatttgcattgcgggcacagagagtggaggtggcgctgggaagcgtgctcctgccagccacatttttctcctcactggggaaaagaaaagagcctggtggtggtgattggccatgatgtcataggtcagttaccggcaaaagccctacaagaggcaggggagagcacctgcaaactggggtgcaacagaagggacgtggggaagcagaggctgaggagaccaacccatgggaaggaaggcccgtggaggctgctgcagtgggcagtaacgaggggctggacttgaggattggagaaatcactgcagaatgggcttaatggaagayaaatttttaaaggaaaaatagtgactgatttgtaaaaaaattagatgaccgaaattttaagcacatattactgatagagtgttgataccactggcaaaatgaaaaggcaaggaaggatgatggcttccatgttggacatgttgagtttgtggtaacggcaagaaaacctgttagaaatctccagacttagaactatggacccacgtggaactcaaaaggtcagtttcgatatgtcacttgaataaaatagttttgaaggcatgagagtagaaaagtagagaatggaaagcctctcaagaccctgctgtacattttgaacctcctcttttctttttctcttcctaagtattacttttgtctacttcaggttcgcaatatcatcttcagaaaagcagaccaaagatcaaggaattgttcatttttggcttgagccctttttcttttctctttagctctgtgagtttgtgcagaaggatgagttgaaaccagcagtgacccagctgctgtgggagcgggccaccgagaaggtcgcctgctgtcctctggagcgctgttcctctgtcatgcttcttggcatgatggcacggtgaggctcaaatctagcaggcaatggggtgggagagcaaaggaaggttctgagagggctccttttccttcrgtgacattgtcacagtgaggcccaactgagctctgctgtgagttataacgccacctaaatggaaaagcaaatagtgagaggaccagccctcctgcctagtagtagtgggattcagtaaagcaacaggacccaagaggctggccctgcggcagagccacgctatagtgctccacggctctagacaccacatgaggtgctggtacctacccctattggccctttctcccccgatgagtccaatccatgactgcctttaactctgtggcttccttcccctagaggaaagccagaaattgtgggaagcaatttagacacactgrtgagcatagggctggatgagaagtttccacaggactacaggctggcccagcaggtgtgccatgccattgccaacatctcggacaggagaaaggtatgtgrgggtggttccaaactaaggagagtggagattctcgtgtccaccctgtacacacacccacgttgtcttgctctccacagccttctctgggcaaacgtcacccccccttccggctgcctcaggaacacaggttgtttgagcgactgcgggagacagtcacaaaaggtgagctctcagggaaggccttgggcagawttgggccctttgttgcagtaaacaacttctccctcctcctctgcaggctttgtccacccagacccactctggatcccattcaaagaggtggcagtgaccctcatttaccaactggcagagggccccgaagtgatctgtgcccagatattgcagggctgtgcaaaacaggccctggagaagctagaagagaagagaaccagtcaggaggacccgagtaagtgggcaggggttgacccactgcggcagccagcttctgttctccctgcagggccaggagccactgccaccaccactatctgcaacaacccttagtgtacactgtgtcgtttttgtctaagttgaagttgggccagttcccacccccaactcttactacttcactagtttgaatagcacgtgagcaaggggaagatcagtaaaaatcggattcaggtttgatgggacttaaaaatgtctctttgccccaccttccctctccctctcctccagaggagtcccccgcaatgctccccactttcctgttgatgaacctgctgtccctggctggggatgtggctctgcagcagctggtccacttggagcaggcagtgagtggagagctctgccggcgccgagttctccgggaagaacaggagcacaagaccaaagatcccaaggagaaggtgtgtgaatgtcctcagcacttcccagatttatttcatacctcagctcagaactgagctgatccccttccggcaatctctgctcctctgctattacatgaagcgaagagtttctgcctctctgtggctactaccgtaggaaaggttcgtgtgaacaatgacraaactgtcagtgatcacccaggaaggaaagatttaggtaaatgcagagtgtggagttagagacctcagcataaaacagaggctttgtgtctgaggcagggtttgttagaacacgcacgtacccgccggccttttccatcagcttccattgctggcctggccccggatggggccctgtgttccctccactagaggcaatgatgtcttgcagacaaataagacacagagccttgcagcgctggagaaaagtctgacctctgtgactttgaaccattgtctggcgtgatccatctgtttaccatatataggaaacgatgtcttccatgaggaagaggtgcagaaacacgctttggcaacttaaaacaaatggggacctcattgttcccctgcttaattcaggaatcctttctctttacagacacatttgacaattctctaaatgtttttgtagaatttgcccttcctcactttgttcatgcaaaacaaagtatgggctggaatcaaaaatgttgtctctgcttatccatgatccccaatttcattccctttagaatacgagctctgagaccaccatggaggaggagctggggctggttggggcaacagcagatgacacagaggcagaactaatccgtggcatctgcgagatggaactgttggatggtaagaaaaatggctgcactcagcagtttcttcccaattaagataacctgtcccaaacctgcagttactcttccaacaggcaaacagacactggctgcctttgttccactcttgcttaaagtctgtaacaacccaggcctctatagcaacccagacctctctgcagctgcttcacttgcccttggcaagttctgcatgatcaggtaggccgtggggttggtacccccttctcaaggaagatggggatgaaatggcttccctaatgatcctcttcttgctcttagtgccactttctgcgactcccagcttcgtcttctgttcaccatgctggaaaagtctccacttcccattgtccggtctaacctcatggttgccactggggatctggccatccgctttcccaatctggtggacccctggactcctcatctgtatgctcggtaagagacccctcacaacgtggtggcagttcccaggagccccggagtctgttgagagtcagtgtgagaatcaccagggctcttcccctaggctttggcatcaccgcgaacatctgcttgatacttgacctgtacaggcccctggctaagagtcaccccagtgggactgacacttctggttagaagcttcacctctttcccccactccagctttcaactctagacagctttctgactgcttctggagtggcagagcaygggataattgattcctgctgagggccttttctaccagtgttagggtgtagcccggaggtctcggtccccatgacccgcaattccattcctagyctccgggaccctgctcagcaagtgcggaaaacagcggggctggtgatgmcccacctgatcctcaaggacatggtgaaggtgaaggggcaggtcagygagatggcggtgctgctcatcgaccccgagcctcagattgctgccctggccaagaacttcttcaatgagctctcccacaaggtgagaggcagagaggcactgagggctggctgcagagggaatctgtaggtcacctcatctccttaacatggytctctctgtcttacagggcaaygcaatctatratctccttccagatatcatcagccgcctgtcagaccccgagctgggggtggaggaagagcctttccacaccatcatgaagtattgctccccgggccctggggcacattttccacatagcaygggcttaggaatcagacacacctgtatttgaattccacctcggctactctttagctgtacagccttcggcaataacttagcctctctttgtgcctatttcctnttcttttgaggctgatgatacttaacccttagttcttgaaaatattaaatacgataaagttcctaacatggtggcagacatacagtagcactcactccctagcagctgctcctgttaatttccattcacagtgaaaattcctgagccgggggcggggtggggtccctctctgctgaatgggacagggcaaggggagtggtgaggcagacaggggccgtggcagagaacatcagagaagacgagtgctgggggagggtccagggttggtcttagtggatggcagagctggccctgggccatcraacatcctcatctycccttcctgcagacagctcctctcctacatcaccaaggacaagcagacagagagcctggtggaaaagctgtgtcagcggttccgcacatccckgtatgctgccctccctgagggttctttgtgctgagcggggccctgcaggggagaaaggcccatccctcaccccttcaatgcccccactgtggcatccctgggactggggaggctgatggggaaggttgagcctytactagctggatctcccagttcctcacaaagcccttcctatctgcagaactgagcggcagcagcgagacctggcctactgtgtgtcacagctgcccctcacagagcgaggcctccgtaagatgcttgacaattttgactgttttggagacaaactgtcagatgagtccatcttcagtgcttttttgtcagttgtrggcaagctgcgacgtggggccaagcckgagggcaaggtgagcagcacaggacacttcaatgcctgttgggttctgggctggctaagacatctgccggccctgggcagcatacggctcttgcagtcaccttcccgtcctccttatccccagctgggttgcaaccaaattgccagagtgacctaagaccagatctttgtctccagttctttttttattactccaaaaacacaaccaaagcagcatctcatccaattcttgtttgtttgtttttaatagtttttatttttcagagcagttttaggttcaaagcaaaattgagcagaaagtacagggagttcccttctaccccttgcccctacacatcacagccttccccaccttcaacatcctgcaccagggtggcacatttgttacagctgaacctacacttacacatcatctcctaaagtcatggtttaccttggagttcactgcacgtaatgacatgtacccaccattgcagtatcatacagaagagtttcactgccttacaaatcccctgcactccacctatttatccctctctccccacaacccctgatctttttactgttgccatcactttgtcttttccagaatgtatcattggaatgatccggtatggagccttctcaccttggcttcttagtaatgtgcgtttaaggcctccatgtcttccatggccttgtttctttttaatcagaagtaactgttttcaggcctgctctgaatctccttttctccctccaggctataatagatgaatttgagcagaagcttcgggcctgtcataccagaggtttggatggaatcaaggagcttgagattggccaagcaggtagccagagagcgccatcagccaagaaaccatccastggtacgtaaggcagcctgtgcgggcgagaccagactgggccctcccctcctgcagtgatttgtttcttcttcttttttaaatcacgttttcctgccttttctaggttctaggtaccagcctctggcttctacagcctcagacaatgactttgtcacaccagagccccgccgtactacccgtcggcatccaaacacccagcagcgagcttccaaaaagaaacccaaagttgtcttctcaagtgatgagtccagtgaggaaggtatgatgctcccgcctgttcccgrccgagaaggcacacagctagggtgcagagggctggtttccataggacctgctgcgggggcctgagtgtasatgctctgccccactgccgcagaagggcctctcctgtacagcttggattttatttcttctgtgcggtgtgggattgtctcacttgttctctgatatctattttttyaccatctttgtgactcagctttttcttattcctttaattctttgcatagatctttcagcagagatgacagaagacgagacacccaagaaaacaactcccattctcagagcatcggctcgcaggcacagatcctaggaagtctgttcctgtcctccctgtgcagggtatcctgtagggtgacctggaattcgaattctgtttcccttgtaaaatatttgtctgtctcttttttwwaaaaaaaaaaaaggccgggcactgtggctcacgcctgtaatcccagcactttgcgataccaaggcgggtggataacctgaggtagggagttcgagaccagcctgaccaacatggagaaaccccatctctactaaaaataaaaaattagccgggcgtattggcgtgcgcctgtaatcccagctactcaagaggctgaggcaggagaatcgcctgaacccagaggcggaggttgtagtgagccgaaatcacaccattgcactccagcttgggcaacaatagcgaacctccatctcaaattwaaaaaaaaatgcctacacgctctttaaaatgcaaggctttctcttaaattagcctaactgaactgcgttgagctgcttcaactttggaatatatgtttgccaatctccttgttttctaatgaataaatgtttttatatacttttagacattttttcctaagcttgtctttgtttcatctttcacattagcccagtttcatgcagcagagagagggttatcagtgcagagagagatgagtgagcccagagtcctagggcctgtcccgggatggcagatgagcttcctgccccgtcactgccacctttcccctctcaacctctggaccctgcacagtgaccagacagcctctctggggagaattatgcagtgcctaggctccagatcagtgcttctgaaccgggggcaattttgtctgccagaggacatctgacaacacctggggcctgttttgttgtcatagcctataggggaagaatgctaccagcatttgtgggaagaggccagggatgtggctcaacatcctgcagtgcacaggatggcccctcaacaaagaatcacacggcccacaatgtcaatagcgtcacagttgagaaaacctgctctagaccaagggttgctttctgccgtgtgcctcaccccacccccactcgtgttccctaatcccatctccaaaggttggcagcagaccggcccaggctcgtggaagttcagatcatgatcccctccagctctgcaggagacaagacctgtctcccagcattcctcattgttcccgggtctgcagagggcgtgagctatgctgcaggcgggctgccccctgaagcctgcgcacccctctccagctcctcaagtcttctctgctgagtcaccttcgaaccggaggctgtgagctggctgtcgtgacyacactggtgcctctgctgtcatgacaacagcacactacgtcagtagtgctccctgggcactgagctccctctttgcggggagaagacagtaatgaaaaatgacaagcatgaggcagaggggaagatcacgcttgggtggtgcaggagcatggaggtgctcttaatgctctcaatgagaaagggttaacggtcctggttgcaggaatagctgagtcagaggtggggcttcctccactcccccaccccacccctttcaccattagggaccttcttgccttgctcttgctactctgctctgggtggtcattgtgaaaagcccgcaccaaccatgccagtggcagccagacgaggacacagcctggctctgggtcccagcaggaaaggcaatcccagaaaggcagggtcagggactggagtcctgtgggtgctttttaagcaaagattatcaccaggcaggctaaacttagcaaccggcttttagctagaagggcagggggctggtgtcaggttatgctgggccagcaaagaggcccgggatccccctcccatgcacctgctgatgggccaaggccaccccaccccacccccttccttacaagtgttcagcaccctcccatcccacactcacaaacctggccctctgccctcctaccagaagaatggatcccctgtgggagggggcaggggacctgttcccaccgtgtgcccaagacctcttttcccactttttccctcttcttgactcaccctgccctcaatatcccccggcgcagccagtgaaagggagtccctggctcctggctcgcctgcacgtcccagggcggggagggacttccgccctcacgtcccgctcttcgccccaggctggatggaatgaaaggcacactgtctctctccctaggcagcacagcccacaggtttccaggagtgcctttgtgggaggcctctgggcccccaccagccatcctgtcctccgcctggggccccagcccggagagagccgctggtgcacacagggccgggattgtctgccctaattatcaggtccaggctacagggctgcrggacatcgtgaccttccgtgcagaaacctccccctccccctcaagccgcctcccgagcctccttcctctccaggcccccagtgcccagtgcccagtgcccagcccaggcctcggtcccagagatgccaggagccaggagatggggagggggaagtgggggctgggaaggaaccacgggcccccgcccgaggcccatgggcccctcctaggcctttgcctgagcagtccggtgtcactaccgcagagcctcgaggagaagttccccaactttcccgcctctcagcctttgaaagaaagaaaggggagggggcaggccgcgtgcagccgcgagcggtgctgggctccggctccaattccccatctcagtcgytcccaaagtcctyctgtttcatccaagcgtgtaagggtccccgtccttgactccctagtgtcctgctgcccacagtccagtcctgggaaccagcaccgatcacctcccatcggrccaatctcagtcccttcccccctacgtcggggcccacacgctcggtgcgtgcccagttgaaccaggcggctgcggaaaaaaaaaagcggggagaaagtagggcccggctactagcggttttacgggcgcacgtagctcaggcctcaagaccttgggctgggactggctgagcstggcgggaggcggggtccgagtcaccgcctgccgccgcgcccccggtttctataaattgagcccgcagcctcccgcttcgctctctgctcctcctgttcgacagtcagccgcatcttcttttgcgtcgccaggtgaagacgggcggagagaaacccgggaggctagggacggcctgaaggcggcaggggcgggcgcaggccggatgtgttcgcgccgctgcggggtgggcccgggcggcctccgcattgcaggggcgggcggaggacgtgatgcggcgcgggctgggcatggaggcctggtgggggaggggaggggaggcgtgkgtgtcggccggggccactaggcgctcactgttctctccctccgcgcagccgagccacatcgctsagacaccatggggaaggtgaaggtcggagtcaacgggtgagttcgcgggtggctggggggccctgggctgcgaccgcccccgaaccgcgtctacgagccttgcgggctccgggtctttgcagtcgtatgggggcagggtagctgttcyccgcaaggagagctcaaggtcagcgctcggacctggcggagccccgcacccaggctgtggcgccctgtgcagctccgcccttgcggcgccatctgcccggagcctccttcccctagwccccagaaacaggaggtccctactcccgcccgagatcccgacccggacccctaggtgggggacgctktctttccttycgcgctctgcggggtcacgtgtcgcagaggagcccctcccccacggcctccggcaccgcaggccccgggatgctagtgcgcagcgggtgcatccctgtccggatgctgcgcctgcggtagagcggccgccatgttgcaaccgggaaggaaatgaatgggcagccgttaggaaagcctgccggtgactaaccctgcgctcctgcctcgatgggtggagtcgcgtgtggcggggaagtcaggtggagcgaggctagctggcccgatttctcctccgggtgatgcttttcctagattattctctggtaaatcaaagaagtgggtttatggaggtcctcttgtgtcccctccccgcagaggtgtggkggctgtggcatggtgccaagccgggrgaagctgagtcatgggtagttggaaaaggacatttccaccgcaaaatggcccctctggyggtggccccttcctgcagcgccggctcacctcacggccccgcccttcccctgccagcctagcgttgacccgaccccaaaggccaggctgtaaatgtcaccgggaggattgggtgtctgggcgcctcggggaacctgcccttctccccattccgtcttccggaaaccagatctcccaccgcaccctggtctgaggttaaatatagctgctgacctttctgtagctgggggcctgggctggggctctctcccatcccttctccccacacacatgcacttacctgtgctcccactcctgatttctggaaaagagctaggaaggacaggcaacttggcaaatcaaagccctgggactagggggttaaaatacagcttcccctcttcccacccgccccagtctctgtcccttttgtaggagggacttagagaaggggtgggcttgccctgtccagttaatttctgacctttactcctgccctttgagtttgatgatgctgagtgtacaagcgttttctccctaaagggtgcagctgagctargcagcagcaagcattcctggggtggcatagtggggtggtgaataccatgtacaaagcttgtgcccagactgtgggtggcagtgccccacatggccgcttctcctggaagggcttcgtatgactgggggtgttgggcagccctggagccttcagttgcagccatgccttaagccaggccagcctggcagggaagctcaagggagataaaattcaacctcttgggccctcctgggggtaaggagatgcygcattcgccctcttaatggggaggtggcctagggctgctcacatattctggaggagcctcccctcctcatgccttcttgcctcttgtctcttagatttggtcgtattgggcgcctggtcaccagggctgcttttaactctggtaaagtggatattgttgccatcaatgaccccttcattgacctcaactacatggtgagtgctacatggtgagccccaaagctggtgtgggaggagccacctggctgatgggcagccccttcataccctcacgtattcccccaggtttacatgttccaatatgattccacccatggcaaattccatggcaccgtcaaggctgagaacgggaagcttgtcatcaatggaaatcccatcaccatcttccaggagtgagtggaagacagaatggaagaaatgtgctttggggaggcaactaggatggtgtggctcccttgggtatatggtaaccttgtgtccctcaatatggtcctgtccccatctcccccccacccccataggcgagatccctccaaaatcaagtggggcgatgctggcgctgagtacgtcgtggagtccactggcgtcttcaccaccatggagaaggctggggtgagtgcaggagggcccgcgggaggggaagctgactcagccctgcaaaggcaggasccgggttcataactgtctgcttctctgctgtaggctcatttgcaggggggagccaaaagggtcatcatctctgccccctctgctgaygcccccatgttcgtcatgggtgtgaaccatgagaagtatgacaacagcctcaagatcatcaggtgaggaaggcagggcccgtggagaagcggccagcctggcaccctatggacacgctcccctgacttgcgccccgctccctctttctttgcagcaatgcctcctgcaccaccaactgcttagcacccctggccaaggtcatccatgacaactttggtatcgtggaaggactcatggtatgagagctggggaatgggactgaggctcccacctttctcatccaagactggctcctccctgccggggctgcgtgcaaccctggggttgggggttctggggactggctttcccataatttcctttcaaggtggggagggaggtagaggggtgatgtggggagtacgctgcagggcctcactccttttgcagaccacagtccatgccatcactgccacccagaagactgtggatggcccctccgggaaactgtggcgtgatggccgcggggctctccagaacatcatccctgcctctactggcgctgccaaggctgtgggcaaggtcatccctgagctgaacgggaagctcactggcatggccttccgtgtccccactgccaacgtgtcagtggtggacctgacctgccgtctagaaaamcctgccaaatatgatgacatcaagaaggtggtgaagcaggcgtcggagggccccctcaagggcatcctgggctacactgagcaccaggtggtctcctctgacttcaacagcgacacccactcctccacctttgacgctggggc

SEQ ID NO: 13473 - DNA, 394468 bp, Homo sapiens
  misc_feature (1)...(394468): n = A,T,C or G, or insertion/deletion polymorphism (see Tables 1-2)
cggagagataaaattctctgcaatataggatgttttaaaaaaatattttccttaagggaggctgagtgtgtgattcttgaataaaatgtgagatcaaactgatttttagtctccctgggaatgaagatcctgatgactcaactggaagagaattcagaatcatcaaaattgtttcagcctggtcaggtagggtggtcaagctgctcacatttatgataggaaagcatagtttacatctgggcacttaagcacagggctgtgagttcggagctaaaaattggcccggagtgacctgaaagctgtctactctgtactgtttgtgcctaacctgmaattttgctgttttcttagggtaaaattatgaaaattccaggcacctgctgtgacacatgtgagtgcgttactaatatcttgtcccttgaaacccatcagagcaagtcyaggggctctttgcagcttgctccttgaaacccattagcaagccgcatgactgttctttggagtaagctttatttcagaaagatatttcgtgaccactggtcagtcattatgttcagtcttgcagggagcagcctcccctccttggatgtcatcagactgccctcttgaactcccttttagatcccatggagcaatctctttccccttttcctgcaaactccctcctgtctccagcttcttatgtgccttttccctcataggatctttgattgctcatagtcctatcctgggacgatatgttccctctctaaccaaagcttcttgaagacaggcaccttggatctatgatcctgacagagtagactctcaacacatatctattcatgagtgtgctaaagctatctcaaagagaaagcgaagccaccagctggctgacaacagcccacatgtgctgtgggggctggtctaagtttatcaccccctcttcttcactctgagctcctctttacctcgtagttatgtcctactgattggttctcattgctcacagcagcagctttggagacgagacacaaatctgcacatcagacagtgttcttcccatacatgcttgtgtttgtgagcacaaataactttcaggatcccaatgctaatgccataatttctgaatatagaattacttgcctggactaagattttttgttttagattagggtatttcttttctgccctgggttcacaggtccatgcttgtttacagatagagaaaggaagagtgaaaacatgaatactttcagtgttcaatcattcattcttgacagcccctgcaattgctgtaaccaaatctcagatcgaggaagcactctgaaagcatgtctttctatgattcccatttgaatggtttaagaatgtgaagtcaggaaaccatcagagaagaagaattctctctaggcacactgcacgtggaatttgattaggagactgttacctacaaaaccaccacaaagggtctttgttggtcaactcattcaagaggcttcgagatctttaataaggacaataagccaggctcagggccttaaatccacagcaacatagtatagtatgctggtctaaatgttttttttttttaattcatcctcttaatgtaattggcaggctttccctttacaatgaaattatctagaaattaggaggcagactaatatgtagttagggttgatttagatttcgagccatcyaaggacagaaaactcccagtgttcagactggaatggtgagctgggattaaatttttgaattcccagtgggccaagtagagattcagatctgaatgccactaacccctgtgtgaaaggaaacccccatgtcagcaacctggagtcagcagtaccygaagagaggccttcacaaaggtgcctagggatcttctcggtccccagagaggcagggtatgcccttacatcaccatkacttcgcctttcctcttaccccaaggcaggaatgaagagatagtaattatacttattgactacttcattgcccattagcttctgaatgtagttacaagcacaagagggttgctttagccatgtggtttttagagtctacaatgatacaaaggcaagtcttcctcattttacatcaccatagcacagtgaatttaggctcttcctgcaattaaaattgtaccattaagtgagttaagtccagcaataactatatctctgcatatttcgggccaggaacagctgaggtgaaccaggataactgaattccctccctgtggctggctttatttggttactgtgaaagggacctatttccagcccagtgagggcactggggctgaagagtgttctctagaaccccagccagtcctcaagtttcatctctcacctgtcctgtaggtgaggagcctgagtgcaacgacatcactgccaggctgcagtatgtcaaggtgggaagctgtaagtctgaagtagaggtggatatccactactgccaggtaagggctctgcttcaataagggctgggtgyggagggytgagcctccgtgttcggatacctatccttagttacattctagaaggatctggaaaattcgcagggaagagaagggaaataaactggaagcatttttttttaagcaaatgttttattgaagtaactggaaatttttgactccaggaaaaaaacaaaaatggaggaaagactcagcaahtcctttacagaaaatggagagttatttatgcaagatgggggccacaattcttgaagatcagtcaaacatatataaaattttcctgcataaaacatgcataatcaggcataaaacattttatgcattaacatgcataaaaattgcagctagaggggtgtgggtatgatattattaccatagagaagaggacatgtcagacctatgatcttcctttacaaattgcctagctgtcctgggtgcttctgggtgagatcagacctgccttgcttggagggggtcagggagaaagcaggctgccccagagccctgcctaagccaggacttcccaccatygtgaagctcccatcttcctctgctttcttgcagggcaaatgkgccagcaaagccatgtactccattgacatcaacgatgtgcaggaccagwrctccygctgctctccgacacggacggagcccatgcaggtggccctgcactgcaccaatggctctgttgtktaccatgaggttctcaatgccatggagtrcaaatgctcccccaggaagtgcagcaagtgaggctgctgcagctgcatgggtgcctgctgctgcctgccttggcctgatggccaggccagagtgctgccagtcctctgcatgttctgctcttgtgcccttctgagcccacaataaaggctgagctcttatcttgcaaaaggctgctggtgcactgtgtcgtagggctgagatggcaacggtgggcaggggctgagttctgagacyggttctgaggaaggaagcacaggccccatctgcaagcctcagtgtcagtgtgagatactgccaacytctggggaagagtgatgtctttgcctccaggggtgggaaaggcatagcatggggtaggcctcttctgaaactcagcacaaagtaaaagggattttcccagcaacactggattctccagtctctgaatggaggggcttctgaacatagcagaggggtgggtcctggagccaggctcctgctgagatagatactattgttgtcacatggctggcagtgtggagaaggtgtctgaccaggtgtgcaaggatttctctgagcccgtggctcacagggttcctgtgtacccatagtggcccctgtgggagggagaggtgctgaygactgatggggacctggaaacagggtgctggcaggtgcagtagtgtggtcacccaactcagcctgaggccatgagccccagatttggaggcagacctgggctccacacatggccctcgctcagctgtgtggcctcaaacaagccccttggtggttctcagactcagtttcctcatctggaaaacaggagtgttgttctcactcataaggtggtaaggataaacaacctcagcctaaaatagggcctgcaagtccttaggtaactgtaaattgctctgtaatcatgtaagaagtggcgagaataacaatggggagatcaaggctttcggtagggaataagagactctaatgttaacagcagagcattagagatttcctttgtggtgagggctggaccggctgggtttctatcaggctttatgcttgatgccaaggtcctacatactccagacatcctwcagtggaagaggaagtggtgtagataacaccaaacatcatccagtccccaaatcactamctggtactgtcacttgcagttagagatggtccttccttaaaatgtatggaagaattttcatgtacatgctggcaagatggtggggactcttgctggggagaatacccatgagaaagaaggggatgtcctggattacaagaatttgatgaagaattgattttcattccaaatacttttgacacaggagagactcagctcattgaaagtactggataatggaatcaaaagggacttagacatcatctagtccactgtccctcctccactcctttacaagtgatgaaagcagctcagagaattcaagtgacttgccaaaggtcataactgctgggtggcagggccaggttcagaacccaggtgacttgacacctgcataagaactcccaggccaccccatcagagccacascatccctgttgcttacactcctcccgtgctgacatggggaccagtgactgctgcacccttaagttcccaccacttctgttactgcctgagcttaaccttaagagaagccacattacaggaaaatggcatagattatgctgagtaggcttggtggggagtttagtggggcagaaggraggaagaatggatagaagttttatgtaactactcagtaattmaaaggttactgtctctccatccatcaccccactcccaactttgggtagcctctaaggtctctcttggtaggaaaccagatccagggacagggaattaactgtcactcttctgactgatcgcctaacactctagctggggacaaggtgttattggaggcatcagctctggagaaattcagcaggaaggctaggctaccactgcagcataggtggttgattttccaactgcctgtgtcttgctagcttgaacttctcatgtttactgatatgtcattttaccgtcaagaaaaaagctgaatcggaaaactgcatgttttgattatttwaaaaaaacccaaaacgatggaagagagctgggtaaaaaggatgcaagaagagaaacttgtggggctagtgtgtgcggagcggtgtctcggcagtcttcttttatttacaggtattccaaaggcactatctgtacctggtttcagggaccctcttttttactcaccctcagaccaggcaagacagagtgccccaaagtggatgttttaaggggagtctcaaggaaggagtatatagacactaagaaactgctggagggaaagaagaaagggaatgaatgaaagagcaatggtgaccatttttcaatcgtttggggattgaaaagacdtaacggtccctggaagtagacagggagaaaggggttgttagggacagaaaggagcagaatagcagagtgttatgccacagactccagggcaggctgcctgctttggaatcctaggatcctcttagaggcaagttacttgccatttaacactgcagttctctcatctgtaaaatgggcacactgcagtgattgcctcatatacttattgttaggattaaaataactaccatagggaaagcactgagaagggtgttgggtggagaggaagtcctgtagaagcattagctggtagtacttgcagtggatggaataaaggcctgggttgggacatcacatcttgtggttttccttctgctctgccctcgactgtggtgtcacttactcccctttgcttccccaggctccttctctataaagtggratctatcatgaccagcctaccttatcaatataggagagaaaatcttcatgcctgaaggtcagtgatcacaaatggcatacttgaccttaacatagtacttcttcattttgggggtccatggtattaatgaacttgttttacttctgtgcatcttggagttgcagattccatcgtgcagaagggccctttggaggtcttccctcccatccccctgcccaggtccgtgaactgtcccggggagmtggcactcctcttcccctctggggatggagcttccatcatctactccctcaaccttccttaaccctcctagcgtctcatgggagagctcttrtaaaatggacccctcctcctgcctctggcagcccctcctgttttgcggtcccttgtgcacttactacctgcctcttctcccttttgttctgcttaacctagggsaaggtgaggacagctggtctccacctagtatggagacaggtgtgggagatccgccgtccaggggctcgcccccactcccgccccagggctaactcttgggcagtggatgaccctttggggcggcrggaagaaggttttgctggcaggattggaaactaatcagccagacagttcatgagataatccgrctgaatttttacactcgaagcaggttgtggggcgttgccccggctctgggggagcagggagcgtttactgtctcgcccctcagccccacggacccgagtgtgtcctggactcaacccggccgcgggaccgcgctccattctcgacgccccgctcccagcacccgggcgcccagggcgcagcggggagagctgggctgtggctgcgcggcgccggcggccgggagggatgggggaggaggaggcggcagccggcgaggggcgggcgcgccgggacggagctgagccgcgatggaattagccccgcggcggcataagcctgcccagaagcgcgcggccgcgggccggcggggtcygcgtccacatcatggcgactcccgggccgcgcggtgagttttccggctggacctggtcctggtctcctacaggtggtaggagggagggagtgaaggaggcggcatccgaactcccacycttcgggattggggacccccaagggagcctgggcagggtggtgcgggaagttgaccccgtttttccagggtagggactctgagggacgtctatgtaatttccgagacgttttttgttttttgttttgttttgttttttttttaactcaaggagagggaaggtaggacaacagaggtttgggcggccgcttctctgtgattggttaccaatccccacctctgtgatgttgcctctccttgttacaagtcctggggacgtttagcctacagcatctgaaggtaagtaaacaataagtaaacaaccagccggactgggtttaactcagcaacggtccgytgaggacagagcaaatttgactttggcatccctggagtggcctctcagtttcagaagttttttccagtgtcttacccaaaaccgcattcaggaagggttccaagatcaggcatttacaccccaggctgcagggaaacacagctataccttcccgagggacttttcttagaagaaaagcaaattgaggtggagtatggagaagaaagacgttattttattgcttttgggcaggactgactttgcctgggacagggactttgtcggctgttgtgtttctggtaattcttgagacaggcatgaagagggaggtgcccgctcctttggcatgaacaatgagctgagtgcactgggaggtggtgtcagtcacagtcctgatactttgtgagcagatgtggagaaataccaccccgggaccatgtggaacctcgtctgggacagaaggtcccactgagcaaggtcgggtctcagcccaaaggcaggtggcaggtggagggaggatcttagacaaggtgaaggtgcttccagaggactgtggtcctcttggccctccacctgccgagcctttgtccttggaacctggcatcagagcccctgcccagtctctctgtcaccctggctcagctgctgggcatccagggctcatttgctcctctcagtgtgtcttaacgtgcacccgtcatttccggagccaagcacctgattcgatcctttccagcaactgcttctgctgtstgagttgcctctatgtgggtaccagagccactctgctggttgactgtagagactgtgtgaggggtaagggtgggatccaaacacacrcctcaagttctagtscagtttccaggtgtgccatctcttcatcttccattgtggggcaaggctgcagggtgagaggcatttgggcctactggggagtgtgtctataattttctgtaacaaagacctaattttctggaaagctacccattctgtgggctgagagaagcccatcccaccctatgtatgacgttgctagagcacatgcatagcaggtatttggctgctagggacggtgttattgtctctagtacacrgtataatccatctgtattgtttaaaaattgttttaaaaatgtcagtagtttttagggtacggggttttgcttttggttacatgggtaagttctttggtggtgaattctgagattttagtgcctcctcacccgagcagtgtacattgtacccagtatgtaatcttttatcccttatccctcctcccacccttacccgctgagtccccaaagtccatgatatcattcttatgtctttgcatcctcatagcataactcccacttatgaatgagaacatatgatatttagttacccattcctgagttacttcacttacaataatggcctctagctccatccaatttgctgcaaaagacttattttgtttcttttcatggccgagtagtattacacacacacacacacacacacacacacacacaaacacacactcaaacacagacatcccacattttctttattcactttttagttaatgggcatttaagttggttccctatctttgcaattgtgaattgagctgctataaacatacatgtgcatgtgtcttttttatataatgacttcattttctttaggtagatgcccagtagtgggattrctggatctaatggtgttctacttttagttctttaaagactctccatactgtttttctatagtggttgtactagtttacattctcagcagcagtgttaaagtgttcccttttcatcacatccatgccgacatctagtaaaatttttgacttyttagttatagccattcttgcagcagtaaggtgggttatctcattgtggttttaatttgcatttccctgatgattagtgatgctgaacattttttcatatgtttgttggctrtttatatatcttcttttgagaaacgtctattctccatcactattcgtaactaagtggttagcgaaggcctctcttaggagatgaatttgaacagagattgcattaaatgaaggaacaagccatgcagatatctggaggattgtctagcaaaggaagtaaaggcaaaagaacccatggcaaggagatgcttgggctgtggagcttcccctgtggggaagctaagggctgcagcagagggatcaagagggagagaggtaagagccagccaggttgtgtgcggtcttgtggctcaggccacgtgttcctggcattcaaagggaaagggaagacagtaagtaacatggctgtcattatgtaatgaaaggagactggtttatctacactaaaatatcaygagttcatggtgatattgatgtaagacattgcccaacataacgagctgtattttcattagtaggtttttaaaatgagtattatttatcacgtgggcatttatcatattatttttaattttaaaagaggaacgtttttgccttattcttttctggtccattctaccccattacactttaaaaarygctatttgaaaaccatgaaatttatatmataactaattaataggttaaacctgttatcctaaaagtagtgacttagtcatagggaacastcaatggctagtagtctrtttggagcagtgacactgagtctctttttccttctctgtgtaagaaagggatacgcggcactccatcaggaagttcttaggaagarttcttaatcgcatttccatttgttatcctttcccttcagcctgcagaacatcctgtagcattgttagaggtgcagttctgctggtgacattctctcaacttgtgtttttatgaaaaatgtctttatttcatccttatttttgaaggatacttcattggatatagatgaatggtttgatagcttttttyccacccccagccccagccctctgggtatcactcttttggtctccattgttttgacgagaagctagcctaaattcatatttaaatattcttcattatcttattaatgtataatctcttttgaatttggtagtgttcaagatttgatattcagttttggttttcagtattttgactctgatgtatctaggtgtggttttcttttttttttttaacttgagtttgctggacttcttaaatctgttattacaagttattgtattttatcaaattttgagacaatttcagccactatttattcaactatttttattttattttttttcttcttcaactatttttgatctgcttttcttttcttctttttgtggaactccagtcacatgaacgttagcttgtttggtatcgccctactagtttctgaggtgctgttaaatttttccaatctttatcctctgctctctagatttgattacttttgttggatccatctttaacttcactgatcctttctctgccgtctccagtttgctgttaatcccacccaatggatttttcttttccataattgtaatttttaattctaggaattccattgaaaaacagctttattgagatacaattcacataccataaaatgtaccctttaaaggtgtccagttcagtggctgttggtatattcacagagttgttcaaccatcaccgcaatctagtttaaagcatttgcrtcatcctaaagagaaacttcacactcaatggcagttgctcatttttcctccctccccctagcccttggcaaccgcgaatccactttctgtctccatggatatgcctattctacacattttatgtaaatggaaccatacaatgtgtggcattttgtgtctgtgttctttcacttagcataatgctttcaaggttaatgtgtattgttacacatatcggtacttcattcttttttatagctgaaatctatttccttggrtggataggctacattttgtttatccakttgccagttcatgggcatttgtgtgtcctagtttttgttactataaatgatactgctrtgaactttcaagtacaagtctttgtgtgtacatgttttttagttctcttggkcatatacctaggagaagaattgctgggtcatatgtttaactttgattgtcagactattttccaaagtggctgtaccattttacattcccaccagcaatttatgagggttctgatttctccacaaactcaccagcagttgttrttattcatctttttattatagccatcctcatggacgtgaagtagtgtgttactgtggttttgcctgaaccyaggagcaagacaagcctgtcactggagaaggaaaagctcctctgcctgcaaatccccaagcatgcttaggcttcctggtcttagaagtgtgtgcctcaatgatggggaggaccctccacttggacggcttctgtgtggctcttcsacttctaaaacatacgttagagaactgatgataataccagtttaagaatcagagggtgcaggaatgggttctatacaatctatctaaattcaaatgctaaattttgctaaatgtagttaacttgtgcctaaatgatttgatccagtttataggtgtactggaggcatgcccaccttccatatcaaasgggaaggcaagcatctttctctaaattgacaacatcgryatgtggcattccaggaggagcctcaagaagcaacagaatctgttggccaactactgtcacacaagctcaccatccatccatcyatccatccatccatccatccatccatccattgatttaaaaaccatttaataagcatttaccatatccctgccttgtcctgggtgctgaactggatctsagagcctacttggggagataaatgtggaaatgtataactttaacacaatataaggtgtgaacatgctacaccaagcttttcatttttggtaggcctctgtgacagagactactagctgcttaccaaaatccatgttctcctcttcttcctgaacacacagctcgaccttatttcctagcctcccttacagttagttatgacactgaattttagccaaaggaatctgaacagtgacatgtgctacttctggccctggcccctggaagccttccatgcctgttcttccatgcgctttctacctttcggaaaacaggaatggcattactgtgactcatatagtatccttcaccatcggtgtggataataataaattacttataagagcgttaacccagtccactgagtgactgttcatgtcaaatctccatatttctaagccttgctcaacagagcctttcccaaatttccaccaacctaacagatttaacccacctcasacttmtgcataccacaggtggggagagatactcaaaggcagggayggaggatggatctaactcatctttgatccttactgcagcctgacacacggtaggtgctcaatgagtgggtgtttcattgagcaggtgctcaaattgaaatgttgaaaagaagagcagggagaaacttctaggcaaagtcatctcttctgtgctttgtggtttagaattctggagcttttgattatgttgaatcaagtgttcttgaggaaacacaaagttttttttttttttttttttttttgttggagtcttgctctgtcactaggctggagtgcagtggtgccatctcagctcactgcaacctctgcctcccgggttcaaacgattctcctgtctcagcctcccgagtagctgggactacaggcgcgcaccactacgcccagctaatttttgtatttttagtagagacggggttttactctcttggccaggatggtcttgatctcttgacctcatcatccgcctgcctcggcctctcaaagtgctaggattacaggcctgagccaccttgcctggccacaaaattattttwwwaaaaaaatattggccttggttacaggtgctcctgtggcctacctcaggacaagaaaaaaggttgggatcttagcttatcttktttttttctttttgagacagagttttgctcttgtcgcccaggctgaagtgcaatggtgcaatcttggctcactgcaacctctgyctcccgggttcaagcaattctcctgcctcagcctcctgagtagctgggattacaggtgcctgccaccacacccagctaatttttgtattttttttcagtagagacggagtttcaccatgttggccaggctggtcttgaactcctgacctcaggtaatccatttgcttcgatctcccaaagtgctgggattataggcgtgarccaccatgcctggcccttagcttatcttaataagtaaataaaatagactgggtgcagtggctcatgcctataatcacagcactttgggaggctgaggccataatggaataactggtcctgggatagacattctgtcataaattataatactggaaaaaaatatgtagatcagttattttcaggtactgaacaagcaccagcatagaagtacaatccctgaaagaagagaaatttagccctctgagtgcaggctatttaccaggggtcagggatctggagtccacatggaggaaaggatcccactgaactgagaagacagagataaaaatttggagcagcaaaatgcctggaaatgcttaytaaatgcctggaaattatggggaagaacacagagaggaggaatgtgtgtgaaaggaggtgcccagagggctctttggggacccttcgtgagtccttggctaagagtgaggcttcacatgcacagggtgaggcatatgaagtttgccagagagaagctgctgcagcattgagatcagaacagaaatggtagaagtcgaacggtactgggagatgttgaaagtccatcccagccagagtggcaagacctcatgagcatgtcctaacattccagacatgtagctgagacccccaggggctttgttttaggagtaagaagcacacggtagagaaaaatttactctggatggtccctgaagaacactaaggccaagcctagaaagatcaatagggaagacaagagtttagaggctgaacccttccagattagagcctcttgagaaacaccttggattttccacagcataccctggcaacaacagcaaactcctacataagctcaaagtgatcagcycatagttgaacttcctgctagaaagttaaaaaaaaaaattccaaccccctcgataggaagataatgttttatcattcacaatgtccagtataccataaaacttactagacatgcaaataaatagaaataagtgatccatgaaaaagagacaaaggaaacaaaatgaaaaggcagccaatgaagtggaaggaaatatttggcaactgtgtatcagataagaagttaatattcacaatatataaggaactcacacaatccaatagcaaaaatacaaataacctaattaaaaaataggcaaatgacytggatagacatttctccaaagaagacataaaagtggccaacagktatatgaaaargtcctcgacgtcaccagtcattagggaaatgcraatcaaaactacagtgagatatcatcgcatacctgttaggatagctawtataaaaaagtcaggagataactcttttggaaggaatgtggagaaaaaggagcccttatacactgttggtggaatgcagtttcatgcagtcattgtggaaaacagtttgaagttgctaaagaaataaaaaaatggaaccaccatatgacccagaaattcctattctgggtatatactgaaagaagtaaaatcactacctggtaaagrtatctgcactgccatgttcattgaaacattattcayagtggtcaagatatggaaacaacctaagtgcctgtcactttatggtatagaattttggagctttgatgatgttgcatccaagtaaatattctataaaaataaaattctataaaaattctggagctttgattatgctgaattcaactagagagtcatgtacaaagaatgaagttggaccctttcctcactcatacataaaaattaactcaaagtgaatcgtagatgtaaatgtagtagttaaatygataaaactagaagacracatagaagtaaatcttcgcaaccttggtttaggtgatgttttcttaatgttacaccaaaaccataagcattctgtctcagtttgctcactctaacaaaatgccagagactggcttgtttataaagcacagaaatttatttcttacagttctccaggctgggaagtccaggatcaaggtgtcagcattcagtatctggtgacagctgctctctgcttccaagatggcactttgtttttgtgtccttacttggggggagaagggcaaaaagagggtctagcctgttcctttgagcccttttataagggtactaacccatttgtaaaggcagagcccttatgacttaatccttcccagagggacccacttcttaattctgctgcattgagggttaagtttcaatatgaattttggaagagacacmgatagtcaaacygtgacacatcagataaaaaatagacaaaatggacttcataaaaattaaaaatgctccaaaagagcatttttggttgcaggtgcttctcttgactccatcaagaaaattgaacagacaacctacagaatgggagaaaatatttgtgagtcatatatcagacaaaggacttatatctggaatatagaaataactcttataactcaacaatraaaagatgaacctgattttaaaatgagcaaaagctctgaatagacatttytccaaagaagatatgcaaattgctagtaagcacgtaaaaagatgttcaacattattggtcattagggaaatgtaaatccacccaaatagtggtgcttctttcttctratatttcaagatctgtgactagatctgtgctccctgttttgactctgttagtgattctctagactaatggtctcaaccctggttgtaccatagaatcaccccagataaattaagtccaaatctgtggaggtgaaacccagacatcaatattttaaccttcttgggtgattckaatgaatatccaaggttgagaacccctctgtgttcccatttgtctttttcyagttgcggaatcctaatattttaagtctggcttcccatgacaggctccttctccacacagaataggtcttgtatgcttctgtgccccttctccagaactttttttctcccagttttgtcctttgggatatggtggccataatttcacagatgctcaaatgaggacatatcctggttttgaataagagcgatctgcatttggctagaccacagtagcctggtggaggagaagttatgagaaaataaaaaatgtatttctcaaaattttcccccactagttattatgctatctccagtcacccttaaagtctgacccagtaatgatgggagtccctaggtgtgtctccagtgccttcatgmacaatcctctcgactttcacatggtgttaccattgtggtggatgtttgctattgaacctccttttctcacactctgccctcaaagattattatgtaccaggtcatatgctcagggcttaggatacagaggtgaayaagataggtactatgcctatcctcaagcagtgtgcaactagcccattaagctcactgtctatacaatatgaattcactcataccagttaaaaaagctgtaacagaggcattttctgagcactttcctacagactataaataaatatatttgggatattttataaaattctcaggattgttcctatccctcatgtctgctgcatccttccataacccccagcatctcacccagttccaaagtcctcagtagcctgagagtgggagctatgattggaagagctgttttaggctttaacctcagtcccagtccattttgggtaggagaaacctattcctactttggagagatgagaataagaatgatatcwttaatcttggttacacccaggaggaakagatgggagatgtttatgggtggtggagaatgatgagggacacggagrgagcccattgaatatacccaggatgtcaatggaagagcaaacagagcaaatctgttgcaaaacaggttataattaatgagccaacagaccagttttgaccaattttatgttgtacactggctacttcctcatgacatgtaaggaggggcatttataccttaatctcatcagccatactccaaaccaaagtgtaggatgggctgccaatgagtaggtttcatttaggcaactcatccaagtcccaatttgtaaattttgtcattgagagaagcacttcctgaaatgaatttctcattcgattacattctcaataagataattctctcttattcttattctcttggtcttaactgttaggatcttgggtctgatcattgactataaatgctatttgtaaaaagacctttttaaagggtgagggatgttaagaatgtccagccaggaagggatttaccaagtaatgttggccatttatcttccttttgcacagcattgcttagtggagaaaagtgtggactgagtgtgctggtgatcttggacaacttacctggcctctctgtgcttcagtttcctcatcagtaaaatggtgacaacaatggtacctacctcagggttatcgtgaagattacataaattgatacatgtaaagtgtttaaaacagtgtctgacacatgtaaagtgttagcgattagtgttgtagttgttaytagtagggcagttctatgttcagttcagcacaggggaatccatcctgtttcaaaattcactcacaagaaaggattcctcagttccctacatcgttacctccaaaagcttttagagctcttattgcatccagagtcctgtgctaggaatacagagataaaaaaggcaaatctgaacttctagaggacttccttcagtggttagggaaggcgtggtataggagtaggactttacctgggtatgacttagcttagtggagaggacatgccaaacagaagtaacagcctaggcagaggcacagagtgagcatcagtctggggacaggtttgactaaagaggaatgttcttgtctgatggagggatttggcagcagagacatgtaacagtcagctgtgtaagtctttggatgccaagttgtttgtaagcctcaagacagtggaagttttgagtagcagtgtgaccagtgaaataaaattttgtgaattttataaagggtacgtgtatcagaaaaacagttaggaatctgtccatccatttattcacctacccacctgtccatccacccacccrcccatccatttatccatccttctcctggcacctcatttatcctcactacagccagggccatctttctaatgtaatctaattatgttgttctcttgcttaaaatcttttaacattataataaattgtgaacctcgttaacagagtggaatttggggtggttgtatggttggggagagaagtttagagacagaagggcaaataaaaaagcagatcaccttctgggagctgcaggcagttcattctctggagtttctgtgcatgtgtggctgtgtgtgcacaagaggagagtcactagcaggagatgacagtgggaaggttgacaagaaagatggtaaagggccttgtaggccatgttaagaagtgtgcactatacaccagatagggccstttctgtgcccctcaaatctcaccacgtagctggccccttgtggggactccgcaggcagaaaatgagggtgaggaggctagcagtcattgctctcaggagggccataatctcaaccagccaggcccgaggcccattgcaatggatcatacaaatcactgcctttcttcctggagtctcctttcctcctttgcccrttggtagatgcctagttaattcttctagttgcatgcaaaagccgtgtcctctgggagcctccctgacagctctagggagagctgagggcttctgcttccatggatccttcttcatactttcatgttgactctcctcccattctggagattatctccttgttagtcttccttcctcactagtctactttccttcctcactggtctactttccttcctctctagtctaccttccttccttactcgtctaccttctttccttattagtcactttcttaccagtcttccttccttactagtctaycttctttcctcactcgtctrccttctttccttattagtcactttcttaccagtcttccttccttactrgtctaccttctttcctcactcgtctrccttctttccttattagtcactttcttaccagtcttccttccttactagtctaycttctttcctcactcgtctaccttctttccttattagtcactttcttaccagtcttccttccttactagtctaccttctttcctcactcgtctaccttctttccttattagtcactttgttaccagtcttccttccttactagtctaccttctttcctcactcgtctgccttctttccttattagtcactttcttaccagtcttccttccttactagtctaccttctttcctcactcgtctaccttctttccttattagtcactttcttaccagtcttccttccttactagtctatcttctttcctcactcatctaccttctttccttattagtcactttcttaccagtcttccttccttactagtctatcttctttcctcactcgtctaccttctttccttattagtcactttcttaccagtcttccttccttactagtctatcttctttcctcactcgtctaccttctttccttataggccttccttccttgtgattacccagggcttgatggaaggagccagattctgtttagctttaattcccaatgttttatacaatacstgggaagttaaatgggtctgcaatgaaygaacagagatgtgaaatactgcacgtatatcatccccaccccaacctcccaaagaatggtcatttgctgtgcttggagcctggcatgatggtgtgggtaatgggggtatagggggaaggccagcagtggatgagtgttgggagatgaagtggtccagacgggtaggtgcggactcgatcawraaagaccctgtatgtcatatatgacaatttggtcttcatcctaagaagagtaggcaaccacagagtgggactaacttggtgagattgtttcaaaatggtaatagtagctgtggtgtgagcccaggatgagagagaagcaagataagcagtaggaaggccagcttacttctatcagaggggaacaaggcaaggatgcaaactgtggtggtggcatcatcaggaaaggggggcatgtgcattggagagagagggctaattctgagccaaggctataagacaagcagagcccaggaggcggatatgcaaatggattttatgtgtgtgtgagtatggagggaactggagagcagtcctgttactgtggctgcatatagagactgagggaagtgctgttctgcaggacctctggggcaaggggtggggtaatcaggagggccattgggcccaaattttaagcctggagcttcaaattttggctgttgtcctgggtccaattcatgcaagaagcaggatgagacctgggtgtaaatgttgattctaactgaaatgaagtgcccagggcacttgaggaggggtccagggggagggtcttcaatctgaaagcacccaggtctctctgaggcttctaccagggcatgccttcagcaggaccatggttgcctactcttcttaggatgaagaccaaattgtcatatatgacatacagggtctttcctgatcgagtccgcayctacccgtctggaccacttcatctcccaacactcatccactgctggccttccccctatacccccattacccacaccatcatgccaggctccaagcacagcaaatgaccattctttgggaggttggggtggggatgatatacgtgcagtatttcacatctctgttcgttcattgcagacccatttaacttcccaggtattgtataaaacaytgggaattaaagctaaacagaatgtggctccttccatcaaaccctgggtaatcacaaggaaggaaggcctataaggaaagaaggcagacragtgaggaaagaaggtagactagtaaggaaggaagactggtaagaaagtgactaataaggaaagaaggcagacgagtgaggaaagaaggtagactagtaaggaaggaagactggtaagaaagtgactaataaggaaagaaggyagacgagtgaggaaagaaggtagactagtaaggaaggaagactggtaagaaagtgactaataaggaaagaaggcagacgagagaggaaagaaggtagactagtaaggaaggaagactggtaagaaagtgactaataaggaaagaaggtagacgagtaaggaaggaaggtagactcgtaaggaaggaagactggtaagaaagtgactaataaggaaagaaggyagacgagtaaggaaagaagatagactagtaaggaaggaagactggtaagaaagtgactaataaggaaagaaggtagactagtaaggaaggaagrtagactagtaaggaaggaagactggtaagaaagtgactaataaggaaagaaggyagacgagtraggaaagaagrtagactagtaaggaaggaagactggtaagaragtgactaataaggaaagaaggtagacgagtgaggaaagaagatagactagtaaggaaggaagactggtaagaaagtgactaataaggaaagaaggcagacgagtaaggaaagaagatagaaaaggaaggaagactggtaagaaagtgactaataaggaaagaaggtagacgagtgaggaaagaaggtagactagtaaggaaggaagactggtaagaaagtgactaataaggaaagaaggtagacgagtaaggaaagaagatagactagtaaggaaggaagactggtaagaaagtgactaatraggaaagaaggtagacgagtaaggaaagaagatagactagtaaggaaggaagactggtaagaaagtgactaataaggaaagaaggtagactagtaaggaaggaaggtagactagtaaggaaggaagactggtaagaaagtgactaataaggaaagaaggtagactagtaaggaaggaaggtagactagagaggaaggaaagtagaccagtgaggaaggaaagtagactagtgacgaaggaaagtagactacggaggaaggaaagtagactagtgaggaaggaaagtagactagtgaggaaggaaagtagactagtgcagaagcctgggagagtgcggatgctctgtctcccacagggcagccctgggcctgtctggttttgctggaagcagtggctttgggaggttggggatggaggtggcccctcatttcagggcccttcatacttcagccaccaggagttaggartgagacagtaatgaygccaagagggaaactcagaggaaaagcccaactgcccagaagtccagttccctcaggacacctcctcctcctgctgctggtctctcttggaggctctggaagttgcctaggtccctgctgactcaccttgccccctattccatgcttagtgaactcactttctgccctttctctgcacaatctggccctgtcttgctcctgactgtgtctcctggtctccttggctttggtgtttcccctgtcagctacatgcccaagcttctctcactcttaccagctctccacattctgtgcctgcccctcccccctgttcagaagggcctttctagctctcggcctatgcagtgaccttgaaggttcctgccagactgtctggggatatagcattatttggaggtcccagccagaacttctgcctctcagccatcttcctctcaccccattagagatgatgccttcaggctatgacctctgccccatcagcatgtgggcttatgccttctgcagaaccttttaatgttttcaaaatgctttttaccaatatcaggacgtagcatgggctgtttgtactttggtgtaaattagctgattagcaaaagagccagaggttaaatgaggaaatggtcgttggaagccctgatggtagatggacagtggagggtggaatacagggcacagaagctggggaggggctttgggcaggcycagaaaggagatttcggaaggactggtttggggagactctgaaaacaggcttcacctgttttttcattgagatttgggcctctccatccttcagtctctgttcttttctctcaatgtctctgatcctaccccttcttcatctgcctctgtagagtgacctaaggtacctgcagtcctgcgagtggtgaggttggctccaatgagaagggacagaggtstcacctgaggccactgatatgaaacagccaagactgtaccgaaaggattaaaaaatgtgtggtcatccctgatgagtaaacccacttgtactaataatggtggggacagacagccagtgcttctcctgcttagtctggggaagcttccaggaggaagtggcaggtgagcaggcagtgggctgggagagaaagggaattccagggacttgaagcagagcagctggaatgaagtggagaagagacggatgaaggaggcagcatggacgtcctgaagtagggtttgataattatcctgtgcatttttcatagctcatgtacttccaaggaatgttaatcttttctcttactgtatcatcacactcactttatgaggaaaagatataataatgacaccttctcccaaatcaccgaagtaaaaactaagctcagagaaagggtttgtcttggggcagggtgctggtggtgaggccttcctcyggcaacatcacatgggtcctcgtggcctgcacctcctcccartcctgcacaacccaacttgtggaaccttactcatgtctaggttggaaggaaattagctttcttagtagtatctgaatattccagtcttacaccttgattagcagctttttgaagcaagaatggattgctttggattttctgggtccctaaggaccaaaatagtaggtggcccacaactagatgaagagtgtgtagggaarcatggtccaggcagcgggaagaatgcatgtaggatgctgggctggggagctggtgtgctagagcagaggtgtatggcgggaccccagggagccagcaggagagagggggtggagactggcggggcagaatgcagrgtcccagccsgagagccatgggagccccataagtttgtgctcttgagggtgtcctggccagatggatgtttgtaaggacccctggctgccttgtggggaacagggacagggagcagggagatctgttaggagggcatcrccgtcctccaggggaaggaggctgacagctggcactagggtgggactcatggaagggtgaagaacagaggggtttggcagacatttcaggggtaaagtttataggatcggtaccaaattggacatggggcatgaggaagaacagctatcaaggctgcttctrgatttccagctcgttgactgtttggtggagcatttgcaggagcaggaaatgctgaaaaagaatcctgttttggagaagatcgtatgtttggatttgggcatgttgactttgaggggctgggaaacatccaagtgtagatgctgagcaggcaggggaatgtgtggacctggtscctgcaggagagcaagagttagagtgaaacttaagtgtcgtcagcaataggtgacaatgaaggtctctggagtggatgagartgcccagggagagagctggaacgtggagaaaggcccaggccccagccttacgacatccatctcctcaacccagacgtgggtaagccatgcccccaccctcacggcattgcagttatgaacacccaaggatctgttgttcaaggcagcgtggaaggagagccaaggcaacggtgaaggaaggaaagattctttccaaatgggtgacatgttccacgggctgtgtacgatggcctttccttctaattgacctcattcacctcttctaagcttcttagggagttctcaaggtgtgtgctcacctgcctcacccttccccttcctgagggcaggcgtcactcgcgttccccttggccttcctctcacgtctgaaggtggctcccttgtgtctttattgcctggagtgcctctccagagctgggacggctgggatggctgawccgtgtgctgtgctctaatcacttgtggggagagggagagaagggaagcagagttcccaggcagccggatccgtgtgtcagagagcgagccgggggagcaactgcgatggctagtgagggccctgaatgtcagcctcaaactccaggtggcacctttaggggatggtggttcctggacagcagctggaccaaagctttgcattgcccttgaatctgagctactctgagccacaggtgcaaatctgaatgtagctgccagggtagggtggcccttgagtgaacatcatctttatcatgttccccagtgatgtatccagtggtcttgggctttttagacatgcatctagaggtttccaggtcttctctggggtagagtccttctgttccaagttctgttctcaggcacttgtggggcaggcatgcaggaaggcacaagggaagtgggaggaggcgagattgggcacaagggaggaagccccttttttagagccctgagcctgagccccatcacatgtaaaccaaaaaatatctgagacaggcctcaatcaattycgtttattttgccaacgttaagaatgtggttggaagagaggtctgtgtctttctccaaagatcattttgagggcttcaatatttaacggggaaaagcaggctgygggggaaagagggaggctgtgggaatctgcatgttgcaggagaaaaggagcagttagggaattatcaatgatgtattcatcttgcgctttggacaaggtgaatatagagtagctgcctgtggagctatctagccttttatctgtagctgtctgcttaggaacaaaaggaaaggcagcgtcttgcctgactcagctttcggcttaatattttcctttcggcagagtgatatggggtcctgagttttcattttcctcccacaaggtgtgcccacgcctgcccttctgtgctgtctccctagggagtgcctcccgtgcctcctggcctttcagaagctacccaccctccaggacccagctctggctcagttaccccagaagccgactttgacttagtctttctggtctcccacagtgtggactagaacccacagtatagaaaggaatgatgaaagctttcctctgctggtcacagttgtgtttcctgcatgtcagctctgtcttcataaagagattatgtttctcaagtgcagggaccgaatgttctaggacccctgaaactgygctggagggctgagcacctaaggggctgctccacaagttggcaaagggccgggagttctgtttcaacagactggaagagttgcttttgttcattcattcactgagcaggtgcttagggctgagttggagacataaggtgttacttctgctcacttggaggttaaaatgcaaacactaacgattctaatcacagcctttgatcacatgccgtcaggctaatcactgctctgggtgctttgcaggcattatcttattctcattctcactgcaatcctgcaagtttgagattctcattttacagctagagaacaagcacaaagaggtcttagagctggcaagtggcagagctgaggtttaagcctgggcactggctgtgttgcttttctaggaagtgtttctcagaggagagaatagattgagtctgacctgcgctgagaccttggcaactcgcggttccagtggggtctgtacaaagtgcagctggactatctactctctcagttccctccaattctagcatgcagtcattccatcacctactrgggacttttcccttcaggggagacactggaatttttctgaagtggtcctgcattcctgccgagaaggggctgcagacctctggggcctgggtagaggcagcaggtgcgtgaggaccctgaaaggacactggaggacagtcctttgttcagttgttcagaggacccccttggtctgtccttgctctctccccgagggaggtgggggctggccagggtgccagctggtgctgctgccacgggagaggcccaaagcctaagcctttggtattaattcaaggtgtctctccaggcagtgcccccccaccaccctgacttgctcaatgccacccctttcttatctgggaattatgagagattatgacagccatgatccgaaggagctcctgctggtggctccacgctgtgtgtgtgcgtgtgtgtgtgtgtgtgtgtgtatgtgtgtgtatgcrtgtgtgtrtgtgtgcatgtgtgtgtgtatgtgggtgtgtgcgtgcgtgtgygtgtrtgtgtgtgtgcgtgtgtrtgtgtgtgtatgcgtgtgtgtatgtgtggatgtgtgtgtatgtrggtgtgtrtgcgtgcatgtgtgtgtatgtgtgtgtgcgtgtgtrtgygtatgcgtgtgtgtatgtgtgcatgtgtgtgtgtatgtgggtgtgtgtgcgtgcatgtgtgtgtatgtgtgtgtgcgtgtgtgtatgcagtcggggggccgcacttccttttccatgctccctyccttgtggycagtgtgaacctgggctttagggactaaccaaggaggcagctgtgaagcaaaatgggccattttctcagggctagtgtctgagtacactcagtacctcagtgtcttggatttccttcacctgaggctgttttgcctcccttgtctttccctctcacagatatacccctgctccctggctccccacgccggctgagccctcaggcagggtccagagggggccagggccccaaacatggacagcagtgtctcaagatgccaggtccccgggccccaggtctgcagggcggttccaacagagatcctggccagccctgcggtggagagagcacccgcagcagctctgtgagtactgggcrggggtggggtggggggataggccagccctgttgcaggccaccaaggagcctctggtctgggggatcctccagttgggagcacatgtgtgcgtgaaagagagagacctaggtttgggtagggccttttctcttctctgtctccaagtcaggcacactttcccagtgccctgttctggtcagaggagggtcaggaaaggaggaggcgtgggaggccagtcgatgctgccagttggtctgcaggccccctggttcccctcctgcaagcctgagcaactgtcttctctgctatggtggctctgagtctctcccttgtgcctggagcttcatctggttgcccaggtgacctctcaggtggctgcagaggcagctgggtttcaaaccagtaataaacagggaaacacccacggggagaggccggtccctcccctgcttcatcgtgttctctctcctcctcttctttccacctccccacctctggagtggaagacagcagaagtcagttccctgctgctgtctttgaaagggccctcaccagtggctggagaggaggatgtggggctgtgaatagtgcctggtgaattcccgtgggtgggagggtaggggtcgggtctggtgactagaaattggtctttgttccaatggatccagagaacctgcctgtgagtattctgtgtttaaatatatagtgtatctgcaggcagaggtgcagatctgcaaggaggtgagcgtgtgtgggccatggtgcctgtggaagggggtgtgtgtgttagagcgcactcgggtagatacgcgtgtacacaggccccttcacctgtatggtgcaggagtgctggtgcagggagacaagggtagaggtggctgcgtgtgcatctgcaggtgcttgcatgtgtgtgtgcaggcgtgggcgtgtggttctgtgtgtggaggcaggagtgcggttgtgaggggtttgctgctgcaggtacagtctgtgtgtgagtgtgtgtgtgcatggatgctggagcatgtgtgaaggcaccgatgcccagaytgtcaacaggtgggtggagggcctcgcaagctggcatgacagattaacttaggccattcggtccttttactgggggcactgggggcctttgggcctgagaggcttgcttctgagtccgtttccctgagcccagagcatagatcagcctcctctgtttctcaccccttactcaccagaccttgccctgcctctcctctctctctggccaggtcatcaacaactatctggatgccaatgagcctgtgtccttggaggcccgtcttagccgcatgcacttccatgacagtcagaggaaggtcgactaygtacttgcctaccactaccggaaacgcggggygcacctggcccaaggcttccctggccactcgctggctatcgtctccaatggggagacaggcaaggagcctcatgctgggggcccaggtgacattgagctgggrycgctcgatgccctggaggaggagaggaaggarcagcgggaggaatttgagcacaatctgatggaggctggactggagcttgagaaggacttggaggtgagtcaggcgggtggccagggacttggagatggaatggyaccacagaacygggctcctagtgagcagtgccacctgacagagagcctaggctttattctggcaggtggacttttttttctgctggagaaaccagattttgtttctttctttttttwaaaaaaattttttttgagacggagtcttgctctgtcaccaaggctggagtgcagtggtgtgatcttggctcrcttcaagctctgcctcctgggttcctgccattctcctacctcagtctcccgagtagctgggactataggcgcccgccaccasacccagctaattttttgtatttttttagtagagacggggtttcaccrtgttagccaggatggtctcgatctcccgaccttctgatctggcatcctcggcctcccaaagtgctgggattacaggygtgagccaccgtgcctggcctggagaaaccagattttcttgcccaagggcttgagaaagagtcttgtgttgctagtggtcctgattaggggattccaggtagtagtggtggggtggtggtgtgccaatctgttctttgggagttgggagttagcctagttagacattaaaggcaagaaatttcttcttgacattctcaggccacatctagtggccttctccatatggtttccttgggaggaagacctagtttccttgttgaattttggaataaaattcctctatatgaatctcattcactaaggaatgcgcttgtctggggtcccctgagggagctgatttgagatgtatttggaaactgagttgggacatacataggacatattttatcaacctataagctatagatactctcacctctggtcagtgcaagggaatccatggaaatccattcatacacatatccacctatccatccattcatccacccatctgtccacccacccatgcatgcatgcatgcatccatccatccatccatccatccatccatccatccatccatccatttatccacaccacagtgatcctttaaaaatgaccttcccttgccaggcgcggtgactcacgcctgtaatcccagcactttgggaggctgaggcgggcggatcacaaggtcaggagatcgagatcattctggctaacatggtgaaaccctgtctctactaaatacacaaaaaattagctgggcctggtgttgggcgcctgtagtcccagctactcgggaggctgaggcaggagaatggcatgaacctgggaggcagagcttgcagtgagccgagatcgcgccactgcactccagcctgcgtgacagagcgagactccgtctcaaaaarraaaaaaaaaatgaccttcccttgccatctcccccaaactcattcctacccttcccaccctccctaccttcctgcaggtcacgggcctcatcttgggtgtgggctgatcaccttgacctcaggtctttgtgctattgccctctctgcyttgggcaccttgacctcaggtctttgtgctattgccctctctgctttgggcaccttgacctcaggtctttgtgctgttgccctctctgctttgggcaccttgacctcaggtctttgtgctgttgccctctctgctttgggcaccttgacctcaggtctttgtgcyattgccctttctgctttgggcaccttgacctcaggtctttgtgccgttgccctctctgctttgggcaccttgacctcaggtctttgtgctgttgccctctgtgctttgggcactcttcctcagacctgtgcatcacattccctctcttcagctctctgctcaaatgtcacctccttcctgacatcttccctgaccatcctagccaaaatacccccaccccgtccctctctgtccctcgatcctgccttacttttcttcatcacactcagcattgccacctggaataacaatgatagactttttttgtttgttttttatctgtgctcccactagctccatgaaggcagagatcttgtttggctcgctgcacatccccagcacccaggacagactctggcacatataggtgcttaataagtgtcagctgagtatatgagtgacctccctgaacctcaggtcccttatctgcaaagtaatagatgccttgctggattatacttaaacatgcctcatcattagatggagcaatgaaaatttcagcacaatgtctggtacataataggtgctcaataaatgctcatcatgatgattttaaaaggtgtcatgctgaggcttgaggtgccattttcatcagaagtttgcctgataagatttaagttggctgggtgtggtggctcatgcctgtaatccaagcactttgggaggctgaggctggaggattatgaggtcaagagatcaagaccagcctggccaatatggtgaaacactgtctctactaaaaatacaaaaagttagccaggcgtgatggtgcttgcctgtagtcccagctacttgggaggctgaggcagaagaatcgcttgaacccgggaggtggaggttgcagtgagctgagattgtgccactgcactccagcctgggcgacagagggagactctgtctcaaaaaaaaaaaaaaaaaaagattcaagttaatgctttcctcaaactggaaggkatccccagaggtcattcatcctttcctttcccctgtccctaggcagaatggcatgtggcctggctcatgcctcrtggtgctggcctgtgctgctttgccagacccttaaggcagaagacattcttcctgggttagtctttccacccatgtaggaagagggagctctcttagggatgcgttaggcttccttgctgtgggagtgctgattttcactttttgaaacccagagctcacttggtggctccagctggggtctgctgagatggtctctccaaggtgaagatgcattctcgctccaggaacttaccaatgtgggagctgtggtgcgtacctctgttgttgggtcttagggagcagaggccagggcttcactcagctgcctggttgggaagcagtatgtctgtgctcaagagagtgagctcttaaggccaattacatatgttcacattccaggcctgacttactagctcatgaccttgcttagcttacctcatccttttggtaaagcttcctggtctataaaaaggaaataacaggtctggktgcagtggctcacatctgtaatctcagcactttgggacggtgagktggatggattgcttgaggtcaggagtttgagaccagcctggccaacacggtgaaaacctgtctytactaaaaatacaaaaaattagctgggtgtggtggtgcgcatctgtagtcgcagctactctggaggctgaggcaggaggattgcctgaactctggaggtggaagttgcagtgagctgagatggcaccactacactccagcctgggtgacagagcaagaccctgtctccaaaaaaaaaaaaaaaaaaagaaaaaagagaataataataacagtactttcttcactgggttattatgaagatgaaacaaggtaactaaataaagtacctagaacactaacaaagaatattactgctattattattatttactgttgccaggtttagcaaacaaaaatgcagcatgcctagttaaatttgagtttcagttcaacagtgaatactttttttttcttagcatgtacaatgaaatattggggacatacactaaaaattattcactatggatctgaaattaaaatgtaatggtcctggccacccttaatgctactatcaacaccactgcccatcttggctgcccccgtctccccaccatgcttcattctggtttctgtcagatgttccccrctttggctgggaatttggagggcaaagagatggctcttgcgactgaccagtgttagactggggtcctggattgttgttcctgttgtataaccacccagactcctccctctcagcccccacccatggcttcaaggccactcagcacttcttcatgaggctactccaggtgacacagcctcccccagcgtccctgtcatcagacttccacctctcattgtggcctactgtcttgcagcgttgtctctgtcttccaaaaggtagttattatgatctgtgctgggacctcgcgtgtaaagcgttgagtttacttttcagccatggcacattactatcactgatctgcacaataacttgggttatttatttaaatctccccctgactctgcactgcctgctacctcgcaggcagtcattccaaggcatcgtcgttctggaaaagatacagtgtttktttttttttttaaattaaaaaaaagactttattgtgtagaacagttttagatgtacagaaaaattggaagattgtacagagtttccatctaccccattcccagtttcctgtattattaacaccttacattaataggatacatttgttacagttaatgaactaatactgacacattatcattaactaaaattcacactttattcagatttccttactgctgcctttttttttttttttttttttaacctgctgcgatttttctattcagagttgtcaggtctcctaaracttctcttggtggtgacagtttctcagaactgtatgcattcttaatttacatagaaggtactgttttatagcccattctgttttttacttttttctctagcactttatttttcagatccattcacgttctgcatgtacattgattccattattttatttttatttatttttgagaccaggcctcactctgtcacccaggctggattgcagcagtgtgatttcagctcactgcaggctcaactccccaggtgccggtgatcctcctgcctcagcctcctgagtagctgggaccagcggtgtgtgccaccatgcccagctaatttttgtattttttgtagagacggggcttcaccatgttgcccaggctgttcttgaactcctgacctcaagagatccacccacctcagcctcccaaagtgmtgggattagaggggtgatccacagtgcctggccagactccattattttaatgaatgagcagtttgcagccaccacagtgtacctagtcactcccctagtaataatgaacacttaggttgcttccagttgtgtgccactgaaaaaaaggatcgagaatgaatcgtcgcctcctttggggcagcattctgtgatatcccctgctccctccatgccatgttggtgttaaactgtgcttggagattcatcagctagaggctgtgaggttctgaacaacttttcaccatgttaagatgcttggccttggctgtgagcagcagcctggaatgggggcttcacaggagagggagacttgcttgactgcacctggtggcagtttgaacagtaggtgcggtggccccacctgctcagctgtcccacccttctgagctgggcaatcttttaggctctgggttcattgactttaaggcaaatggagagcaaatgggttcctatcagagacccattaaaaatgattcacttagccttacagatcaaaagaacttcgcatccactgaactctgtttgaatagcagataattcacttcccaccctccttgatacctgggcatgcttttgacaggatgataattggcacataccttccatttggcatttcactttttcattttttgtgcatatttccatgtattgatattgtccatgttcatatttyaaagacaattcagcattttatcaaatgtctttatatgtcatttgataaaatactaaattttctttcaagtatgaacatttgctttcttagtttgaccgtttgattagaatttcatttaaagacgtcgttggagatgcttatgggtgacagagacgtctgcaccctaccaattcatataaatgagggccacctgttggtgctgtgcattgtgtcagagtkgggggctaatttaagcagttcaggagactgccccagccttgagcgtccagagagtttcctgtagtcctggcgggactgcgagtgggtgagctgaacaggctctgacacagctctggggaggtctggtcggcccacctcctcccactctctcttaaagaaacctcctgctttgacccagagagcgagcagggcagaggcagagactcacatgcatgggtgtcaccaggggcacctgagggaggggtctgagaaccaggcacagtacaatcctgtggaagccaggagggcatgtttgtagacttttagctaaagacctctcaccttgcaggccctgaaatcctagcagacatggccccaagcttcatccttgtgggcagctagatagctgaaattggaaatggagaatggcatgacagggaggccaggtgcccccttactaggggctggctttcttgagattgagggaccaccagggaactgatagcagaagttggctttaaaattcagcgtggcctggcatcgccagcaggtctacgggctgttcttggaagggacagcgtaccatcagggaagtctsggggcccacagctgctttcgggaggtggagccctactctgtctcggtatcaggtgtgaatccaggaatttcccaaatcctttctctgcagagaggagactccctcctcctatgccatgagatgtctctgacccctgactcctcaccctgtaggtctggcagagcctggatgtctggcatctcaacctgaattgcagcactgagtcaaagggggatatcttgggtgtgtgacatcgtgccctcccagggaggcccatttagcagagaggactgagaaaatcagaatgtcgcctcactttcttttttctyttttttycytttttgagatggagtctcactctgtcacctaggctggagtgcagtagcgcaatcttggctcactgcaacctccgcctcccgggttcaagtgattctcctgcctcagcctcctgagtagctgggattacaggtgcacaacaccatgcccrgctaatttttgtatttttagtagagacagggtttcaccatgttgctgaggctggtctccaactcctgactgtgtgatccgcctgtctcggcgtcccaaaggcttcactttcttaaaaccagctgccactgtttctcaggctctgtcgccatcccactttccacctccttttcaggaagaggtcggggtgactttcagaaattctgtctttagagtgagatttaatctatggttttaaggaagaaaacggacttttctgagtgccttttgtgagcctcatcacgtgtggttttgctttcacttgtgctcatttagtcttcatgaataccctgcaaggggctgttattcccatcttggaggagacaggccaagtggcttggccaaggtcacgctgccactaaggggtcctgctgggatttggaccctgtctgagctttggagcttctgggatccttgtcatcccgaggagaaccaaccaagcactttatagtagttttctcttcctccctccccagaattcacagagattctctgcagaggtcagcagttacgtattcaaagcgggactgatttacggagtacctattcttcctttccagaaggagcgtgtggcgccagggccgtgagcccactggactctgggctttttgccctccctggaggctgctctgtggcctctgaagcacaggttggccctgggtgaccattttttgggacccagatcagtycatcacctcacagggcgaacactcagacttgccgctgtcttcctcactcttacctatataaaacttgtcttgaagcagttctcctcttataattctcaagtctggcttggttttgctttgctggggaaactagggcttagaatccttaggaaaaccttgctgtttggttttctagggtgacagcgtcccctggaggccttcctgcccgttgctccgtcttggacatccacagagggcaggctgctggtgctggatcggggcgtggtgtatttctatgggatggggatctccaggcccccattgactccattataaaatgaggctattttctcctctggagtgggatggttgcttgtgttcctaggaaaggatatagcaaacgcagggaaaatgcaaatatgggttttaatgatgccctcgtctctactgtttattcgtgacgctgccatgctctcctgagtgtaggaacagtcgtgccgctgctgctcacactaatgactggggaagatgcgatgatttccctctggctttggctgtgttcctgtcctgcttgtcccaccctgaggcagcaggctgggaccttgggcttctcccttgcctctttcctaccccgagggatctttggggaacacaacaaagaactctgcagcccctgcccctgggaccgcacagctgagacagggaggcacagtagggctggctggatttgatctcagaggggacgcctccgggcagcctggggtggggatgcacagggaaagcagggaggggcaaggcaagcctccaagcccccaaatccaggtacatgtctatttccatctccaaagactctataatgaaaacattaaccttcagcattctcctctgatgctcgttttagcctccccccaccccaacctccccaaccctgaggaggttagagcagctaatgtcccttctcaccgactaggaaacgtaaagcaccttgtcaagtgggtgagtagcagggctgggccttgaaataaggtcttcttgcttctgctcctcttgttctttattctctcatactccccaggaggtggcactcacccagccacagagatgagcagtgtccaggttttgcacaaagctgggcagtgggtctagtgaaaagcaggctgagggtttacacggaggaggaagggagctgggtgtggctctttaccaagtcctttatgtctggagtcttttaccaactgacagggtgcttctggagatctctaggattcctcagaaggggttggaaggaggtttctgggctttgatctgccatatcccaaactgcagtaccagatgctatggctcaacgaatgtcacggttgtccttgtcaagggtttctggtctgtgcatcaccttagccagctgtgtgctttgctgattttctttgttactgggtgccacctgtgatgtgtgagaagatgggatcataggacattatagttgtaacaacagcttggataatttctttcaatttcatcttagagcgggaactgaagcccagagagaatatgtgactggcacaaggtcagactgctggttaatgccttaatcagattaaatactgacattatagagtctatgcagacaaataagctaagggagtctggcttccttgcgttagtctgtcttcctcctagcaaagttattatctccctatctgactggtattcctggtacgactgtacttggtgttcgtggctggtgcctgccctgattcgcaatgtgttatgctggttgttaaatatcttgagtatcacccgtgcttcctactgtcattcacatcaatgtctgcatttggtgaagagagactcgggggacagttggtttctatcttgctaatcgtccctcttcatggcactgctagatgttttgggctctgagacacacattgagaaggaaagcccttctgcatttgtcacttgataagttcagggtctttatcggtctggggctggttgggcagtcacagcagctgtaaagcaactgccaggagggacctgccaggctcagtctctggcccctctctcctgcttttcatgtagcagacatttactgagcacctactaggtgctgggtcctgggtgggctgggagctgaggatgctgaggtgaataagacatggcccctgctttcaagggaagcagacctgacctgggagaatcaaatagggtctaaaagtgcagtaacagaggtgagaaaagagtcctgggagagtgaccgatggtctgatggactgggaaggcttaactctgttgtgaaggtctgggtgaaatcaacttccctctccctgcccgcagatgctggggtccagcaggagtgggtgagctctgtttcctacccttgtcagatctccaggaagaactcaccctcaggatgctgagatgctggcgtggactgtgcaagtgtgaaaggtttagctgaagtgggtggtgtacgtggtagacagagtctttaaggctttgaggtctgaggatacagaatggttatatctgggcttgacagatgatgagggtggttcttggggccacttcagccttaagtgtcctccttcactgaagacagagtctccctgctacccctggacagcttcttagggtgcttatatctgatgactcctggggccatatgacagcatcaagggttcttgaatcttgagggttttgtggatagaattcaggggtagaatccacaaacttgaatgatagaaaattacatctttattttcatcaacatttaactgacatttagtatttacttcaattaataatataggcaaaaacctacattaagatgagttcctgtgactgtcactaatagaagtaacacatagaggccaggttctgtggctcacacctgtaatcccaatactttgggaggcctaaatgggtggatccactgaggtcaggagttcaagaccagcctggccaacatggtgaaaccctgtctctactaaaaatacaaaaattagccaggcttggtggcacgtgcctgtaatccagctactccagaggctgaggcacgagaatcgctggaacccaggaggcagagattgcagtcagccgagattgtgccactgcactccagcctgggtgacagagtgagactgtctcaaaaaacaaaacaacaagaacaaacacatagatttgtatcatatcaaatttgttgcacaaatctcgaaaacaaattatactcatttgtacttagaaattatgccaatttttagatgtgtctctaggtctcattatttcatgtgttaatagagaaggaagtctattactatatcacaaatttatgtttaactatttggataactctgtttctatacatttagtctccttgttgcctcggataattattttatacatttaaaaacattctgagtagggtccatagatttcatctgactgtcctgaggttccattccatggccccaaaatgcctacatgcccttgaacatattccccaaagcctaggagaagccttaggtagagcatggcagtcctgcctggctgctgtatgaagggagatcaaataggaacgcccaccgcctgctctctgggcacgcactgcccagagagggctcctgaagagtcctgctgcaggtgcacttgtggggcacgggatgatgctgggctcctgtgtgctgctgtgcagctgcctctccgtgtgcacagctaactgcactttggaagcatgttgtttagtccatggtgtgcctgaacccaagaagggagctgagcactggaagacctgggttctaggaccttgtctgctgccaactggcttctctctggatctcgacttctattctggaaaaagggaaggttgggtgtgaaatcagggattctccagctatgtatctgacagtactgtcttcccatgacttggagtaaggtagtctataccaaaataaaaaaattgataawgtttttgcaatttactaaaaagtaacatgaataaagatagttttctcaatttacagttgttctaacatatctttttgttaaacctttggaagctgttaccccttgcctgccagtaagtacttgttgagggcaaaaggagtgggtgagaagtgagagaatattaatgggagcatgtggaattggccaatcatgtttaatttctaggcttagtttgggttgtgggtttttctacagaattattcctagttttaatggtggaattaagcatgctggtacgttaagaacctttgtaaaggatcttgcaaacagcatcatgatctgtgcatgttctcctagctcccaccagtctccagggccccttcctgctctgctattttgtggacctacagcgtgtaatgatgcattctgctcaaaaggcggatgacccttgttctgagtggactcatgattctgtgtggagtgaaggccattctccagaggagataatgctcctgtttacattcargcaccaatacaagcaatggtgcaccccacttattccctgccttccctattctgtgcacacaattgtaagggaaaacaaagcgacagttacaatggaagcaaaaggaagagcagctgttggggatgttagctgtgtcactgtctgctgagcgggacagatgcacttaggaggcctcatcttctcttacctctcttggcttgcccaggagcttagctaaagtcagagggttccatgatgattcatggaaattgccatttatggcctaatgcctcctagggaaccctgggtccattctgatgtctcccagaatgtgtttaccattccttgagcatcactgggttgggagtctcggctactgcaaaccactccactgtggccagcagttggactttctgtccagcccagcaccctgggcagtcggactctcggcttggatagggtgactgctggtgttcgtattactgccttgttgagtttccactcaggaattgattattctcaggtggtaagggctgaggtctgtttgaccgtggatattttagcccatgctgttgatccgttctttctgggctcttccagcccagggaacttacacttagctcatccacaggccgttggagggtgaaggcttctcaggcctcagagaggacctgtgagtcttagcagcttttcaggaacaggaaacagaaggagtggaatttgatgggtgtgcttttctgttgttctctgcagacacgggaacccccaaaggcttcagagtggaagccccagggtcctcggagctggtgtgggtttgctgctggctccctgcacacgctgcccgtgcgtggttacgagtttgtgtgtgttgctatgtactsctctcacggtgcattgtggagttggggaggttgcattcagaccaactcaggccacgcctgtgagcagggtctggcatcccagctctgcctgctgaaggctgagagcatcagtggtatgcgtgggagctgccttccccactgggctccccaggagcacgatgtagcaagaagaacttagggtatggagagtgaagggccaggttcactgatgtgtgtctttgtgcaaggttcttagccatgccgggtctattttcttatctgggatctgtagcccacaccgttcatgggcgaaatacttcatgaattgtaatgtgtcataaaataagccaaagttggctctcccaccctgtctacctttgtgcttcaattttcctttttttttccccctctttatgggstgagttgaattcccttcctattttctgaatgaatgaaactgcttgatgagtggattaggcatccccaaagggagaaggtgcagggagtttactgtcttgttaggaaattagaaaattcatgaacagagagttaacagttcaaggcatatrtgccaattgcctcttttctgggctcccagagtaaaaggtttcacaaatactggttatttgaataccatgattatgagtttgaataccactacttactagattcctaattttaggcgtagccatttactatctggactattatttgctgaatatttttgttaaattggctcacttttgaaacttaaatttattttaaagggaaacattctatcattatcagaaatggagaaccaatatcactggccaacagatagacaataattataaaaataggcacaaccgaaacaaaacgacatcattcatttctagctggatactgttggctgcaggagatccgagaccggggcctgcttactctttgttgagaaggaagcttagctagcatcagagaggttaaagacatattggaaacaaacggagactttatttttgcaggataattgaaaacggactttcttgttatttaaaaatgttatttgatgctatgttgcatccatccatcatctaatgcctctcattctgtacttgggcaacattaccaaagcacctagtacaccttctagagctatgcttgccgctgaatggattgaagacttttagaacagagactgtgtctttctaatttatttttatttctatttattttatttttatttatttatttatttatttattttgagacagagtctcactctgtcaccaggctggagtgcagtggtgcgatcttggctcactgcaacctccacctcccaggttcaagtgattctcctgcctcagcctcctgagtagctgggactacaggtgcgcaccaccatgcccagctaatttttgtatttttagtagagactgggtttcactgtgttggccaggatggtctcaatctcttgacctcgtgatctgcccgccttggcctcccaaagtgctgggattacaggcatgagccactgcgcctggcctttattttatttttgaaaaatagggatggggtcttgctatgctgttgaccaggctgctcttgaactcctggcctcaagtgatcctaccatctcccaaagtactgggattacaggtgtgagtcaccatggatggcctctttttttytttttcytttttttttttttttaacaatgtgtgacatattgataatataatagcctttagtgctgtttgttgaatgattcaaagcataatgcctagcaaagataatacattgtagagttgctccaggaggcagagatgcccaggagcttgagttgacagggaaggccaactggagaggaagcccttggtgccttctcctagccctgcccccaattatagcagcctgggatctctgtgtgtcagctcctatccttttcctgcactgaaaccttctccaattcctgcctctcattcaatagcagtattgcctttggttctcccatctccttcctcagtctgggaagaaaacaccacagcaatctgcagcccgctcagagccacccaccctgaggagacgcccgaagagagaaagctagaagccggggtgggatgaagggataggggagagaaggtgagagagaggagacctgtagggtgaacctgagtccctgaacaggctgtcatctggtccagtgttttggggatttggtgacctgttggggaaagaggttgagccctggggtgttagcagattttttttgtatctttccacccttccttcttttctagttctggccttctcttctttctttcaaccctctctggctctgtgccattgggcagattccaaggtcataatgattactttgtcatggacttggatttgtcatgggctcttcagaaaaaagacgcagacatgatttcctagggacagtatgtcaggcactgtctccttgtcctgaaagcttctctggtggtgggatcttttccagtcatcaggaacttcctattcagtgttgccaggaatacctgctctctctttcctgccactggggcctcatgaatcttgggcccctccctctctgatcmctgtacttctgcttttgaagttattagtaataagagatgcttctactgtgctaggaacataaagtaactcatttaatctttaaaaccactccatgaagcgtatactaccactgcccctattttgcagataagaaaaccaaagttacataacttgatcagggtcatcccagcactgcccccagggtgatgggggagctgacattccacaccgtcctccctgccagagccccaggtggctccaggtgccacacggccctaacacgcaacagcacctggtgctcccttcaattctttcagcgttatcccccagcctcacccccctgggaacccttgctgccagtgagggattcaaaccctgagcctgagctctcagtcactgccgtgtcctccctctccagggatgaggttcctgctgtctgagcttggcatggggaaaggggagtcctagagtccactgtttggattgtcagccacttaagaaagttcaggggaggagaagaacacctctgaacttgagagtatcctcttcttatcattttgttccctgttccctttgttctgctgatcctgtcttccctcctgtcagcctargtgggagcttgtgggttgggaaagarctggatccctgcagataccttttaattacccttgggctgtgtttgtggtgagaatcagtctgctcaggactgcccctgagacaggtgtatgggtctggagccagcaggcaggggtgagaggtggcaaggcttcccagggggagcaaggctagaggatgacactgcamaatttgaagatcgagaaggagcatcgggtgctgtggcatgtcggggccgtgtggtaccagggtcacctggggctctggcagggaggacaggacgatgtggagtgtcagctgcccccggaagcagtactgggataaacccacaggtgtgtgcgccgctcattcgtgctacaggcatcaggagaggtgatggtgggcctgcgaggcgtctgccctgggcacactcagccttcctcttctgtggcttcccttccatgtggttttcccatcactctccctccttccaatcccactcattcagacccttcagtgtaaccctgctttgcggcagctgcatttttctcagggatcaaagccttaggtgaatggtggtgtattgggcaccagcaggtggagcaggttctggaaatcacatcatattggctctttcctttttcaaggaccatggtcccagatgggagtccccccttctttactacagcttccataagctgcttacattggagactaatgctgcagcagccaggcaacatttgggctggaacactcttcaagcacagaggcctgcattgctctgggatgaagaaagaggggatgatcatgtggtgggcacatttggggaggtcagtgtttaatgaagaaagcagaaggcaggaaattgcccagggtcatgcaggatgacccatgtacatgtgtgggtttcctccrtgtgggggctactcayggagggtgagtgcttaatctgctcaccacctcttgcattctgggtcaccccttcctgctgctaggatgctcagaagtgggagctaattcagtcattaatcttagcctaaaccaggctgaattacacagatatgctgggatcttccactctcaaatgcagagtacaaatccctccaggaccaaaggaccaaagggctgcggtttatctgtgctaccactcatcatctctgccagtttggataattgtgaattgtctgcacagaccttgctgtctacacccaccacacacacacacacacacacacacacacatctttgcacatcctagctgtcttactgtaatgcttggaaccaagagtggcagagctgggaaggtttcttgaagaagaaggttctggtgtaaagcacagtgagaatgccagccagaatctgaatttcagctgagccactagaggacatataaccgtggggaaattatatgatacttcacatcacttcagttttcttctctgtataagtaatctggctgaattgttttgaagaaggatggcacatagtgggtgcttaatatttgtccaggaaacaaataattaaatgatataatgtatgttaaagagcccagtgcagtgcctggcatatatcagaagctcaggattagctgttyttagagtttcttaatatcaggtccaaagatccctcaaactcttttgtctttttctggcctctgggatgacctacctgtaagttggatgtaatctcccatcctaattattcccagttcctcttctggcctggctttacagaccagcatgagacttcaacactgcgcaattgtccggtgctgtggagagtctgcattcagaaagacagaagcctttgtccttccttctttctagagtctctaaagctcttccaagagctaagacccccatgtcatatacctcaccaggaagctggatggtccctaggaagactcagctaaaatcatagagacctttgcattcctgggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcccattcccttcccttcccttcttttgtgattgagtcttgttctgttggccaggctggagtgcagtggtgcgatcatggctcactgaaacctctaactcctgggctcaagtcttcctccgccttggcctcctgggtagctggaactataggcacatgtcaccatgcctagctaatttttaaatttttcttttgtagagatgggggtctcactatattgccaaggctgattgcaaactcctggctccaagccatcctcctgcctcagccacccaaagtgctgggattaaaggcatgaaccatcttgtccagcctagctattttgaatgccattcttaaatctcacatccaaatttaagtgtattaatatagcttgttatcgtgagttttttaaaaaagtgaataagcaacctaattggtctgctttttaatcctggactttcagatatcaagtttgttcgaagtgaggtgcactgtagctttctcactatgctgtagtggaaggggatatttcctctctatacatctctgagtgtaatctagcctataaactgactgtaggaagagagaatataaactgcctcttttgctcgctcatgcagtatctcaaatctcaggaggaagttcttcctaagatctaaccgaaatccctccagagcaactgtatgttggcaaaggaataagtcaaatagcatctgtgtgattggcccctcggagtctaatgtacatggggaattgtctctggagcctcattttgatgctcttatgtcctaggcaatggagcaacaggattggaaaatatcttccttgtgggcctgaggaggagggattctgtgtatctgcaaataggagttcctttcccagctttgtctccaactcagaacaggtcatgtggtttttcccagctcttgaatttccattccatttttggctggtttgagttcctccatctctcgtctcctgcaacacctaccgagcaggtccactcaccgtattctgcagaatcatgcagtcgtgtgcatcagatgcttgaaggtcacctcatccatgcccccagctctggacaggctgtgcatgtcagggtccttcagacttcttcccagggggcttgcccatgctcttacgtaatatctccctatgtttctagagtctgacccgaacctttcttgctgccatctcaaacccttggtccacatagtggtggcctccagggaggcaaagaacagctgcttgtcctcccccttgttccttccttgttcttgttggggtatcacctccatgcatccagctcatgaatcccccagcaatttctttgtcaccagatcacattgcaagctcctgtccaaatgctgtctggctgcttcctgttccaagcatctccctcccacctgagtatttgtgtttctgattatttatccccagatgcaaaggccgcatttttccaggttgaatctgctcattgttacttcctgcctgggtttgctaacatctccaggtccctcttgcagccaccgctgcagccttgctcggtatggaaaygtgtatttccaggcttcagaaagcaaagcgtgtcgggaatgggasgaggagaatcagtgaccctgctgagagtggccccacctcatctgaagtcaaggccctccccaggagaacgtctgaattgatgaatacaaaaagccatcaaagtgctgccggcaggggaatgacctagactgagacctgtcccagctgttgggctttctctgagtctcctgagccgagaacaaggagacgccttcctgccctcttggccttgactctttccaaacagccatcaccagttctaattaaatactcagcagatgaagtgactgagcaccagaggggaggttgggaagatgctgtgtgcttggccatttcctgtcccggccccacccatggggaaggggattgtggtcaggctgtgccaggatggcagggaccacacgttaaatgcggaggtagagcaaatgctcccccatgtttttttttttaaagggagagttcactttagttttttkttgttgttgttgttgttttccattttattttatggtaagccctcgatgactcagaaagagttggaagggacctttgagagtctttaattagcgtctcattttacagatggaggtccatggaagttcagtaacatactcaaattcacaaaygcatttttaaattgtcctctgccctctagatgggtgctaaacactgggcatggaaagtgaaatctctcgtgactaggaggggctcagaaacggatgcctgatccaaacaaccatgtgttccagggagtaagtctcagcctgcctgcatttttcctcactctttaccttgagccagagctagaagatgaagctgggcatagtggtgcctctccatcctctcagggctcttggttgtcsgtgattacattgaaatccagggctgtgatgtgggttgagttggatactgcttatgagagaycatcagaacttgggtgacaggggaactgctgaaaaacggaactcatgcatcctgtcccccttcccaattctcttgcttcctatccactgcagctttggagtattgaacatgttgctagttaggagggctcctcagaagatgctgatgaatttggaatgatttttaaattcatctggggaaataaacagctgcagcttgaaacacaaacacagacacttgtgctgctgtgtgttccccctcccaccatccctcctccctgatctgggaaaagcrcacacacccaaaccatgtagaaacgcagaaacccatgtgcataaactgaacaaccactgtgcaaaggaaaagggatgagctgtcctagagactggcagactctgtgctagaccagcagatgacatggttctaagaacagttatytggaatccgagggaccttkgcatccctggtttgcagagctctttgcaaaatggagctgtttctstcttctaagaatcttcagtttccctagggaaaggagaggagaaagggaacaaacatttgttggtcacctgagtccatgccaaatgtatatattaacaaaatygttgtgaagtagcaattgttgttagattattattcccattttacagaaacagaggcttgcggaggtgaagctggggctccagttgagatctgtgactttgcatgacacaggactgctttcttattcccctggctctgcggagttgcctgagtgagcatctcagaatccaaagtctctgagggaccgtgtgattttaggggacagctgctaacccactaagtgtgtctgtttcctctctgaagatgggaatcatgcactttggctatttggctgagttgctagaattcttaataagatgaagtctctagtcctctgaggtgtgattaggaatgacaatgaaagagatgtttgccagtcctctaagctggaagcatcacccagaggcgactgtctcaatcaatgagtttactgtgcacttactatgcatggccaaggtgttggcggactccggagtcctggctcaggtgaacagcagggggagtctcttccatcttaatgagagatgagctgcttcttgggctgcagcttggttttacaggctcaacttttttccttgagaaactcctctttctaaaccccattaacccctctagctatggccttctcattctcctctcctttatagctaggcttttaaaaaagcctcttttggaagtatagcatatatcagaatagtacacaaatttttaktgtacaacttggtgaattatcactgagtggacaaactagaggaactgccatccagatgaagaaatagaacatttccagctttctggaagtcccccttgggcctccttccagtcgtgaccctacccccaccacccaaaggtcgtgactattctgacttctagcatcacagatgagttttgcctgtttttcaactttgtataaatggaatcgtataatatgtattttgtgtctggcttttgtttttgcccaacattaagtgtgtgcgattaatctatatggttgtgtgtagtagtggtttatgcgttactggatagtatttcatcgtttgaatgtaccacattttccttgtctgttgtactgttgatggacgttagggttgttttctgttttaggatattatgaatagtattgctatgactattcttttacaggtcttttggtaaatgcatttctaaagggtacacacctaggagtggaattgctgggtcatatggcaggtgatgaccagctttagtagacactattggaaagtttccaaagtgtttgcatcaatttatattccccattagtagtgtaggagagttccagtttccctacatcctaccaacacttaatattgtcagtcatcttaattttagccattytgatacatgtgtagtggtatgtcagggtggttttaatttgcaatatctggtgactgctaatgagataaaaaccttttcatatattttttttccagccatttggatatcctcttttttaaagtgcctgtttgagtcttatagccattaaaaaaatgggttgtctccctttttcatattgacatgaagggattcttcatctatacttggtacatcttttgttgagtatatattttgcaaatatcttcttctcactcagtggtttttcttttcactcttttggtggataaatgttctcaattttattttacktcattttattgatcttttcctttatgtcagtgctttttgtattctgtttaagaaattatcacctatccaagctaagaatatattctttgttatcttccataacatttatttgttaacttttcacatttaagtccacagtccacatagaattgattttttttttttttggtctgtatgtggcatgaggtgtgagtcaaaattaatttttccccactttgatatcccattaacccaacgtcatttattgaacggaccattcttcctcattgctctgctggattattgaagccaggaatcaagactttgtctttgtatgggatctgcttctggactttattttattctcttagtctgtttgactatccttgtgccaatatctcattatcttaatcactgcatctctcacagactttttttggaagttatttctacttactatgcccatttctttacctgtcactcagcctactccaatctgcctctgcttcccactgctgtgccccagatgctcttgtatgggtggccagggtttctagtaggtgctaacctgagcagtttttttttctttttttagttcttagcttccttaacccttgagcaatattcagcacagtaggacattccttcctgttggaaacaccattttccctgatgctatccatacttttctgacttccttcctgcttctctggctgcttcctctaagtcttcttggctgggtctttctgctgtaatgaattcttttttatttatttttttctttttttacacctctcatgtctctgcatctatctgatgattaaatattgaaacttttcaaagctcatccctaggttctcttcaaaaaagggagatttaagaccctaaaaatcttaaggagtgactttacagtcagtcttaagatgatttattttatgttcaacatttctgttgccatctttatcgtaagagaactccaaaatttatatttccaattagaattgtcttcaaaagtttaaactatggattatctcaactggaatttttttcttccaaaactcttcccgaattacccttttaatccagttttaaatcctttttaaaaaaacctttctacctattctctgtgcactcagatcccaaccagttggggcttcaaataaaatatttaatttctttgagattcagttgccaaaaatcattaatagggagaattatttctctccttcatgaggaaatttagagaattatcaaaattatttctgtaaatttatttcctatctttagagacagataatatctctacacagtgttagttaccatcccatttaggttcctatgaagcacccattatcttcaatggtactgttttcatcttcattctgaccatctagaaggtggggcttaaaaggaggggaaaattgaaggcactgtatgtattaaagctggagtttcaatgttataagtgaatactaatcaggattttaataagatttaaagttcttttgtgtagtctactggttctcaatttgagcattatcagaattatctggagaacttgtttatgaatacatctttatgtgtgattttattagttgttgatctagggattacaacagatatactttttttgtttttgttttgattaatatttttatttcaatagttttggtggtacaggtggtttttggctacatggataagttctttagtggttatttctgagattttagtggacctgtcactgagcagtgtacaytgtacccaatatgtagtcttttatacctcacccsccttccagtccccaaagtccattatatgattcctatgtctttgtgtcctcatagcttagctcccacttataagtgagaggatagaatatttggttttccattcctgagttacttcacttagaataatggcctccagctccatccaatttgctgcaaaataaattatttcattcctttttatggctgagtagtatcccatggtatatatgccacattttctttattcrctcattggttgatgggcacttaggttggctccatctttgcagttgtgaattgtgctgctgtaaacatatgcatgcgtgtgtgtttttcatataatgactttttttttttcctttgggtagctacccagaagtgggattgctggatcaaatggtagttctacttttagttctttaaggaatctccatactgtttttcatagtgattgtactaatttacatcccaccagcagtgtaaaagtgttccttttcaccacatccatgctgacatcyattgttttatgactttttaattatggccattcttgcaggagtgaggtggkatctcattgtggttttaatttgcatttccctgatgattagtgatgttgaacattttttcatatgtttgttggctatttgtttatcttctcttaagaaatgtctcttcatttcttcactggttctgtttatgtgatggagtatgtctctgtttgcaaatgacatgattgtatatttagaaaaccccatcgtttcagccccaaatctccttaagctgatatgcaacttcagcaaaatctcagaatataaaatcaatgtgcaaaaatcacaagcatttctatacaccaataatagacaaacagagagccaaatcatgagtgaactcccattcacaattgcttcagaaaataaaatacctaaggaatacaacttacaagggatgtgaaggacctcttcatggacaactacaaaccactgctgaaggaaataagagaggacacaaacaaatggaaaaacattccatgctcatggataggtagaatcaatatcatgaaaatggccatactgcccaaagtaatttatagattcagtgctatccccattaagctaccattgaccttcctcacagaattagaaaaaactactttaaatttcatatggaaccaaaagagagcccatatatccaagacaatcctagacaaaaagaacaaagctagaggcatcacactacctgacttcaaactatactacaagcctacaggaaccaaaacagcatggtattggtaccaaaacagatatatagaccaatggaacagaacagagccctcagaaataacgccacccatctacaaccatctggtctttgacaaacctgacaaaaacaagcaatggggaaaggattccctatttaataaatggtgttgggaaaactggctagccatatgcagaaaactgaaactggatcccttccttacaccttatacaaaaattaactcaagatggactaaagacttaaacgtaagatctaaaactataaaaaccctagaagaaaacctaggcaataccattcaggacataggcatgggcaaagacttcatgactaaaacaccaaaagcttttggccacaaawgccagaattgacaaaggggatctaattaaactaaagagcttctgcacagcaaaataaactatcatcagagtgaacaggcaacctacagaatgggagaaaakttttgaaacctatccatctgacaaagggctaatatccagaatctaccaagaacttaaacaaatttgcaagaaaaaaacaaacaaccccatcaaaaagtgggtgaaggatatgaacagacacttctcaaaagaagacatttatgtggccaacaaacagatgaaaaaaaactcatcaccactggtcattagagaaatgcaaatgaaaaccacaatgagataccatctcacaccagttagaatggtgattattaaaaagtcaggaaacaacagatgctggagaggaagtggaggaataggaacacttttacactgttggtgggagtgtaaattacttcaatcattatggaagacagtgtgtgattcctcaaggatctagagccagaaatatcatttgacccagcaatcctattactgggtatatactcagaggattataaattgttctactataaagacacatgcacatgtatgtttattgcagcactattgacaatagcaaagacttggaaccaacccaaatgcccataaaggtagactggataaagaaaatgtggcacatatacaccgtggaatactatgcagccataaaaaaggatgagttcatgtcctttgcacagacacagatgaagtttgaaaccatcattctcagcaaactaacacaggaacagaaaaccaaacaccacgtgttctcactcacaagtgggagttgaacaatgagaatacatgggcacagggaggggaacatcacacactggggcctgttgtggggtggggggctaggggagggatagcattaggcgaaatacctaatgtagatgatgagttgatgggtacagcaaaccaccatggcttgtgtatacctatgtaacaaacctccacgttctgcacatgtatcccagaacttaaagtataattaaaaaaaaaaaaagaaaaaaagggaaaaaaaactacatacaaaataaagaaaagaaatgtctcttcagattctttgcccactttttgatggaattatgtgttttctttctttttgatttgtttgagttccttctagattctggatactagtcctttgttggatgcatcatttgtgaatattttctcccactctatatgttgtctatttactctgctgatgatttgttttgctgtgaggaagcttttaaacttaattaggtcccatttatttatttttgttattgttgcatttgcttttggggtcttagtatgaattctttgcctaagccaatgtccagaagagttttctgatattatattctagaaatgttatggtttcttagatttmagtctttgatccatcttgagttgatttttggatatacttgttttctttcagtctacttagaataaatattttaccacttcaaatgcagtaaagaagccttaccatcttagaagttcctttgcctttcctcctttgtatttgtcttatgtattatagttacacaaattgaaaactctatgagaaagtgttataatttttgttttcagttgtcaaacatttcaaagaatttaagaagtgagaatagtctatttgcacagacagttaacatttttctggttctttattcctgatgttctaagtttccttttggtacattttccttttttctgaagaatttcctttagcaattctttgaaccaagtctgttggcaataaattaccttagttttcctcacagaggagtctttactttcattcctgaatggtattttcacaggttatagaattcttgattgacaattcttttctttaagcattttcaaaatgttgctccactaccttctgaccttcatggctcctcatgagaaatctgtggtcattcaaatcactattttcctgtaagtaatgcattgtttatctctggctgctttcaaaactttttcctttgtcgttttcaatactttgattatgatgtgtctaggtgtgaatttctttgagtttatcttatttggggtttgctgaacttcataaatctgtttctggtttatacctctcaccaaatttggaaagtctgtagctattatattttcaaatttttttctatgctgtactcattcttctgaccttctggagcttcagtggcattaatgttagatgtttttggtttgccttataggtctccaatattttgttcattgttttcaacatgtttttttgtctctgttgttcaggttggwtaatttctattgatttcttcaagtatactgactcctctgtcacttcaattctgttattgagttcattcagtgagttttttaattcagttattttattttttaattataaaattcccatttggttcatttttatgtcttctattttttttttctgaaaatgtctctttctattcatttcaagagtgtttgctctttcttgggccttttttgtaatgactactttaaagcattggtcagataagtccaatatctttgtcatcggcatttgtctattgtcatttctcacaaaagatttccttgttctttgtatgttcrgtaattttaaattgtatcctggacactttcaatattatgttatggaaatctgggttttatttaaatcctatttgtgttttatcaggcaattgatctggttgggttgaagttgcaagttctgaccagaattctgtaggtagtttcaaaatcagtttcattttcacagccttatgctatttgagtctatcctatggatgctatcaagtggccaggttgagacctggttagtgatgtattatgtagctcagtctttactgtcttagggtatatagtgtgctatttaggatcagatccatgcacatgcagctttagggtaagccaaagggttcatgaacagcttatgggggcattttgctgagctcttgcctctccgtgatctttgcagaaccttcctgtcccctgagaccctctttgccatccttcagccagaaatcttggaatctacttaccctcctctgccacatacttcccaaaactgcacctgtgtctggggccaagtggtgaaaggacgcacacagagaaaaaagcaacaggggtttgctccaacctcttgggagcaaagaggaatgttcctctcactctccttctaggggcctgtggtctagcatgtgaaagaatggagaaaagaaaacaatgggggcttccttccactctttctgagtgttaagagatgactttctttttctaaagccagaaatagagggcttctcctcggctctctctgtccatgctaatgaccccttctgggttttggactgcttgagtctaagctgactcaaaaagaaagtaattttgaggtggcatagaaggagaacgtgtctgaagagaaatgtgtgatctctacacagtctatcaggattgtaaatggacataccccaaaggtggagagagtggaatgtgatgaggtctgaatgcaagtaaaaaggcaaactcaatgaagtgagyttgggagattcaagttctatatgagctgtgacttgtaaaatatgggaaaggcaaacaatgttttctgtgtcactgcaagggaaagaagacagcaggtgaccaatcctgtaagtgaatggcagatattccactgtgctggggaggaaggcagtcactggaggaaaagatgtcagcccaggtttttgcagaaggccatgcaagatatttatccatcagtaaacatgaactgattgtgtaccaactsagatattgtacctttgtgaattcttcccctgctgcctcctcagggatgcccctgtttcctatgcatgcctttatgatgggcctcactgacttgcgctgtaaactgcatgttcatctctaccttgaggatggggactgcatctttttcaatctctaagttcctaayacagggcttggcmagaaattattaggctgaattctttctatctcacaatttaatgtgtgcctttaggaaaatcctagaagacagagttgcctaagaatatttaacttcagattaaggtatttataaagacaaagcagtctcttgacatattctgacatgtgaacctctgctctgagctgtgagtagaaggacctcttctgacagggtcccaaagggcttaagacaggggtctgttccattgtctaatgtgctccagtgtgataagttggaggcacattctgcattgacctgaatgtgccagtgggttggcaatgaggctgcaagcacctccaagcagctgccatagtagagaaatggactctggccatgggaggccttgtcatcttccccaggcccctggaagaattttccatgcagccaagggctcaatactcgtgggaattaatcacttctgggcagtgctggttttcccaagatgcaggtctggacagaaaaaaaaaaaaaatggaattttaagccccagggccacagactggaggggacctggtgagtcctatttcccatctgtgaacctgcttttgcttgtctacagacacattgcctctgattgtctttcctttctggacttttagccttaagggcctgccttatttgtgcaactcacatgagtcctccaggccaccaggaggtggtaaagggtcttggacggggtgcttcattgagcgaagctctatgatcagtaggaagttaatacctcctttaagaaagagttgacttctcagtcaggcactgacctaaaagctttcatttcccctctacctgagagccctactttggcattcctgggttaatggcctgtctggtggccagcatatcacagctgttaccagcacaggggctgtgtaaagaggaaacccagtcctggctccaagagactggcagtctggggaaggagatgggacacgtgtaagacaggggtcgtttaagagtcccacctttgtggagttgtcctgatttcctcacctgcgctcctggacacttattatgctgacccatgttttaccaagtgtctttttgtaatgtaatgtaattgctttttgtccaactgtccctcagcagcatgtaaactctctgagggcaggggccatgtggaattgagaggtgacagcgtgctggcagtccttgcagccctcgctcgctctcggctcccactttggtggcacttgaagagcccttcagcctgctgctgcactgtgggagcccctacctgggctggccgaggccggagtcggctccctcagcttgcagggaggtgtagagggagaggcatggkcgggaaccagggctgcgcgtggcgcttgggggccagcgcgagttctgggtgggcgtgggcttggcaggccccgcacttggagcaaccagccggccygccggccgtgggcagtgagaggcttagcacctgggccagcagctgctgtgctcgacttctcgtggggccttagctgcctccccacggggcggggtttgggacctgcagcctgccatgcctgagcctccccagctgtgggctcctgcgtggccccagcctccccaacgagcacagctccctgctccaaggcacccagtcccttcgaccacccaagggctgaggagtgtgggcgcacggcgtgggactggcaggcagctccacctgcggccccagtgtgggatccactggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccattcagctctctgtaaaatagaccaattggctctctgtaaaatggaccaatcagcaggatgtgggtggggccagataagagaataaaagcaggctgctggagccagcggtggcaatccgctggggtccccttccacactgtggaaggtttgttctttcgctttttgcaataaatcttgctgctgctcactctttgggtccacactgtttttatgagctgtaacgctcaccgcgaaggtctgcagcttcactcctgaagccagtgagaccacgaacccaccgggaggaaagaacaactccagacgcgccgccttaagagctgtaacactcaccgcgaaggtctgcagcttcactcctgatccagcgagaccacaaacccaccaggaggaagaaactccgaacacatccgaacgtcagaaggaacagactccggacaccccgcctttaagaactgtaacactcactgcgagggtccgcggcttcattcttgaagtcagtgagaccaagaacccaccaattgcggacacagaatcaacctctgtatgtctgtcccggaacaatgtaacttagtggttaagcactcatgctttgtgrgcagacaaacctgaattcaaatccctgtgcaccaccaaaggtttcttctctctctcataaaacttcatgtttccactaaaaaaaaaaaagaaaaaaaaaaccggggggcatgttagtatctaccccatagagcttatgtgaggggcacagaggataacgcttgtaaaaagctcagagctgtgcttggcgcattgcaagtgctcaaaaaaagagttagcttctctgcttccttcccaagggtctccatccttctctctctccttccttctttatttcgaaagccgtatacagtgctcagaaacaactgatgtctgaaaacattagttggatgactgagaaaatgatggaagtgagaaaacaagttgtgacccagtgataaggctagttgagcctcccagggctagccagtcctcatttgcttggacgctgttggcaggctctgctgaggagcagggaaacatgggcaaccctgaggagcaacatcccccacagtggaagtggtttatccccagggctgggctcaggggcccttcttgagtgatctctaatcacacatttttactgagggtgctgctgtattaggtaaggttacttacttaaataatttaatatcaaaagatttaactttcactttcctatatttcagtgaacccatcattacatttcattggggtttggggccagtgaatgtatctcctctttatgtgtggattttatgaatttcttattcctctctgctttaaaaaaaatcctagcctaagttttaattatgatcactttcaagagacataatatttactgtaaatgtttccttttattgtggttaaatgtacattacataaatttaccattttagccgtttcaaaatgtatagttttgtggcattaagtacattcacattgtagcgcaaccaccactaccatccatctccacagcttttttgtcttcctcaactgaaactctgtacccgtcacacactaatgctccggccaccctcaacccagccttggaaaccaccattatactttctgtctctgtgaatttgactgaggacctcatataagtggaatcatgcaatgtttgtcctttcacgtccttttatttcacttaacataatgtcttcaaagtgtatccatgttgtagcatatatcagaatttccttaaaaaaaagctatattaaggtgtaattaatatgcaaagaaatacattaatatgtacaatttgttgagtttgaacacatgcaaacacccttgataccatcaccataatcaaggtaatagacatatccaacatctaccaaagtttctttgtgtccctctattttttaattctttaaatttcattttgtatttgtggtaagaacatttaacatgagatctagcctcttacattytgaagtgcatgatactattttgttgactgtagccactatgttgtacagcagaactctagaacttactcatctaacataacctaaactttatgcccattcaacaactctccatttcccctcagcmccaggcaaacactattatattttctgcttctatgagtctgactacttatttcacatagcataatgtcctccaggctcatcgatgtcacaaatggcaggatttccttcctttttaaggctgaatagtattccattgtgtgtatataccacattttgtttatccattcgttcatttacagacgcttgcttccatttgccttggctattgtgaaccatgctgctttaaacatgggtgtacacatatctgttcaaatctctacttttcctctctgcttttaaacttgcttaggwtggtctgggaagcttagatttatgggctgggaagggtctgttcagggtctttcctcctaaaacacagttccggagtcccaggccaggactctattcggattccttttggcctactccggacacctcctgggcatcattggcagtagggtgtgcagttagcactggtttcctatgcccatggrgaagagcagtggtgcagatctccaggaagacagatgagataaagtttgtgttggctttgagtggagtcagccttaatggactaaggacccctttcttgagtaggtgttgattcatggtcagggtctgtcttccagaaggaggcagaaatatactagctcaggaatcttaattagccatggacagtcctcaatatccccatcatggctcattaaggattgcaaggtgttgaggggcatttcaaagaactcrgggctagctagtaacgttgcacagtggttaagggcttgaactctggatttggactgcctggattcaaatcttgactctgccactctgggaaaacctttcttaggttcactcttttttcatctttaaagtgggaaaaagaatagtgtctacttgttgagtttattgagatgatttgtgatatagtgcattagaagcccttagtacagtgcctaatatatggtaatctgcgcatttaaagtgagttattattgttathatctggttttattcttgcagccacctttctttggccagctttggtcactggacagtaagcatgaacctcagacatagcctgggctgaatctttagtgcaattttgattcagttgctcttttctctgcaaaactttgagatcagctcacccaacttgaaagcttggtgaaagctctgacaccttgtaaagcctcactccttcctaataactttctatatgagtcaggggccacccagtgtgtttatacttccagaccccaggagtggggacggggtggtggctgccactggcttcatagcttccaggcagccagggccaattggagaggtcaactccaccaaaggaaattttgttcggcttccacggaataggaatattaatctgacatgaggccagggaaggctggaccacagggagatgaaatagtggagtaagaatgttgtagtgctttctggtagaatcaggcagtggatggctgcagcaaatcagaaccagatttctgtacatggttctgatggtggtgggtgggcagggggtgttcttgctttagggtcccctctgctctccattagaagtcctggctgggggctgtgtttgcccttcttcatcatgctgtgggaggagagtgggtttgyctgctggcttccttttacttttgtttggtccattttctgttcagatggtctagagcaatctgcaggtccagcatattgtcctaggtcatgagttgaacaaaaggatytcaatggttgttgtttccttccaatgcacactctcaggcaaggtggaaccatcttcccaaggcaggctggcacctttgcctgggcaccaggaagggcttcctggtgtttcagttactgttgcctgctcaccacctctggaatggtgcagaaagtgccggctgtcctgggtcagtacaaagatggccatggggccctatcaaatcctgccttcaggccaccttgccatgatgcagtgattgcttttcctcaggagtgatttgcaggtatagcagtgatagggccatgggggaaggggacgaaaggacagactttaaattatrggcttggcattcatatcagcccacatctgaggctggycaggtggacagaggaagaaggatgacacctctgaaactgaagctgcccttgtsctttgaatggaggctagtaatttcatcctcttctcatgaattttgcaatgtcctggtggtggcagctagaatcactgcccacagtggctgttatctggtattgccttgcaccttgactggtgagaggcccagattccaaatgttcttccctttataatggggccatataatgtcatagttaagtgtgcagggtctggaggaagactgtccctctataggtttcccaactctgttattcattacctgtgtgaccttgggccacatttttaacttttctgtgacttggttttttcaatctgtaaaacaggaattttaatatatacctgacaatgctgggattaggtttaagttagataatgcacagaaaaggcttagagaaattcctrccacacatggctcaatcaatcaatgttagcaattataacaattaattctaattacatggtgctatttaaagtggatttaagaaatccagaaaatgtcagagctagaaatgacctatgagatcagtcatctcagcaaagtcctcatttcatagatggggaaatcgaggtctaagaaggcaaagtgtcttgccaagccccagttcctggtggtagaggagcagggacttgaagtgaagacctgggctcccggcctagagcccctccacaccctgcttctccatgggggccacctctcaaagcttgaagaaagtcatgcagaacgtccagagaccctggcagctgggcagacaccacacacacacacacacacacacacacacacacacacaccaccctaatgtcaaacaygcacacatgcacagaccaccctaggatttgtgctatttccaatcagtggcataaatgactgagcaagagaagtttactcaggatgcatattaaacagctaaatgacatttccatgagtgtttctacagagtggttgtgtatttatgagaaggcatctctaggtctggctcagcagtagagtaggtggtccaaaccctgggggacatgtgtcctctacctcaggtgaacctgagttctaatggagggggtgtatgctctgcacttgggcctcagatatttaattgctcagttttcarcatgctaggcggggagtgacgggaagcccggaaagggaaaatggagccactcatgagattttaggctgacacgggctgtgtgtgttaatggkgctgggggtgggggtttccaatggggcacgtggtgggtggtgaatgctccctactgataaggagctcaggctcacttggaaccctggcagggaagccacaggaagcatctctgctcatgcagcagccgtctttrctctcatatctccccattcagttcttaacctcatcctcataatttcccctctgtttcttcctctgccctcctgtccagcatatctcccctttgtggctctgagkacccccaagtggtctatgcaatgccctctggccccagtttgatcaagatctctgccttttttcctggggctttagtctgctgctgtgtcctttgcatcaggamaacaaaggcagctctgtttggggatgtgggcgacttggctgtgtcctgttctccattccttttgctccctcctaattgctctttcagaccaccccagctgatgcctctcccacctttgacgtttcctccaaagcttggaaaagaagacccatcacatgaccccagtcctttggccagttgtccctctgatgtctgaccaagctatgaatgtcctctgtctagccagcaggccaggacctgaagctggctctgtccctactctatgcctgtgggaggggaagagcaggtcccagcctttctgtttgaaggtaccattaaagtccatgcctctcaaaattctcttcctcaagtagagaagatagagcagcatagaaacttctcaagaggaagraagtctcattctggaaaataactccaaactgtttctcatttgcagcatgaagaccacaaacccagtgttttttatatccacctccttctagtgtacctggggccctgatgggagcttgagttagagggaggcattatttctttagactgtaggataggtctttagacttcagtgactgagttgatgaaggtcagataaaatctcagtgtgaacctagaaatgcttttgactgttcctttccttgctgttcttaatgactcttgaagaaaaaaaatacttgtctgttttcagtgtcattcagycctgcctttatcttgccatagttatttacatttgaattctctttctttgccttctctagccacccacccactcatctctaacctttgcctgaaagagttaattctcttcttcagccccagccaggaagtttccatgtgccagtaggatcagtccaggatgagcatgattgaaatcactaatttatttctatagcttcagtctctgtcctggaatggaacaatggaccaaaaagtgttccagacacattgtttgtttaacaaaggaacattcttccagctgaactgtatggctattggattttatggtttgattggttagccctcataaggggtttatatttctcctgttggagctggagggagtgatggggggctgggggtccataawcccctttaattgttgtattgtgactcacctgaacctggtctctcacctagtcaaaaaccttgacttcttagcatgatgccttgcatccagaggattggttaaaggctgtaaatctcaaaaatgagcatgctgtatagccccaggagaaattacaatattgccccttctgaatttcaacccctttggctttgagaaggctgttgattttattattgatcattgagtttgatctgatgcatttcacagagacttggctctgtggctgtgcccttggctccaggggcagcagctatrctgatgaygagtttttccattcccccagccagaaggcaagaggtggtagggtagatgyacatgtactcctccctttcttctggaaagtctgatttggatgcatgcatatgtgggtttctttagattagatggtgtgtgttaaaaattgctcttgacattctgccacagagagggggatagatggagtgacctttggaaggcccctctcaatagaatagttataaagtgttttcttgcttttctgtagactgcacatttctttttttctgtagacatacgtagaatactagacaacttattctggaagggatgctctgaggtcatctttgtccattgctctggttctggaaagaatcatcataaatccagtccatcatgaggatagtagattcattttggggtagccaatatagttgcgcttccatccatccacccacccattccacccctcaatccactcatccatccatccatccatccatccatccatccatcccccacctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccacccatctatccatccatccacccacccatctattcatccatccacctatccatctcttcatccatctgtcctttcatccattcacccatcatttatcaaatatctactaaattctaggaacactcctaatctgctccttrttatttaatttattttggtatttctattaattgagaagatccattcaatccttgcttgacttgatttttctattgcatttgaaacagttgactccttcctcctgcttgacattttccctcccttgggtgtccaggagcccatgattctttcctgaatctcctctgcctctatgggcttcctcttattctctttcatgtgttctttcttccttatctgtcattgaagtatyagtgttctcagagttctgtcttcagatgtttttctctcctttttcctttcctttgctcttcttacacacacttttctgggcaatttcatacatttatgtggcctaagttactatctaactacctacgatgactctcaaatgctcttctttaacctgcacttatcctgcgttccccaggctcttatgtctgtctcctgaacataaatgcctggatttatgttttggaaacatctcaagtttaaggtcttcataaaaaaactcagtatcttctctgtaaaacctgcgacttctttattccttgtcttgctggttgtcttarccattctccctgtcaactacaacagaatctggaagcctccttagattctctctcctctcgtgttctggtggacaccaggtcatgtcaattccatttcccgtatctgtttctaccttaccttccccattgccacaatctaattccagcactcactatctmccsttgtgtgattgaacttctttctagatttgcccctccaaaccatcttcatgctstatcagagtgatctttccaaatgcaaatctgattaagccatttcctcattaaaatctttcartggcttctaagcacctcagarcgagttcacacttcttaagcatgttgtcccaggctttcacaattagtctcttggctacctctttgcttttacttgaccccaaatgcacaccctaggytggagtcaaaccaaaccacttgtcatgctgcttcttgccttcagcccctgcccctgctcctctctccatctgaaatgctctttcttctcttaataygttggtcttagctcaagcattgtctcttctatgaagtcttctttgaccccttaggtttcctcttccccacttgtattgcaccctgcaaatattgtaataatttgttttcatgtctgtttccstcctagatattgagcttcttgacaatgagaatagtgtcttttgtcctggtaaccctagtgcttcacacaggtcttgtatcgagagagagagcttacttagcacgtgcttatgactataccgttccctaagattatttttcctcttctgatctgtatcygagctataataacttgtttatttagacttttccttttatcttatcatgtcagaagttcaccaagaaactgaagggcttctgaaattggctttgtttcytgggcttgagtwcagtcccttcttatttacctgcctgcggcttcatctgctgattattgatgatttgaagaaaaaattgtttatgtggaatcagcttcacgtggctccttagctctgaccctgcttctgcttcctttcccttttccccatccttatacctggggagcaggaaatgcaracagcttcagtgtcaagccatgttttaagtggagaaggatgaagaacactgtcatgttctcgcaggccttccacacttgtagacgcaccaactgtcccacttttagtgttcctgatggtcaatttctctttytttcttcaaaccaaatgttaagcctgagcaggacatgattagcaatctgcttgaggataaaatgttataaggtatgcgtttgttccctgctccatctcctatggaaaaccacaccctcagtgaaggtactactggacagtgtgtttcttcagggagtctcacatctcagtgctgcctttcctggcatctctaagtcacaacagatcctgtttccagcaagtttgtatggccacataaaatgctgtgtaaatcagtgtgggaatgtgatgttcccagtaatctgttggctcattgagggatcgatgatctctagctttattggtattgggtactatgttatttgtttgtctatgttatttgtctgtgtttgtctatgttgtctatgtttgtctatgttatttgaatccagcttaagagaaaaatcaataatgccaatgtcaggggcatgcatctatcttataattagtgaatcaatgaatttatcaagtgttttggacatacttgttatgacccaggcattgtgccagggctggtaacacagtgggggacagaactggtgcccgcccaagggggcagcgtggtattatggaaaagcacttaagtsctatagacctgagcatgaatctcgattccaccactccttaatgtgtgatcctcaccagatgagtcaacctctctgagcctcagtttcttcatctataaaatgaagattattctacttcccttacagcattatcgtaagaattggagataaaatacatcacgcacaatctggtttgtacagtgcctcacatttaatagacagagagtcataattattattcccattcatagtrgtgattgtagtaaaatggaaaaccagaactttgtgtgccttggcttactgcaatagctgaaatttatagtggtacattccctgataacagacatgactcttagtgctgcataggtattaatgctttaaaccaggggtctccaacccccmggccgtgggccggtagtggaggtgagctgcatgtgaacaagtgaagcttcrtctgtatttacagccactccccatcactcacattactgcctgagctccacctcctgtcagatcagcggcggcattcgattctcataggagggtgaaccttattgtgaaatgcacatgctaggaatctaggttgtgcgttccttatgagaatttaactaatgcctgaagatctgaggcggaacagtttcatcctgatccccccaccccaggtccatgcaaaaatggtcttccaagaaactagtccctggtgccaaaaaggttggggaccactgctttaaacaamcatcttatgagctagatacttttattattttgtagcaggggaaactgaggcagaggaaagttaaatagcttgcccaagatcacataattggtaatggttggctggggatgtgagcccagcctgggcccctcatgttatgttcttctagccaccatatcacactgcctcttcatgaaatgctcaacccaatcatatttctaagttgctaactctcttaagactcccagaacaactacctcaaatttcttggcttaaaacaatcaaaatccagaagtccaaaatgaaagtgccagcagggtgggttcctcctggaggctctgagggagaatcgtcacayggccgtctcctcgcttcctatggctactggcagtccttcactccaatctctgcctccatctttacattgccttcttctctctgtgtgtctctgtgtatcctttcctctacttataaggacctcagtcattaggtttagggccaccttaatccactatgacctcatctaaacaaattctatctgcaaaacctcttccataaataaggtcacattatgaggttctgcatggacatgaatttttcrgggtaagggcgctactcaacccacttcaataaccatttgctctttactttaaagtgggaattgatgaaagaatgtttatttactgtcttttttaaaaattatactttaagttctgggatacatgtgcagaatctgcagattcgttacataggtatacatgtgccatggtggtttgctgcacctatcaacccgtcatctacattaggtatttctcctaatgctatccctcccctaaccccctacccctgacaggtcccaragtgtgatgttcccctccctgtgtctatgtgttctcgttgttcagctcccacttatgagtgagaacatgcagtgtttagttttctgttcctgtgttagttggctaagaatgatgtttccagcttcatccatgtctctgcaaacgatattaactcatcttttttatggctgcatagtgttccatggtgtatatgtgccacaatttctttatccagtctatcattgatgggcatttgggttggatccaaatctttgctattgtgaatagtgctgcaataaacataaaagtacatgtgtctttatagtagaatggtttgtaatcctttgcgtttatacccagtaataggattgctgcgtcaaatgatgtttctggttctagatccttgaggaattgccacactgtcttccacaatggttgaactaatttacactcccaccaacagtgtaaaagcattcatatttctccayatctgttggaattatgtcctagaatatgatgcggttctaagascactattttaattacttcatctgcctttttggaataagacagatgtggagaaatacggtcttataagaagatgtggagaaatactgtcttattccaaaaaggcaggtgaagtaattaaaataatgctctaagaaccccatcatattctaggacttaatttcaatgggtatttgggccatggccagaatagcagactgagggggatgcttccttcctcctcagctgggctggccctgccccttggcaccacagcgactaagtctgcagtggcagtttgaagccagataccatccttcttctctcacatctttgccctggccttctctctacccggtaaaatacctcaagttccttcattcgtttttcattggctatgggcttgagttctttagctttctcatctctcttctctgaatgagctctgattttcctgacctcttgaaatgaaccagtcatagaggggctgttcctctcygtcattctagatgtagcctaggacttatcatctttttctagtggccacgttgtgctgctcactgcagtgattttgawcaattcatagcctctctgagctcagtctgctcttgtgtatactggagatcattgcacttaatcacaagaatactgagagagccaagcggcctgatgtgtttgatggtgaccgtcaccggtgcagcatgatgaatgcgttagtggtagttattaggcatctgctacaggttcaaggttaaagagcctggaagctcccacagatggctgccttctttggttgatcccagtccttggagggccatcagtcggggatggttagtgtgggaggagatggaggaatggatccaggagctggagtgtctggtccaaacttttgatcagttcatgtgccttttgatgtagcaggaaggagtaccctttaagagcagtgctgaggccagcaggccagcttgcgttcccctgcaatctctggcaggtatcatccaaacttgtgtgggtggatcttcttgctgtgcttcttagtatctcatggtctgtcctagtgrtgatctccttaggttgtgagacgtgaaacaggtactatcagatcagggcattaagaggacaagcatttattggacacctattatatataaggcacagtatcagacactggggttcaacaggtaaaagacacagagctggccttcaggaagtccagtatagcagacagacatgtaaacaatttcagtgatgagagaggggccaggtgcagatatgtctatcagtaaagcctgtcctagagcaggagttagcaaactgtggcctgcaagccaaatccagcttcccacctacttttgtaartaaaattttaccagaattcacctacacttattcacttatatattgtttatgacttcttttgtgactcaacatcagagttgagtagctgtgacagaaaccacgtggcctgcactttacagaaaaagtgtgctgagtcctgtccttgatgatgggtcggcaggtaagagttccaaataaaaaaagacgtggactctaatccttggaggctctctggatttccatatgtacaactaacacarttcagaggaagatgagctggaggatctggctggggggagctttgcagacatgtgtgaggtttctgattgggaagcggatgccagaaggcacagcaagtcgcatgaggcacggggtgcttggagagagctgagagcccagaggtgcacgctcgcagctgcacagaaaggcagagtggggacagagtcaagcaaggagcaagaggctgtgacaacagagaggcttgtatggatttgaggccctgttgaggtgataaaagtgattgaatatgaagcaccaaagaagcctgcagctctggagttgggaaggccctcagggttcctctaatccaagctcttgcctgcatagggcaagagaagggagaggaagggacgtgacttccccaagctcactcagctagtgaattgggcagattaggtctcagtcctgtcctgacctaagccagggtgctcttccctggttgtgaactgagccctgggactcttaccttgtggcctagctctttaggagaaagagctgggaagctcaagctccatccctcacagcctctcttttgtaaattttctgtagctgtcagcctcctggtcttttttcctagcctcttttatgattccccagtctaaaagctgtttgagggcaaagtctgtgtctggtccagctctttgagttcctccttgttcatactgaggactccacagatgtgtgtaaaagcactgagcattgaggcctctatcctggtctgcccaagtatgcagrtgggaggtctgggcttctctgygcrtctcttggttgggttggggtacatcagctctggctggtgtccctagagctgagaggctcctctaaaggactgcgaggctgccactagccctggaggggctttgcagctcccaggtgcagttgtcacattctttgtggccacctgctgaggctttcctgcaaaacacttcaccacccctgcacaaagagcttctttcaatgctgaatgtctcccaagcagccccattagctcagggaggattcagtcggggtgccatgcatcttcagtgattgacagaaacacctcatttgtcctgacgtgttgacggaaagactgcaagagcagccagagaggactctccagttcagcccatccttaatcgccaggacatgctcctcccagcctctttcaggctttaagcaggctctccttggcttcctctagcctgctggatgggccccagcccaaattcctccagcgaggcagggacgggttggggatgtggacgggtcctggagtgtagtagggcatagagtgtgaagtgagttggatgctatttgcccacagagtcccagattcatttgtcatctgcacagcaacccatgggttgtcctgagtcagtggcttcgccggcctagtgacagtgccagagagcaacatgaggccagagttcaagagcctggggacaccaggtgcagagaaagagagaaagggagagagacagacagagagagagagagagagagagagagagagctgctttaggcaaaagtaacaaagttataattctggtagggcttataaactgctcagccctcactccgtctttatctggttttatttacaacaatatggaaattagtgatttacagtagccttgcaaataaggatggagtgctatctagcccaggttaccaaatgttgaaacaaagagagcccccagtgcaaacagtcccctattgctgaaggaaactaacatatatgtgcacctgccacatgtacaccagggagcagtgtttcccacatctctgcacgctggatcttcacaatggtcccatgaaaggtgttatttttcctttctgtggaccagggctcagcctggttaagtaactctgtaggtgacaaagataggaacttggagggctgacaggttccagagcccattcctttgcattacaccatgtctcctcccggaaccgtgggcatatctttttcctagaaaaaggactatttagaaagattttctagacctctagtagggctggctctcttagtgggctgaaatggaggtccaggtagcatatttaaaaaaaattaagatgtaattttcgatactattaagtgcactcttctaaaacgtagaactgagtggtttgtgcaaacagcatgtaggtagcatgatttgaggctcttcagaaaggcccctagacctcctagtgggcctgatatctgctgttagtcactgatttgaggtgaagccttcgaagcccctgtcacagtagagctgggtggggtcagatattcatcagcctccagtaccttaaaagggttgctcatcatagattgaaaaacagccatgtggtattccctgagtgagggaccctgggttagactatgagctccttggggccatcccaaggacttctttacctggaaaggatgtgggttgaatgacaggtaagccaggatgargatgagtttttggtacttgctstctggatgcccaggacatagactggtcaaagtgagaccagagcaggtgcgcratcctatggagagctctggggaaaagctgggggtcacgagagggaaaaaggacaatggaaaatacattttgctcctgtcttgtttacctgtccccattaagagctggctgacatcctagagctagtttctggactgcttctctgactctgtgggttgcaggatgagtaaaaagaagttagaagattgtacatttccagttttctctggtctcagaaacattcatgcagctttcctgagcatgtgctgtgggaaggcctgtgaaagattctgagtaggacaagctggactttccagcccaaccacagagggtctctttctgggctatgagtttaggagacatggatrgttgcactccccaccagtaggtttctgacataagcaaaaacagcagagtttgtatccattggttttgcttatcccatcaaaccrtttagagtagtggtccccaacctttttggcaccagggactggtttcatggaagacaatttttccatggactggtgggtagggggatggttttgagatgaaacttctacctcagatcatcaggcattaaattctcataaggagcatgcaacctagatcccttgcgtgcacagatcacaatagggtcggtgctcctgtgagttataatactgctgcttatctgacaggaggtggcactcacgtggtgatgcttgcttccctgccatttacctcctgctatgcagcccagttcctgacaggcctcagactggtaccagtttgggaaccccttgtttagagtgcatactctattctaggtatagaatgtcatgtggacacttggacactgtgtgaggtgtccaagtgcttgggacttagtgatgagcaaaataaggacccagtttttaagaaattattcttttmtttgaccttcaaaaaatataaatatccccaggagggattctgcttgggcctatgtgtccgatttacaacctatgtagatgacttttgtagattccatttttgactgtaggttttgctttggggcagtagagagaccattaagtgctcccatctctctatggccgttttcctgtgagtcggcatccaggctaaygactggggccgtggagagcccatgtggtgcctttatgccaattagaaaaaggcctcccttcctcaagttgcttttttaataaaaaaatcagtttttttgaaattacttaatatactgattctgttagatcaaaacactttgccatcttccagaaaacgatcatagtaaatatgctattgaatataaactatcttctccayggtagtgcccccctgaaatagcacctttgtgcagtgcatgacctgcgccactgcatgtggccaccttgtttaggatagcaagtaccaaacttcaataaatactggcattcagcagctgggatgtgctgcatttctctttcagcagggaggtacctcatcctgagtaggacctttgatcccttcaagttttagaatatgagaagaagggagggacctttaaggaaagaagacaagaaaagatgcagttctatttagatggtggaaatctctgtgactctgtgttctagctcatttctgggttctcccaggaggctggagctttgcagcccatcaaagtacatttgcagtagaatgattaaggctagttcttcatgctaaggtgctgagagaattcctgccctttgtgaagtcacaggatctttcagcgggagggaaccttcatagttcaatgctgtcattgtatagggaagcagaaggcagagccctggggtgactcaggtgtgacgttgccaaggtgccaaagatgagaagtggcagagctggcaccaggacctggtctccgtgtttcccccactgccctgggctgggggaaagcacctctggaagggcagggatccagatgagcaggaaacactgtggacttcctttctctagaggmctctcagaatggtcagagtcctgttggcttggggtgtaatgaacctgccatgcacagcaggtaccctaaagacaccttcctccccaggcttctctgcagatggattgctctgcacatttgcctttttactttcccctctgttgtccctggtgccatggtgggctgagtgtcaaaacaagtctttggtacttactctcttcatctcctgagacacacacgtttagtgagagtgacagtattcttgggctgatggtgtggggagggctcctgcctttcttcagaggagcttgatttcacagtggttcaaggcagtagttatgtttcttcctagggccaggtaagccttactcaagtttcctgagracgagttataccttattgtcctgattatttttatcatgattattggttttgaagttatcarctgaaagggggcaggtgtctcagggaagccactctcgtcttgcagaaaacactctcagcaccatggctatgtgaggacagtccccgtcacatgagggacacatccgcctcatcatttcccctctacttgtgatttgtcttctttcccccggcccctcagtgatctctggtttgtgtcctggcctgagtaacggttaaacaagcagttgactgaggggtgccatgcatgaggcatcgggatagggccgaggcctagagataaggacagagagatctcagacagaattttgacccagcaggggttggagagggaaattcttctctttgtcatgttattggagatgatgcccaccctsatttttattgaagatttaccctgggctttgctttgagttggatgcaggaaggagcacagtgagtcacagggcctggatccttgtccccatggagctcagagtctggttgaagctaaaagagtcagatgtggaatgatgcccatggtcaaacatgaccctgccgagcacagaagagtaatgagcagggagactggtagggctcgctgtggaagtccagaaaggcttcttggaggaggtgctactcggactggtgctggagtggaggatggactttggaagcgagccttggagagtgcgaatggccctgctggatgggacccacagtttccatttggacttcctgcaggcttctcgacccctacttcctgttcacctcctgcgcccattctctcatttgccacctgtcttccatcygctccaagccctcatcacctctgcctttttccagcttccccttcccctccagggtctatgtttctgattattccccacagttggagttccttgcattcttctgcattgaatctcattttgtgatttcctgtcccatattttgtaaactccctaggtcccttctcatttatatccctgtcctctctggtgctgtttgcagagccgcccagtttgttatcatctgcagatttaattagcagggctgatgaccccttctcttccagacctgcggtctcaggcaggactggttccatgtggtgtgcatgcagggtcatggctgtggaaaagcatgtttgggctgcatagagaggacacgatccagactgggctttcgcctcatagagggggagaaaatgccccaggagccagctttttctaggaaaaaagggaggatgctggaaactcaattgcacaaacccccttaattcaaattattctggccagaagacaccatctgcagaatctaattattattagcattgagcacctactatgtgccagacattgtgctaggtgtctttcttacattattgctgatattcacaagcactctatgaggtcactattgcttccagattcttatttttctgcttgatcagaaaggaggctgagactcagagagatcatgttacatatcaacgtcacacagggagtaagtggcagagctgggattttcagcagggtctctctgagctcttctttaatgtgccctgcttctagagaccacatgaccttcatcccctggcctccagaacactctaagctaatggattattattattttttattttaaaaacatttttaacttttgtgggtacctagtacatgtatatattaatggtgtacactagatamcctgatacaggcatgtaattcgtaataatcacattgtggacaatggggtatctgtcccttcaaacatttatcctttgtgtaacaaacaatccaattgtactcttttagttattttaaaatatacaattaaattattattgactgtagttatccattgtgctattgaatactatgtcttattttttctatttttattttgtactcattaaccattcccacttcctgcccactcccctactgtccttcccaggctctggtaaccayccttttactcttaawggattattttcatagtgctcttgacagctgggttgatytggatatttttggaagctcacgaagtaatcaaatccactggttttttttttttttttttttttcattatagtgctaggtctttttctgtgtccctgattagtttatcaacatcacatccaaratctarattttagctaattcgatagcctttattcataatccaagttctttaagctctaccttaatatctctcaaggctgagtctgctggagccagagccatgggacttgtgtgataattgctaatcctgccttctatgtcaggtcggacagatgtgcggggcagcacagtaattttcaacttcacttacctgagccctagggaagtctcagtggagcactgtatattccaggaaggttaatttttcctaggactttctagtacatcgaagcatgtttggtgtctctcacttcatccattaaatatgagtggtgtttccctgtcattgtgacagtcaaaaacctcatccatttctaaggactacagttcttggggtttgcatacaagtgccacagaaaccacttggagcccaagttggggctgagcaggtggggctgtagttctctggaacacaaccaggtagccccttgaaatatttggagaaagagttctttagctgaagaaagcttgtgatcaatgttgtagaaggttttatagcttctttgtacatgttcaaagtctacactgcctctttgtgtaagatctctgctatgaaggagtaatggctcctagaaggaaggccagagcctgtcttcagaaaactgcctcctccgaaggtcacagcctggatctgtgccacatgggaggcttgttctgtcattctgtttgatcacagcctagaccaacccagaccaacccctagaccaactccctgctatcacttgtatttgttggtctcactggagagtgggaagaagtttctaatttgagctccactgggaaaagaggaaggcattttcttaaaggttccttgactaggcggactctctcatcttttatcttgttgaaaatataacgaacctgggtgaaagtatggggttgatctgtcaaggtcactgttgcaaaatgcactggcagcagcattgtagtgggcagtacagccagcacaggccagtctcagccccctggatccccaggctccattcagtttcaggcyggctggtctctacatgctgcacattcctctctgcacctgtgttcatccacttcttctcttccatgccgctcacaacggcatgtgcaaatctcatcatgtagtggtcaaagtacaactcaaggtccctctcctccacaacatgccctctggctctagcccagagtcagctctttccagtagtttcttatatcagtgagaatgcttgttcatattggcagaacatccaactcaaaccagctcaaacaacaaagggaatttataagctcgtgtgatcaggaagcccataagcagatctggtgaggcttgatccctcagctcccatgatgtccctaaagacaaccaatttctctatctttctgctcaaccatctgcagggtccacttcatcttttrttttctcactgatcccccttgctgacccaggacttccctttatggagtgaatcgatggccactgttatcccccagagtctgacggaaggagaaagctgctttccctagaaatcctggccattatttcctcacatcttattgattttgaccacattacaagcatattccagaagcagtcgttgtggcagagggttggatatgctgattggttcaaactaattgggcataggcttggatttgggatgggatcaattctgctaaaaacatatggctgagctccagtaggggtgtttctctcagagcaaaacttggcaactattggtgagtgaaaggggagatgacaaacaaatgatcrttcattgtcgtcctgtccctttggacgttaattgccctggtcgtgatctgtcccaggtattagatatcatttatctggtttccaaagagaatgaaaatggtgtgactgcatgatggtatggtggcatgatggtgtgaatgaatgattgtgtgaatgcatgatggtgtgaatgcatgatggtgtgattgcatgatggtgtgaatgcataatggtgtgatggcctgatgatatggtggcataatgctgtggtggcatgatagtgtgaatgcacgatagcgtgaatgcatgatggtgtgatggtatgatggtgtgatggcatgatggtgtggtggcatgatggtgtggtggcatgatggtatgaatgcatgatggtgtgaattcttgatggtatgaatgcatgatggtgtgaatgtatgatggtgtgatggcatgctggtgtaaatgyatgatggtgtgaatgcatgatggtgtgatgaaatggtagtgtggtggcatgatggtgtgaattcttgatggtatgaattcatgatggtgtgaatgcatggtgatgtgatggcatgatggtttgaatgcatgatggtgtcatggcatgatggtgtggtggcatgatggtgtgaatgcatggtgatgtgatggcatgatggtgtgatggcatgatggcttagatttctttcatatgccctaactcttagcacattgccaagcacacagtcgttgcccaataaatacttgttgaattgaactttgttaggatgattgaatcataggaaaatagtgtaaagattctttaagggagagatgagtcactgctaagagaaggcaggggcatatccttgtgggggaggggagttaattactgataacataaagggtttagggaggtgtcttgaggttggaagaaaagtagcaaaatcaaggaatcatgcaaattttaagtcaggagagacattagagataatgaagagatagggctttcagagttaatatgaccagcttttaaatgcctgggaatgcttctctctgagtgggatatttttcacatgggccaaataaatgaaagacaggaaggggatactgggcattcttgctcaaaggtttgatggctattaagtgtagtggtgctcacaggttgatcctgtgatttgcttgtctagcctgggacatttttgagaatgctaaaatcctaaacttgatgggatgatgaggcaaggggaataaacagagactgttccaggccagccaggacctactgatcatctgtggtctgagtatttactaatgaccagctagggcacccctttgcccattgctctcttgccttccattcctcaggcactgaagtgctctccgtgtcctggtgggggtgagggagaggcacacccattgctgagagttagcatccacagcatctgattccacttgcaggatggcgactgtccagaacaatttcactgtgatgaataggaaacagcagcattttccttgggtctttcctcacagttcatccaggatcccctgtttgggctggttctgtgtgctggaagcccaggcgccagcctactggcctccctgagttttgggagaggccctgttctttctgccaacatctttggggcttatggattgtcattctctcatttttggtagaaatgttgcatctggctactttcagcctgttatctttgagcatcataaactcccaagagaaatgttcacttttatcttcatcctcacttggtggtgttcagttacatgccaggggctactgcctcggtgggctcagctatgattttttttatgtgggatccaagaaacatggtgggattcccacaggggtcaaggacatgtgtttttttggccctaggaacatgggtatgccctgtgctttgagtaccaaggcagagatttcacagtgcctatccctgcacttgctctttaaaaaatccttttgtagacacttcatagtttacaaaataccttcatatgtacaaccttatttgattctgagataccatgaaatcattattcacttttgaatatttattattaattaaaagctaacgaatatataacatattgttaagtaaataatgtttatttaacataaaacattataattaaaaataatgattttttaaaacaaaaaaagttacaagaagtgttgcattgttttacatttttgcatatcttttccctctagcctttttgaggtataactgatgtataataaactgcacatatttaaagtatccaatctgttgagttttgacatrtgttcaaaaccatcactgtgaaaccatcactgtcttgtaatcaagaaaatgaacatatctaccacccccaaacatttccacaggtccttttgtaaagtctatccttctctcctccaagtggtattattattaattattacaattatttaacattgcctgtcaatccgagagagctttggtggcttgttggaaatggtgcagctggtaagtgacagagctggggcccaaggcctggtcctcaggctccagaacccatggccttcccggggcctatcttacatggtgaggattattccctatttcttccacctgtaggatttctgaagtagaataacaccyagagaagcctgagtcacactctgttgctgactccccataggttaggtctttcaaggtgccgtgctgcctttggggtcctctgcagctcaggggttgagtggggaagaggttctctcacccttgatatgttggagggtgtattagtctgttctcacgctgctaaaaaagacataccagagactgggtaatttataaagaaaaagaggtttaatggactcacagttccacgtgggtgggaaggcctcccaatcacrgtggaaggtgaaaggcatgtgtttacatggcagcagacaagagagaattgagaaccaaatgaaaggggtttcccctcaccgtctctactaaaaaaaagaaaaaaatacaaaaaattagctgggtgtggtggtgggtgcctgtaatcccagctactcaggaggctgaggctggaggattgcttgaacctgggaggtggaggttgcagtgagccaagattgcgccattgcactccagcctgggtaacaagagcgaaattttgtctcaaaaaaagaaagaaagaaagaaagaggttttcccttataaaaccatcagatcttgtgagcttattcactaccacgagaacagtatggggkaaaccgcccccatgattcagttacctcccaccaggtccctcccgcaacatgtgggaattatgggagctacaattcaagatgagatttgggcagggacagagtcagaccctatcagagggttggactcctcagtctccctgggctcccctcactgcttcctcttcacttgggctttgaggagttgttcctgggctgcctctggttggagtgcaatgatgtgtgatacacggagtggagactgtggtgataggtccagagatcacccgttctgcgtgtctgtccaggttggcacccagaaatacgacaaaagtggctgagttttcatgtccataggaccctgggttgtccctggtcgttggttgggaaccaggtgaagtcttttccataagaaggaagggtcttgctgctggtcttagtgggtctctgggatggggcttggtgggcatttggctctgtcttctgcctctgctgattattggccaccttcaccttggcctatgcaggacagggttggagaggagattccagtactctcatccaggagctcccagcagagcagatttccacctttccttccctaggcaggaacttcttccctttgcttaatcccaaatccctgtgtctcaggaggaccaggcagagcctgctccgaatcagaggctgtacattcttgagagccaaaaggaagttaaggctttgatcttcacratgacacaggtagactatggtgttcctcaaatggagcagatgggaggcctgtctcagatgaattcctgctcttatttcaaaagccctctgtctcaaggctacacctcactctcctccttcgcctgtgacgatggctgccctggccaccatctcagcacccctgtcctccagctgtgtgagcttcaatcttgatgatctgagagtgtggggctcccagcaggtgtggtgggggcgctggtgatgtcttaggggagtccaagggagtctgtctcctctctgctcctccatcatcgacaggctcatccccccacccttccttacagcgccattcccgggcgccgatgtgctgcagctgackttcttgcctcacagcagggcccgggaccagagtacactcaggccccttgggtcagcatggaggtggcttggcagggctgtggggaaggaggcctgaggagtatcagtttccagtgtttggctggggctgcctcccgctcactattgtctctctagagagaggacgttgtcttgtttatccacatgcaagctttggataacaacaacaagacaaaaacaatgaggataacttcaccaggagcgcgacctccagtccctgctaggggcctggagtgcgggagagaggtggctgggggtacgaaccccttcttccctcactccctagcccattcctccttcccctgcctccctaatttcttgtgaagggaggggctgcaggattgccgtggatggttggcagccctcaggatggaagggtgggatgaatgctggtgccaggagacctggatctgcttgtaattagctgtatgtctatgcttatgcagcacagactcttgggctgcaggtcttcctttgttactggagaaagatatgttaggtgtgcttggaggtgtttccaactctagagtcctatggccaaatcagttcatcattctgaaattcctctgtgtccctaagctggccctgccttgaactgtcagcatggggtgttgactagcatcatggcagtctaatgcttgctgagtgaagacgtcaaagactgacatttgaagccttgtctattttccagagtattcctgattcttctccttaatgctataacacccccagaagcctatgaggcagaaaagtttctgatatatccagttcaggttgtgttttgtgagcacgagtgaggctgtgtcaattcctttggcctctaggaaagggaacggcggtctgcaaatgtggtgagcatctggggctaccaacaggatggagaggccctccacgatctttagatggttcctggtcaggtggaaagtttagtaactttagctgtcaatatgagagacacattcaagaatgacacttaagggtaattgaattattttctcaaaactgaattagatttaaattctgttggccaaaggtcaccaattactttgtgggccatggtagctaatttttagagattggtcacaggatccaaatggaatccactaggaatacagtatatgtgtactgaagttgccagaaatatttactgagcacttactatacgtcaggtactgtggtggctgctgaggacaaagcaaacaacaagacagactcattctttgtcctcatggagctacagatctagcagagaagaagggtatgagatgcttagtgacacaatgattgtgatagtgggtccgtgctgtgaaggagaaagacaaggaattgcacaagcaagaggaagggaccaggcataatccacggctcaggaagaggcttcctgaggaaggaatgtttaagctgagacccaaataggagttggttgggatgggggatgatgagagctttgcaatggagggatagaatgtgaggaggcttgagcgtaggaagctggtggaacagccagatgacagtgagaagggctgggtgctggagcctggggaggagggtgagaggggctggtaccttagaccatgtgcaaattatcgggcttgctgttgagttaactttaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtggtgactcacgtctgtaattctagcactttgggaggccaaggcaggtggatcgcttgagttcaagagtttgagaccaggctggggaaaatggcaaaactccatctttaaaaaagtatttaaaaattagctgggtatggtggygcacacctgtagtccgagcttcttgggaggctgaggtgggaggattgcttgaacctgggaggtggttgcagtgagccaagatggtgccactgcactccagcctgggagacaaagcaagaccccatcttggaaaaaaaaaaagagagagagaccggtgaactcagaagtcaggctctgattgaggagtattcatttcctttggccacagtactcacaccgtcttcttgggtaactctccctgataacaagaactagagaagtagggtttgtagggctttatgaaaatggagtcacagtgaaaggattgcatagtttttttgagacatttcaactaagctagagacatttcctgctctgttatatatttcacattgcttgtccctggaaaaattacctaccttagactgacaggcctgggmcttcctacagaaatatctgtgccctggttctcccttctgtgatgacaaggaccaaattatgtgttacagctcattttacacgaactgaagttttagttgcctgttgagatttgggagcccctccagtcatattgrttacttatttataacatcttctttagggatggattgtatcctctgacggctaatctcttcatgttgtgttaaatttcctgtcgatttcagcaacttatattttctgaccttgtccccaaattctggagatgcactgtattttgaacctgtgatttcctttaggacatgtgggacattttgaaaatcttgtagataattttaaaagtgcaaggcaataaaggaaccaggattactcactcacaattttaatctaacgggaactggttttccccagcraggacctgctgtgtgtgcagtctcgtgctaggtgcttgaagaatacagaagaagtttcagatactgtcccgcagtcaagaagcagtcattttacctgggtagagctaatcgctatagtaatgcctgatgtttattgaacactccacatttcaggcacactagcagggacttcacctacttcatctgcagttctcacaacagccatgcaacatttctcatcctccttattcagataaagaaggtgaggctcatttggttaagtgacttgcctaagctcccacagctgcaaaattctggaggcaaataattttttttttaaataattgaggcataggtctccgtttattttcaggtggtgaagattccagaattagtgggaaatactgattctatttgaatctctaaactatgagggaagctatacacctagatagtctttttccctttctaatcttgttccataattaattttggttgttttcagtattttgctattagaaataatgctgtcacaaacatattttttccttttacttttagttgatgtaactgtacatacttatgggatacagagtgrtattttgatacatatatgcaatgtgtaatgattaaatcagggtagttagcgtatctgtcacccctaatatatcatttctttgtgttgtaaatattcacaatcctctcttctaactttttggaaacatacaataaattatattaatcctattcaccctgcartgctgcagaacactggaaggtattcctcctatctagcttaactttggatccattaaccaacctctccccatcctcccctctccacattttgcccagcctctaataaccacaattctatgctctacttccataagctcaaatattctttagtttccacatatgagggagaacatgtggtatttgtctttctgtgtctggcctatttcacttaacatgatgtcctccaggctcatccatattgctgtgaatagcaggatatcattctttttatggctgagtactattccagtgggcatctatctatctatctatctatctatctatctatctatctatcacatttcttttatccattcctctcttgatggacatttaggttgattcaacaaataatctaattaaaaactgggcaaaggatctaaataaacacttcataaaagaagacatagaaatggacaacaggtatatgaaaaaatgcttaacatcactgatcatcgaggaatgcaaatcaaaatcacaattagatatcatctcaccccagttagaatggctattataaaaaagaccaaaaaaataaaggctggcaaggacgcagtgaaaagggaactctcacatactgctggtaggaatgtaaattggtatagccattatggaaagcagaatggaggtccctcaaaaacgaaaaatgggactggcatatgacctagcaatcccattcttgggtatgtacccaaaggaaaagaaatcaatatatcaaggggatacctgcacccccatgtttattgcaggactattcacaataactaaggattcagatcttgttctgtctaacttggaagctccaagctcttccactcccctactatgcctaaaagaacccacatccacaggcagggcagaatggatgtcggagtggcctgggggacaaggaaaaaattattttaaagtcaatacatgttaaccttcaggtttagattcctgggggatgcattcggtgatggttgtgctccggagctttcaaggagttactttttttctttggagacacaaccagtcacatcagctaatatttcacaatggtgggtatgttttcctttttatgagaaggtaacaatattgcacagcatgaaaggaacatgactagatccacaaaactgcattcctgcttttgttttcattttaaacaagttccttttgaggagagtggagatgcatgctttgctggaggaagttaacaaccccatactgggaaacgattttgcattcgttagtgtaagattaggctgcaatggatagagcctctaaaatcaccgtggataaacaaggtagaattctatctttcacgtaaaaatctaaaggcatcccagggctgctatgacactctctagagccagagccagcttctctcttgacactttgctgtttctggcccggactttaaccttaaggtctaaaatgtctgtgtccatcttccaggcagcgggttaaggggacggaagaaaatgacggggcaaaaagcacctacttgctgtatttgaagaaggttaccagatacttccaccttgcgacattggccagaaatactgtttatggaaacacctcattgcaagggagatgtggtcttaatgctggatggccatgtgctttgttaaaaatgaagaacatgagaacagctgtcgggacagctagcagtctgccaccaagatcttggaatttgacccttgccctcccaaccctacctcaaacttagaacatctgcacccacttaatggacatctgttacacacttgagccamcgaccctaaagaaagttaaaacagcattcatcacagtttgaaaataaagacaaagggtaatgtgttaacattcataatcattgtgatctcctcttagcgagagggatgatgctgtttgccatctttcascaaaaacataatttctggggccgtgatggagagctgggcttgcaggtcagcttcacagatggtttcttttcttaccctttattttcacttagttggaaaagcttaaattacagttagaagtagtagcaagtgattgatgattctatctagcagtcctgcataaccaaagataaaattggggagatttcttgctgaaggccactttcagtattttgtcagaacgatgtcacacttgggattgggaaggtttcattttagggctgccacataggttccttatcaacccttggatttgattttagcctaaacacatgtctttgtgttgtgttacagtccttgggtgtgtttcttaattatcctgagtgaccatgtcatgtctgaacactatctttattgcactatctgtgtaactttgggcaaatcatttacattttccstgccttgctttcctcagctgtggaatagagattgtggtagtactggccttacagcatagttgcaaatattgtgtgagctaatgcacgtgaccacctaactcagttctggcgcataatacacagtcaataaatatgcattgtggtaattgttattttcagatattgtcaaactctagactacccaaggctttcacaccatagtccaatctccttttgaaatcgtggtttattcttcatttttctgccttgtaagtcatgagctttcttcctcaaagtgaggtttggttctggatgtttgaattactgaacatattttggagctgccattgaagaataatagaaatagttttcacttgcattaataagtgccataaaatatctttttattttgttcatcatttcaaaagcacatgtgagcacctcctccatagacagtgttcttcagtkgggggacgtagtcttctatttgccatctatctctctgccaggcacactgaaaatgcagacagtcagagcctgtgagttgaagattttctatatagtcttcaacactaaaccaagatcagagggcggaatgaaggattgtgctwtcagctcgttccttctctctgaacacagtgaaggagtttaaacacaatgcttgtgcttaattttgcaggtagttttagaaacttctcaccaataatgagacttctgccagtttttcctacttggttttggtcctctttagttctttagtgacaaaattaattaaattcatatcagaaagtattttttcccctgtgcgtgcttgttttgaaaaaaaaaaaaaaagtgaatgtttatttgaagatgaggtgccktcctctcataatctgacacctatttgtaacagtcatagtgacaagggccagatgaattgctgggtcaatgaaacctgactttcaaatacttatcactgcattttctgtccttatttttcatgttttgagagaaatcaacacacaacacagtcacttatcctgagacatagattcatgttctgtattcatataggagccctgtttatattattctgcattgtaccattgtcattatgatttatagtattacttctaggctctagtagatcacttttgtggtttggggctataacagcatgacagtagaacaaaaatacaaacttgaacaataaacaatgaaaacatgtgaatggagacaagttgcaggctattcactgagtgtgagcagtgcaaaaccaaccacttgttattaagagtgtaatgagatttccgtgaaaatcatgattgcttatatttcaaatctgtgaccaaaattgttttaacttgtttttttttttttttttttttttgctctgaagctaccaaacttccaggggccacactttgggaacactatcctactgttttcgatgagaacatttttggaataractgatgaactgggtacaggtgggaagggactggtccctggtgaattttaaagagaacgaaaacgagaaactgaagaacaacgggttgggctccttgtgtggaacagttgaagaaccaggagtttaagctatgtccttacaagtgtttccatttgttctttctttgtaccttgcagaataaaagccagggatccatctttgtccggatacacgccccgtggcaggtgctggccagagaggcagaattcttgaagatcaaagttcctaccaagaaagtatgagcatgtttctcctgggttctgggcctcctgagggctggatggatgcaaataatttgggaatagggccaggtgggatgtgggttttgtggaattgaaatcacacttgcttccccagggacccatgatgccggggtggggggtggggnnnnnnnnnnnnnnnnnnnnttggggtggggagggagaatcctcccacctcagagcactggctgggtttgctccatgagaagcaacacattgtccctgtccgtgttcttcatttttctgtttcacctcctttctctcttctcggggtcctagtacagccagacacttctttagtgaatagagtaatgagagaaggctgcaagccacgctgactgtgtcagcagtgggcaggggaaacaacaccaatttgctgtggagaaacctattctggttatgattctgccactaaatattgtgtttggtgggkttcacttatctcttctgtaaatcagaagrttcttaatcaggtgaattgattaagatcacctggtaagtgttttcaaactgttcatgccagtgtcccatctctgggaatttgacctacttggttggtatggaatgacgttctcatcagtgttaggcaaaaaatccccaggatgatgcacatctgggttgacagccacacagtttagatgatgtttgaggtaktttttttttttttaatccaggatagtctatacrtaatttaaaaatctacccagaggccaggmacggtggctcacacctgtaatcccagcactttgttggggagaagtggaaggatctcttgaagtcagaagtttgagaccagcctgggcaacatagcaaaaccccacctctaccaaaaaaaaaaaaaaaaaatctacccagggaatttctaggtgacatgtctccttgcataacaaaatctagcaaatagctccaaagagaaaggaagcatgtgctcacagatactccattctttattcataggtattttaggggaaaggggtggctattgactttgaccatctgccatgtctcttagggagggtcctgtggcagatggcactctagtttaaccatgggtgaactgtgggtggtctctctttctttccctccaccccctcttctctctctctctctctcatatacaccacacacacacacacacacacacacacacacacacacacacacacacgtccctttccatagtgtagttgtatacatgctaccatggcaaagatcatcttgctgtttgtaactaccatcatcatagttttcatgctgcccactgtgaacagaattccatatttgttgccttctgtaccaccactgtgatcacctgccccctcgttaccatgccgactctcagtgctatcattatagtcagcaacaccattctgatttacattgttggccaacaccattttcactaccaacagatctgctatctccatcaaaaatcactcatcaaataccagcacatgactgataccatcatgaatcctctacttgagaagaataaagtctatgggttctgttcttatagatttattacaatggacaataactccacggcaggtggacaaatgcttattaaacaatgaacaaacacaaacattaatattagctacaaacattttgccaacaaaaggtgatttttggtgtcggggaggggggtcacatgcctgaagtgtcttagtttcacaaggaatacgctgtgtctttccccttcaattgcrctgctgcgttttttgtctcctagtttcagtcctctcactcctaataccgcagccctcaaatgcgggtgccatctttgttttggatctctgcttctctttagctcatgttctctggagttcctggcaacatgatactagtttcagctttgggtggaggcttctgcttcctyctggtggggtcctgttttggccaaccctatctcctctttcttctgtcttccttctaactccaatatattattctcctttctctctggtttatctgaatgtgtaatgttctcttaacctcattctatttgtgtcttgtttcctatgttttaatctctgctgctgatccttggaaaggaggtgagcaaaactctaatgcccatgttatgatttccatcccccagggtaacccttttaggggaaacctagagacayaggaaaagtgtgtcctttttcaacctccgcttgcttattttccctctttgctttccttcccgtctttctactctcattcttttccttctcttctctcttccttccaccccccacctctgatgcctcctcttagcctctctctctgttctttgcacactctatgacacctccacatctctctttttttttttttttttgagatggagtcttgctctgttgcccaggctggagtgcagtggtgtgatctcggctcactgcaatctccgtcccccaggttcaagcaattctcctgcctcaacttcccgattagctgggattacaggtgctcatcaccatgcccagctaatttttgtatttttagtagagacagggtttctccatgttggccagctggtctcgaatttctgatctcatgatctgcccgcctcggcttcccaaagtgttgggattacaagcgtgagccaccacacccagccagacacctctacatctcttgtctttctgccaccttctcctcctcactcccagacttggcttccccagtagtgcttgcctttggtccctctggtatctcctttatcttttcacatgcttatgctttttagagcatagttttgcataaatgacatattggctttcagagtttcagtgcccctatacattaactgtttggaacttacatctgtagtttttaggtggtacctgcatttgaacttgtagatgagttggcgagggtgagaacatagtataaagcagccatctctgggtttctctccccactttgcattttggtagacacagcactagtcgagtcctcagaagaagagacttctaaccttggttctgcagttattcgttgtgtggtttggggacgtcatcccatctctcagagcctcagttgcctcatctatgatatgggcatactcatacctgtcctatttttcttagaaggtttttgtaaggatctgattcttaaccagtgctgtgtaaatgcaggactttgttgtgtctgctttctgagatattttaatgtgtattctcaattcttagtcccccagtcaacttcctttctgaccaaagaagcagccagcactgatagtgctccctctgtaagaaagtccttggagaggcactgagggagcagaaacaacccatgccctcagggtgccgacaatcacagggcagcatagggggagtgcaggtgcccagacatcaatgcagtgatgggatactgtgtcaagtagtaactcattagcccagcaccaattctgtttgtcaatgtggtgggttagggagtagggagaggcaaagcatgtgattgcccsccarggctgcagataaaacagaaagaactttttyccaaagtttcttggtcccagactcgactcagggggactgttttggcttccttttaccacatggccccagatcttccttttctttctttcttyttttttttttttttgagatggagtgtccctctgtcacccaggctggagtgcagtggtgcaatctcggctcactgcaacctctgcctcctgggctgaagcrattctcttgcctcagcctcccaagtagctgggactataagtacgcgccaccacgcccggctattttttgtatttttagtagagacagggtttcaacatgttggccaggctggtctcgaactcctgacctcaagtgatccatctgcctcagcctcccaaagtgttgggcttacaggcatgagccactgcacccggccccagatcttctttttatcatagaaggcaatggcttgtagtggagctcacggagggtgttatacacagatgaggggggatataacttggyatgctgggtaggatgctatgtttgtaaaaattaatctgaggctctgatcccaggggtgggggtctgggttaaacccagttcctgagttgagagaggagcatggaaaatggaagacgagactcgctgtctgtggagggctagtgttgaggctggtggcatgctctctttttaaaatgagaaaaaaaccacatttgctgagagccacatcctggcggcgaggggagcgtggaggaagaatgaggcatggcgcgggatcagttaagcatcctccaggcagtggaggtttggatcataactcggtggggtccagagagactgggaagatggggaggaaatcacaaaatcgagatctcaaacctggacaaatccattgtaatgtgtccagggactccaagtcctgagcacagatattaactgggagggggaatcttggaaggaagcatttgttttccaaaaacaacaacagaagagccagcattttgtgagggacactcaagatccatgcacagaagggtgtgggaaggcctggcctttggccccgagyagcctgagaaggtttgaaatggcggtatggaagcaggtgctttcttacgtctgctcattaccaagatggctcttctagagatcgtggtcaacatttctgttgatttctcatttgctttttttgtatatatgaatgaacactccgtttctcatcctttacattctcttattcctcaagcctctagcagagacaaggtcgatgcaggctattagggacgactttcatgtcagtgaaatcatattaatccagccagagtccactaaatttggaagaagtgacatgcctgggatgggtgaaaaatcccttttgtccaatcgtcagagcttttgtagctattgttaatagagtgactgatattgaaggggtctcatttgctgtccctcagagcatgccagaacttcagcttatgtgtcctttgcacgcaagtagatgctgttaacttccagcaagtcatgcctttttaggaaagcaggctcagagctccatgcatctccaaaacgggagtaatacacattgtggagggaagaggtgatgatgttctctgaatgcctggcagagaggcacacacaacacatgagaattgccgttgttactgctgttggtattgttattcatagcaaggtgtgcaggcagcgcaattggtacaagactagggctgtttctgctctttgactctcttctctcttctctgcaatgttgggggaagcaggcccagtccctcaactctgccaaggcagccagaaatccagacatgaaatctgtggagatgcaggaacagatggcctttggactatgtgctggggacttccacttcctagagcgcgggtccttggggcgtctgtaaacacgacggctccacctgtgaggtctgcggtgcagttgctgggaaagccagtgagaagactgctggggccccgtggtgcaggaggcagagcttgaaggcacccattttaagggagagacagcaaacgtgacaagtggtccaccttgagttccactattggctctgccaccattaacctggggttacttgattcatgtcttagtctgtttcctaaaatggacttgagatggatgacaaccaaaagaattttggttgtaaaaggacagataaaaagaatcatgtaactggggagkgggggaagtaggggaagtgcaagggaaatgatgatagtggaaactaaaaataagggtgatggatgcaggagagacagagttgcattctgggctttctggtagccaagacagaaaggactgtggctcacagtcgtctataggaatcagcatctgttttgccaaaggaggcaaatttttcctgttgtaaatgacatgaacaatacaagggactatgttttcaataataagttcacacaagcttctgcaatgttcttcatgtgaccattgyttgcactgattctggataaaactgaggatgtaatgttaaagtgtagttgagggagggttgaatacagagtaatgtgtgaaaatttctgaggggctaactgggttcaaagataacggttygagcagaaatgccactgacactttaattcttttcggttgaacccatgttttgaaatgtttatgtctactaaactgcatttattaaagaataagttatcttcttttcctgaagagaaaacatatgtaattgctattaagcattatttatcagtgtgaaaaaaattggtgtttccacactgagctgatagaattccagttaraaagcaaagaaacttggcattttagttagcttcagtggccctttaggagggaaaggtaattccatttagctttgraaatgattggaaattgttctcaggtacttgttattgtctctgtagagactctgatttggtagccctggcttttgcaaaagcttcacaggaggacttcttcctggttcatggtgctcgcccggcctgagggactctactcagccaggactgcagcacctcttatttctcagttatccagatttgaggcttgtattagggttctccagagaaacagaaccaacaggacacacacacacacacacacacacacacacacacagaggtgttatgaggaattgattaatacaattatggtggctgggaagtctcaagatctgcagttcatgcgatggagacccaggagagctgatggtgtagttccagtctatgtccaaagacctgagaactaggaaagccaatgaagaagctccagcagcctcaagacccaagaactgatgtttcagttcaagtttgaaggcaggaaaagactgatgtcccagctcatgcagtcaggcagaaagagtttccccttacctgtgggaaggtcagcctttttgttctattccggccttcaactgattggatgaggcccaccacattagggagggtaatctgctctactcagcctactgactcaaatgctcatttcatcccaaaacactctcatagatacacccagaatgtttgaccaaatatctgggcacccaatggtccagtcaagttgacacataaaatgaaccatcacaaggcttgtactttccaagtcartaatcctctttgttagggaatgaatagtggcattcaaaaagatatgtccaagtcctagccctggaacctgtaaatataatcttatttggaaaaaagatctttgcagatataattagttaaggatctcaggatgagatcatcctggatttagaatagaacttaaatccaatgacaggtatccctataagagaaaggcagaaggagatttgagaggggagaagattatgtgaagaaggcagagactggagttatgcaggctcaaagtgaagaacacctggggccatccaaagctggaagagtcaagaaataatttttcccttacagccttcagagggagtgcagccccactgataccttgatttcaggcttgtgaccttcacaactgtgacagaataaatttatgttgtgataatttgttatggcagcactatgaaactaatacactcttcttctgggcaggaagcagtaagcagacaattgaagacctaggtctctggtaggcttgttggctttctctgtattccaagaatccactttgcagattctaagataacttggagtagtcttgtttatttgttgtcattgggtttgggagttttatggaagagacttggtgcatggatcttcctacgtgaccttkgcatgtctatgatgactttttcatgttccattcctgtttgatgaaatagaagtagaggctcacsttgttatgaatggtggaaggagacccartgtggctcatgtcaagaagagcttactccactcaagaattattttcctatttatacttctatatccaaatacagtaattggcttaagtaacagcttctgcctcagtaagaggtgtctgcaaagaaggatattagcatsttttaaagcttgtccatatttcataattcttacatttgactttgaggaaaaagattcataaaaccgctttgaattatgccastcaaaacaaattatcttgagatcaaaagtcttataagtataagttgataaataaattaattgagttttaaatatagttaatactgcatcccatgtgctagaccatttcgtaagagccttatgtacgtgatttgttttcaccttcacaacaaygacatgaggtagatatgaccgttagcttcattttatagatgagaaaattgaaactcagagaggttaataaacttatccaagggcacacascttgaaggagatagtcagggactcaaaatcatgtctgtctgactccaaagccacgctcctgctctctcactttactgaaaaatccataactggacttgaggtagtggatagtgtggtctagaatggcatttctcaaagtatattttttagaatgaaagtctttgttcttcttttggatttttttttttttttttttgagatgtagtcttactctgtcgcccaggctggagtgcagtggagcgatctcggctcactgcaagctccgcctcctgagttgatgccattctccggcctcagcctcctgagtagctgggactacaggtgcctgccaccacgcccagctaattttttgtatttttagtagagatggagtttcaccgtgttagacaggatggtctcggtctcctgaccttgtgatccaactgcctcggcctcccaaagttctgggattacaggcgtgagccacagtgccaggccatttttttttyyttttttgagacaaagtttcaaaaaagtcttgcccaggctggagtgcagtggtacagtcacggtttattgcaaccttgacttcctgggctcaggtgtttctcccacctcagcctcctgagtagctgggactataggcacacacctccatgcctggctaatttttggtagagacggggtttcccccatgttgcccaggctggtctcgaactcctgggctcaagttatccacccacctctgcctcccaaagtgctgggattacagctgtgaggtgccatgcccagcctagtctttggttttactaaaaaaaaaaaaaaaaatttcatggttgaacaaattcagaaaacactaatgattacaatttaccaggacagtcaaagttttgagaagccttgtagtaaaaacaaacaaacaaacaaayaaacaaacaaacaaacaaacacacaaaaactggttcaatttttttcaggcctttttctgctgaacacttgaacacctatgaatatcctgaggaaccaatgttctgcagaacatactctggggaattccatcctagattaaagaatcctggtctgggagaggcaacagatttcaatggtcatttttaaaaatgatattgtcttgctcagtgagttattccacattcctggatgacagctttctcacccgtacagtaagaagattagctcctgaattatctaccatagctttaaaatgctgtggtctacatgtaaagcaaatgacaatttgtgaatgtattttttcctctgttattgatgttggctgaggggccttaggacagttaccttttggggtcagttacwttctgattgttcacagatatctaagagtaaaagtgtcgtacgtctgtcacctcttcaagctttgctctaaatacagtagtacactttgcctgtggtgcctattctgaaactgccctgtgtccccaagcctggtaakgtcaccgggctttctctgggtttacccatgctggactgctcttctccaaaccacacctctctgtgtagcctagatggagctccctgatttagaytctcgtccaagcagagtactttactctttcctccatgggctggagcctttccaaatgctttaagtatttgtccttagtcctagaatattctgcccattcctgtctgaataaacatatactactcatcctttgctgcccagcctaaatctcacctccttcatagacctttctttattccttcagcccgagctgatattaccttttccggactcttagtcaacagtcagtatttatcttacctgttagtttttcttcagctgcttcaggtcctaactcttgtgtttccaaatatatcataagccccctgagagcaagtactatggtttatatctcttacgtgttccctgcaaactctagtatggtgttcctcaaacaatatttgctcaataaacaccaggttgattaacccattgatgcttcctctgcccagcatcttgtttgggttgtgatccctagcagagtcgctcaggatgataagagatgtttcagctcacagctgtacactggccctatgaaattcggcaacaggaattgccccgcgttccctcctcaccctgaccaactmsttcctttatcggaactgtttttgatagttcagtacatccagaaagaaaaatcaggagaaattctctgagtttgttgttgtttatttattttattttattttattttttttttgagatggaatctcgctctgtcacccaggctggagtgcagtggcgcaatctcggctcactgcaaactctgtcgctcaggttcaagcaattctcataccgcagcctcccaagtagctgggattataggtgtgcgccactatgcctggctcatttttgtatttttactagagacagggtttcaccatgttggccaggctggtctcaaactcctgaccgcaagtgatccgcccaccttggcctcccaaagttctgggattacaggtgtgagccaccgcgcctggcctgagttttattaaggatggagaacttgcagatcctcggtcgtgggaaggaggttcgctgccaactcagtcttcaacatgactttctggacagattcttgttattattattgtcagtaactttttaaatgagctagaactgatgccgtttacatagggttggttggctataggtggggtctttctcttgctgtcattacctgttctctaacatttgttttcaatagagggacagctgggagggtagggtttatatttaatacctttatgggcttttcagtgcatgctctttgattgctttgattgctgtttaaatagactggraagagtgcagaatgctttttattcattttgttttctgtaatgcttctcactgtcaaaaataagaaaaaataattggtggtacctaagtgctgcagttcctgtgaggaacctgagatggtcacggccgtgtggcggatgtgcgtatgagcctgggaagaccccaggcccggttgactacgtggaggcctttcagtggacaagtgtgactcagggcccagaaacagtgacgttaaaaatatgaaaatgtgttacaatagcaagttaatctaaaccgttttatcagcagcacccacaacagtgcctggtgtacagcaggcactaaataaatgctggtagcgaacgaaagagtgagtcatgcacaccagatctcacccagtggtggtggcgtgctggagggtgatgctgagatggattcggaggctccatccaagggcaataggcaggaatcctgtgctccctgagggctgcctgcgagaaaagggcagggcatcatggtggcacatgtagcattatagctgccctgatctgcgtcctttgctaaaggactccttcagttaatggggacagactgtgtgtaagagatcctgtggaaagttacgttttccatccacccctccgaccatccaatgaatatttattgagtattaccatacaccaggtactttgctgagggctggtgatatagtggtgctaataactgttccctggccccactggtgtggggaggattcagatgttgtatggctagttataaattgggaggcaaggctggccatggtggcttacacctgtaatcccagcactttgggaggcaaaggcaggaggatcacttgaggccaggagttcaagaccaacctggccaacaaagcaagacctcatctctactaaaactaaaaaaaatttaagaagttagctgggtatggtggcatgcacctgtggtcccagcaactcaggaggccgaggtgggaaaatcacttgagcccaggaggttgaggctgcagcgagctataatcatacyactgcactccagcctgggtgacagagtgagatcttgtctcaaaaaaataaaaaataaaaagtaaaataaattaggaggcaccaacagaagaaaaagactgggktatgacaagagagccaaccagaggagaatcatttagatgaaagtgggggagaggaagagaagacgccatttaagctgaaatgtgagcactgggtaggagtctgtgggtgggaagatcaggtgagaaccttccagaagagggaaggacatgcccacaggccccaaggtaagaaaaccctggactgcgtgtggaaccaaggggagccagggtgggagcagctcagagagaggggcaggggctgaggctgccgagggaggcagcaggcatggcgcctaagaggccttgtcagccatgtaattttaaaagtttggttttaatcccaacttttataagtcagcaaacattcattcatgtgtagaggacctactracaacagaatcaaaaaccataaamaaatacagaactagacactagagaatgtgcattgtgtaagtgtatcactgtctgtctacactcagtgttgttgctgaggggaaacttacctgtggacacaggtggggtggaggggaatgggcagcccctgttctcgctgttcttggtgtgcacagagaaagtcttcctttggctccaggttgtagctgaccttggctgctcctggcgctgtttcccttttgatcgctgaaaggcttaatgctctcttgcatgcgtgaatgtgcagcaagcgagcagggacagatttcagcagcatggaacccctcaggtcctggctcagcgtgtgcctgtgtgcctctcgcaggcaccacctggcggggagagcagtgggtgaactccatggcatttttggcttctcttgctcctcccttcttcagctccagaatcttccatccttgcccagctggtgacttgcacccctttcctattgttcggcttctctgtgtgtctgagcctttagggtgagtagaaaggtataatgatcgtcttcagcccagccctacctctcaagatgagtgagataccataagtaataactatggaacttcgatgatccagcgactggaggaggagcagaggaaagcatcaataaataaaaagaggcggacgatgggtgttaatttckgtcaacacgtgtgctcccagctgcagcacacgttctgttcttaggtctggtctgcattcctcctgggtgacctttcctgcctgttgctgggagagacactcttaggcctctgcagatattagtgactcatgggtcattaagattatgttgtttttatcttatrctgttagaccttttccttgatcttcggggtcattggatctcccaatgtttgtgcaccttgggcatgttagtaaaactttctgtgcctcagtgttttttaatctgtaaaatggggacagtgccttgtatactgtccaatatatgcagcttcattccccgcaccccaggaaagcacatgattttaatataaaaaggaaacaaatcagccctcagaccacactgctgtgcccctctgcagaggagaggctgagggagacaagaaggaaaaaagaagtaagaaaagacagtaaaccccttagactgtaacagtgaggcccaagtgagcttttatgagaaccacatttgagccctggaataaaaaataacagcaacatattttaaaaattatttatgattttaagcacatgaaaggcgtatcatgtacccagggagggcataatggggaacagctggctaacatgtgtctcgccatttctgaggttgttcataattctctgatatccaagaatracagtaataatgatgccactgctgattgtattaataataataaagaggattggggtgtctttcctgaatcctgccgaagtaaagaggagagcctgggctgctgggtttggccagggtggaaaggggcactacagcctactttcttctcaggggcagtccatggagcccagccaaggatcaaaggatgttaggttgaagtaaagggctccagaaggggaaggcaggaagcctgggctcctggcatgattttaccactgactgtggccattcccagcccctctgagtctcagtgttctcatctataaggtagagatgctaatcctacctggcaggcacacctgacagagtttgtatggaccgtggatgraatgatgctcagggaagtgctgggtacactgcaaaacattccatacatggaagggtttgttatcatccttgtgtttctccagggcttaccacaatcaaccaccaagctcaggactggacatctaggaggtacccagagatgcttgtgccatgaatgaatgtttctttttcattaaatgttcagagccatggagtggtagccttggacaatactttttaaagtatttagtccagttctctcttttataatttgttaggtgagtctggagtagcgctcagtctaaggcagattatcctccattgccgagtcatctgagcacactacccagtgccctgtgaatcagggaattttcctgtacagctggtgggcataagtgctgttccctttcagacagttctctctccagtcttgggtactttcctcacactcatgggctaaatactcacaggggaccttctgtagctctctggggtgctctgtcctgtgaactctagttgtcttgctctccccagacttagagctcagtcttctcaactcagggagtttcttgggctccacctctctcccctcctctcccaaggcagcgagctggactcacagggctccccttgtctgtctcccatctctcagggatcactgcctttcattgcctgatgtccagtatcttgaaaatcattatttcatgtattttgtttgggtgttttggttgttttaggcaggagagtaaatgggtccctgttactccatcatggtaggaagtagagtttcccttgttttcccttcggagatgaagaagctgggagaagggtatgacttgctcaaagctgcacatctcattggtgtcagcaaagaggcagcctcctgtccccactgtgtgccagcacacaggcagggtccctgctctccgtaagtccatggtttgttgggcagacagacaaatcaactgagaatttgagacagatgcttaagtcaaggaaagcaaaccacaatgtattttatgaggcgggtattcatccacagggtaccaaggaagcatggaaggaagtgagagggcaaggaagggctcctgggagggttggcacatgagccttgcggtgaaggagaggcaggagtcatccaggcgggagaggagggaagaagtctcaggaacaggtaacacacacaacagctcggagacaggaagcaggtccctcgcctcaagaccagtgtgtatggtgtgtactacgggggagacctatgtgtgttttattgtggatatgaacctgctccatcccccgacagagtccctgaagtctggaaatttcttccaacacaagtctgctgtggtgtttcagcctggggatgtttgtgtagggtcttgttcagggctatgcagttgatgttaccatgaggtttctggtgggactctggccttccacactcttgaaggcagccaacaatattcctttcagtgatatggagcatcctccatcaagaaacagttgaaacttaccccagtcccactcctggtcccagtaaaaacagcgtgggagcccactccctttagcccgtttctctaggtgagccctagcagatctattgccaaggtgaggctcaggaactgcctggaggttctcagctgaacgtctgccagagccagaccctgaaacaattgatgggttagaaatctgcatcaacttctgtgggatcggtggtgatatcccctttatcattttttattgcgtctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttctgaatgtgtttgctcttccttttctagttcttttaattgggatgttagggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcataaaacaatagggaacattttggacagtatcctgtcctcatgggattatggtttggtagggatggctggacattcatcaatcactcaaataagtataaaattacaactgtgataagtgttataaaaaaaggaattagggcttatgaaatacagtgaaggtgggacttgccattgtttggaagccaaaaaaggctttttcccaggaagtgacaataacacgagacctcagtgtgaacagagcttggtgagccagcgggtagggggtggtgaggtgggagccataggggcgagatgtgcccagctcagccagtgtctgggtgcagtcagcaggaactacacggaaaggtcaatatggagacttctacaggttccatgggatgtgttaagagttttggtctttttcctaagagcagtggrtgactgttgaaggctttttaatgaggaggcaagaagattagatttttgcttcagaaacctcacttgggctccagtgtagagactgaattggaggtgggcaagagtagaaatgtcagatagaacacaggatgcctagttaaatttcaatttcagataaacaatgcatactttgttagtatatgtcccaaataccacatgggatataattacatttaaaatttattgttttaactgtatttttaaaaagttttaagtaggttgcaaatattgcatgggacctaattatgctaaagattattcaytgtttatctgaaattcacatttaatttgacatcytgtatttttatttgttcgatctggcaacccttagcaagagaaaatgtggagagactggttatagaccagttattgttgtaaactactaaaagatgtttaggttaggtagcagaggtggagacggagaggagtggacagaaaaggaatagcctggttggtccaaatctgccattgaaaggcatctggaggacagagtccatcagcttccctcccactctgaaactaattaccrcacacatgccatttaaagacacgtgggtatggtatggtgaactccatagtctcagtgcaggtcaggtgcctggtcagaacctgcactgaatggcctataagaggtgtgctgtgacagtgtgaggtggtcttctttctgtctccatccctccaggccagagacacctgagaggtgagttctgtgcattgcagtgactaatgtgtgtgaaggagaggtttggtagaaaggtcaagaccttacgacaatagaggcaatattgtaagttgtacactgcttttcccatgacaactcacattttacaaatcaaacagtggagtaaagcagtcaagaacacgggctttgccaggggttttaaaccccatcrgttattagcttgtctacactatctgtgtgatcttggctgagatacttaactctcttggctttgcaacatattttaagattagcactaaagtacattgaaagccaggcccacaggagatgcttagtaaatcgtatatgctactagaatcaacagtctccttgtttcggaaggcaggcttactcttcgtcttcttacacaactcacttgattatcttcttaattcacagctctggttttgtcacygttcacactgttcagtgtcttccactkccttgtgtagcagatctccatgcactcatctcagtttgccccaactgagtttcatggagatctgctgcacaaggcaacagaagattgttgcacatgaagattgtcactattgcccgtcagaacccctttgtccaagcaaaccagcccgtgtaaacctccttaaacatagcttgaactttccacttttttgtttgcctagaatatcttttcctgtatctgtttaagccttattaatcaaaastatttataagtgaatgttaacagaaatatgaaccaaaacaagatataaaacttatatataaaatgagataaatgcctgtcactggggaaatggctaaacaaattagtattcatgtctactgtgtaatactacgcatccattacagtagctgtatggaaactgtcctggaaagatatctatgatatgatgctaaatgaaaaaaaagcaaattatagaggaatatgtgaagtagggtcacagttgcttaggaaggaacctagttctatctatatggaaagagtagggattaaatatattccaaacggttaagtgaggttccttttggagaggagggtgggaattgagttggaagtcaaaggaaactcctaacgtttagttaatatactttaatgttttaagcttgttcgtttacctgaactgtgttaattttgtaattgaaattaaatcaaaatgcatagaaaaaggtttagaagaactaaataaactgtggttatgtttcagttgttagactggggaggctcttgccctgtccttacttatcattattttattaaagaacaaaatggtaatggaagaagattacccttctgccaaatccaactgaaatgctactccctcaacgaatatgtttctaattcctcaactgaatgtgctgcctcctttctttgaaccctcaaagtactttatatatcttttgtggcattttctcatcctatcttagtgagtatttcaggtgcccaagtatgaagacaagtatttcataccagtcttactgcccctctgcattgaagtaacgtgaagctatcatggtagagaaggaaataggattttgagtcagagcgtctggatgttgcctcttattctggatgtctattgcagcctgacagattagcccacacttagtagcctaaagcaacagtcatttcattttatctcatgattttttgttcaggaacttgggcagagctgggctgggtgattattctgcttcatgtggtrttgactggggtcacttggtggtagccagcttggaggtgggatggacgggagggttcaggaaggctttagttgtatgcctgctgcttggcagggcagctggaagactgggctcagctgagtgcctttcccttactgggtactctcaggacgcctccgtagacttcttatggtgtgattcagggcttcaagggataaggcggaccaaggctgaggctgcctgtcttctaaagcagtggtccccaacctttttggcaccagggactggtttcacgggaagacaatatttccatggaccaagggtaggggtggtggtggcagggatggtttcaggatgaaactgttccacttcagatcatcggcattagattctcataaataacacgcaacctagatccctcacatgtgcagttcacaatagggttcacgctcctatgagaatctaatgccatcactgatctgacaagaggcagagctcaggcggtaatgcttgctcacccaccacgcacctcctgttgtgtggtccagttcctaacaggccatggaccagtaccggtcagtttgtggccccggggattggggacccctgttctaaaggatggaactggcatagtatcactcctgctatactccactggttaaacatccacagatccaatgcagattcaaggggggtgggaacagagatgctacctcttaaaagaatatgtgtgaaaaatctgtggccatcatcaatttatcacagctttgctatgagaaatacaacttctgtgyctcaatgactccatttgcaggttataaagatccaaagctataatgtgtgcaaagcatgctatgcattataaaaaaaacagtatgcactataaatattaacaattaccttggtactaaatctatgccttactcaaggcaggtactcattaaatgtttaatactttgaaagcaaactcatttaaacacasatatttcctaagaaaaacataaagaacgggatgctggatgatcacatagaagcgtggcgcagttttagagtatagactttggattaggttgacatgagttaaatccaagctctgtcacccagttcctatctatgtggcctttgttaattcgcctcacctctctgagccttaattgcctcatcatatggaaatagtattacctacccagcagggttgctgtaagcattggagttaatttgtgtcaagcacctactagggtcacattgtaggtgtgcagtttttctaagatgatatcgagtcatatagaaagtttgtactcctcacttatttctctacactgctcacctccatgagctcaaaggattgagaggagtcaggagtccaggtccttgtgagagcactggggaaaagggaaaggccctccttcttgtttctcccagtctcttcctctctccaatgttcacctctgggaatctgtgtccatgcagcttttttttgtgaagccattcctctctgctggaagtggcccccttttcagacctgtggctcttcctttcatagatgtacgagatcaaagcaggaggcagcattgcaaagaagttcagcgcggctctgcagaagctgagctcgcacctgcagccccgagttccagaacacagcaacaacaagatgaaaaacctctcctacccattctccagggagaagatgtacctgtgagtattgaagctgctggagcagagatgtgggaagggataggaaggaaaattgaatactgttctatgactcagccctggggctcccaaagtgggtgccccagtgcctgggagagagagtaggaagcatgctctcatggtgacattgtccctgtgcctgctttgtgaaccccctccccatgtgagattgtcccaaacagccaagggtgcttgtccagcaggaaatccaccatttcaccattttgcaggatggagggcaaaccagggagcagccaacaataaactttggaactstgtgagaaagtggtcagacacctgtgtatcttctgtaggaaaaccttctgcccaattgccagtctaatagggtttcaacaggatatgataaaccagaaagaaggtggatgaagcttctgggtttctggattccagctgcctacttgtacactcattgactctcaggggtctttccctgtccctgcaccctgcctaggaagagtgaataaaagctcttcacagagatagccacttggaaacgtttggaagggggagccacagctgggaagtgggagatgcagccgccaagcatcaactttgctctaggagctaaggagaaaataaacaaccatcgagggtgatgagaaaatggagcaagagagggaaaggccggggcatggaagggcagagaggacagaaagaaggaccttctcattttaggaggtggaagttgtggagcagtgtttctgctgtccataagagaccatctcctatccatctctgctgtgtttgatattatcctacacacatgaatatgctgtttcatttgcmtatatttaccctctcattgagtcctcatgtccccttgcgwggtggcgggccagatctaactatcttctattatagataccaaagtctaggtccatccagggtcataccgccctaagtggctgagctgggccttgcatggtgactggtggcttgctgctctttctgtgtcctgtggtgcttccctgcatccccttccctgggccttcatttatgctggtgctggcatctgaatggtcacttcacatgcacctccgttcgttttacttctgttgtccttcaagactggttcatcaacaccttccttttgaaggatattctgctcttcccaaccagaagcacgcgcttcaccctctgaactttcatagcaatggtctgcatgttactatgttctactctgtgtcagttacttggagaaatgtaccttccagtgactggggctcctggggtgctgggagcgtatttccttccttcatcagtgcatcctctagcacagcttcctcagcatgacaaacatgccccatgtgctattttctgagtgaaagctcagtatatgaagttaaaaacagacccagcccttgcataattaagatttttctaatggatgagatgacagtgacattaaatcaaattttgaagaatcagagtgataatccaacaccctgaaatgataccctttttgttttgtatttttcactgtctttgttcatgcaccagtatcttttctacatactttccatttggaaccttatcatcatataatatttttctaacatggtgtaatctttttctttacacaaagttttcataattataaatttcaatgactgcatgataccctatcctatagatttgggcattgcatcttattgctataatctttgttataaataccttttcaataagcatttttatttatgttatttttctttccttgtgttgagtttcttccctaagataaatttctagaatacgtttttagaattactgagtcaagaagggcataaacatcgtgtgtgtgtgcacctcataagtcttgctatgttgctttctaaagatttgttgtgggtctggggtggcagtggtctcagggcaagggtaatgaaatgaatttgccatctgctctcttggtgtctccaggtacaacatccaggaaaaggacaccttctttgataatgccacccgcagccgcattgtaagtaaatggatgtactgtgttaggaaagaggatggggaaagggctgagttcctagttggcagggcattctcttaccctccctgccacctcacaccgttatttgcttggagttgcctagcaacagagaagagtatgcaagagcttccccattccccaaaagaaacagcaaataactgccctcactcgtggtttaagaggagcgtcttctctttatgggttctccattaaagttcttcttagaaaaaaaagaaaaacagagaaggtcatagttggtgcgggtgttagttaggtgaaccccttgatttacaattgaggaaactgaggctctgagaagcaatgcattgaaaaaaaattatatagatcgttagcgtcagaacaaggatcgttagcgttagaactagtccttctgattgttgggccactgtgtttgtttatgcattttcccttctttcaactcccatgacagagtcatgtgaatttctataacaaggaatgctagttagccaatttgcgcaagaataatatcaccagcccattcaatagaaagccarcgcttgtgaccgtagctcttcttctacagtcgttttgccttcatgtcaagtgtttgaattttgtaggatgattggttctaataaaaatctgcatatggcctgtgtttctgtggcctctgcatgagctgtagaacatcttcattcaccgatcagtttattctctatcaccctagaggtcacatagcctatgggcagaagagagaaagaggggcccaaggaatgccagaaacttacacatgcccacatgggacgtatggaagtgcatttccattgatccttaccaaagaactgaagtttccacaggaggaatgaggattagatacctagaaggatctcccagctaatagggtggtaagaaaatatatgaataagaagggacaggtgattagaggaggctaggctatttcccaggcacactgcaaacatggcgttaactcttacttgcaggatgggcaaggacatctcagatcccttagcctagtgttttaggcagagttaaaatgggcatagatctctttttttttccaatggaaaaaggcattaacgtcccattttcttggttgatgctattacaaaccaattaaatctcactgtggcttgrgtcccacgactgtgggggagttataaggtgttgtggagattactcgataattgcaaagtactcgtaaaataatacaatgccatataagtgctgttcctaattattattgctgttgaattactgcactatattaggagcagaattaaacactcttgggccccgtagttatttatttaccactccctttaggctgtggctggaatatgggaatgtaaataatgatggaataacacttcttctagcattcatctctccttctggaagcatcttcctttcctcagtccaccccacattgagaacaggggaaaagagccttgagttttttcctggggtctattctgccctggactttggttggaggacctcacccacatctgtggatgtctcctctgtgcctscttctttgtgggtgtctgagcacctcagctgtttgttgcaaagcagacttcattgctgggcatctctttatagactggcataggctgggractcaggaggtcactcgttggccagcaggtttacactgacccacctttgtccctccctgattcttttgtgggaagcacccctttcctcccatgtaagaaacacagtcccctgcaggccccataggccaggggattctgtaggctgttttgggcatgtagggcttcaggcaggcaaagccactgagtcggcagctgctgtgtgcctaggactgtgctctaagacatgaatcttcaaggaagtgtatgatatgctctgatcagggaggcaagatgaggacccaggaaaaaaccagagaaataaagacatcaatgaccaacatagaggtagctcctttgctgttgcagagcactttcctgtgcacggtctggctggcgtccccgagcaggtgggcgagatggccccattacagatgcaagctgaccctcttggcgtttgctcaggaccctctgcacctacctccacgttcggagctttctgctaccacactggctctccctgtcagccgggctccaggctgggggagggggcccgcccctccccgggacccgccagacagaaccccgccttccctgmgrttccccgacgtgggcggcagacactgtkccctactccacagacccagggcttcctcccagccctcccgaggctatgtggtctggggtgggctcctctgttttccttacttcctgtgactgccgtccatttctagccttttattcatttgtttttctcagggtggggcgaaggggcgggggatgtgtgcgcgggccttacatcccttgtttcctcaaagtcctcaagtctgagtggggttgatgtgcgggccatgagccaggcacatgcttggcttcgtcctggctccaaatgagcccgggcgcctcccgcccctgccaggcagtggtgagggtgacacacggtggagggcgggggggaactaggagctcacagctctgctgtcgtccccttttaggtgcacgagatcctgaagcgcacagcctgctcccgagccaacaacacgatgggtaaggaccccagcccgcgggcagrgtgctgacgggcgctgaggcggctcccgccccgtgctttcaacagctcccttggtcggcagcaaagaacaaaacaagcaaatgccccccacggagaggctgcttagcttgggctgagaagcctgccttggccccaggagcagcgggggtcccatttctcagtggggctgcccccaggctgttgtaacttctcccaggccctcctcccaggtctccgggctttctctttctcttttccctgtaccgcccacacctgccactttatccggataattctgcggctcctctgtttttcaccatttccaatagtttctaataacccaagaaaagcgtcttagaggtcctttagtccagccttctcatattatgtaagaagagaygaacctccagagaggggtcatgactgtcctaagcccacacagcacgtgatagctgagtctgagtgagcctcttctaacttcagcattcttctcaccatatccggctgaatctgtttgccctgtggtttgtttcttaaatattagggtaattgtcttggaagcatttgggaccaagtataaggcaggcagtataaggcaggcagtccagatcctgayggattgtgtggaagacatctgtgatggcccaggtacaatgtgagctgtgyccataaccccatgagactgctttttcgaaaaatgtgccaaaaagtcacgcacaaacaccttttgcacaggagtcattcttgcatgttgaacccttgttcccaaggtgctgccatctccaagtggcatctgacagctttgggagagctgccttcagaatgcgctctgggatggcaaatctttggcttttgaggcagctttaggttgaaaagagttcagagtcatttggagtcctgtctactgaatagaggaggtgatcaggctcaggaataacaatgataatgatgatgttagctagctaatatttgagagtgtgttgtggggcttgtaagctgcctgggtacccagggcacagtgctggagaaggaatcagaatgggttttatgccatgatagtctttttagaatagtgcttaacctctcaacagggcaattatgtttgcttgaatttgctttgctatattcatcttgctacaagattccaaataacaatgcactttttaaaaatcagaccttccatgttatgttatttgtctggaacacggtgctgatgaggcgaggctgagtaagtgggtgagagaattagcttaaaaaacagagaaattttatatatacatatcaaggatatatatatatatatatgagtttattaagcattagcccaccgactcaaatgttaatctcctttggcaacaccctctcagacacacccaggatcaatagtttgcatctttcagtccaatcaagtcgacactcagtattaaccatcacgaatccacccattgtcaacttgaacccatacacatctcctgagatcatacataatcttcaaataaaagcaataataaggtcataattacacctaacgtaatacaactatccttcgtacaaccggaaatgcactcatccccaatccaaatactattacataaagttaacaatacctaaatgctgatatgaggtcaataaatcttatgtcacttgataaaggaaaaaggaaataaaatgaagatatttcttagtgcaagtgtatacatgcacaaacatgtttttaacaaaagaaggaaatactcatgacaattggcagtcctcgtttctgcagctggtcatgtggtcgtagctggtgttgatgactaccttcttcactaaacattctgtattccctttgccttcaggaagcacctcagcaggtcgtggttttcttcctggtggagtgacccaaaccattcctgaggggtctgggccatttgtattcctgcctggattgggctgttgtggtttcccattgaccttaatcacagggcatgataatactaagagatgccctaacgaatctcctgtattgcatgtacactcttccttacctctgttgtggagtagtagactgatttcatcttgatggtctgggtcaatcaccccagccaacactgtaattccctccttagcctgttgacttaaaggtaggaggagcccaaagtgtccaggtggcaatcttaacttccagtttaatggaattgttgttgtgtctcctggtggcagcattcctccctctgaaactaagatctctaggccagcagaacgtaatgctgtgggaacaggaagcaaaaattttgctagtggatcactaggggcgatggtgagtggtgccacttccacttcagtgccttgattcttggacccgtgaatcctggctatgggagaaacagtaccatatattggatggtgattcagagcatacatggccttctggggaactttgtcccagcccagcaaagtattgtcacctagttggtgttgcaattgtgacttcaaaaggccattccaccattctgtcaatccagctgcttcaggatgatggggaacatggtaagaccagtgaattccatgagcatgagtccactgccacacttctttagctgtaaagtgagtgccttggtcagatgcaatgctgtatggaataccatgatagtggataagacattctatgagtccacggatggtagttgatatggtttggctgtgtccccctgccaaaactcaacttgaattgtatctcccagaatttccacatgttgtggcaggtacccagggggaggtaattcaatcatgggggctgttctttcccatgctattcttgtgatagtgaataagtctcacgagatctgatgggtttatcaggggtttccacttttgcttcttcctcattctctcttgctgccaccatgtaagaagtgcctttcccctcccaccatgattctgaggcctcccagccatgtgtaactgtaagtcctttttcttcccagtctcgggtatgtctctatcagcagcatgaaaatggactattacagtaaattggtaccaatagagtggggcattgctgaaaagataccccaaaaatgtggaagcaacattggaactgggtaacaggtggaggttggaacagtttggagggctcagaagaaggaaaatgtgggaaagtttggaacttcctagagacttgttgaatggctttgctcaaaatgctgatagcaatatggacaataaggtccaggctgaggtggtctcagatggaggggaggaacttgttgggaactggtgtgaaggtgactcttgttatgttttagcaaagagactggtagcattttgcccctgccctagatatcagtagaactatgaacttgacaaagatggtttagggtatctggcagaagaaatttctaagcagcaaagcattcaagaggcgacttgggtgctgttaaaagcattcagttttataagggaagcagaacataaaagtttggaaaatttgcagcctgactatatgatagaaaagaaaaacccatttttctggggagaaattcaagctggctgcagaaatttgcrtaagtagcaaggagcctaatgttaatccccaagaccatggggaaaatgtctccaggccatgtcagggaccttcacagcagcttctcccatcacagacccagaggcccaggaggaaaaaatggtttcatgggctgggcccagggtccctgtgttgtgtgcagcctagggacttgctgccctgtgttccagccgctccagctgtggctgaaaggggccaacatacagctcaggctgtggcttcagaggacggaagccccaagccttggcagcttccatgtagtgttgagcctgcaggtgcacagaagtcaagaattgaggtttgggaacctctgcctagatttcagaagatgtatggaaacgcctggatgtgcaggcgaaagtttgctgcaggggtggggccctcatggagaacctctgctagggcagtgtgcaggggaaatgtggggttgaagcttccacacagagtccctactggggcactrcctagtggagctatgagaagagggccaccctcctccagaacccagaatagtagatccactgacagcttgcgctgtgtgcctggaaaagctgcagacactcagtgccagtccatgaaagcagccaggagggaggctgtaccctgcaaagccacaggggtgcagctgcccaagaccatgggaaccaacatcttgcatcagcrtgacccagagtcaaaggagatcattttggagctttaaaattttactgccctgcttgatttcagatgtgcattggccctgtaacccctttgttttggtcaatttctcccatgtggaatggctgtatttaccaaatacctgtacccccattttatcttcggaagtaactagcatgcttttgattttacaggctcataggcagaagggacttgccttatctcagatgagactttggactgtggacttttgggttaattctgaaatgagttaagactttggagggaaggcatgattgtggacttttgggttaattctgaaatgagttaagactctgttgggaaggcatgattggttttgaaatgtgaggacatgagatttggaagagccagaggtggaatgatatggtttggctgtgtccmcctgcaaatctcaacttgaattgtatctcccagaattcccatgtgttgtgggagggacacagggtgggtaattgaatcatggggcctgttctttcccatgctattctcatgatagtgaataagtctcatgagatctgatgggtttatcaggggtttctgcttttgcttcttcctctttctctcttgccctcttgccactgccatgtaagaagtgcctccctccatgattcttgggcctccccaaccatgtggaactgtaagtctaattaaacctctttttcttcccagtctgaggtatatctttatcagcagtgtgaaaatggactaatacagtagtcttggcagaagcattgcgtacaggataggaaaacccataccctgagtaagtgtctgttctagtgaggacaaacctctgccctttccatgatggaagaggtccaaaataatcaacctgccatcatgtagctggttgatcacccccaggaatggtgccatatttagggctcagtgttggtctctgctgctggcaaattgggaagtcagcagtggctgtagccaggtcagccttggtgagtggaagtccatgttgctaagcccatgtgtaacctccatccctgccaccatggccactttgttcatgggcccattgagcaatgacaggggtggctggggaaagaggttgagtagtgtccacagaataggtcatcctgtccactccactgctgaggtcacccgctggtgaacactcacatgggatacaaatatcttcacagtytttgaccactcagagaggtccatctacatacctcttccccagatttstttgtcaccaattttccaatcatgcttcttccaagtccctgaccatccaaccaaaccattggctacagcccgtgaatcagtatataattgcayatctggccatttctccttgcttgcaaagtgcacaaccaggtgcactactcgaagtgcccactgggaagatttcccttcactgctgtccttagggatgtcctagaaaggggctgtagtgctgctgcagctgtccacttttgggtggtgcctgcgtattgtgcagacccatctgtgaaccaggcctgagtcttctcttcctctgtcaactgatcatagggagctccccacgagaccattggtgtagactggggaagagacggcagggtggcaggaatgaagaccatgagcatttgagccactttctcatgtaacttacttgtgctttcaggacctgcttgagcccartcacatatataccacttacgtttgatgatggaatgctgctgttcatgacccactttatggttagatgggtcagaaggcacccagttcattataggcagttcaggtgccatggtgactttatgacccatagtcaaacgttcagtttccatcaaagtcctgtaacaggccaagagctgtctctcaaaaggagagcagttatctgcagaagatggcagggccttgctccaatatcctagaggcctgcgctgtgattcacttgccagaggctccaaacagcatccctatctgtgactgacacctcaagcaccattggatctgctgggtcatgtgacccaagtgacagaacagcttgcacagcagcctggacctgttgcagagccttctcctattctggatcccactcaaaactggcagcctttcatatcacttgataaacgggccggagtaacacatccaaatgagaaatgtgttgcctccaaaatccaaataggcccactatgtgttgtgcctctttcttggttgtaaaaggggctaaatgcagcagctgatccttcaccttagaaggaatatcttgacaggccccacascactggacccctagaaattttactgaggtagaagttccctgaattttagtcagatttttttcccatcccctggcatgcaaatgtctcacccataagtctggtgtgtttgctacttcttgctcactggatccagtcagcataatgtcatcaatgtaatggaccagtgtgatatcttgtggaagcgaaaaacgatcaaggtctctccaaataagattatgacacaaagctggagagttgatataaccctgagggaggacagtaaaagtrtattaatggccttgccagctgaagggaaattgcttctggtgggcctaatggacaggaatggaggaaaaggcatttgccaagtcagtggctgcataccaggtaccaggagatgtgttaatttgctcaagcaatgaaaccacatctggtacagaagctgcaattgaagttaccacttggttaagcttacagtaatcccctgttattctccaagatccatctgtcttctgcacagkccaaatgggagagttgaagagggatgtggtgggaatcaccacccctgtgtctttcagtccttgatggtggcactaatctctgcacaccctccagggatgcgatattgtttctgatttactatttttctaggtagagccagctctaatggcttccatttgwcctttcccaccatagtagctctcacyctaccagtcagggagccgatgtgggggttctgccagctgctaagtatgtctatgctaattatgcattctggcactggggaaatgaccacaggattagtctggggaccctctggacccactgtaagtcagacctgacctgaaactccattaattatctgacctccataagtccttactttaacttgaggatcacaatgacgttttgggtcccctggaatcaacgtcatctcagagccaatgaccagtagtccccaaaaatctgatcatatccctttccccaatgcacagttaccccawtgcacagttaccctgataaaaggctggaggtctccttggggaaggatgggagaaagattaacagcataaattgtcagtagtrtagtggggtccttcctcaaggggacccaacctccccttcaatcaaggggttctgggtctgtaaactggctcaagtccggaaattgattgatgggccatgattctctgtttttataattcaaattagtcttttgtccatttgacctagaagttttctgcttatataaattaagtaggaatgcagtaggcttcctataaatttcacttctaggaacactgtgattaataagccaatgccagagctctacataagtcagattattctgattgctgctttgcctctgctgtccattacagtaggtacacccaccttgcctttgatggttgagttggcccctgccacttcaggatccarttattcccattgtatttaaattttatagttgagtgactgtggttcccactgttagatctgacatacagagaagagtgattayagggcccttcaaagatgcaggtgctgccctcacaaatctgttttacaaggcattggtcaagggtatatcttctggacttcccaactaggatgagtaggtctaaagtgactaatccactccaccatcccaatctccctaaccctttggatctcttcctctacgttaaaccaagggagatcaggcattttcagctyrccacagtgggccatgttttaatccatatttcagctaaccaagcaaataaactattagaaccccttttaactccccaggctgcaacattaaatgcagagtccctacttaatgagcccaaatcaataaatttagcctgatccaactctatgttccttccaccattatcccatatccttaatatccattcccatgcctgttatccagatttctgtttatataaattagaaaactcaagcagttcttttctaatgtagtgcaccttctcgtgggtcatactgtcaacctcacatctaagggcccactggggcttcagtctatttataggtctagaagcaaacaggggtgttgggggtggctcctgaggagaatcaacattattttgcctggcaactgcctcaggggaggccatcactgttgcatctcattcttttgcaatcaatgccctgactttaacagtagatacctggagaggctgtgaatgcacctttcactgcaggtcagccactcgcatgataagagcttgtgtctgtttttccacaatttcagctctttgtcttcaggrgataagactgtcactcagggccatcttagcagatttgatgctcagaatctgcttttgaagttgggagttagaatccctgagttcatcattttctttcatcactttgtccactgaacttaggagcaaccaaccgcttcattatgttccttggttccctgcatatggtcaaaggtattatgtacagagtcactaatctccttgcctgtcatgagcagtgaatcaggagtgtcaaatgcatttattttgcataactctctaaacagttcatgccaaggactatcagtgttctccataytattagaagtagagtccttagcatttyggggtctaatcatattaagcagccaactccagaaaccccaaaaccaatgaaagaactccatccttaatattctgttcctctagaaccactcctggtagaaaatctgtattagtgttctctagagggacagaactaataggatatatatatatatcctattacatatccatatatayatatatatatatatatatatatatatatatatatatataatatgagtttattaagtattaactcacatgatcacaagctcccatgagctgaggagcaaggaaacccagtctgagtcccaaaactgaagaacttggagtccgatgtttgagggcaggaagggtccagcgcaggagaaagatgtaggccagtatagtcttttcatgtttttctgtctgctttatattgtagctgcactggcagctgattagatggtgcccaccagattaaacggtgggtctgcctttcccagcccactgactcaaatgttaatctcctttggcaacaccctcacagacacacccaggattaatactttgcatcctgcgatccaatcaagttgacactcagtattaaccatcacacctcccatagttcatgtttttttcttctcagtcttcatcttccacaacttcctgcatccttccaagccttctttactgcacctccatcttctgatagttgttggaaggtgctgttgacctactcaactgctctccttctgtttctgcctcatgggccacattttccttgatttctcttccttcttccacattttagatgttgtcagcttccaagttcctttggcttttgcactctctattttctctatatagatgacttgcagccatctatttttgctcctgtttctctcaccaattgcagccctgcatttccagttgctggatggataccaccacttagatgttcaccagaacctcaaaatagcatatccacttctctcctctctctctcctgctcctcttcctgttaatatgaccacttttttctctgtctttgctcatgctgtttccttttcctgaatgtcctgcctgtgtttttccccaatctcagtgatgcctatccccacatcaaacatcgctgtcctccagatttttccttaaagccctttccttggagctcttatcaaaccgaatctctttcttgcttgttttctacacccgtggcttagactcctaaggcagtgagtccttgagatatttctgagtcatcttctatgccccagtgcacctcactgcgtgtctcacacattctactcagttgatttgattgaatggattaatttaaaaatgcccagcctgctagtcccacagcagtttctggtcagtttctgactatgtgtgttcatggacaaataacctctctgcatctcagcttacttttatgtaaaatggggataataatatctatcttgcagagtttttgtaaagatgaaataagcggctgttagcttgttttgtaaactggaaagtcctaaaaacaaaagtttattttgggggacaatccccaggttgttggaaggccactagagactagacgccctctgctttaacattgaggttttttattgtgtgtgtgagaatctgagggttttttggtgatgtctcaaagtcaaatgtcaggattttgttgttgtttttgagttgtatttataattttgtctttcctttttgacattcaaaaaacatttaatgagcacctgctatgtgtcaaatgatgttagagaaacggagggatgccaagctgagtttagcataatttctacccttgaggggctcttagtttagccatgcagacagacgtggaaacagattgtgatgaggcaatgtggtaggtgctataatagagatacatacagagtgcagttgggacacagggkaggaggcaattaatgtccatgtgtatgtctctatatgtctaagtatcaatgtaaatcattgctcccaggaaacttacgtatgtcaggagtgatcatctccaattacagatgggcacaaagaggatacgtgacttgcccagggttacatcttgagtcagaaatgagtctagaacttgggtactcttgctctaatcgtatttccaatacctttgggatgctacagagtaggagtggaattaggctgagtctttagagtctgttaacttcacagtagccactgaggacttactagctttgtaacaagagacatgtgactgaactctacttctcagcagaggagaacccaaaggccagatttccagtgggttgacttctgcccatgaagaccaagtgccctctaagctctttggtgaacttaccaatcttatttagaagataaaaaaaaaaatgaggaatgtgataactccatgaggccccaagataatatggaggcctgagccacagggtaaatttagattttattgcctttctttctggcttataaggggtggaagagaagcatgagtgactagaatcggcttatattcctccagaaggttgtttcctcattaaaaaaaaaaragagagagagagaaagggagaacaggactggatttggaatcgtaggtgttttcattgatccttcaccctcagattatcttttgtatggtcatttcttttgcaaccaacttacaaagctaattctctttcccattgtacccaatttaaatattagaaaatagaaaagatactaaagatagtaataacttggaaacactcctgtttatctagtaatgtctcttttttctttgtagacaatacgtttttattgaatgcctacttttmcaaagctttaacctatatacaagtagtatgtagtgatatatttatattcctgccttgttccacaaaatttctggggtagcttacaagaaaaacaataagacagcatagtataaaaataaattgaaaaataagaaccagagaaaataaattaaaatagaatgtcaaaactaggaggaagaaaatagaacacatatgcaaaccataatgtcttctagtttctacagttgaactgcaaatttaaccttgaaccaaagtgaaagggggaatatggtcaggggtgtagctcttgctgcctacagcaatatctttctgtacagaaatctttctaaagtctatcacacaatttcctgcttgcttatrtagaacatgtctacatatattctccacataaaggcgtcttatgtagaacatgtctacwtatattctccacataaaggcgtatgacaaattttctggattattcaagatcatcattaagaacataatgattttcatgttctctcaagaattatcaaagcattattaggattgtttgccccacactgctctgatttcttgaattcttgactctggtaacctccctccccgagttttgctatctcagtttyrctttgcagtgtgggagatggaaaaacaagctcattagaattttgggtaaagagagtgtaaaatgcatggcaggaggtctgaaggattctgctgtggaaaagggacatcgcattagaaagtaggttttgtgagatctattttagctgctcatktatttttttcttgtttctgggttttctgttgtgagagctgagataaccagataagaggcctctgataaatgaggtgttactgtcaccaaagtaataaggactccttgcatgcttgcagttgtatgtttttcaaaacaccttaacrctcattatctcatttgatcctttaaactgccagcaaagtagcttcagcagatgttaattaacttcacaacagagagattaactggcatacacacagctagaactttggaaatgggtttagaacttaggtttcttgactctttgtcattgctttttaactaatttaattaggaaatggataaagttattggaaaaagtttcccagaagaggtggaagctgagcccttcccagtataacatccattcactcattcaacacgtatttactgagcacttactatgtgacattcatgttgtggacctggggaatggagtagtgaatccaacagacacaaattcctgcccttaaggggcttactttctagttacggaagacagaaaataaaccaagaagtaaatacaatggataggatgtcgtgtagggataagggtcaggagaaagaatagagcaaataaaggagatgaaaatgaagtgggagtgggaaggtattttaaatagagtagtcggagaaggtsttcctgatgtaatatttgaggaaaacagggagcaagccacatggctgtgagaagacagatacatgcaaggaaagcaaataacacagaagacatggtggtggcaattccagataaccagttagggtcccaataggaacaaatagcacaccccaattagggtaattcaaggtgggcatatgtatagagaaaccatttacaaagggattggcagggagttggggaatgccagggacggcgttgtaacctggaattaacaatagtagagytcttatcatccctagacctgcagaaagatagagaggtcactgcaacgtggaattgggtagaggaggtgaccttgagcaggtgactatttaggcagaaggccaggggtctcaatactgctgatggcagtaggaagccagagagcacagcagcctgttcatgtcagatagaggaccgtagagagtatatctggaaggggaagatggaagataggcacacagctggcaaggctggagaagtgggtgccagttccagctctgggatgaacaagttgtaaaacttcggtcaagccatgttccctgtctgggccagtttctcccctcataaaacaaatggggcctctcagtgctctctaagcttctttctgactctaacatttcccagactctgtgattcaaaggagccacatgatctgtacatatgagccaacgaggcccagggagggractggctttcctgaaagttcacagagakcaggtaccaggggtgtggccaggacttggggttgcgtgatgtccgcaggcctcagagaggttgagaggagacaattgtagtgaaagggaagatggagaataaggagcatccagagcagttggtgaggatggttggaagaagtttgtactcctatagcaattctttgcatgtgattatgggcgacggtggtcaggtgtggttgcatgyaattggcatcagaatcacctggtgtgcttgctaaaaccctggctgtccaggtcccatgccacatttgctgaatcagaatctgcaggggcaaggtccgaagatctgcatatttaataatctacccagtgattcttasgaactctagagtgaacaaaagaaaaagataaaaataaagatagggtgcactgttgtagtcttcatgacctacttacacttgggaatatgaagtgtattgcaaagtactctgcctcctgcctcctggggatttgaccactggggttctgaccccccaaagataaccaagtctatctgtgaagggcctagtttttrtttttctaatattgtatgaacatttggcattcagtcccttttaatgccctagccaccagctaggtctctggaacttcttttcctttccttccttcctctcttccttttttccttcctctttcgtcttccttccttcctctttctttctttgtttcttctctttctttttttctttctctctctttctttcttgcttgtttgcttacccttccttccttcctccctccctctcttccttctttccttccttccttcctctctttctctctctttctttttcttgcttgcttgtttgcttctccttccttccttctttccttctccttccttccttctgtccttctccttccttccttctttccttcctcccttccttccttccttttttcctttctttctttctttttctttctttcacttgcctgccttccctccctcccctcctcccttccctcttgcctccctccctcccttccttcttcttcttttctttctctttctttctttctcttgcctgccttccctccctctcttcctcccttcctccttcccttccttccttcctctttccttccaccttccttcctttttcttcttcctctttctttctctttctttttttctttttctttctttctttcttcgcttgcctgcctgccctccctccctcccttcctccttccctccctccctttcttccttccttccttccttcctcccccttccttcctttcttcctttcttcctttctctctttcttttgcttgcctgcctgccctccctccctccttccttccttcccttctttctttctttctttttctttctctctccttcctccttccttcctccctccttccctccctccctcccttccttccttcctcttctttctttcccctgccctgtgtttccctcccttctccttccctcctttcccctctcttccccttccccttcccccttcccttccctttccttcccttttcttccctcccttccccttctctttcctgctctgccctgcctcccctccactcccctgccctgccctgcactattttccctgcccttccctggcctcgcctcccctcccctcccatcccttcctctcccctcttctcccctcccctcccttacccttcccttccctttctctcttttggggggtggtgtttaaaattagtataaaatggcaaagcaggaggagttgaccttgaaaargtatggttggactaatgatcaaactttttagaattctttcataacctcaagagaaacaactcaacctttccctcttattttctctcttatttacccctggaagtgggagattatggattaatgcccatcacattcagagactgaaaatatttgtgagtttgggtactgcattgtggtggaagtgtgggagtgatcatgatgcctccttaatcaatatcatctttcctaaggtcaattgtcagggccctgggagttgactttactattgaataactttttagtgcactttgccatggaaagaaactcaagcctcattgaccatatcagaggagggtaaacacctttcttgctccttcatatgaaagttattgttgcttttttatggacagaaaattacaggttgatggaactatattttcgtggacattttggtgtcagagtctttaaacaaaatgtattctttgggaacctcccctccccaatcaggagacgatgtcttaattattttgaccaaagccagaccatgttgtgtgttgtaaacatctggtttatcattcatccagctgaactggtttacattttcttagaagaaaaggcttgggattaaaggcatttaagtaattaagcacacgtcaagacaatttggtgatgggtaaatatagtctctgttaaatgcaccgtctgggagttctggtttagatttacgtccggctggagtgcagggatgaaagcacaatgccgggtggactgggcccttttctggggagaatcaaaaccaaatggattttcaggagtatggcaccattcctctaagtacctgtcccaatggataaaagtttcctttgagtttggcctggagggaatggcactgcagtccctgtcacccagcagcacttgtagatttaatgagactctttgggaggtagaccataaacttctgtgctttggttgttcctttgtgtccaggaaaccagatatgtctatgaagcttaatgctaggtctcaggctttgtatgacaagtatgtgttttyaggtaccaatgctggggcctaagccttccctggtcatgtttcttggccctgcccctgtggatgtgggacagtgttgctaggcctggttgtgtcaggctgcacagatgtgtggtccatgctgggcagggaggaaacatgagycttttcctttggaggtttttagttctaagcactaggcatgaagtacctggtgatttgaaggagacatgggcacgttgacttcgaggatcagtaaggggctcctcaggggctatactttgagctgagacgttgttcctgttaagggagacagggaaaggaaaatgtcctcagcactttcttcttctcactgtctcccatcctgaaagtaacaggacaaaaggttgggtctctctgtctctccctgggtcgagagctgagaggaaagaatatagatgcaatcctgaagaagaaagctttgccattatggccagatggatggcrcatgatggaaccaattagcccattttttgctgaaaaraaagaaaaaaatcagaatttcaattttcaaagcagggactcttttttaaaaacgtttgattattttcttcttgttttaaactgatttccatgcttgtttgggggtagaatcttggtttctgaagtctgggtgaacggggaggccaaagcaaatmyctgttgttgggtaaagttgtggatggatgcttacttttcaacatgcctctcctgccccattcctcctcctctaatgtactttctcctcccttcccttatcagccactgattgggatcacccataggataccacctgaaaagtagggagtacacagctagagggaacagagaaacatccagttgcggcattttgggggctctggttatctgagtcaggacaactctggttttataacttgaatctttgctccaaagcaaaggaccttttaccttgactttctgtcttaggaggcagaacaatcagctggagtgtaaaagtttcttcatgagcatagaatgctcaacaaagcagtgaggaaggcgatgaacaagaggagtactgagataactgcagccgtagggccggtgactgttagggctgccatctcttctgtgtttccagctgtgagctaagtgcggtgagacrcacaggtgagaggagtgctctctgacgcaggtcaggcctctggggaacacaaaacaatgagcaaaccttgtcctggaagtgaagcaagctgcccacttccagctgcaccgtgcwcaggaagctttatttaagatgggggatagggcgcatggctttaatgtcccaataatttgaggcatttctgaggatctggcagctgggaccaggagttcaggttgtcggtctaatggtctgatgcttccagacactcggctaccgtgcaaagtccagctgagaattagcagatgagctaagtcggtgaaaacaactgctggacttttccacagagttttgggactgtcttaakggtatatacagctgccacrgcaactgtggggtgtgactgtatggattgggttgggtaggttctggggtgcggtctagctggggccytacccgcctgtgatgcttcaacctctatccatgcctacagcactttgtagctttagcttttaactacaaactcccacaaactcccctcccggcttgggactcctccctttgattatggtagggtggcttcacattgctgtggttatggctcttgaactgagtaatgatgctcagagtgaaattgtagtcttgtgagtcagacaaatctgcagcttagcgaacctccaggcacccttcccccatctgcactccctctccccaccctctgctcctctcaccccacaaagttatttctcatgttttatgtgcatgccaaggaagaaacttaaaatcaggaaaggactggccctttggtgacgcagcagtaccaaaacacttagctttcaactcattggaagagcagccacttctactgggcacacctggcagcctgccgcgggcctctgctcccacgtggggcctggagaatagtctttgtgccatccaatgtcctggaactgtggcaaatgggggcgaggtttgaggaagaggaggctgatggaggggagaggattgtctgagatcctctgcgggtctctgagcatgtgggtggggcattgggtaagagcgggaggtgggaagccatgaattttaatgagtaaatgttgtctagatttgttatccaacctcggcgtttattcagagccatgcaaatgcagatttcttagcatttggacatcatacatctttccctccaaaaccaattatctcctcatctcactacagtctacagtctctttggaaagaatggttcagggcagaaagtaagtgcgagacaagggaaatcattgtgtaccagaaattccccctctcctccccctccatgattaaatgtggatcctcgtatggcgggatccttggtactacgagttggtgagacataatccctcccatctggaagccagcgacctaggacagaccatcccgactcagacagaacacacagaccactttatagtctctgaaaaaaaccaagaatgaaacaagtaaataacgacgactttatgctgcgcagaaggttctctgttgtgagtataatggagttggagggacagagccatttgttcatttcacatttgtttagtagggtctgctatgtgcaagtggtgtgagacactgttggaattaaaacataaatcccttgtatagttttcaaactttttggtctcagggtaacttcacacttttaaaaattattgggaacacccaaagggtgtttgcatgactatgtcgaccaatgtttactgcatgagaagttaaggytgagaaattgtgaaagtgcaagaatacacaaacacacatgccattagccataggkgatgatgtcagcatgtgccacaacaccccactatgtacttgtgaaggaagagtgagaaagcagttagaaaccgttagtgctgttagaaaaatagttttcctccagggaccccygaaagcctcatgaggactcccagggctccccagaccacattttgagaaccactgccctgttgcttcctgcccacctcagggatattatggtccaggcggcagatcagtcacagcgaacgctgccttgtgaaacagcaggaaggagctcaaagtgcagtcggatgctctcatacacttttatagatcatgattaaaatgatccatataaccattcctatgcggtcatggagcacagagattctcacctgatggtggtggaaggttattggaatggaatgactggaatctttgaagacaggaggaatgtgaactttgagacagcatatttgatattaaaacataattttgtatttagagaatgaaacaatattgttcttatactaagaaccagagcttgacaaaaagttctagcctggatgatatagaggaggatgcagtgattctcaactgggggggcatgtgaaagcttatttatcaaaaaacaggggttaagttgagaaacgcttgccccagagttactattttcatctccctttcttccgtaggtattaactctctgatcgcaaacaatatctatgaggctgcctaccctcttcatgacgtaagtactattttcatcagcgtgctctctgtagtcttcaaaactttgaaaaccacaacttttcagtggcagtgagatgggtgaatacctgcagggtgaggcaggagtgaatcatgacattaaaatacyttgactgaccctggaccactcattgctgacaataatccccagtttgatttttgccaatcatctcaaactgtctcggcaatgatttccccagatgacacaataaactgggctttgtttgagcttttcttgtactccctagctttatttttagcaaaagtgtaactatacagatgtggcatgaggtgattaaagggaggagatattgatgagggtggtggatggtggtggaaggagactgaaaggcgtgagtaatccctaacctggactgtcagacgtctccttagctgcctgaaagtgatattttgtatgggagagttttgtgcagatgtgaaattcctccttaacatgcaggtacatattaacgaaagatcattattttaaaaaaaattttttttgaagaaaatctctcagaattccttgtacaatgctttggttaagtaargaaaacagaatgactgtaatgaaatctctccttgactggagataatgttacgaacataccatgatacaatgcaatggtattcttcaagacagtttacgagaatgtaactggtccttgagctaaatgctccatggcttcactattcatcagactggtcaggtcttgggcacgtgccatgcggtagtgccatttgagactgctgaggtggggctccctgactgccagcaggaatttttcggatggcagtcttctaattcctgacatatttgcagtggcatatgcactgctaagttctgcagttacggacagagtgagcatgtcatggcacaggtgcttttcacgtgatgggctaaaccatttaaagtctggagctctgccattgcattgctacgagggggcacaggctgatctctgaagtggatgagggggcacatcttcatgtgagaagttatcccaggaaatgtggcaagtgttgatggctcagaaaatggaatatcagccccttaccatgccatgcttttgaccttccttaaatgggaatgaaaaaaaagcaatgatattagaaaataaaaaagaaaatcctttctcctttggcacctgcttctggtaatttcattggctttatccagcatcactttttctccacagggtgaatacgatagtccagaggacgatatgaatgacaggaaggtaagcctgcctcgtgcagcatcctggactttgggcatgcgagactacgggtgggtgtggaagtggctagaagtgtcttagatgttctctttacctgcttatctactttccaacaattttaccagctcccccctttcccccacccaggtatttggaaatgtgagggtggttgctactgtatttagtgcctggagagccacaatgccaactgttctgaaatatatccaatggccctccacacacagccctcaccccaccctcccatggcaagagagcaccagttgagaaacattggctgtccaaattccttaactgatatatgcagaaatggaggcacagaaacttgagcaccttggcctagatcacacagmcacaggaaacagagatggggctcggaacacctctagccctcaaatccagggctcttgcttaaaacatgtgatgatccatgccattatagcttttggagggtcaactttaggtgattcttctttccttttaggcaggcaggtggagtatagccactcccaaattatagatgagcaatctgagtgtgagggaggctcagttgtgctttgtagttcaagaaactaggaattggaggttacagttaggggaaggaaaatggccccacctcttcagtggggatgcaccgatgatccccttatgccatcctcctgctggcttctccccaccttcaacaactctagtgagcagaggagggtgggcgatggtgggagggttgaggagctgaagctcaagcaacttccctcccccactctgttgtctggaaaatcattcatgccccaagttgccttttgagcaggcttctttttatcctgcctattagtccctgttatgaagtgttaagtattaaaaacataaaaggtcttttccagaaatactgtggtgattgcttacacatgtcccctctctgcctgcccagggaatctgctgtagtattgcgatgtcttaacctcatctgttttctatccgatgctaatagtctcggtgtttaatttcctgaaaagtccygcatcagatttaaaggaaaaggaggaagcatgtctcaccacatctcacctctctcgcccaaccattttctgtcctcccactctctaatttttccttccttccctttaaatggtgatcaccatccattgcctgtgtaagaaaacaggtggtgaccccagcctgtctaggatcattacggagaccaggaacacacagcaagtcataggagagatcagtcagccttctgttacctgcactaatggaagaagtaaattgtggactatttacaatatatatgttgtagatataaaaatatgtatttgtctttggaaagatacgaaattactgttaaccacagcaatgccttttaacaaaaaattttcccatcagaaaatgtttctctttggctgatrtaatgaagtcagggtccactccacctggtagaataggtgggaactaggaggcagggagagcccagccaggatggaattgcatctccatggataactcccaaagttgatgtcagaaagatgcttcgtgaaggtgaacaagtctttgaaggacaagatgaccctttcttgtggcctttccttgggcttgctggccagtcttggtgatacctagccaggagagaagactggttttaatgtccctgaatgttcgtgaagtcaggactaaaaccttagtgtccaaatcccagctagtgctgtgtggtcatgttgacacagcttcttctgttaagcaagagagattctcacggcagggctagatttgtttctgtagttttagtggtatgtgggtggtgcctacaacatatcctgaaggagaaagagcaaaaacgcccaagtgtgtgctgcatatttatttgttttcattatattataactgtcaagtgttcttcgaggtggttgcaggaagcattttgcttaggtgcaaggaaggacccctgcatttggagctgaaggacatggagaaggcttgggagccgcagtgtagggtggcctctctggggcctgtagggattatttgccatggtrtcccaacctgcccatcctgccagcacctggatgttctccttcactcttccttaccatctgtggctgttcccatgttctccccaaggcccaggctcattgcaggcagattctaggcaagccaagaggcgctagagaatgtcagtctccctctcctgaagctcacctggtgctattgtgcagcttscgtgactcagccccaggtaggggctggaagtctctttctttcccctcctggagggtcgttaagaagaggcttcctccgtcttgagaacaaggaattcctgccttcctagaagccaggacaaccggaagagggagcagcgtgggggtagatgggtccctcctggcttccagyagctgcctagttccccatttgccaaagctgcctagtgtcctggaaattcccagagaagtggctgtcaccatctgctcagggctgcccggctcccactggctctctgtggcttcttcacccacttacaggggagaacccaaagtagaactttggatgtgacttcctttagcattctggaaacccttagtcctggattttccagcctttgcaggtggrtgtcttccctagtggatagttagtaagtgacccactgaaaactgtggagagagtcactcctgcattttaagacttgccttcctcacaagaaaggcacttttcttcttggttccaactgaggattcattttgccgtgctgcaygactttcatgttactgtgtggagacgctgagacctagagaggtggggttactggctaaaatgttcgaataggtcagtgtggcatctgggagcagaagctaagtctcttccattcaggatgccccgtcccttgaatgcctccaaggtggctatagcatctttctgcctgtctcaggtctagctgctctctgaggagcttgtggcctcagagagggtcatgagtcccacacaccttcatgttatctggcattgcaaagggttgttgcaaagggtttttaacacttgagttccttcatagtctcgtgaaattcttaaattgatgacctctgtcaaatgtgatccctggggagccaaacttgctgcttctatctctgatccatcaggtgggatggttcctgctgtaaaggcttggggcagacagacacatctgggattacatccagggctctggaatcaggcactgtccattaagaaggagcagtagtctctccctggtttatttgctagctttgccagttggtgaagagaggacatggtgaacctgtaagggagaaagtggattcactaagagctgcattagaaggctctagactctgcaagtttaaagggattgttacgtgyctgtgctttactcacaccatgctggtccatatggggcaggactccagagtgtgcctcccttcaccctgagtgctggtcccttctgggaccctgcaagctggagttcagcatgatccacttgctcttaactatgtgtgactaaaccttcttaaagattgggaagggtctacagcactctccacctccctccctgcctcccctgcaggtgacagaaggcgtgtgagctggcctgggcatccaggcgtaattgctgcaccgcctcccagctttggtgctctgtagctccagctgtctgtttcaggggctgcctgatcacggcctcctctgtatgcttctagcttttctgtatcaagcccagatagttctcttrgctcctcctcatctatatccacaagctgtggatacatctttgtgcttagaagagaccatggtgagagagggactttctggaagtctctttcagcagatctgggattcaaccagggaaaaggcttctgaggtcagctctccgttgaggccatacagggttcctgggacatttttcgtttttgccttcagggcagtggcagataggtgttctcaagctcaggttttgcctggacatatgacttggggaggartttgctctggaggtcagagcctatgaggcagacagtgacgtcccatagctctcgagggggtgccctgcctgcatctcctgacgcaagcatatctccctttgggcaacaaatgatgtcactatgacaaccaggtgttggagagcccagggtttgcactcaggggagggagtaaaaactcaggcagtagaagcacccaagatgtgggaggaggagatgtactaataagaataagattaggttagccactgccctggagtgagcaggagcagtgctcatgaattcagatgttcctctgccttcatgcactgagtgaccccttttgtatctgggtttcctccattgcgagtggtggtaaatgctggtacagtttgccctttcagggcctgtgtagtttctgctcctgttttgcagttgctggaagacattgtgacaataaaagtctatcacctttaagcaagaacgctggttctcatttccattttaatatcatgtctttaaagattcttaggtaaacaggatggctctctgtagggctgatgttcagatgggcttccgaagtacctgattaaagtaggttctccttgacagatttcctcgtgaaatgtgtgtgatgtggtaggagaataaataatgtaacaaaatagcagctgtattataaatctgtcaattctagacatataatctaataaaatgccgatattgattcagcatggatacctagatgaggtctaatgatgaccctttactgaatgattttatttactgggattgatacacaggtttagtgagacacgtgttagtcctgctaaagttgctgcagaaatattccaagatggcctggcctgatgtgtttggttttgcccctacccctctcctggagccactcttgtcaaggtgatcagtgacctcaaagccactgagtccagtggtcactgctcatctgacctgacccattagcaacatttgacacagcttgtcatcttcttttgtttgaaatcctttcttcccttagcttcctggatgccacacacttctggttctcctccacatcactgggcctctccttctctctcctttactcattcttcatcaccctcttgacctctaaatggtggcgtgcccagggcccagacctcaggcatcttctatacttactatctcttctttggcaataacatccatcatttaatgactttacaaattgcctcctcttcaataactctcgaatgtactggactcttctttgaacttcagattttcatatctagctgctcaccatgcccctggatacccaaagagcatctcaaaaaatgcatccccaagtgagctcttaatttcacccccactaacctgtccttcccacatttcagtaaaaggcatcaccatgactcagtggctcaggccaagttcttatttattctcatcccacatccaatccagcagtaaatcttacaggctttacctttaaaatctaagcagaatcaactagttcttactgtatctgctgctgcccccatggtgcaagccatcatcatctcttccctggaccattccagtaacttccctatgcctctgatcactctcagtctgttctccacacagcagccagagtgagccttctgcaatctcagtcagattgtttcgccctctactgcaaatctcccagtggcttccttcaaaacccaaatttcatccagtgttgatacaaagattttagcatgacctgcaaatccccaagagatctggccatcctggttctttctgactttgtctcccacgttctccccgtgctcactctgccccagccacactggttccctgttcttcctaggatgtgccatatgcacttgccttggggcatttgcacaagaagactgtcctgcctgggacaccctccccccttcctttgtgtctcagctcaatgtcacctcctcagagaggccttccctggccatcctgtctacaacagcaccctactcctctcccttccttcacattctactccctgaccttgattaatttttcttcattaagatttcaaaatcttatctgtttatatgtttatgtttatctctccacaccagggtgtaagcagactgtggcttactgctgtatccagtgtggggacagtgcctggcacataaggagatgtcaataaatacttgttaaatgagtgaatcatgaacattagggctcattttgctggactaggcaagacgtgggaataaagaagacggggttctgctaatcaggtgyaggactgcctcagagtgtgataaagttcatctctgttgtttgaggaaggagaagccagtttccatagcctcccgattctgaacatctccccctggatgtctcatgagaatttcttagaagctggactttggggataaaaatctgacttgttaggatggacaaaatcaggtgaagtttcccatctctacctctaacctgtttccttattttctttgtttagctgctatatcaagaatgggcgcgctatggagtgttctataagttccaacctattgacctcatcaggtaagaggtggtagggaacttttggaagtatcctggagatgcaagtcctgaaagatgtatcataaaccttttgactctgacagtcctttgctcaagtggagggatcttcttttctagcttctrtgatccactcctctgtgtctcatgggtggggaagcagctggggacatgggagggacatggaggctgcgtggggcaaaagatactgtagattgatagaccatgacctgcaccttgaggtcttcaacattggtctctttccctgcctgttctctgggaggggtgcatggagctgtctcatttcttttccttagtcttgtcctagagaagaacctggatgaagctgattgttgggttatgcccaagtgccagtgttgatccaggaaagggtggatttagcaaatcacatgaggaatatgctggttggcctgacagaatgtggactttttatggcttttccaaattagaarggaggagagactaggccctgggtttcctcccttctgtgttgtcacagaatgatgtcctgttttctggcaccttggacatttccccagcttctgttgaacattagtgaaaagtccttggaaataacttactggaatgtcataggtctgactagtttaaaatggcttcagggctctagaaactcaatcttctggctggaatgttgggcggcagcactgtgtgacagcactgggctgagagtctrgagacgtgagttctggtctgggcctggccactaagtgctaccatttctttgggcaagccccaattcctctttgatcttcagggtcctggttgtcctaacttgggaggctgagctgagggatctgtgagttcacatggtagaatgtgctcatttggaaaagatgggccgctggagcctgcaggaggaggctgctccatggtggacatggtggactcactgccctgaagtcacctaatgagctaattcatcagcctgagaatagagcgtgttcctggctggttgccctgggctgggattgtgagaggggcagcggccaggagaatcgagtctagagggaggaattccagcttctgcttggaaagagaaagccgcgtggaggccagagtttgggcagctcacctcctacacagagatgcagcggccctcccagcggacagagcttggttggatgtctcttggaagcaggtgtttgttccagctgaggaccgtgaaccaaggtcttgggtgggggagcagggacatgcggggcctgtgaccaggtgccttcaccctgtctcccgtcccctggctgcctttcatgtggcatgggccacctagactgttctctgggccaccccaaggctgatcattccattcttggtgggctttgatctttctctctggatctcaagtggccacccactctgtcgcctgttttctccaactactcatttgtttttgttttttttaagtacgattaaaaaataaaaattctccctaccagagagccctatcttttcccgcagagacttcaggtgactcgctgccagctaagtggcaaatggctccaatatgcactcggttttggccaccaaagcagcctcacctgcaggggaagtattgcctttggagcggagccctgctctggggcctggcggttcctgaggatggagagctcaaatctgtctagacagggcacggtgtactggagcagggccggaggctgtctacagctcctcacagatcagatggcctggaacactcccacggtccctgggcaaagccaagtcttggtcaggagggagaggaggaaggagcctcaggagaaygggacgctgggcagcatgtgtgtggggagccraggcagatggtgatggtggttgtcatcccagtggcataaggaactctctgacctcaagaaactgctggaaagagaagtgatggaagggctggtggtggggagcactagrgtcagaagtgggcgagtacctggagaacttgtagagagaaatgtgggctggagcatgcagggagcagctacttagactcagtgagcacaccaaactcctcattttacactcttttaccaaatggtcccaacttgctttccctgattctgtccaagtcctctccttcctcttcttcatcatgacacaacccgagacctcagtaatccctgactggcgtcactttcacttcccactccccaatctaactgtgagtcttggggattcttcttcagcaccatttctctcttttgccacttcctctccatcattcctcccacctcctgtcggggcccacctgcctgcagagtccagcctgtggttcccttcctgagccatcacaggccccacaccatgacagttttgctccatgactacttactaccatgcatggcaccctccgkgtgcctcgcggagaagttgccctcatatggtctgtgytggaagagtgacggagcaggggaatctggcacaggcggaaygtgataattcatgcacaggcctggccaaggtctttcccacccgtttctttgggtwttcagctcctcatttttagygccaagcttctgttcctcctctggagccctagtgctcctcctctgtgccaattgtttggaagattctaaaacctctgtgtgagccattgagagctcatggggcaggagacctgtttgtatgtggaaggccccggaactagctctccttccccttccgcaggccttcaggcctcattttgagtcttggggtttgagacaccgttcctggatgttgaaagtccacagaggggaggcaagacacccttccctgcacccctggcccctgcctccacccrgctgcagtgtcgttcgtgcccagcaggctgcactgtgagactgctgatggcctccagccccrcacggctctcctcccgatcctgcctctgctctggagacctggggcctgcaggcctgagtgtgtgtgtgagcctgtatgagagtgtttgtgtgtgttagtgtgtgtgagtgtgagaatgtgttcgtgtgagagtgtgtctctgtgtgttgtgagtttgtgtgtgtgtatgtgcaagagtgggtgtgtgtgtgagtgcatgtgtgtgagtgtaagagtatgagagtgtgtgtgtgtgccagagaatatgtgtgtttgggagagtgtatatgtgagggtgtgtgtgagagtgtgagcgtgcatgagtgtgtgagtgtgagcagggagtgtatgtgtatgagcgtgtgaatgagtgtgtgtgcatgcgtgtgtcggtgtgagtgtatgtgtgtgagtgggtatgagtgtgttcatgtgtgtcagtgtgagagtgtgagtgtatgtgagagagtgtgtgcatgagtgtgtatgaatgagcgattgtgtgactgtgtgtgtgtgagtgtgtgtgtgagagctctctggaaagttccctagagaggtatccagcaggaacctcgatgagtgagtgcaccccaatccagaagacctcctgggcacttccagccagcagcacttgtgccttgtcagaaacatggcttgtggctgataatatgaggaatgactcctaagctagagtgaaatgactcttctagtcctttagggagctggaagagggtcctcacagctggagaaggacatttctgcctgcacttctctggttcaatgctctaaaacccaggaggaaaacagcccttattttctgggaaaacttggggactggaggccttttcgatttgtacaggtctgacccaatactagtcagggccrtaatctgtctttttactaaagttaatatctgctcccaggctgattttcttagcttggacgttttgatatgaatgagacaaaacaataggtcttaagcatcttctgagtttgatttctcttctgactatactctgctgaaactaatgtacaaaaagtttattctaaagcagctgccactgcctgcctgtgacagcatgggaaagagagggttctagaactgtactcagctcagagggattgcagcctgttgacttgtgggagttcaccaaggggataatggatggggagcttcactgtaccaaaccaggcctgcagtctgaagaggggtaatggtccctactcactcccacctgttcctggggtgctcacttcatgagtgaggcttcctgcacttaaagtcaggccctgggcatgaagcccacccatgtggaagctctggagttctcttagaaatgtgccagcttagagccttgagatatggaacagcttccaygaggatctgagagtgatctctatggggttaccatttcaagagcccttgggtggcactgtgccccaacgttgctacacatctctaccagccctctctagcctgacatgccacgaatgggatctccctcctactgcaargcacaggtcaccrtccttgccagggttccccagcactgccaccagagactgtgtggtttgatccatccctccttgtctctgggctctgcttccaccctcctgaactgtgagccatctgagcacccccggagggagaccgaggaagccatgttcttaggaggcttctcagcaggccaggctggggaaggactggccaggccacagctgggttagaggaggaactggagagagaaaaacgttgatcaatctgtgattacttatttccttagccctgctgctttctccttgatttttctttgggattgagaaaggcarttcagctcgacacaatacacattcactgatgcttacagtgagcaagtctctttgcttggcagtatggggaggcacaacaacgatgaagggagagcttatggcctttaagatctaggagttatgtagggagacaaatgtgtgcaagaccggatatagcgagggctctcaggactataataatgttcaaacctatcagtatgggatcacatttgaagagtaattgctgctagaggaataagacaagacttcctggaagaggtggcccttgaatcagaaatgttgctttctgaaggacgactgaggtgaaagagtgtgtctttgtaaccagcctggactgccctgtataaggatttatagtttagcctgatactaatgactgaaaatcacattgactcaaagccagatctttcctcactgttgactgggagtggtgagatcaagaacttggcttgcagaccttgtctgtaaggattccctgccaacctggcccaagtcccttgctctgccccacgaattagcaggcaatccagggttggaaggaaatgaggctggatgcatgaagggaagctaaggagagatgacaygtgggatcagcaccatggcatttgcacgggtcttatcatttgatggttgggtttagctggaaaacattttgcagcctggaaggaaataatacctcataggcctgaagtctattcttcctttacctctgagggtgtgagagaagggtagacagagaaaagcagcaacagctggttgaggtgaggcagaaacaaggatgattatgttccatgccattacattctggtccattttatagatcaggatataagtcatgctgttaatcccatcatgctgtggaaaggctctgccccagtctcctttctctcatttcctccatggagtgccactctcctccagttgtaccctttcggagggaaggctgttggtcttgtggttgaccaatggaaacaggagttggagtacaatgctaccagctccagttcaaaatgctaccagctccagttcaaggtagcagctaatgactgtgttggtcttctgagggtggcctcctagcctcacaacagccttccagagatggtggctcctgttttaaacttttcatcctccttcctgtcttatcagccacatggtatggatggtggatcccaaggcaccaagaggctccacaagttccccatggccacctggaattccagggcagagctggggaaggaaggagctgtctggcatcagctcattgcctccttgatcagcttatgtcatgccccagggaggaaaagctgatattagtctgaaaaatatgacaagctatatgtttgtgctgtcttggccctgttgtacaataagctttcaattatccagaacctctaggaacaaaccatagcctcacagaggcaaatgaagcttagaggccagacagttggatagctgtccctggaaggaaggaatgaagaatttttcttgcggcatattcatctagcaaatgcccagcctctgcttgatttttcttggaatagggagcaccttatctctgggacagtttgtttctgtcttgggcatatctagcccataggaagtcatgaaactagaaggaaaactgctgatttcccttattttggtcttagttctgcttcctggagctgcacagaacaagtataccctgttgtataggtcaaccctttaaatatttgaaaayaacaattgtgtcaacaacagtgctcatatacctaagctttctttcccacaccccaaatactcctaggmctttctgcgtttccatatcaacgtgtgttccccacacagccttatcatcgtgattgtccttcttgggactcactggtggggtaacttggaagaggaggagccttacatacacctcactgaagcagttaagccaccacatattttgcattatccagacactggtcctggggatacggagatgatgtaagcatgaccccactctcaaggagcttgagttcaaagtggaatctccatgcttgcagatgaccactgggttttctgggaaataaagggacaggctgatggagaaaatttatagaaagtagctgtgaggctgtaggaaaacaacatatggaaaagatcacgagggaaaattggccttcgactagccatttgtgatgggctcagaggtatcagctatgcatcaggcagagatctttggggatgattgtaactctttctagaaacatcagtgtgatgtgatgcagcaccacagacccctcgaattctcagaatacattttaaaaccaagctaggattgcatcactcagtgatttacygaatcatggtaaaacctcacatgtggctgacttaggtcatcacacctaaagaaaacataaccaggctggaactgtttcacagaaggaaaagtaatgtgatcaaggatttggagaggcgtctttataaagtcggacttaaacaaggaagagttccctattctcagaacaaaatggagaaggagtgaggctgacagtcaaaagatgggtaatgtgcctgtgtatgtgttcatcagaccctgacgcacctgcccggggacattcctttagaccaggagcagtgagttaagagtgaaaagaactcagttttacctccagatttgtttccagttgatgtaatatttgggcaagtcattctctcttgagcctcagttttctcagctatgaaataggggtgatagcacctgtgctacctgcccacagtattactgggaggattcagatgaagagctgtgcaaatactgtgatgatggctgtaggtctaaataaatacaaataaatgtatttatacatttatttatattacaataattatttctattacaatataatacaaataaaataaatggctgtagttaaataaatacgaatttattgactccctgtgggggaaattataacattcattaaagtggtggaatttcatatggttccttagcttaagagctttgacaaatatagtataatcatattgtattactgtaaatcaatccactgtatgcattttctgtctgtgacctctgtgcctcacagcaaccctgtgaagtgggtattcttatcttcatttcacaggcaaggagactgagttcagtgaagtaaaggcttcccagagccacagagcaagctcatctggaattcaaacccaggcctgtctaactctagaaacttttatttttttcacagtactctgtagctgaaggtgccmcagagttccattcagtggatgtcaggctagctggggttccagccctctagtgttaatcccttcaattacccatctcccagggaaaaccatggtgtggtcttctggtacrggctgcatgctgaccatagtcgaccttggcttatgatggggccatctttatgaacatccctctttgtgcctagcaggagtaaaatatcactctcagggcctctgttcagcaaccccagaatgccatgtttttgatttttcatttctattttttatgatcttttttttttctgagtccttccatgttgtcagattgtcagctgtcacttcttgcttttgtcaactgagtagcttctgttcccaattctaatttactgctttgtctcagttgcagcttcggcaaccagacacccaagcaagttagcactgtgtgcaaagtaagacgcttccacggttcatcctggagtctggtttctgttgggtgggggagcttgtagagggcctgcttttgtgctggaagtgactgtttttgcttcccagtgagagtgaaatgatgttactgaagttcaaggggcctcagcgatgggactagagtgaggatgctacagcagggggccctcactatgaaaagctgtattttggccctccttgcttgtttggggacgtcatgaaaaatccaccctatcagatattttccttaaaaatagagctctgagtctgttaacagcgcaagagtcagtccctgcatcaggatctgctgaatgcagagctttgtactggrtgtggtgttgaagcctcaaagaagggggaaaatgggagcttgaagggtactgatgggacacaaggtcctcacaaaagaaaacttcttgggtcggtcacagagctatcaagtagcttccagcaggtaactaatgcacaaagctttgtgtggcagtgctgggcaaggtagggagaggcttcgaagggcttagtaactggcttcagggtagcagattacacaaaaatgagacttacgacatagatgagttttaagcaggaagcagagatttgaaggagagaagaaatatagttgggggatttacaagattgggatttaagcattcttggtcaggaaatgttgagagaagagacttgagaaggggctaaggcagatgartggcttgagaagaaagcaccggggctgagctagacaagggacatgatggtgggggaaaytcaggagaggatctcaggtggtttctctggaatttaggcaggtggaaaaacctaggcagagggctaaaggaagggtttcaggtctcgtattcccagctgggcaggtaagagtgggcacaaggagtttcagttcttctctcatctctcctggggagtctctgggaaggtcattcagcccctgcagatctgttgaagtttctctccctatagttgcatctcttctacaaaatctctaggctgcatgatggcaggtgcagttctgtctgtgggaatcaagatctcaggtagacctgagggactgatcttgccttagaaggagcaaggggactggcgtcctgtgagttaccagggacacggctcaactgtttgatcccgggagccactgtttgaccacrtgtccctggaacccctgagcacctcagtcctcctaataatattccctggagtgatgttctccacccacaccacatggctatgtaaccaacataaacagaaaacgtcttaacacactgaataacatcagcagaacacacgttacaacaacaaccgcaagatagctaaatttaattagcccggcatgcccaggctttttgtacaggcacatgcctctgttttagaaatggaaaaccacagcattctgtgggtctggaagtcacacacataagaaaggaaaaaaaatacacaaaccttcaagatccctgcctgggagactgctgtcttctagtacctacttgggattatctcaaggtattcaaagatgttgacagttgggtggctgccaggaattactgcctgcctctggcaaattggttggctcagccgtgaagagacyggggagctcagccttagtcactcagcctgcggcagggactcgggaaaccctcagagatgtaggctcatccttactggtttctttcatagagtccacattcaactgaacctagtcaagagagacagagaggggattggagaactgggatttttaacttttcatttgagcattttagtctggatgagggcaatggtatgatttycagctgtcatcaactctaacaaaatggcagcaattccttaggctgacattctgcccagtcctcagccctggggcaggaaggcaagctgcatggcagagagaagcgaatcagccatgtactaagggtgtccctgccctactcagaggcactgcatctcctgaaagcccaagctggtgcctcgmgtagatctctcttactgtgcttctatccctctccttttgttcatcctgcggtgatctcttctttgtccagtcccgtgagatcacatcccttttagaaaaactagctcttttgacttctgtggattaagaaggttasgtctcggatgctctgacagccggctagcagcatcaggatcatctctatggggatgatgcgaaagaaaaagaaggcagagcccccagactcagacctctcagcatccaggtgggacaaagacttgatgttttaggaaagagatttaagaaatatgtaattcaggctgggcatggtggctcacgcctgtaatcccagcactttgagaggccgaggtgggcggatcacctgaggtcaggagtttgagaccagcctggccaacatggtgaaaccctgtctctactaaaactacaaaaattagctgggtgtggtggcgggtgcctgtaatcccagctactcaggaagctgaggcaagagagttgctcgaaccctggaggcagaggttgcagtgagccgagatcgcaccactgcactccagcctgggtgacrgttagactccgtctccaaaaacaaaaacaaaaacaaaagacaaacatataattcagttcaacttaatccagtctattcatcgagcaccttctctgtgccaggtactgtattaggtgctggagttaaagtgatgaacgagatagatatggactgatggtgggcagttagataatttatcatcctactggggacactttttctagtgaaagtgagagctattaataatgatgttgtgtgtactagttaactgttattacattgatgttgcataacaaaccatccgaaggtcagcagattataacaaaggtcatttctgtattgtgttcatgtgtctttgggttgaatgggaaagctctgtttcaggctgagagttagttggtcctggctctgggctgtggattgtgtttagtttgccccaggygtgcacattttgcttagattcaacagcttctgggacacattctkctcacaragactcagcagagcacaggaaagaaggaaaacatgaagtacttcttgcggtacctgctgacatcacatttgctagcattccattggccaaagcaagtcatgtggccaagcacaaatccatggagctgggaaggctagcataggagttagtatttactgacaaatccaggctgccacagtgcaacgacaggtaaaaggtgggactgtttcgggcacgtctggacctatggtccagctgggtctggcctcacagagcttatgacctagcaggggagacagtgcatagttaaccggaagtgtgacagagatgactagagaggaggacagaagtgtaatgggaatggagatataaggccatccaacctaattggagatctccctgaggaagcgacatttaaactagtatgatttgctggatgggtcaaaacaaaaatgatccaggcaaagatgaggaaaataatgacaacagctaacagttagatgtttgctgtgtggcaggcactgttctaccccttggcatttgctaactcacaacaccccgtcgagatcgatactatcatcctcattatacagaagaggaaattgaagcacaaagacattattaagtggcccaaagtcacaaggttggtgagagaggtaggatctgaactcctgagtctggcttctccaccatgtgtatgccccactgctgggggaaggcactgggatgctggagcttcagctctgtagcggagatgcttgtggggagccaggtcacggaggagcttttgggctggttagggattttggaccgtaccctaaggaaagggtacatcattgaaaggtttggcttatgtgagtgcctgtgtgtgggtggtgctggcatggcccattgtcatcagttgaaggatcaggggttcttctggctggggcactggaaaggaactggrattgtgctttttgtgtctaacaggatggtttcctcctatgtgccctttgtccttctgaaggacttgtgggcagcctggccatcatgactctgagcccagagcctcttttgtcttcctctcctcatccccctgacatcataactaacctatggtctcaccaggttgtgctccagtggacatgaagcatctctccctgctcacctatggtggctgtgttagtgggaatgtgaatgactgctgtgaacatatcactcagcctgcgctcatcaaggaccagtttaccatgccctttgtgtgcatgatctaattgaattgtcatggtgactctatgaacttggcacaatcctggtccccatcattttcaagatgagacacagagtagacaagtcacttgccccaaatcccaggcagtttgacaccagagcctgttatcttaactgctttgctccactttaagggaagagcactgtgttgatgagacatgcagacaactcccggggaggtggtggggaggcggagaatatgatcggatgtgcagcggtgatggcaaagggactctaggaggttttggagcaaaacagccctgtttccttaagtgaggggggcttgccatagatcttgaaggcttaggaattttaggtctgggaggggtcttaaaagccatccaggctcatcctctcactctgtaagggactaaaatcctccaatagagctaaggaggcaaggggacagggatatcatgtctgaggcctctttcaaatgaagggcctttaatgtgtgccactgtaacccactgaagtttaatacagacagtactgacccgggagttagaaggatgtgtggggtcagaggtggtgcatgacactctaggtgggtctacttacacatcaccttcctcacctaaaaatgaagggtaggccaggtgctctagagcattccttccaggactaacttcctatggttcttcagagatagaatctcaatcctaaagctggtctgggggcagggcctaggatctcacaggggggtcaagttgaaccagggattggaatcaaagagtctggacctagttgtagacttcatccattggaagcaccaccccaggggcaccgccccctgtcccctaaccaagtccctggatttctctcacccccagcctctcccccttcctgaacacccccatctctgttttctttcgcctctctggctttgatcacatctggagcattttgtagagttgatgagtatgtgttttcctgttgggacacatggtgtatatcagaggcacttaaggagctctggacgatgaatggaaaagtctgcgtggcatctcaggggctgctggcctggagggtagatggcagctgcatggcaaggggacctggcatgaaggccaggatactctctgggaaggcccgggggaccagcatggggactgctgctccaaatggctttgagttgtcacgtaggggtggtgcatgggaactgtgtctgtgtgcttgtatgtgtgtrtakgtgtgtgtgtgtgtgtgtgtgtacaagaggactggaagggctcccttgtcctgttgccattggatactgccttcaagatttgctcttcatggtaactggggctcttatctgcacaaccagtgacataaaccaatgatgtgtcacctacaggtggacagtgagtgatgaatttaatatggggtgctctgtctatgagaagtgatagtaacctccagcatgggcttgcaggaccagtgagcagtgaagaaggatgagacacaaagtgggcttcctgtggtgaatgagctgggaacatgcccaaccctgtgacccctctttgctgtcccccagtatccccctgaagatttatcctcaggctttgtagctgcgtgtttctccctctaarcctctcgctggtcctyttgaactttttccttctccctcctccaataatcctaagtcttcaccccttttccctctcatcccctgtctttaccaatccatcccagctactctctttccattcacttcaagtgacatcttccagccttggggacaagttaccactgtctgggcctgctggaggtgatcttagaaagtgatagatggtatttataggtccagggtagkggtggagctggggaatgccatgcagagttcagtctggaaggttgtttatgctcttgcaactccaacaaagagcagccctgtctatccatggctcaaattaaattgcagatgcccctgaactcggggttaggaacataaacaactggtgagttgcagacttcaagcaatgagcaaactyggcaggggagaggcctggtgaagggctggttggcaatggatttttccagttgatgtttttccaggaggcttctctgacttcttggattccagggaccagagcacttctcttgaacagcacgtctggggagtgtggctcctccttggttgtaaggcattggtggagacttcccagcccttctttcatttaatttgtcctgctcagggaggaggtttaggaagagggtggagaactcagtgaaaggcccagggagtcacatcagggaagtctctgacatgtagatttttgctttgaggcagagtccaagaggccaagcctgagctcaggatgctctgatggggacttaagtttgcctggcttggcccctccagtgcaggaagtaagcagccacccatgtggtataactggctcagtcattaactcactcatcattcagtctactcaacgattcaacgaatacttacactgtggcaggaaccagctcagacggtgctaacaaaaaatcctggccctcaaggagcttatagtcaagttggaaaaggtgattgataagtcagccaacagcatgatgaatgctgagacacaatatgtagagtggctcttggacagaaacaagaagggcttctgaatccatcagaggaggcctcctggaaggttcagtggctaagctgagttttgaataatgaattgctatgagttgggtatagagagggggatggacattccagataggggggaatagcatgaattaaggcatgaaaggtcgaaaaagcacaattgttgaggggttacaagtagctgactgtagctggaatgaagagtgtgcatgagtttagggtgggatgtaaggcaggaaaggcaggcaaggtcagattgtgagattgtggctactcagctaaagtgatgtagaaggattttaagtagaaaactggtaagataaaactttaaggatgttgtttgagggataggaaaagttgcccctagttacttttcccagaattaggtcgtagccagtgcaaagcagggccttgcggaagtggggcacaggctggagccctagtgggagaaggggttccagagtgggacaagaatgatagcttcttgagaaggaaacctcagatgaggaaggcaaggctcaggaaaggaaactctgtagcccaggaccacatagctaattagcaccagagctgggccttctgagtgacagccaaacagaagtgatgacttcacagccttgctcaagggtggccccatcttctccatttttaacattacctgttacctggtgaaatgagcggcaggagtattcatgggaatgtttatacaaagtgctcatgtagactatacattcaccatcaccctggcaatttgccatgatacttcctaagagctgggttggcttgtttgtgtttcatctctttctgttccccgttcccctaggggtagagattatgaagaacaaaggtgggactgattcatcagtcaagagggctgtgtcatgggctctagtcacttgctctgggtccttgagaataggaggcatacctaccagattttcaactgatgcccatctgggtaaaggttactttgagagataagagaatcaagatttgaagtgtgcttgacaagatgaaaccctgagccaaaaccaacaagataaaatgtaatcatgataaatgtaaagtcagttagcagcatgcgggacagaaaggtctgatttggcaggcatttgtgtgagagatggggagtgttaggtgagttaagcacccctgagcatgagctctcagtgtgttgccaaaacatgaacttgtctcacactgaagtaaagaacttgttgaatgtagattataggtaactgtgggtcatcacctttgagctgtcagtctaccatggaggattgtgctctgttctgggcaccccatttaaagtggtagattggcagtagggaagatacacagatgtggcattctgtgatctcaaggaagatttctgctagtagacatttttaagatttggctcaaaagatgttttaaaaacattaaatgtggatattttccattggakcccatgctctctagctctcttcaactcccaacataccctgttgccttatagccaatccagtggcttacatttccacaattccatttaaacttgtgacctttgggttaaagcaatggctcccagctccagcagcacaccagaatcacccgaaaaacctataaaatgtagatttcctatgtctacatctggccatgatggagtaactggtgcaggactaccttttctgccataaccaactggaaacatggctaaaaaatataataattgttttcagatgttagacaataggcaggtaatccctgaaaaaaacaaggttagttctacagtggctctgaacaagtgcaaaataaaatagcgagataggtaggaaacttaaatccataatgataattacattaagtataaatggtctaaacatcaaaattaaggggtagaaattgccagatttaataaaaatgcaatacccaattatatgctgtttaccagaaacacactttaaatatacaggcacagatatgttaaaaaggttgaaaaaagctctaccatataaacgctaattaaaagaaaactgaagtggctatattaatatcagacagtagggtctgggaaaagaatattatcagacatatggataatatttatattgacaaaggggttaattcattaagaagacataaaaatcctaaatatgtgtgtacctaataacagagcttcaaaatagatggagcagtagttgacaaaacgaaaagragaaatagacaaatcagttacatattggtgataccatctttttcagtacttgatagaccaagtagatgatcagtaagaatatagtagacttgaacaatattatgaatgaacttgtcctaattgatgtttatagaatactatacccaaactgcagcagaaacattattttcacatgcacatggaccatttaccaagacagaacatattctagcctataaaacaagttccaatgattttaaagaattgagatcatacagcatatatcctcagaccacagtggaattaaattacagatcattaacaaaaaggccaaccaacaggtcatcttgcctgctgccttgcatttatgcagaccgtatacctctttcatctgttgcaagctgacctaaaccattgcatttatgtacaattcttttttgacagacaatagtggtccttgaagaagtattaaaataagttatatttattgactaaacatttattagcaagtatgaaaaagaagtagttcatatgacctttttaagggtgcccaaatttactgttcttttatattctctgatcatctctttgcctaaaagatttactccaggcaaacatctcaatcctagagatagaactttgtcaatcttgtaaccaacatcagagaaacagaatccagagactcagctaggcacagggccatttagtggcttagcctggggcaccacccctgagttcaaagggtacaggcctcatagatattaattagcaagagtgaggagtatgtatggaatatgtctggccagttcatattatttgaatgcgtctsatttctccaaatgagagcccttttctaacattcatgatgctagtcaacaggccattgtcttcacccataaaaatcaatttttgacactttgcatgctaattaaccaagttctggtcattgatagtgatatgagggcagcaatgctcatagcagccacctctgagcttgggctgtctgaacacctggccttgagccttctcgattgctacytgagccatatcttcagttcagtaagacaaaactctcacactttctatgatgaartagttgaaagaaaattttacacattgtaacattttcctagatggctttcttatcttttaaagatgtctagggaaggacgcccgttggcttctccttgtaagccatcccaatatctcacaaagtcatcaaggtttccttttttcccttccaaaagctgtttccaggaacagatttattcttgtattcagggcctccttcaaaatatacacagccccacggcctgcccttccttgtaactttgatttaagactcgcagttcctgagggcagagggggtttggctgagtttcccagctggtgtgtttacaagcgaaggatcctcctgcggccacgtacacggccagtgactctctctctgtggttgttgcactaattgtttcatgctcagataattatttccaactatcactttgtttgcttgtagtctctactgaaatcaaaggaatgactgaatgtgttaagagctaggatgtgctaayggaagtttctctgttttcttctgtgatggcttttggagcctaagaaatcagacgttgctgtttggaggccagggcgcagatcaaatgactactgtaaaaaataaagagatactgtttttatttgtttttttactttttattttgaaacaatttcagatttataagatgtgttaggttggtgcaaaatttcgccattaaaaattaatgatatttcaaaaataatgcaaagaactccctattatcagcactcagattcatcagttgttcacatctgccacatttactcttctgatgcatatgaatatatatgaatctataggaatatatgcatagaggtatattaataataatatggacatgttattattgaaccaattaagagtatgtggcagacatcatgccactttactcttgaagtaatctaatatatgtgtgtattttctaaaaacaaagactttttcttacatctgattttcaaaatcaggaagtttaacattgatacaataccattacctattctacaatccattttgaaatcagttgtcccaattatttcctgttttagcatttacttttttttagtccgagaatcaacctaggctcacatgtcacatttagttgttatgtctctatatagcctccttcaatctggaatcctttcttcrtctttcatgacattgaaatttttgaggactaaaggatcattttatagaaggtctgtcaatttggctttgtctgatgtttcctcatgactgcattcagatgatgcacttttagcaagacacctacataagtcactttggtcctttccaaaacatcctgagaggaggtgcgtgccgttgctatgtctcttttttggtgatgttagctctggtctggattatgacagtctctgccagattcctccactgtgaggctactggtcttcctttgtaattattaagtaatttatgaggagggcccttgggactatgtgaatttcctgttcctccgcagattttcacccatgacttttcgcatggaggaattctttttggatgttacatctattgtgatagggtttagaaagaagagcgtttggaggaagtccttattaaaggctttttgtccctgtttctaaaaccatggcgtattcctgaagaaaataggcattttagattatttaaattgagaatggagaagggagattgatttrtgtttaaatggcagtattagtatgtgttgtggaggttgggagagaagtgatttaaaagtgtagaaatgggagaaagaagcttgagtttgaccaaagaaaagggagtgaaaaaagtcttactgagtgtactcttgattggacactgtgaatgcacactaaattttcacaattaatcagattagcaaccaatcaggtttcacattttaggtatagaatcctggatggatctagaagggttctccagargtcatttgattcaactctttttgcccttgggcagtaataatcagaaatgttggctgggttgggctttccttccttttcaatacttccaggaaggagtgactcccattgtttcttgaataatgcagaactgggaacttgggaaccaaaaaataaatcagacaagatccatacctttaagaaacttacactcttctgagagggatgcctcacataatcattccacacctccatcaaaattctataagcctttaaatttacaattgatcctactgtttttggactgctctggactcaaaatttttttcttctcacttgatctcctatgacacataccttatttggcacttaacatccattgccccatattgttcattacactttcatgtggaactggtcttggtttgagatgaccatatttcattgcttctaagagtctgctgattgtaagatatacatttatttcatgtaatactaacactaaagagcactgccaattacattatgctatgccatctattggaattgcattttgatttcagatatgttagatgtggggaagtgcatatttgcattgaggaaatatggtataaacatcagcagcaagacccatcatttgtacttgttcatttattctttcattkatttattcattcagatgtaaaataatgtgacactttctgcaggatggtacaaagaacccctttagcactgagccaaattacagtgaataaagaaaaaaatggaattagatacacttgagtttgaatcctagttttccattatttcctagctttataatactcatttaacttctctgttttctcagtcctcatctataaaatagggttaataatactcatcttgtagtgctattgtgaagattggaaataatatttgaaaactacttagattagtgtctgacacataacactagtcttattagagtagacactcaataaatattaataaatagattggcttgtagrcatgcaattaatctgctttgttataacagtggattacaactgggcattccttttgatgtctaaattgcattcccttctgtctaatagaagccgttctgttccatttccagaggagatggggaacagctggacaccatccctttgmtaaagtctgaggacagaggtggagtcaccctcacatgagtcaccttacccatcccagtgtttgacatttgggggctatttcttttttgtccccttgggcagaccaaatgtctgctcccacctccttgcagtcgcttttctggctgtgaacgttcatgacagggctgggtgctgctgccatttggatttgttgaccagctacagtgattttcctagcatgttccaagctctctgaaaaccatactatgcattttggtccctggccgttcttttgtttttttccttttcatttaaaaatctgtatgtgtttttctggcataaggagaggaagatgggggtggggaggtggaatcaaatccatatgtttgtgatgcagttgccctgaaataataagaaagcattgctgggaaagagcctttggatgtctcaggaaccatgtttacaarccccacattggccttttggtcccctcakttcatgctgccacttgccaggctttgaaaggaccaagttcacatggggacactactcttctttcttctcctgattttttgcagcctttgctcccaatgaccttgtctctttctctgtatcatcaacatgaggtgaaggacaaatgcttgaatctttacttctctgcagagctcaatgaggcatactgctttttgccgccctatgacctcactatctgagctaaatatcatttcttcttgtcatctgtaatgctgacaactcttggttaaagctggtgcctcacctacagctaactggaccctgtaaacttcttgtctgttaaaaagtggcttttaaatttcctccaagctcaggctcatatcagtttccacatttaattatttttaagctcattgattttcttgcccctcaatatttattctttgtgtatttgcacatacactgtcatatgtcccaggttctgaaagaacttcaggtaggtttaaatggagggttcgtgacccttccctaagatctagaagctgagttctttggagcctgtcaaatgtagaggctcctctcctcgaactttggagttgtcctccaggttatggcattgttctgcccccatacacctccagagtcaggccaaggttgagaaagtgtgtgaccacggacttaaccctcaagttctgctgaaattctacatgtagattccaatgagaagaagtcagtgagacccagactgtatctaagatcaaaggagcttctcattctctagtccttacgttaaaatatgctaagagaaagctcatggccgagtccaggcaaaggttactcacatttagattcttccgggtaaccaggatcctggtgacagaaactggtaccgtccctgaatggctttcttcctaaatgtctctcatgcacatcagctgatgcattcttccacttgccattacttgacacgtggaagatgctcatgtcacacattcatttgttcatgcattcaataggcatttgtcaagtgcttggaaaggacagggccttgtacaatgcctgtgtgggaataaaaagatgtataagtccttgaggtactttcaatgaagccaagtagacaagacacaaccagttacataacaagagagcaggcaatggtagccgaagacctggtgtaagtctccatattcacctatcacagctgcttggctctgagtcagtcgtcgaacacctgtgaccttcactttcttttacaaagagtggttgggaagattgcatgggatagggtgtgcacaaagtcagtactgtggatagcagtgataaaagagtggtaccatgcatcagaagtargtcctagaatgtgacaggtgaggtatggggacatatgttcgccaacagtgctcattattgatgcgtggtctgaggaaggactgattggtttggagatagagggtggacttttttcattaactctcgtgtaaatagccttggcaggcctagatcttcaccctcaatcatgatacgtgaggatgggttttagctggtgttggtattgacagcttttagagctgcttttgtgtcagtgtttaacccacactcctctgtttactactgccctttactgtcagcacagcaaaaactgtagttggttctgggcaagacttcaggtaggaagggtttctgcaccagtacacagtctcagaggcaaaagaggtctatcatggagaaattagaaggagaaaattgttctgacacacatctaaataaaagattkatgcactttgggaggccgaggcaggtggatcacgaggtcagaagatcgagaccatcctggctaacatggtgaaaccctgtctctattaaaaatacaaaaaattagctgggcgtggtggcagacgcctgtactcccagctactcrggaggctgaggcaggagaatgacgtgaacctgggaggcggagcttgcagtgagccaagatcgcgccactgcactccagcctgggcgacagagcgagactccatctcaaaaaaaaaaaaaaaaaaggattgatggtgctcaggaggatgcatcttgatattcagaaaaatcattgagaagtgtttcatctttattcttgtataatttttaacatgactcatacgggcatatgtgaccttttgggttaagatgagacaatggagattgttcttgttttgtagaatttytctctctctctctctctctgygtgtgtgcacgtaattatttctattctcttatccgttagtaatattctagtggtagaaaagggaggtgaaattagcagtggaaagaaaaagtttggaattggcaaaaagtagggcaatggaatagatcagaggctctcaaaatagactcgagttggaaacccagatgtgtagctaactgcatgtgtgaccttgggcaagggatttagcttctttgaaaatggttttcctgatctgcaaattgggggaataatttctgacgcatagagtggggattaaaccatctacgtatgtaaaaaacagtgtaggtgctcaataaatgttctttttctttccttgcttggtggaggaaagggcgacaaattttggttaaaagaaagtcatcaagaagagatgcaatgcctaggtgcagaactgacagggttatttctaaggtgagaaatgcaccttgaatttgaaagaagtatgaatgagggctcagttgaaatttcacatggatgaacctgggggcaggacctgggctttggaagttcaggatgggcacagcctgtctctgtgaagagcagccctgtccctgggagggctgggtcctgacgcagctctcctagaggttccaacaaggcatcaggtgtccttcggaaacattaacaccaacattgcccgtgagcttttagcaraggatgtgctttgtaccaaggcatttcttcatcaaacttttcccataaaatataactctttccttagcacaattgttacacatcctagtgctcttctttctttccccttgaaaacactgaagaaaaacttttttatttttgagatggtctcacactgtttcccaggctggagtgtggtggtgtgatctcaactcactgcaacctccccatctcaggctcaaggcatcctcccacctcagcctctgagtagctgggactgcaggtgcatgccaccacacctggctaatttttatggatttttttgttgttgttgttgacgtggggttttgcaattttccctaggctggtttcaaactcctgggctcaagcaatccgcccaccttgccctcccaaagtgctgggattataggtgtgagccactgcgtcctgcccaagaacaactttttgtcataaggtggaaaaggtttattattattattttttctgccatgcccacacattatggaatagcaaagtcaaagaattcttcaagctcttctcattctagtctctggctgcttttcagtttggaaggatgtggagcaagaaggccacagtaattcatcttggaatcctctgctttggagtttttaaagcacttttcatatgctgtcttcgtgaatattcacagcaactcaatgagataaggtcattttcatttaacagtgacactaacttgctgggggacctgaaccagggccattgtatgacagttgtgcaggttgtgcactgaacaaggcacctgaccaagggagtgtgaggggttagaaggcatcccatgctcactcaccaagttgtgagccttggtgcctctttctcattcctgctgtagggggcggtggctcagccttggagagaacctttctgggctttggtttctctccatctaccaaataggattactttttgaattcttaagctagaaagattgtgaatttttgatccatttccccttttctaatccataactgaattaggaattagcacgatgataaagatgatgatgatggtagctaacatttctgagtatttccatgtggcaagtgctgtttcaagcacttaattaactcatataaatcttctgatctaagatccagtttctaattgcggctctgtcttgctgttggtggtgattttggacaagtcttgtaatctcccttargctgagttccccaatccataaaatgaaacaattataacagacaagtagtttctaactcccctgacccctttttagactttagaatcttggattatttagagacttggcaaggaagaggtgacatgctcaaatgggtaattgaggactacaggaaatcaacaaaaaatggggaagcaacaatgggagggctgttaacacctctggcaggaagggacaagagaaggagtgactacagaacccagagagggctgtagccggagctggtgcatgggagaaaagctctgacagaagctgtggcacccactgccaaggcaggacttcatagccagggaactggggaaatcaacaccccactctctttactctcccatccgctgactcctgctcatgcctgctattagccagggagcctggttgttgcagtccacagacatcagcctcctggggcacaggccaggtggagcaaggcagcgaatgggtcagcagctccacacaaacccccttcttgacagcacgtgtttaatcccctggactcccttgggagtggctattaacatccatattatgtggtatatgatgaagaaatgattttcagcaaaaatattttaatttagatctatatattaggggatattgtactgtaaagttcacttgcatacagtcttttataatattcactatacataaaggcgagtctatccttttcttttttgacaagtgtggcacatgctgtttatgctatcacattaaattatgtaagaaaaaaacaagatgttccaacaaatacatttttaaatagcagagtatatcatctttggtttgggtaatgatgtatataaaaacttagattaaaatttatcatcatattacagcgaaaaattagacaaaatctactattttcacatgaaatttgatatgtttgccccttgagttaaacatttaactggtttttaatctaataattatcttttattcccaaaagataagctgaaagagaagatttaggcgactacggcaaggacttctgtrtagattacacttggtaggtggagacaatctttaccaataatgaaaagccagtcggatgtaattgatgtaataactcccttcccttttaacattgggttttcataatggaattctttctctgtcatgtgatacttttsatcagttgtatgcagtttatggatctgtgtgaacatcatctagaggaaaaatttattgatttctttcatgtcatttttttttgctctgcattaatatgatatttttcaccatcagtgttctttatgttttcctctttattaaaaaatctgttgtgggtaaaaagtaaagcaatattcaataatgagaataaaaacaatgaaacccaaaccaccaggctacagatgattgcagggctagctggggcatgaacatgtgtctctaatcactgtttgacatgtacttggaagctctcatgctgtttattaatgaacagatgatgtttaaataatttcttttattgctttttaacaaataaaaactggaacagataccatcgctgtcttttctgttgtgaatccccttttggaggtcacaaggttttataaaccattcaatgaagaattctgttttatttttattttttattttgagacagaatcttgctctggggtgccgtggtgcaatctcagctcactgcaacctctgcctcccaggttcaagccattctcctgcctcagcctcccgagtagctgggattacaggcacccaccaccatgcccagctaatttttgtatttttagtagagaggaggtttcatcttgatggccaggctggtcttgaaatcttgacctcaagtgatccacctgccttggcctcccaaagtgctgggattacaggcataagccacggcgcccagccgagaattctgttttagatgaaccttagggttatcttccatttttttataaaatagaaaataaatgataacactttttaagctgggaggcttaaatctacattatcatctacactgttacttaaaagacacatgtcatgggtaagcataggttgaaattaggtagctttgagtctgaattcttctcattagctgtgtgaccttacataatttactcaatctctctgagctgtgcttgcctcatgcacagaacagggataggctttataacccaccttatggggttttgatgaggatttagtcatccgttgaacaaatgcttattaagccactgctatgcaccaagcacattctaggcactaagaatacaacagtgaacagggcagaacaagtctctgctctcatggagcttacattctagcagtggagagggacaaaaacacaaatttagaaagcaatgttaggtagtgatcattgtcatgaggaaagacgaagcaggaagagaggttggggccatttgggatggggtgatcacagaaggcctctctgaggaggtgacattggagcagatggaggaggtaggggagtgagcatgagaagagggcacaaccatggcagaggcatggaagtgggagcaggtgtggtgtgtctgaggaatggtaaggtgcctcatgtagctggagcagagccaaagaggggccagatgcaacaggaccttgtagatcctgaaaagtattttgggttttcttctacctgtgatataaagtcagaaaatcatcctgagcagaggaagaaagaatctgacagaagtgtartgaaaagattgcatggggcaagggtagaagcagggaggtctttgcagggaccgtgtttggccagggtattggtggtggagatggtgacacatggttggatttggtgtatttttgaaagtagcgtctataggatttactgatgaattggaagtggaatttgattttttaaaaaagccaaagatgattacttccatgtttttgtcctgagcaactagatgtggttctgtatgctgaaatatgaaagactggggagaagaggaattgttccagtgcaacaaggaaaccaagagttccactttgatcttgttaaccttgggacccttgttagccactcacggggaaatgtcaagtagactggtgggttcatgagattggaaaccaatgagctggaagaatatgattcactttgcttttctgtggttcccatcccrtgaactggggcaaatcatataactggcaaatggggtttcttggctattttagggtcattgggaatctatttccagtgctatgaactcctgtaaggcatttctctctgcttctgtcatgtggcctagtagttaagagcaggggcttttctccctcaacagattagagtttgaatattgggtctgcaacctaagggctttgtcaacttgggcaagatgtttcacctttaagcttccattctctcatctattaaatgtagacagtatctctccttctcgggctgccacacaggcttgtgaattttgtacattgcccataggtgcccagccgaggggttagtggaggctcaaacatagaccacactgctctccacgctttctgcccttaggtggggctgtgtataatacccagggaaaggacccttcacaagccatttgtttgcaaacacctgtatccacttagattcttgtgaggatcctaagggatcatgcgtgcaaaacattcagcagagtacctagaatgaagggtgcacgcagaaatggagcgattttattttactctgagatcttcctctccttctggatggggaggtgtggctgttaatggaggtccatccaccacccacggataggaatgtacaggtaggtagggagacctggaatcaggacttgcctttaccgtttctcttggattcagatgaggattctgccaatgctgtgactcggtttctgcctgctttgtttttcttgctgtaatttactttcctagctctcatctcttgtatgccttacttacttacctaagtgtcacttgcacctcatttctctggttcatcctgaactcagtgtttgctcgtctggcccctggctctctttcttggtctttgggcctgtttgctcctctgaatgcgtctgctgcttgcagagccagtgacaggccacgccaggccagccagtcctggttcctggtcccacctgtaccccatcagcctggctctgcagcctcccttgctccatacgatggctctttatttggaaaccttcttaaagagaggattggttggagagagggaacctcttcttaaaagtggcacagcacaggagagtgtcgtaaatctagggtcctctccttgcaaatggtgtgttttcttcctctgcctttctggaatttttgagcagttctcatcccatttgctgtgttgtttccagctgtcaggacataagctaagcccagcttccacagcgctgccatcccgagcccagccctcttgttactgtactttctgaactagctccatagcagcaaaatgtgctttttagcaagaggccttttcttgtccttcctgggaggatcaagaactcagagcccttgtgagttctcaagaattccccagttcttaagaactcctcagcccactgttgatctgaggagtggctactgtgtctgctggcccgtacccagctcaggggcagacagccagggtcctgctgttggttttggcagagtggtgacaatccagctgctgtcgttccacagccagtcaggagacctaccgtacaggcatgggtcagtccctcggtggccaggctggtgatgagaaggcaagagctggtagtagagggctgaggagaggggcccaggtctgaggggctgtggctgtgagtcctccgtgcacgtctgtgctcactggagagaagggccatgattcctgaattgtgggtcttgagaaaggagactgactagtggcattgtttaatgaatatgaaatrtctctgctcacaaaaattttgaaatcccttttgatatagactmtcttctcttccaacaacacttctgctctttttccttttgcccctagggaaaggaagagaagacaaacactccctgggaatggggtggcgggaatatgacctggkgaaattcccaccagccaggaagggagaacaagcctttccaatgagggaagatcctcagaaggagaggaagagaaggggagggttgaggactgattattcttgcccttgggktgaaaccatgcggctgtgagaatgggtttggaagcaaggggaggtaggaacaaagatattttggggtgaatcctagggcacagtgtttgcaagagaacacccttagaaaattacaggtcctttagaaaagcccagtgtctggcacgatgttagggtgccttggcactgcccagatagtaggtcaggaagggtgagggacacatctcggtacacagacatgacatagtagctgcaccccctacagtccacatatggcgtctggaggatcctgaggttctcatgaacaagtggactggaaggggctggggtggaacaaggaagggacaccccagctcagcttcagagcagcagagacaagcttagcctccagggtctagacaagaaaattcccagccacagcctgtgggccagagaggccctccacttttccatcagaaggataaaatttcagttccacctgcacctagctgctaccttataaagcagatgggggggaagggcccatgcggacaagtagctcgagtcttgaattcacagaatatttatcccaaagagtttgtttttaaagactgagataccatcaactgtttcaccatctgaatctaatcctaattctaacttttaacttgccttagaaagtttgggaagcattagatgagatactgtgtataaagcatttygcttaaggcttggcacatatagatgctgaataaatgtttcatttcctttctttctctccaatactcactccttattcaccatagtccatttatagtatcttggaggttgagggtggaggacaggaacatttgtgattttgcatgcagaaaccacgttggccctgtctcttaggttcaccaaggagagacttttgctgtcttgcctggcttcttctgtcattgggattttccaggctgtcttccagagaagcaagcactgtgagctttaattaaagcctcggaactttctctctggcatccctgcacctgcccatgacactactaagaacacccacatttgtttgcctttcatccgtctcctgagggaccaggaaagcctgacatctttctctaagtccaggsaggaaggggcagggccagtggtcagcttggcagagttgagagcagaaattagccctccagctgacagggctggctctctaggtacacgccttgttggcaacctgctccatggtaatcatctcctgctcaactctgctcttctgatctcctgagaattgtgcagccattgttaggcctccatcctgccttgggctgtgctgccgaatgccagccttgcttttcaaggcttactgccttgttttttggaagccttgtcttttgtwagcttggcctcctgtgcttccttcagatgagaactcacctcgcagsttagtctccgactgagccagagtgttacatatgcttgacctgaactgaatgtagtctggcctgagagcagagggacaaacaagatgacctgcagggaatctgctggtgtgcgtattatgtgactatgctgcctcttttaaaacttttaaaaccaaagtataatatacagatagaaaggtgtgtgtgccataaatatacagcttcctgcatcttccatgcaaccaatacccagatgaaggaaaaacattatcagcaccccaggaaactccagtccccatgctctccattagtgcctccctagggttggccatgatccaacttctaacgcaagaattattttatttttgaacttaatataaatagaagaatacaatacatatatactctggtatctggcttccattttcaacattatatttgtgggattcacttgtgtggtcatgtgtagttgtagtttgttcattctcattgctatataatattccattgggtgactataccaaaatgcatttatccattttattgcttataatcacttgggcagcttccagttgaggctgttataaatagtgttgctctgaacctccctgtatgtgtcttttggtgcacatatgtgtgtttctgttgggcatagacttgggagtagagttgctgggtcataccggatacctatgctcagctctagcagatgccacaagcagtttttccaaaatacctgtacctgtttatagcttaccagaactatgtgggagttctggtttctccacattttggccaatgcttggcattttccatcttttttcatttttgccactttgatgggtgtgtagagatactgcattatggtttaatttgtatttccctgatgattaagggagttgagcactttggctatttattgattacttggatgttgtttttcttgaagtattctagtcttctgttcatttttctactggattatctatttcttagcaacatgtagaagttctttatgtattctgggtacaaatcccttattggatatatgtatgcaaatatctgttcccattatgtggcctgtttttgtcactcacaacagtggtgtttgataaacaaaagttccattttcatggattttcagaatgagataaccagaagtgaacacttattacttgcttattgtgtccttgtataccttgctcattcaattttcacattaacgtggttttaaatgggaaaaataaagctgagagaacttgaggagagactttccaaagttaggaaacagcagaggcaagattcatgcccaggttttcccacaccagagcttgtgttctgtgatctctgttataccacaaaagataccaataccgactaatatctcatagacaatatccagttatacaattttttttttcaattgaattagttgctaatgtttaaaaattagaagtaaagatttctaacttttcttagcaaattgtaggatgtggcaacgctggtctcattttcccacaagtcaccccggactgctggagctgagtagttactgttcccgggtacctgggtttcagctttccaatcgagagatgctatgtacagttggttatgcctggtcggcttcaatcattttgttatctkcctggctcctgtgggcattggaatttttaaccttgctactgtttctcttaaatggtataattctttttctttctttgtttcttgcattcttactttaatgcattctgccctttcttccttccttttccaggtctctagactctgtgctcaggctcctggactgcctctctggctgatagcatttttatgggtagacagaatagtcaactgtttatatggatagttagaagagtctctcacaatatcctaytccttcctttaagggatgaggcattgtatctctgtaaatgtaaatgttttcctgaaggaagtgactaagtactccagtaagctttaatttatcatatgggctccttaagcacaggcctaagaggcaaagggagaattttgtaaattgtgtgagtggagagagtgccgttagggaaatctgtctctgaacgatcgaatgcctcagatgagatgctgtggtggtacagcttcagagttggaaaaaagcaggagaacaggggagggcggggctgggggcgaatggtgatggcagtggtggtgttggtaatggatgggtagccatatgtagtcctgtccaattaacaaatttgccatgggcatgtctcatgcccaacattttcttttcttctctaaatccttcctggaattcattataatgtggaggttgaaagctggaatctcattagacttgttggatttgaatctcgtctctgcatcttaccagctrtgcaaccttgggttagtgaatgtttttgtacatcagtttcctcatctgtaatttaaggataatagcatactaccttgtagggctgtgagaactaaaaagtaagagaatatttgcaatttccttagaacacagcttggcaattagtcctcaatacacctcagttactattgctgctattactgtattgacatggaagggtcagatgaaaagataaaattgttgctctgccacgtactagctgtgtgactttggacaagtcgatttgaccagggatcttcagttgtctcatctcgaaaagatgttgtgagaattagaagtgaggttaagcaagatgatcaagatgaaagcattagggaagtttgtgtttgttacctcttatgtctctcctaccttttctcatcatttttcctcttccagagttagataatgtggaatagtggagaacataagatgagcccatgaaaagataactagcattagcacatcataatgaataaacaagaactgtactgatgtcccttctttcattcccagtactggtaatttctatcttatcttttattttcttgattagttttactgatcctttcaaacaaccagtttttagtttcattgacttttttctattaatttcattgatttatgctctaatctttattatttctttctttctgcttgctttgggttgaattttcacctcttccctaaagtacaaactttgattactgtttcaaaactttcttgttttttaatactacaaatatctctctacgcatagctttaacagtatcctacaaatcttgataygctgttttgttattttcgctgaattgaaaatatttkctgattttctttgtgatttcttctttgatccataggttatttagaaggatgttgtttaatttccaaatatttagggattgtttccagactctttctggtactaattattagtgttggggggaaatacaatttttcctcaaccctcatacatttgtagttgagacagatcaggtaacaggasacaaattaagaagagaaaagcaaggcatgattgataagaaaatttgcttatttctatagtayataccattttaatataataaccaaaattatgactaatagcattatgcgaagacatatcatatttttaggaatttcatacaatttctggaacacatgttaatatgctcacataattcaaagaaggttaaacatcatttcttatttgacagtactttccatgtaatttaacgtattaaataagcctattttaatagttattttttatagatcttttgagagttcttggtccctgtgggatgtcccaaagttggttcaaggtcaaaaatatttaattttgaatttgattttagaaaatgtttgtcaatataacaaaagtttaaaacacttgagtaaatagtatcaaaagttactatatcattcatttaaccagagtgacaattaaaagacttcaaggcaaatgcagaaattgacatagttgtatgaaaaaccttagctcttttcatattgaaaagactcagttttcttaattaaagacctaataaaagacaatatgaagcacaataaattattttggtaagacacaagtttttgtttracttaaaaggygaagaaaaaattttcgctatctcttatcaatactccaagaaagtcttgacagtttaaaggagaagatcaaattctagttttgtttcagtatacttttgatattaaggctcattttaatacctttataataaattcattcaattatwgtcagtttgagcataagattttctttcactttctatctcttcccacctttctatcatcattaagttttatctatatcctttcttccttcattctgaaacaacctttaagtaatctctaaactagacaaaattactcttctttaacaaaaaactccacatgttcataccatttaacatcttactttccttttatatttgcatatagtgttgtttctcttatcattttatatacttagttagaaattttaactcttagtaaccttattttctagtgaaaacctaagaggtaaatagtttcaaattgttatgtaacattttataaatacacttttcataatttctagaaacatatgcttcctcttagaacaatttttcagtgtcaaacaggaaatatttactaacagacccaggtattttagttcctttgtaataagaagccaaaagtaggtaaagttaaaccttatgttcagcgattaatgtttcagtattttacttcacttggaaatgatctagatatgcaacgaatacccatcatttaatttaacttagcaacaccctaagaatgtagttaccgaagagatttgagaaacatctaaagtaaacatatcataaaacaaaattcttatttaaaaatacagttatacaattttattctacttacatctatttaatttacttgttcttaacaattatgcttggattactcatgaaaatttcataaaacatcaaagctagtcattatctcaaattattttcctgttaactatttttgcagcacatacatgtgagacaattattgccaaagcaagaactctgaagttaaatacatatttttgttttgttttgtttgctgctaactcagaagacagagctgttttcattaatctaacaatgttaaagtaatcttatttaccaaagagcacacaagtcatgtaaacttgaaaaacatttgggttagtttctatagttctagcaattttaggagtatttggtttatatgagtactgatttatcgctrtgcccaactttaaaataactttttaaaaggagttttataccatgtaaacatagatgtacacatggataaacatatgtgaacatatagacagacacaaataaatcttatagctttcatttaaaaattttaacgataagacaggtacaataatataaagctcactagtttataaaagggcagttggatccaaattatgtttttgcacatgggataagttaaggttacctgcttagatggccaatttttttttacccatatctgtggagaatacattaaaaattgccatttgcycttgctaagtaatcttatgggggatgtggactaaatttggggtataggactttttatagcagttgatatttaaaataaagagcctttttccccctttcttcttttttttagtctcatatgggtgtagacattgttttagttaactccttagatatttacatttcagagacgtagtaagatttacaattccaagggactggaagaaaatgtaggttttctytaagaaggagttttggatgagtatttgcttattagagatctagggtaacttttaaagctttttttctctttaagtgtaggacagtctayggaattttttttttttttttttttgctgtgggggtccaaaatttgggacgtcctggagctgatgaagttttactacagagccccacggaagtaagaggagttgtaaggtagagcagagcctgccaggctgcaagtcccctgaatccgtgttcgactgatttcctggctgtcaacttttacacaagtaacctgtatgcctggagatcaggcaagagtgctttttgtaaatcttgcagggaagttaaagcgagcagttgaacgtttaaaggattttctgggaaagttggaggagttttaggtgttaaaggaatctgttgaggggatgggaccagattttgaggagagggttaagtttaagctaggggtccagatatccagaagaccttctggagggccagggacagggaattggagataaagggaggttagaagtaggtggagaaggaggaattatagtggatgtgtaatttggcttttgttctaatttctattctttacatcttttttaaggaaacccctaaaagctagcagttacactcttctgtgtcctcttttcaattagatcttaccataggtaccattaagatagttgtttgggatgagagctctctaaaaaaatttctttttaaaatataaaagttgaaataagattctattcactgttcttactctttagtccttccattaaggtggacagagctctcatttccctcttgtgttttatctcacaggcttttgagaaatgaaatatattgctccttggtagattgcatttttctcctcagacatccataattaatattatctaaggggaaattgctttttagaggcttaactggtaatttacaaactttataaacttggaataaaaaatataatgaattggtaaattttgttttcaaaagaaatcgattttaattttaaaagtgatttattaacaaagtagaaacatttaaaatacagaaagaaatgcagaaataatggtgatggtgtttcagaaatggtgattgagaaagcatactttargtagtgaattgccttttaaaggaattaatagcaaaaatatctcttacytgtcattgttttcaccatttccggtactctctatttcattgtgtagatccaaatttctactgagattatattccttttgcccaaagatctttctttaacatttcttacagttcacatttgctggtaataaattctcttggcttttactccctaaaatagacattgttttgccttcatttttgaaagatatttaatttatatatagtactctaagttaatagttttttttctttccatactttaaggcagcagtccgcaacctttttggcaccagggatcagtttcgtggaagataatttttccacaggctggggacagtgggagaatagttttgggatgaaattgttctacctcagatcatcaggcattagattctcataagaagtgtgcatcctagatccctcccatgcgcagttcacaatagggttcatgctcctttgagaatctaatgctgctgctgatctgataggaagcagagctcaggcagtaatgatggttcactctgctgctcacctcctgctgtgtggcctggttcctaactggacatggacaggtaccagtctgtggtctgggggttggggacccctgctctaaggtgtcactttattaacttttggcttgcatagtttctgccaaaaaattggttataaatcctatataatgactttgatcttctgttgtatctgatttccttcccccacaagcttaattaaaatttttctctttcaatctttggttttyggaaatttgactatgacgtatctaagtatgtggggtttcatttttgtttttgtatttattcttcatgggttctctgaacattgttgatttgtgttttgttgttttttttttttttgtaacttttggaaaattcttagccataacatatttaaatattcttctctgttctttcttttatccttttggaactctaattacatgtgtgatagatcctttgatattgtcctgcagctctcgaatgctagatttgtttttcctcactcttttttccctttgtattttcttttgatacatcttttgtagtagattctgctttaatctattaattagagttatttaaaaatccctattgcatcattctgacatctgaatcaagcttagcttcattgattgccttatttcctgacaatgggattttattttattttatttgtttattgaatgccatacattgtgtataaaatgacagtggaaactgaggtaagtagtattatgcctacatgcctcttccattccatcaggtcagtagtgaggagagttgagtcaatctagttgagtgaggttttgttgttgcaagagtcacmttcagtgcactgcactacaaacttcagattccttcagtgatagtacgctattaccttatgctttgtgtgagccctggagtgctgaattggtcctcattgtttctttaccactctcagatttcagcagtccctgcatgcctgtgccacaatggggtatttctccatgcccctcccgctcccctagaatcaggctgttgatgtttgttgctcagtgataaatggagcttatcacttgtttactataagtggggctgtggagggaaatagggcagttttgttctcatgcctatctcagtcttaggcaggctctgtgcactcaagcctcagaaatgacggtttcttagaattcatgtcctccctctgcccctcacaattaaactctgtcctttactggtacagattcttgggtgggagacagtttcctgcccttcctcagcagtaacagacttctaatttgtaattttgcagaatctcgggcctaggagagtttccaccctttccaccaagtaccatcggctgtatgtgcaacccatctcgggcttcagaagcagtgggtctttgcctaggtccttgggtcaggtcccttcttccgtttaaggctttcgatttgaataagagaagattccaggaagtgcatggtttttcatacctgtgtgcaacttaaggggactgactctctttggtctcttaccttacccattatcttccttatgaggtctatggaaatgaccttgtgcataagggcaaactgctcttgtgtttgaagcttccagttrttacactctgtcatgctaacttatactcatctttctgaatttttaaaattttagctatttcttcttacttttacagggactatcgcatcctcccattctctgtcaaatgtaaaactattcacatatcccagttttccctggacggacttggcatttaaaaaaaattcagttstcctggttaccttacaacttcagctctctgatgagctcaagcaaagttataatttcacagattatccagatttctcttgttgttaggctgggaactatattctcttgcaattgtctgcatcataagtggaagcagaacctgtggtggtgggtaaatagatcctattcactgttcttcttaccctttagttcttctatcaatgtgtggacagagctctcatttccctcttgtgttttacgtcacaggcttttgggaaattaaatatattgctccttggtagattgtacttttctcatcaggcatccatagtcaatatttatctaaggggaaattgtattttagaggcttaactggtaatttacaaactttataaacttgtaataaaaatatatgagttggtaaattttctttttacaagaaatcacttttcattctaaaagtaatttattaacaaagtagaaaaattttaagtgcagaaagatagaaataaagaaatacagtgacatcagcaagatggcaaaatagaaagtccccaggcctcacccttctactgaaacacctgtttagcaaccatctatatacaaaatagacctttatgagagctctggttttcaggtaagaggttgcagaaccctggtggagctcaagacctagaaaaacttcactgagaatgcaggctcatgctttctggcagcagaaccaccagccatgggcctggaagcagccttgctcacttgaacacctagtgacagcactgcctgttcactgctcataaggaactctgcccatatacagaccctacaggaagctggcttcccatgtccccaatggcatgaccacttccacagagcaggggacttggtgacagacccacccactttcccacagacccaggggcagccctgctcatctgcccgtggacccatcagcaaacttgactgctcatggaaaccaaatgcagccctactctcatgcagatctcaacagaatctctgtctgtggcgcagcagcccagtcctctagtggaccttggaagcaggcccacctgcccacatacccagcagcaggccagcccacccacagactctggcaacaggcccacccacggaccatggcagcagatccacccttggaccccacccagcttaagtctgcccgcaggcactgcctgcttactctggcagctgatccacccataatctctgaccagcatgactgatgaaggtctttgcctgctgaaagcagtcagtaagaactggaagaggtgactacttctcaaatacacagacaccactctaaggctacaaggatcacaaagaatcaggaattctcgatactaccttattaggagctgaaaaagactccagtaacttaccctaaataaattgatatccataatctgcttgacaaagaactcaaaataattgtcttaaatgagctgcaagagaacagacagctaaacacaattaggagtataacatgtcaacaaaatcagaagttcaacaaacatatagaaataataaaaaagagccaaagtgaaatcctagaactgaagaatacaatgactgaactaaaaaacttaatacagaacttcagtagcatacttggtcaagcagaagaaagaatcattgtacttaaagacaagtcatttgaaattatccagtcggaagaacagaaaaaacagaaaggttgaaaagtgaagaaagcctaagatcttatgggacaccatagagtgaaccaatatatgcattctgggagactcagaaggagactaaagaaagaaaaagaggaagaaagcttattaagggaataattgctaaaaactttccaaatctaggaagagaaatgaacatccaaattcatgaagtctcaatgtacccaagtacattgaacccaaagaggttaacastgagtcaccttaaaattgaatttgatggactggattaagaaaatgtggcacatatacaccatggaatactatgcagccatacaaaatgatgagttcatgtcctttgtagggacatggatgaagctggaaaccatcattctcagcaacctatcagaaggacaaaaaaccaaacaccgcatgttctcactcattggtgggaattgaacaatgagaacacatgaacacaggaaggggaacatcacacaccagggcctgttgtggggtggggagaggggggagggatagcattaagagatatacctaatgtaaatgacgagttaatgggtgcagcacacgaacatggcacatgtatacatacgtaacaaacctgcacgttgtgcacatgtaccctagaacttaaagtataataaaaatataaataaataaataaataaataaaataaataaaaataaataaatgtaaaaaagaaaaaaattgaattctcaaaagtcaagtagagaattttgaaagcaacaagaaaaaagtgacttatcacaaacaagggaaccattataaggctactagtggacttctcagcagaaaccttgcaggtgaggagagagtaggatgatatattcaaagtattgaaatttawaaaacctgccaaycaagagtactatatctaggtcaaagaataaatcaaaaaaggaaattagaaaatatctcaagacaaatgaaaatgaaagcacaacatattaaaacttatgagaggcagcaaaagcaatactaaaaggaagtttatagtggtaaatggctacatttaagaagaagaaagatctcaaataattaattttacatctcaagtaactacaaaagaagaaaaaactaagcccaaaattagcaggagggaagaaataatmtagattaggggataaataaatataagacaggatatgaaaacagaaaaacaaaaaattgatgaagctaagagtttgttgacgaatccttagttagactaatgaaaaggaaagaagttgcaaataaataaaattagaaatgaaggatgagactttgcacctgatgttacagaaataaaaaggaattattatgaacaattatacaccaacaaattggacaatctagaataaatggataaatgcttagaaccatataatcaacaagattgaatcaaggataaataggaagcctgtacagaccaatgacaaataagtagattcaagcaataattgaaaacaaacaaacaaaatgaaacaaaacaaaactctcagcaaagaaaagcccaggaacagatagtttcatggatgaatccttccaaacattcaaagaaaaattaataccaatacttcttaaagtcttccaaaaaacaggaaaagaggagagacttacaaattcttcctgaggcaagcaccaccctgataccaaatccagacagagacactacaagaagagaactataggtcaacatccctgatgaacgtagatgcaaaactattcaacaaaatagtagtaaatcaaactcagcagcactttaaaaggatcagacaccatgaccaagaagggtttttttccttgggatacaaggatggttcaacatatgcaaatcaataaatgaagataaaaatcacatgaacatctcaatagatggagaaaaaaaatggacaaaagtcagcactgtttcacgatttaaaattctcaacaaattaaaaatagaaagaacttacagctcaacaagttaggaatggaaggaacatgactgtcaatgaattaggaatagaaggaactaacatcaacacaatagaagtcattcatgaaaatctcatggctaacatcatattcaatagtaaaaaaagttttttttctaagatctggaataaggcaaaaatgcccattcttacctctcacattcaacgtggtatttctagcaagagcaattagtcaagaaaaagaaataaaagctatcaaattggaaaggaagaagtaaaattgccttagtttccagatgacatgatctcatatgcagaaaaccctaaagactctaccaaaaaacttttagaaataataaattcagtatagttgcaggatactaaatcaacmtgcaaaaatcattttcatttctgtgcactaacaacctatctaaaaagaaaactaagaagaaaagtaccattcacaatagcaccaaaaagaataaaatacctaggaataagtttaaytaagagggtgaaagatttgcacattgaaaactataaaaygttgataaaagaaattaaagaggatataaataaaaggaaggtgtgaaaggaaaataaaaacttgggaccccaattcactctgccaaaatgaaaaaattaagctgaaagctgagtgatgcaagaagctgccctcccttttgttcctaagcagacagctacagataaaaggctaaatatctccacaggcagctgctctatgttcaccttatattaagtgccgatttgctgagcacaagatgaatacttaattgactattctgctacctgctcattttctcctgcaacatgtggatgaccataccataccctccctctttcccctccagcccactagcccaatatttcccctttaaatattgaagcccttaaattcatctttggagaaaggcaccgatgaatattgaaacccttaaattcatctttggaggaaggcacagaccacagactgtttctgtgactctgtgtttttttcttccaggcatgtccttaaccttagcaaaataaacttctaaattgattgagacctgtctcagaataagttttggtttacaaagtataccttgtgttcatggagctgaagaatcaatattsttaaactgttcatactacttactcttcaataaatgatattgggaaaactggatatccacatgcatgagaatgaagttggacccttattttataccatacaaaaacccaacttaaaatggattaaagacttaaatgtaaaacctgaaacaatagaactcttaaaagaaaacaggggaaaaaagcttctacacattggacttggatatggcacagaaagcacaagcaacaaaagcaaaaatagacaaatgggaatatatcaaactaaaatgcttctacacagcaaaggaaacaatcaacagagtgaaagtcaatatgsagaatgggagaaaatatttgcaaaccatatatctggtaagggattaatatccaacatgtataaggaacttctacaattcagtggcaaaacaaagaaacacacaaaaaaccaaatagcctgataaaaaaattaagtaaaggacctaaatagacatttcaccaaagaagacatacaaatgaccaacaggtataggagaaagtgtttaatgtcacaattcatcagggaaatgcaaatcaaaaccacagtgagatatcacttcacacttattagaatgctattgtccaacaacaaaagataaaaagtgttggtgcagatgtggagaaaagggaacccttgttcactgttggtggcaatgcggtcactgtggaaaacagtatggaggttcctcaaaaaattaaaatataattaccatttgattcaacagtctcccttttggatgtatatcttaaggaattaaagtcaacatcctgaggagatgtctgcactcctatattcatagcagcattattcacaattgccagaaggtataagccacccaagcatccattgacagatgcatggataaagaaaatgtggacacacaatggatattattcagccttaaaaataaggaaatcctgccatttgctgcaacatggatggacctggaggacgttatgctaagtgaaataagccaggcacagaagcacaaatactgcatgatcccacctctatgaggaatctaaaaccgtcaaactcatagatccaaagaatagaatagtggttaacaggggctgcagagaggggaaaatgaggagatattggtcaaaaggtacaaaatttcagttacacaatacatatatgcccggagatctactgtataatatagagcctatagttaatgatactgtattgtatacttaaaaatctgctaacagggtagatctcacattaattgctcttaacacaagagaaaataattttttaattaaacaaaacaagggtgagagcaaaaggaaacttggaggtactggataactttatggagtgattggtgatgttctcatgggtgtatacttatctgcaaactcatcaagttgtatatgttcaacacgtacagctctttgtatgccaacatacctcagtaaactggcttaaaaataaagaaataaaaaccacccataagcccatcatccaaagaaaccattactaatattttattggatttcttctagtcrtttttcartaagtgtgtgtatgttggtttgcatacccaagtatacatgcccaaatatatgatctgtgtgttttgtttaaataagctagttccaaaaaggtgtgttttcttatgggttgagtgctatggcacttatgaaatgatgatgtgttattcatgtttggtaaaggtgccaaaatgtgtggcatatttttagtttgctgttggggctggattctttctcttggctagctatttcacatgaacagccaagacaggtgtgtgaatgtgattccaatggaatgcacgtcrttccagaaaagctcagttgttgattctttgtactgaagcctccccttccccgtgcaacctccatccctttgttttcgtcacaagaggaatgaatatctatgttgacccacccttaggcatagaacaaacagaaataaggaaagtatatgrtgttcttaatatgtgtttcattttcttttctttcttttccagaaagtattttggagaaaaaattggactgtattttgcctggctgggattatatacatcattcctcatcccatcttctgtaattggagtgattgtgtttctttatggatgtgcaacaattgaagaagatattcccaggtaaatcagttttaaagaaaagggctcagttgccatatgttaataatttggagtttcatcccagtacaagtacatttcacatgcctctttccaaagccctcaccctctatcattctccttcgctatgacacatgtagctttcctccagagacagatctaggagctacagattctgggaatggcttcagagccatgctaggcgaggcctacttcctcttctagtcaagctcttctccagggcagggggatgtgtctgatgtgggcaggcagataattcctggtaagaaaaatcatgccagagaaatacttttttcctctctctctccacttcatcacttcttttacctctggtttcccataagacccaaggcaaggtgtggggagtgacactgagtagaaatcacatctgtgtggtcagatgatgctagaataaagcaagctgagaaagcaagcagctctaatgctgaggaaggcacagcctctgtttcaggaagtcagaaactgcagggaggaatagccccaaggcgggactcttggagcgccaagagatagaatcaaagctagtttttatgaggaagagagaacccacaaaggaaatatgggatgagtatggtggctcacacctgtaatcccagtgctttgggaggccaaggagggagtattgttggagcccaggaatttgagaccagcctgggcaacacagtgagacctcatctctaaaaaaaaaaaaaatttagctgggcttggtttggtggcatgtacctgtagtcccagctaattgggaggctgaggcaggagaactgcttgagcccaggagcttgagcttgcagtgagctgtgattgattgtgccactgcactctagcctgggcgaaagagcaagacccctctgaaaaaaaaaaaaaggaaaaggaaagaagcacttagactgacaatgttatatattagccatgtgactggacagtttactccctgaagcttagtattcttggctgtaaaatggtaatcgcgacgcctaagtcatagtgttgtaaggattaaaggagactgtgtctggaacatagcagaagattaataaataattgttgaataaatcaaaatatgtggaaataaagtacaaggaacaaaagagacacttagctaatatttagaatttaaacactcttgccatcttcagaattgtctttgcaaactgaagcatggttagtatgttttaatattcttttggatgcaagtgatagaaatgcagcttgaactagattaagtgaaaaagaaaatttattataagcattcaaggagcactggaatagggactccatttatctcctgcctctgactctttctagcatttgttggttacactacatattttctccatttggattaaacattgctgctagtagctcatgggtgttacaccttagagctttatactcgattggtctcaagtgaaaaagtactatgactctgtttgacttaggtggaggccccgggccaattcattgtggctagggggcaggatagctttgtaccaacttgatgttccctccataggcaggtggatgaggacactgggcggatcattagagttgggggtggtaatggggaaagtagtggccattctgaagaaaaaaccagaaactgtgcattttaggaagggtatgcgtgcatcagtgggcagaaacctgcttcctggctcacctgcttcctgcctactggtgcatactctatagaaatggtctcacaaatcagatcacctggagatgatgttgtcaatatctagaataaaactaaatcaatgtcaatctatgcaaatggtttgcaaatcaaatcaactgaagattatattgtcaatatctagaataaagctaaatcacttgatgtaagagacaagagtttggattttttggtataaaactctagtatcaattgtcaagtgttttgttttgttttttttttttttttttggagggtgaagggaaaaaggaagggggagaggggagggagggaggccgagggcaagtgctcttgattgggagttctgggtcctttatcacaggagatgggttattagggctgtgttttccccagtgcatctagcatgaggcatgagggaagagctaatacttatgaactatctaccttgtggggggcataatgctaggtgattgttataaactagtttctttgatcctgtaagagatcaatgttatacacgccgtaaacaggcattattatttccactgaacagagattgagaaacttatgctacatgaggtcacataaattgtccaatatcaacaactaatagttgtcagtgctgggagttgaactctgttgcctcctgttccaaagtctttgctttttctaataagcagagaagttttccggagggctcatatcctccttcacaactcagtagcttcacgtgggcttgcctgggtgtgttctaagaaaacatggcttttgggtttcccttgccagttgtgatccctagacatctggcctcaggttgaccaagggtggaaaaccccataccgtgccagtgcagtgggtggggcaccagtgggctggtttatatcaggatttaraacttgtgccccgggtccccacatggtaatacacgtggcagcaaccactacagctggaaaggacgtggtctgcacatgctgcaacgatagacgtctatgcacagatgcacacagcccacgttcacacacactcatgcacgcgcacacagatgtctacacacagacgcacacacccacattcacacacactcatgcacgtgcagatagatgtctgcacacagatgcacgcagccacattcacacacactcatgcacgtgcacatagatgtctgcacacagatgcacacagccacattcacacacattcttgcatgtgcagggatattcaagtgtaaaatgcagtcgttactgcggatgtgtcacattgcctgtcagagtggatggtgttctacaactgtggatatgacaacaaccactggtgggttgtggaatcaatttaatgggctttcaagtggactaaaacaagatggggtaagataagctagaatgcaataaatattagtattcattataagaaggatgggtaagtgttgcttcattagattttgtttcatttttrtaagtgtgtttgtgagagtgagggtatgtatttgcatactgaaatctgatgtaacagattgttttaactgtaggtcacagtcaaaaacgtttaaaattactacaaaattgargttttggatgttgttttttcagactcaggatggggcctggcaagtcaggaaggtgtaaatactagaaaaaagtaaacattttaatagatttctttaaaaacagaggaactgttttttaaacataattgtaaattcatcagaagtccaacttctgtgggtctgatggaaactcagaaaatgccactccttataaacaaagggatattctctaaaaaccaatattgaatctaaagaaatgcatactctaagggtttgtgtctttcagccactcataactgtgattaaaaacttacagtattcctgggattattttagaggttgctaattttgtcatcaagcctkaaattcactctgtctcactttttaaaacctttttattttgaaaaattttagattcacagcgcaggaacttgcaaagatagtacagaggggcccagcgtgcacttcttctagcttcctcccgtggtttcgtcttatgtaactacggcacaacatcaaaaccagaaaactgacattgatgaggtggagctttaaatgataccttttattcccagtaatttaactttgatatgtgagatataagcataagcctgtaagtaatacttccatgcgtgcatgatacctctatagaacttccctgtctctactcaccaagggattgatttcatttgttaagcacttacatgaacagagaacactaggacattttttaaaaagctgattaatctaaaccatattgaaaaaagattggttactttaggtctgagaccttaatagcagctgtttagtctgaatttcctgaatgattgcctctttgtaycttctcccgttgtgctaacagggctctgaatcacctaatccatgagcaatgatttaccctgaagaacattgctcactttagggtcttggttcaatggactgtcaagccgtttatcaagcttcttaggctttctggagaaaataataaatcaaaggaatacagcattggatttatagccacagttacttctcactagaaacctgtgtattgtacagcttagtgaataccctagacctgatttccattctgggcaggcttccctcatctttcagcttgtctagaggcagcctctctcacaaaatacaaagtcatttcgatgtcattcttagccagaattcctctagaattctgttaaaattgattacatcaaaaaccccccaatacatatataaagcattctgacttcacatttaaatgatttgaggagaatccataccatggtggctgccatcttgtacaaatgatggatagttgcctgcactctaatttaaagaccagcaatttacacagcacttaggtttcaaagtgctttgcacccgcttggctgctaatacgtttttcattcctgaccttttagcattgactagttccaactaggattcagttgactaggtttctgtctctcctcagtccatgcttaaaagaaaaaaccgctaagttaaatgaagtccctaacacatatacttgaagagcagcattgaggaactcatatgttcttggacgtgacttaaaagcgaacgtcttttactagaatttatacagacaagtgattttctgtgtaaatctgttttttaagggggtactttcctctctgaaaatagcaattccttctcaactacatagcaaacacaggtctgacccagaagacataaactgggctctctagtcacccagcagaacatgcccaggtgaaactagcacagctgaatgtattattaagatatgactatttaatattttcgacgtggatgagtcatttttattgacctttgccagcgagtcagtggaggaactggggtttatcctcagggaccgacaatttccattctctcacacaggaggcctttccttcctgtggacttagtagctcattaaaaacagaagcctagaaactggggcttgacagcaagtggcagccctcagtaaatctgccacccttcaacttcttaatgaagggggaaagagacccaggcatcctttggctttggaggtttcctctgagcactggctttagcacacagggcaccagcttgctctccctagcagtggctcccacttgtgagccatgctctctagcgccctctgctgcttctttctgttggaaacagctgtggttctcagtgctggatcccctgcctccccatcattgtctccagctgccctgtaagaacagccagtgctttgctttcgtgaaatcttaagttctccaccctttccccctgaaccatgagcttaaccatcctcccatctccctgggagaatattacacaacagagggatgagttcattcatttttcctatcagtgtatggtatagagggttattgggaaagtcagtcagggctgattctttggttcttatttccaagcattcatatgagcctaaatctgttggatacagctagtcagctaacgaatgaatggaatttcaaatatattcctcagtccattaaatggaaatacactaagaataggttggaatacaggccattagagattatttggttcatgctccaagtatcaaagaatctagatcttggaagaatttgccttgctctttcattctccctaatcttatttcatggttataataattcttattaggttgaggttattaatctccattctacaagtggctctccagctcatgctcttagaaaagggctttccacccagatctactccgttcttccccatgtagaacttctccttctggaggtgagagcatgcacaggtctagccacacactmgtgtttgtttctacttgggaccagtatcacctgtttgtgagacagccagtaggctttacaaaaacagcctagactgaagaatggatgatgaaatccagcttcaggctgtgatttattcacaactgtggatgcatcccattccaccaacctcatggaccccagatgttctgaagggactttatgaggcatcatttaatgctcaatgtctctgacagatctcactaactttccagggcacttgtagtgacagggagctccatatcccatcttttcattgttgtttttgaacaaagtatgagtaacactctccaggtgaagaatacaatgctaacttctttaacattccttacttatggagttgaaaaactcaaccatagatttggaaatgggagctatttgggggatgtatttttcttggagtggaccatgcttgagctccacctgacccaacaacctccatctattgcagcagagagatgtgtgaccagcagaatgccttcaccatgtgtcccctgtgtgacaagtcctgtgattactggaacctcagctcagcctgtgggaccgcgcaggccagccacctgtttgacaaccctgccaccgtcttcttctctatcttcatggctctgtggggtatgtggccatcaccaggcttgcttatatgggtggttcctttacatgggcacagtgaccaagctgtaaagctcatccccttcaggttacttactttcgcattttttcttcccatcacaagaagtattttaaggatgacacttttcttttctttactcatatgtgtgaatagaaacaggaatatccttcatgtctttatctgttttctctcagatgtagtcatgctaaccatgtactagccccatgtgtgatttattcagaatttgaaccaatgcctgttttgaaaactcctagcacacctgtaagactcctgcaggtgcactgacttaggtaagattgtagatatcgtgcagcacaatacttagaatggtggagtgactgccgtggtcacagagttagctcatgggaaaggtgggctgagatttggtctcctgactcctgttcagtgcgattgttagggcatcaygagtgtagactgtactgtccctgcactgtttaatttaatatttaatgccagggtaatgctttcagtattcccaccaaagggattagtggaggaaaaaataattccttcatttttctcctcctcccttcctcccagagtatggggtaataaacttgttctgagccataggtagctgactgtaaacacacacagatmcacacacacacacacacacacacacacgcctattctcacaaactggaataacgcgggataaccaccccatggtaactgagcatttctaagaagacacacccatgagtattagaaaasggaccaagtcaacctgtgtcagcccatctgagtagccacctgctcctttactcatcaccgaatgtgcaggcccttggtttgcacattggatcacagaccagcaggaccacagtcctgctgcagaggctgtttgatttatcactgactccatggcgcccagaggatatgccaggatgggccctgagtcacacgtccctgagcgtatgaggagaaggaggagagggagaggcctgttctcggtggttcttaggagaactagaacacaaccttcctccattccctgtggggaccttcacttgggtggagacagaacttgattggaaagattcccatattgctaggccaccaataaaaatttccagggcacactctattctctattatcagggagagcagctgcgtcccgggagcacacgggcagtgttcagcccatcgagagctggagcagggagcaggaggaaatggaattgtgaccatagactcytggractgttcacaggcagggttggtagaacacactgaagttggggcttgttgcctgggaagtcactggcagctctgtgtctccttatcaaacaggagcattgtggaattaccccaagatccacctgaactgatttggaacccagaatacgtattcattttttgctatattacaactctaatgcccataatttgtcttgcagatattaccaccattgagttgctgaagcctaataactccaggtctataatccttcaagaactttcttgggacacataatcccctgttgtagagaaacttggttttcaattgtacttcctagtttcaagtttcaacaactgcctcttctcttcctttgatagctgtaatgaacagctacctcccaccccttccgagatcctcagtcatttcctaccctacccctggacccactgtcttcctttcacatcacagtgcagggaaagtactcaggggtgagattgcgccagagcttcctggcatagggtaggatttggttttgttttttgacagtcttgctgtgctttatgtgattgtgtattcagttacagcagccaagagcctttaggccagattgtctacaaattacaattaaaaataatagtaatgcctctcattaccatgattattatgattagtggtgctgtgctgggtgggcctggktcagggcccaggtctgctgggaataaggctgggaagaaatggctgtacatagagagagacttgggctgctggtggcagcggaaggggcggtgtggagtcaggaggtcttgggggatactagtcagcaggacccaagtctgttggctcmcctgtaggtcggacttcaaactccagggtatgttgggaaagagagtgaagtcctactgaaaagggaaggaaagagacagggtttcagaactcttttccgaatagaggttaaggacactgacctaggcagacctaatgtgtgtctcagttctgctccttaccagctagggatcmcatggcaggtaaatgtgaacctaactctgtgtcactaaagtcaatactcttgaccaaggtgccctgttaccttgggcagattacttaatctttgagcatcgttgtcctcatctgtaaattgagcgaaataatacctaccccacagtgctcttgtgacaygtgattgagtgtgcatgcagagcatgtagcatagtgcctggcacagatgagcacccagaactgggagctgctctccatcagtatggtggtcctcccttgccctcacgactcatctatccakgactcttttgcccctctcatcattccttcagtctgacttcctcccttcatggagacaccagtcggtcagcactctgggcactgttgtgtgcacagccctcctcgggaaccaaggaaggagyggtaggaagaggagggacttactaccattcttagtatccccagaccaaagccagtgttaggagggaatacacccactcgagaaaggcctcaaatccaagggagaaaaacatgcaaatcagtgtatgcaaaatgtcatgtcagawgaaaacatgcacatcagtgcaccataatgtagctgcaagtaaaacaaatgcagctttaagtaactgtgtattcaaccagtgcataggtgtttgatattctcagttctgtgctgtgaccgaggtagacataggcagctaagagccaggaaaagtttacagtcctgttattacatcacaaacatgaagtgtcggccaatagtcaggcatggcatgtagtgaagtgtgctcaggctcctgctagaggtggggtggatctgtagggatggcctcagggaatgtcatgtccctccctttccagggtgccatgaacatagggcagtaggagtgaggaggacagggtgccatggggactgatgttatggaagaggggracttgagctgggtcaggataggatgagggtagaagctggaggatagcacaggagagagggacaacgtgcgcaagtcgagtatggagatgacggtgaggggatgacccagctgtaatgtgggcatgggatatatgttgtcaaatggcaggatgagcgattcagatagatagttcgggctcgacatacatagtcctggaatccagagagaagaacttagactgtaaggagccattgaacatgtaggcaggtagtgttggcacccttcctctgcccactccttcaatgcccaaatgccattgtccttcaaaaatcagctcggatgcctcctctggcaggtagcacttctcttcgcaggcccacagctttttcatctgtgtcattcttaaggccctgatcactttatgtcttgtattgtagttgtttacaatcccttctcacagattgtaaacaacttgagaagaaaaatccacatgaagttcacccaatctccctgacaatgcctagaatggtgttttgtacattgcagataccttagttgggactggtgcttttgcaggattagaaattcactccarcttactcaaataacaagagatttattttaagaaagcaagagacaagctcctgggtgtaggaaatgaaatataaccaggcctcttgggaactggagctagagatgctgtgggaaacgaaggccttccctcctttcaggtgctgcgtggtctctcccatccctgctcctctttgtgtcttttagtttcagttttcaaaggagggaatctgagtgctctatcagcaggccctgcatcagatgttcagccctggtataacaaaccatggctgtagggttgtgctcgtgggggtatcaggttcttcctagagcatgctgagaaaggcgtgctggtccttcaaagggccgtgggtggggcaggcaaactgatggatgtgtaggtgtggcaggcattctacaactatttgctaagcaaatggaagaatgaatgcatactactttacagagattattctatcagctacatgcaggatgggttggaaggctgaaagtctggagtcaggtagaactgttaggagactgttatgtaacctcagaatgagatgattagggcccaaatgaggcaagtggcgctggggacagaaagaaagaaatgtagggaaaaagtgacagtgctgatgaaggtgaaggaggaaagaatgtatgcgtaggcaagatgaggcttgtcaaaaaatcctgcagacccctccctttttattttcttcatcccgccatccttactttacttctccagatcagtgtttaccctcctctcataacttagaagtggagaaaggagcgtgtgtgtgtgtgtgtgtgtgtgtgtgtgtgtgtgtaacatatctattggctctcaaggatgtggagtatttctagcagtttcacctagaagtgggaaaaagaggctaaatgcattaaagagagctcctaaatttaaaatagcttatcccccacctccactggtgagcccaaagggtacagaatccactcttcaaaaataatcaaggtttttgttcttgttgttctttttaagctaccatgttcctggaaaactggaagaggctacagatgcgactgggctacttttgggacctgactggcatagaagaggaagaagtgagttctctcacgtatttctcacatacttctgtgggcttttgctttgttttgaccctggaaatggactctcttgagtgagataaccatgtatgtttgctgtcactggctggatctcacagtggctgcctgtgtagcttggctccatggacttgggccatggttgacctactctgaggccaagagttcaagtaccccctcttcccttgagctggagggcattgagcctggtgtttgggcagatgtcccagtgccctcctctggggaaagaggtggcagaagatgcaagaacaagaggcaagacgtaatcttgagatcataaagccagagagtcagggatatgtcagaatgccctgggggcctcctgagggccaaaggagaggcagggtgtcaggtgctggttgtctttgawgtctgtgaatgaagaaagaaacactaaacctctgtggtataagccagtgcactatgtgtgaaactgaggagttggggaggcgtgagctaagggaaaggataggttcttctagagcagtgttctggacagatgatctttaaataatgcaaataaatcagccttcccttatagctcttctgaggactagccccccattcccgatgctggtgagccgatgatgggcagtgtgtcgtgcttgctcccatgatctatycccaccataattcctgctcctccaaaagcaaccccactgtcactcagccctcctcccctcttctttcacttccaagctcagcaagcccctctgttctgaccattaaaaccttcaaggcctcctgacaccaggtgccaccatggatgggatgtcaagcagggactctcaatagtgtggatatcgtgggtgaggggctgagggccgtctagaagggccaggaggcactttcagttgcctgagtccacttgcaaggactggccacagcagtaaggtggctgcatggaacacaagcctgctcattactctcctacagtgattgccttggactagggacctggggccttgtggccctgacactttatgagaaagaagtggaatccctaatttagtctcttcctaagcctgtatgtccccacatctgtggcatgtcaccatttcttctccttaatgctctaagtagtctacttgcctttgagcaggtgggctgaagaatggcaggacccgcagggcagcagcttggaatggaatctaccagtgcagggtgtgctgcctgaaagtgctggaaggagagatgtaatgatatagcctttctccacctcccatgggttctcacttaattgcatccccatcccactccaccccactgcattaccatatattgggtacmcactctactctagtcctaggtatttcgcatataccctgaggctaatactatcatgaactctgtggtgaaagagagaatatacatatgcattctgccttcagagaggattcaaattatttaggaagataagcaacagagaatagtaaagacagttgcatttcttgcgggaaaattcccaaactggtccttccaatagaaagaactctagaagtttgaatgtgggtgatctagtggggaaatgtttgtattatttgtcccatttgatttagctgaaataygtctcatatatatgagagagacagagagagaggaggctgggggaggtgggtagggtagagtgcctactcckctaatgccgtagaatgtttccaaaaaagagaagaagatgcattttggcctccaagcctgtgtggggccagagacaagttaagtgtgtctgctaagtagagttgaggaagccctcacgtcttgctgttagagagcaagtgtaaacatagtctctccatcagaaaagcctcagttataactcaatacccttgaaatctctgtaacaagtccctggcaggrgtgagattataatccatttttctttctgtagccaggtttcctgtttatctgtttaacccaatgagccatggtaacttcctgggaggtacatgatttgaggagctcatgtgctggctgagaggggcctggccaagactgggtttacccagggcctaaggagactttccggatgggatctccgtgtgaggttgctgcaaggctggttggttctgtaacgtgactggcgtgccccacatgtgcacaggccagcctcaacttttcctttaatgcatttctagtttggattagcacacatcaatttcagttcaattctgaacatggccattaagcatctattacatactaggtttttgtatggaatatggaattatctcaggtgtagtgtctgatctccaaagggctgcatccagcagggtgctctttggtctataaatatttagaatagaatggagagtgtgtgagagaaattgctctggctaatgtagagaggaaattcttaaaaaatcagggttttgaagactggttggcttttaatgggcagcaaagggaagaaggggtgcccaygagaaagaaacagcagcagccttgacctgggaaagcgaggcaacaacaagatatcttgaaagccaagttggcttcaggggacagggctcagtatgcagtggtgacaaggaaaaagtatagtctggtgaccgggtcagggagggtcctgattgctaatctgtatctcccaggccatgggaaggcatgaagatcaggataacaaggtacgaatgacttgaacaagggtcctaggacttatatgaagcatttaacccacattcaaaacgaggagtgagtggaaggcagatgttacttgggcactggagggagggaggcaggggtccttgaaagccatgattagaagttttttctattttaaccagacacctcccagtatcaggaatgcttgcgagtctagctttctataaccttaagacttctttcttccccatggtatccactaggaaacacttgcttcccaggggaaaggagggtgccaactgacatacaccaaagcttgtgcaccctctagtcctcccacctgggtgccttcagcaggtgggtcaccccaggaggggtagaacaagcagtagggcttaagtccggcttggaaaccagagacaagccagaagaagactggagactgctttcttctgagggtggggaaggaaggaagcaaccaagcccaacggcccacccccctgggccagtgcaggtctgcctgtgggtgtccctgtggacatcatcatgggacttattgaaggactcctctgatcctgtttgtcctttttgcagggagatctgtcagacctccagagttttatactctaaaatgggataatcttcagctcagtgggccactcttgcccattaccttctgtcacatcaggaataccctgggcctcttagagagtgtggccttatctgaacacagatatcctgcccacccatctctctcccacccctcgtgtataacatcaaagcttagatatcctcagtgacttctttctggtttcacaggaaaccaaatcctctgcctacctttctaacctcagcttgtgtcattctcctccttgcttagaccttccagctacccaggccttcattctgtctcgagctcattccagcctttgccctggttattcctgttgcacagactgcttttcccccagactctgcaaggcctgtcttctcggcttttgtgtctcagtgaaaacattgccgtcttcagattggcctcccccaactccccaatctgaagcagccattctgctttatttcttctgctattcttatcctcatctgctagtttctcattcgtgtgctggtttactcactgtaccttttctctacttggagaaaagttccagggaaggagggatcttgtgtctaggactggcagtatagcctcagtgcctggaaagagctcagagtwtagcaggtgcttgatgactcctggttgaagacatttgttggatgtatctctggacttacctctttacatcagacaaatgtggtcctgagcaggcttgggttcttcctcccagctggctcctggggagactgaccacgtggaaacagttcccagagtctcgatgggaggggtgatgatctgtgatgacttggtatcagataacccatccagtgctgttgtgtttggggaacatcaggagtatcaggctgatctgcccgtggctgggtgtgtcaaagcagccctcccgggggctggattctgctctggccaggagctcagttgtccaatttgagggattccataacctcaccccacttgcttggctgcaaagagggaggtccttgtcaggcctgcttcagctgagtgcagcgcagcctgtctcttctttgagtttcggattcttgtctgagtgcttaggaagctaggcttgctttaaaaagttaagggttatggccgggtgcagtggttcacgcctgtaatcccagcactttgggaggccgaggsgggtggatcacctgaggttaggagttcaagaccagcttggtcaacatggtgaaaccccatctctactaaaagtacaaaaaaatcagctgggcctggtggcatgtgcctgcagtcccagctactccggaggctgaggcaggagaattgcttgagcctggaaggcagaggtttcggtgagccgagatcatgccacagcactccagcctgggcgacagagtgagactctgtctcaaaaaaaaaaraaagaaagaaaaaaaagatgagggagctttgaactggggcccagcatggggggaggtgagccacagccacacctagagggattcaagcaaactcctytgtgtgctgccacatcatgtcctggaaagccagagataatcagaaacatcctgtcggtcagctgagggtgcctcccttagcccctgtgcagggtctggaaggggagaggctcctctggcttgaagagatgtagaacccatgttctggaactcactgaaagatactgctaagtttttaattaaaatctcccattggaataatgtagaagaaaagcaaccaaatttcagaggccatgggggagaacctcaaaccatacttctctaagtattcctgcaggttattaattgttacaggcaaaagttgctctgcgggaaatgatgtgcttaggaaaattaagcaagcttcttgacagtagtacttttcagagttttgaatgtgctcactgtgactctcagaaagtcgatacgttctagtgttttccagtcttttagaccttggaatccttttttagctgaaattctcttggcacacacattaggaaatgctgtgttggagaacggatgaaggtgagagacaaaatcaagtgcactttacaagcgttcagagatttctgtgtgttctgcatggtgccaagtactgtgcaaaacatagaataatacagagcaggtagctgatctttatgttaggataagaagactctcacatgcaaaacagcgaggaaaaaataaaagaaaaatatgtaatgaagatctacagtgtgtggtataagctataaaagtttcrgaattcagagagggaggagaccccacctggtaggtatgttgcaacagttggagaagtcctcctggaaggggtgggactgacgtcccctcggagaatgggtgaggatagaatggcaccgcctgcagttgttttakttatgcttgttagtcacttacatggtctgtcctctcctgcatcatggygtgtcttgggaaagccagagacaggtcaaaagcctggcccgttgacctttggaatctctgacatatggacagggataaggacatgtgtgttccctgaatggcagagcccattgtgagccagtacctgaatccctgcccaggagttatcgataaacgatgcaggaacatgaagtcctcacacctgtagatgtttgttcttgagctggaaaccgtaaggaagacctgccaatgaggccaggtgtacacagttaaattttctttgaagtgagttatgcattttcctaccccggcatctgcactgatttgaccatggtcctctggattagttaggtgctctttcccatgcctggtgactcacaactcaggtttgtgttgctgaatggcccagtgaggtctcttgagcattgctgttacttgccaatgagttactcaccgaggctgcacaggaaacaggtccaggcaagtgagttttaagattccctatggccacccttgactttgatgtttattggtcgccattttagctcagagaataatggagcagggaaggagttttgttgttgccctcactcccagctgtggggcacatctgtttctccagctgggagttggcttgttgaaagttaaagtttgaggtctgacgatagttggtgggatgaccagggatatccctctgcctctggtgaaactgctctgcaaagcactgggcccctcttcgtatcagccatccagttaacatttcctctctttttctcaacaccggcgctatccccaggaacgtgcccaggtttggttttcagtgtgataacgagtgttgtgtgtcccttgtctcttcctcacgttgtgttcttatgttaggatgtgatgtctagatgccttgtgattgtgtgtggtggggcagttcatatccaatagcatccaatcctaaacgctgacgttaatgtacatgtgtctggttataaccctaaggccaaggtsattcttccttttgtttactaaccactcactgctctttggtttaggaacattccaggcctgagtatgaaaccaaagttcgagagaaaatgctaaaggagagcaaccagkctgctgtccagaaattggaaacaaacacgacggagtgtggcgatgaggtatgaagctggacttgctgctcacggtcctctttacttgttgagatcctgttgtcattttgtttggcacgccttagtgaagggagactgggcttgagaaggggttgatgtggggcaggatgagatgagagcatgacatctcgcattgtcctgcagccagagatcatgggcaatgggctttctctatgacttgacctctctttccagatagcggtgctatctggtcaaaatgggagggcaggttagaggagaaacagtttcaggcctgattcctaccatcatctaaatattgaataataataacattcaataccccaccagaccaaccaccaccacggctaatccttatcgaacgcttgctctatgttagacactgttctaagtgtattacattatctcacaataagtctgtgaggctggtactattgctatgtaaatgaaggctcatgaaaaaagttatgtccacagattaagtcatttgccagaggtcacacagccagtaaatggtaggtggatctgggattccactgcaggtctattagtctgtgcctctaaccgctatgccatacagccttcaactgcaatgggaaaatcaaaggatagaacaagaaatggctcttagggcctgcagtggcaaatacatgcctgtatttgctcaagctacttgtgcaatgttccttacatttcattttatcttggtggacctccaaacgtggaaacatgatggtgaccatgtcctctgagtcatgtctctcagtttcatggtggcatgcagtcattaaaacagagcttcagaatttgtgctgtggttcgtaaaaaaactcagagtatgtatgttggggggacatggggatgctctttgggatacctgtctctgtgtgccaccygtctttgaaagcgaggaggggtggggagagagagagagagaggagagtttatgtctttcttaatctggttcttgaaaaaaaattccactagattgaaaatctgttgcttttagatgtgtcttttctccatcttggatttgaattcaaatttcatttcatttcacattctttaagttggaaccattcatgttaacatgcaaatttatgcaagcatcaaaacagaagaatgtggtgttttcgagcccaaaatgctggcatttttttttttttaagaaaacagaacttaaacagaacagagagggtggccctctgagttattttttttcctagacgaagaccaagtccaagaccaccaattattcagggaaataatgaattcattcttaggaaagactaatcatcaccgccaccctcatcagaaagcaagcattctgtgttctgtcagcttcggcaacgccgtgcaaacttctttctccaccccatagcaatatacaatggataattttatggaaatcacatgtaacttttattgaccactgactcattgaattttaattccatagacgggaatgccraggaaccggaattgtgtacactgaggctgtggttctaatataaacattgcttgggtatatatgcatgattggtcaaataactttcaggaaccatgaataattaaaaaacatctgaatgcattatgaatgatacatatgtttatgttttagcattcaacatctattttcattacactgttgagaatgcaaagctcaaagcatctaatgccttatgggcactggggggaaatgaccttctcaaatgagtagtgtaagataaaaatggtctagaatttgattgtcaggatccttcttgtgtttcctcagtttctttaacattgttaatgcttctgttcttgccaaatccagccataggtgggagataaaggtggatgctgctcttgtctgcaggaagagttgtagtcaatacccaccgcatagcattgctgcaggggcatcattgcatgtggaatgtttaggaaaggcacctgcttctgaggaatagacagggactaaagaatcaaattctagctggtggtcttggatgtgcttgtctcaccccagaagatcaccttggttctgccttcactgtaatcctgatgctgcatatcctcacctctccttactttccttcctgttgaatggtaaaaagctaccatttactgaggccyagagtggtgcgcgaatttgcttaagaccacgtagctggttgtggggaagctggtaatcaaacccagctctgcctgatccccaaggcctgtttgcttttctttttcctttttaattttaaagataccaagtccgtttactttttaaacatgtttattgagatttaattttatacactaaaattcacccatttaaagtgcacaattcaatatgcatatttttatatatgcacaattcaatatgcatatttttatatatgcacaattcaatatgcatatttttatatatgcacaattcaatatgcatatatatgaataatttttagcttattcacagatgtgtgcaattatctacacaatttatatttaaaacatttttattatccgaaaaagaaaccstgtacccaatagttgccaagccgtgggtaacaactaatctactttctgtctctatagatttgcctattctggactttcacgtaaatggtattatagaatatgcggtccttagcttctttcacttcgcaacatttttttaggattcattcatattgtagcatatatcagtacttcgttcttttatattgccaaataatattctatattgtggatctgcttcattttatttatcgatgcagttgatggwcatttgggtggtctctacttttgggctattaggaataatgctgcaatggacatttgggtacaagttttttttttttgccgtatgctttcatttttcttgggtatatacgtaggagtagaattgctgggtcatatggtaactctatgtttaacattttaaagaactgccatgctatttttccaaagtggctatattgttttacattccaaccagctatttaggaggtttccagcatctccacatcctcaccaacacttagtatctgttttttacattttatccatcccagtggtgtgaagtgatatttcattgtagttttaacttgcatttccctaatgattaatgatgtgaacttcattagtggtcattaatggtcatttgcatgtcttctttggaaaaatatctattcaaatcctttgcctcttaaaaatattgggttaattggcttttggttatcaggttgtaagagttgtttttatatttggaatatatgaagttctttatatatttgggatataagaaattctttatatatttggattaccagtcttatcaaataatatgatgtagaaatagtttctttaattctgtagattgtcttttcactttattgaaattttgaattttgaaatagttcaatttatctaattttgttacttatgcttttgtgttatatctaagaaaccattgcctaatccaatgtcattaagatatttctaatttttcttctaagaattttatagttttaacacttgcagttaggcctatgatccattttgagttaatttttgtgtatgatttaaggagggtattcaaatgtatttttctgcatgtagatattcagttgtcccagcaacatttgttgaacagactgtttcctcactgaattatcttgacacccttatcaaaagtcaattgaccataaatgtaagagtttatttctggacatcaattagattccattgatctatatgtctgttcttatgtagtaccaccctatcttgactgctgtgcctatatagtaagttttgaaattgggggtatgagtcctctgactttgtacttttttttcaaaattgttttgaccattctgggtgttttgcatttccatatgaacttcatgactaacttgtcaatgtctataagaaagcaagctgggattttgctagggattgagttgaatctatagactaattttggaagaattgccatcttagcaatagtaagtcttctatgaatgtggtatatctttctatttacgtagaccttttattttttcaacaatgttttatagttttcagtgtacaagtcttgtacatattttgttaaatttattgataattattttatttttttgatgctattgaaaatatagttttcttgattttatttttggactgttcactgccagtatatagaaatataattgatttttctatattgatctggtatcccataacttttctgaactcatttattagttctaataakttttaatggattccttaggattttctatttgtgagatcatgttatctgtgaatagtgatagttttacttcttttttccaatctggatatattttatccctgcttgctccacccatttcctaattgccctgattggaatctcctgtacaatgctgaatagaagtggtgaggccgggtgcggtggctcaygcctgtaatcccagcaccttgagaggccgaggtgggcggatcatgaggtcaagagatggagaccatcctggctaacatggtgaaaccccatctctactaaaaatacaaaaaattagctgggcgtggtggcgggcgcctgtagtcccagctgtttgggaggctgaggcaggagaatggcgtgaacccgggaggcagagcttgcagtgagccgagattgcacgactgcactccagcctgggggacasagcaagactctgtctcgaaaaaaaaaaaaraaaaaagtagccgggcgtggtggcaagcacctgtagtcccagctactggggaggctgaggcaggagaatgacatgaacctgggaggcagagctggcagtgagccgagactgcgccactgcactccagcctgggtggcagagtgagactccgtctcaaaaaaaaaaaaaaaaaarrgaagtggtgagaatggacttccttgctttgtttttgaccataggagaaaaaaatttagtttttcaccattaagtcactgtaagtctcatgttagctgtaggccattgcttttttttttttttggtttgtttaaaactctctctataaggtttccctctaaggccattcttgcattgctataaatacccgagactgagtaatttattaaaaaagagaggtttaattggctcatggttctgtagggtttagaaaaggcatggtgctggtatcttcttgacttctaaggaggcctcaggaagtttataatcattgtggaaggcgaagggggagcaggcacgtcacatactgaaagcaggagagagaaaaaggagtgagttataggkgaggtggtgccacacacttttaaatgaccagatctcacaggaactcactcacttttgcaaagacagcaccaagccatgagggatccacccccatgatccaaacacctcccgccagtctccacctccagcaccgaggattacaattcaacatgagatttgggtgggaacaaatatccaaactgtatcagcttccctgaaaacaattcacatctcatgtacatgacactgatctgtaatgaaatgctctgtactgtaatgaggtgataaccatatataaggaccccggggtaggagttatggtaccattaccaggcagctgagccttctgggtctcttccacctcagctgtcatgcaggtagattagattacacagcctctccagttctgagagtcagtctttgctgatgtgcagagatgatgttggtcatcaacccattggtttgggggattggactgtctcttatttatttatatggtagtaacttagctcttataccttctcttattgattttcaaggatgtgggcataggaggatgttaataatgataaaattataagtaacatttatggagtgcttattgtatgtaatgtgcaaagctttacaggtattatttcctttattatttccattatgatccccaactcacagatgagaagactgaggtctataggggaacataagttgatcaatgataatacatggcagagccagagtcgaagccaggcagtctgactcaaaagcaatgcttttaaccycttgctcctgtgtctgctgaaagttttccttcaatagatcctcaaacactcctaaaaagtcatgtttgattcttctttcctaaactaaaggcagaaaggactgtggtattcactggaaagatgggtgagagacaaattcgctaccccacattagtggttttgtgtaaattttagtggggtgatgttctatttccactgaggacaacagtggggagaattagctcagtttactgctagagttcaacagacagtagggaaaattcaggaatataaatataggtatagattgtgttttcaagaaagaatactgagtccggaacttttaataaaagaatagcgtggattttttttttttttcctaaatcagtttgaatcttttctagactgctgtatcccggacacgtttggaggttttcttaagtttccctgcaggtcaccaattctctctgttcctacaagatggtaaagctctaagttgagtgcagatggcaaggtgctggagctggcaggttgaggagcagtgctgttctttgcctctcatccctgtaaccattcactcagcactttctcagctcatgcctcctttgmttccaataaactttctattagagtacagtaagaagacaaaactcattctacgtgggtcagcagagacaatacgaagagctaattctaaaggtgttagaagaagggatgttgaggcaagcaggacagtgaggcagtagagagattagcatggcaggaagtgggcaccaccttagggctgcaaggacaggagcagagctggccttaccagagcccaggagccaggaccacccagtgggagctggaatcccagaggagatgccatctgaagcagatagaagaagtaaaggagaaataccctggatttcccttttctgccccccaggctcccatcattacttcccattggccagacctaaccaaaagtcagttgatgagttattcaaggaaatatagtttttggggtcagcacagagcagaggaaaggaacagcagaatctatctgaaagcaaccggcaaagcgctggcacgaaagtccaggcaataagtctatgtaactttagaacccactagccacaaatcatttacaartggggtccttggttggaggttggagaggctatcggggaagagaaataaaaatttgacaagaagcacaggaatgctcacccctgacataatgaataaatacaccaatggtcagtttttcagaccatccctgaactgttgagagtgtttgagcgggtgtgtgagagtgagtcagtggcatgagcatgtgtgagattgtgttagtatgtatgtgtgtggatgggtgagtgtgccagtggtgtgagattgtgtttgctgtgtgtgtgtgtgtgtgtgtgtgtgwgagagggagacaaggagagggaccatgtctgagtgatggtgtcattggagtgacacagatgggctcagataacagaaagcttcaaagaggagcaaagatayatttttgtgtcaagatgcaaagaacatgaacaagtagagatggggggctaatggcaaatgtaggtttcatacttctatgaaacatatcactgaaaggactttaaaacaaaatcctatttaactagtcctgggagattcttcatggaacttgtcacctacatattgatttagccagtgcgcaggccccggggcccccatccctacctaagccacctgcagtgctcatttaatgaatgttttatgttgagcactgcagctagaaggggacaggagcctagaggaggccgtggatagaggggtgttaatttactgctcagttcatcaccctggggacaattatttcaaaagaaaactcatctaaagttaaagcactgaaacatttacgacagacgcctctggcaggcacaataaacaaacacgtggaataaattatgcataattgttgggcctttgcggaggctgtgacaacagcaacaggaagctgggacattgttggagcatgcgcgtgggtggagaagggagtcccattgagcaggggatgagggtccctcttgcctcttactctgggcccagggagacatggtccaggctttccacgcaggcttcgggtggtttatcagttctttgagtagakgaagttccctcgtgccctcttttgaggcactaaatgaccgaataaccacttgagggtcaaaaacataaagaatcaaaataattatcgcagcctcttcttagggtttctcgttggcaaagggaaacactgaggcacagaaagagccttattttgccagagattcttgtagtaaaagagaagctgaggtgagatgtgagcctggttatgtttctgaaatctgtttatggcctggtggttaagggccctaagcatccttattatatgggcatttcatggactctggctattaagggctgaattaggatacctgggacctttgttctctcctgtacgcctgcatgagctgaggaagaattggcagaaaatggcctggkttctgtcccaagctgaagggcggttggggagtcaagcccctgtgctctcagaccagtccctgagccggtctgataagggctgagaagctgcgggttggttcagctctgcagtcctgtgcttcagaggatctgtgcacactgccccttggccttctcatatttggtaataaggacacttcatttcaggggacaygtagctccctggaacctgtgtcacaaaagtggaattgttgctgaaggctgccccctgacaattttatgtactattttttaaacttyagctttaattttttatttttgacagtgcatggtttctgtctctggctcctctctctctctttctttctctacccgcgcccccgccccccacccgccctgccccttctctgtaatttctcatggagtggcctcctttttcacctctggtcccagtcacatccccagtcactccctggggcaccccagccaagagaaatgggtgagtaggagaagagaaatggatgtagcaaggaaatgtatgggtagagatgtgggcagtctaggatgtggatctccttaggggtactttaggacttcaatttagaactggatcctgcctcccttcccctcattggcggaaaccagccacaaggctccacctggatgagcagaaggcagggaaatacagtccttgcctagcagcctccaagcagcagctccaaaccaccaaagggagagccagccttcacggccaccacatcacaccgcaatgtgagtggactgtgagcagctggactctggggaggtggtagcagaggcagttagggaatggctactggtgattctgattgactaccacctccggagaattgctgccttgggaaatgagaaaggaagaaaggctcttgaaaaaaatgccgtaaggaatttcagtgagtgagccagaagcgctcatccacagtgtacccacagtgtgttggagtttgggactgaccctttmtaaacagaatttagcactctcttacatggcaaggttgtttgttgttgtcgttgttgttgtttataattacacaagttatacatgaaagcatcttcagaaaaattctgacaaacgcctccctggacctacctcttttcctcccaatgttgtctccttaaaagcagccggagctagcagtttggtttgtgcccttccaggtcttttctcatgcatttttattcacgtataaattcatatttgttctgggctctggttgtgggtttatttacgygtgcacacacacacacatacgaaagtcatggacaaatgatttcatcagatcgtggttcccaataacccgagacaccccagggtgccataggaaactcacagaagtgacatggaattactaaacatttcttagggaagcccagcaatgcttgacatccgtacaccgccacacagtattacctcagcagtgtcaatgttctatagtactgtttttagtttttattttttatttttttgagagagtctcgttctgtcgcccaggctggagtgcagtggcgcgatctcagctcactgcaagttctgcctcccaggttcacgccattctcctgcctcagcctcctgagtagctgggactacaggcgcccgccactgcgcccggctaatttttttgtatttttaatagagacggggtttcacygtgttagccaggatggtctcaatctcctgacctcgtgatccacccgtctcagcctcccaaagtgctgggattacaggcgtgagcccccgtgcccggccagtactttgttttttaatgtcatcatgttttagtgaagctgacttttctgtggttgcagccagtgagaactgcacaaaatcaytgtggaacaggaagcatgagtgttgctgttcaatctgataccaagattagaaaagttggaagttctctaacaggtgcacacatcctgttagctagtaattaggtttaagaatgaaataaattattattgtttatttcaatttaygcatattttccccaatggctattaatttgttaggacataaatatttattaagttatttggacttaactacttaacacatggaactgttaagtatttcttttagcctaagagcattgcataaaagttgctgggaccttaagggtactgtgaaccaagaaagtttgggaacagctgcmtaacgaacttcctaagttgggcgcagtggctcacgcctgtaatcccagcactttgggaggctgaggcgggcagactgcttgagctcaggagtttgagaccagcgtgggcaacgtagtaagaccgtgtctctacaaaataattwaaaaatatagctatgcatggtggcatgggcctgtagttccagctactcgggagcctgaggcargaggatggctygagcccaggagttagaggcagcagttagctgtgattgtgccactgcactraaacctgggtgacaaagcgagtctctgcctcttaaaaaaaaacaaaaaaaaaaaacccaaaaccaaaaaccaaaaaaacttttatgttcaacagagatttaagagtaaagcagacagccaagagcagaaagcttaaaaagataaatagtgagttttaaagttgcaggaatttatttggggatggcaacagcctgtggaaactgtgggctaggaaagtgccaggtgggctggcttcctccacacttgctctttgggcctcccacggacttctctcttgggccttacagtgcatctgccccagtgtgtatattctctctctcttattgccgtctctgcatgtttgtgcacacgtgtgtatgtgagtgtgcatggtaggagggcactgagggtttctcatcatgggcacccttgtaaatccttggtatttaaaaataaaccctacaacttctaatccaggagacgttgctttacttacaatctccagcgtggttcgggcttcatggagaaggatgccagagatgtgtagaatgcgtccataaacatctccctgcacggagcctgtgaattacgcatcccaagtagactcctcgggtggcccaggccatcagatggggggccctggtccacttcaactgagagttgattcttagcatcaggagttctggctaaaataagaccttctsctctgctcactgtatacatttctactggccagggtctaaattaggaagttacaaataaggagagccctgaggcctgggttatggaagcaaagctatagagagagacagggcagcctgtgaaatgagagagcagtgggggaggagaagctgtggatccagmctcggagctaaggctgggcagattcaggatggtatttcagaccagaccctcatggcttctgggaaaacacaagacccaaatatgtgcaatgattgggaatgttggaatagcgtagttgctaggagaggccagcacataccattgggatgtgagatgttaggcacaattgacttgtagtttggacttttctttttttggtttaaatgatttttccatatatggccagaagcacgtaaattaaatttgtcttttgctgtctgggccaaggtcgttatttcacttccttagaattcactggaaacacacacatgccctccaggttcccttgctctttctcccttaatgtgccagaaactcaaaagtgctggtttaaaaaattcctccagggtcaaaatgtgttctggctccctgcgattcttttgatatgatggtcaaaaggagctttcaaagaaaactgacgggattgcccttttgtggatggagacacagaggctttgagactatgcgcttctgacaatcattgcccagctagaggttgcaaaaacctccttctccatccaccaccacagcctgctcagccatgctctakctggtgagaaggggcttactgtccaaatcattgcagtcctgtcactgaatggaccccacattatttccaagcattactttaactttcataaagaataaagaactagcttgaaaaaaaaaatgtccttactttggattctcccagatgcagaccctgagccagtgattcaastgcaaaattctgggggaggtagactctccagtagtggagtgagcaagtgagagagacaagggaaggcagcccagaaggggtgcttggtcaatcaggttaccaccgtggacaactcaaccggagcttagttctcctgggaattctgggagctgattcagaacgtgcactttagagtggtattgcatgaggggtgagtgtctcagttggtttctgctgctacagtgaaataccttagactgggtaatttctagacaacagaaacttatttctcacagttctggaggctgggaaggctaagatcaagacactggcagattcaatatttgataagggctgttgtctgcttccaagatggtgccttgttgctgcattctcacatggcagaagaccaaacagcaaaaggacactagagtgcttccttcttttttcagatcatgaatccattcatgagggcagagctcctcaggacttaagcacttcttaaagacccwgtctcttaacaccatcaccttggggtttaagttccaacatatgaattcttcagggactcatatattcaaaccagaacagtgagagagctgagtttatgtgaggtcctgtcagtcactgttatgggcagctccaactgtgagtgtgtgagtgtgtgagtgtgtgtgtcttaattctcctgcacttctagtctgccttgaacgtgcacatgggaagagaaggctcaggccaccaaaaagaaacctttaggcaaagaagtgaaggcgctggcagttggaagttggactcaaaattatcctggtaagctttkagggaatttggagcagacactaacggtatcagggtctcctaagtcctaaagtgcatgagttaagatctagtcagacaatcagcaatcctggagttcagtggagggaatttaatacacggagctagctaggaaggtgtyagaagggctgacaagctaaataaggatgggcaagcaacccagagacagcatcagcaggaagctgcggtacctcccatcagtaggaggtggcccagcgccaggtcctctagtgggaactggaaccatgcaggaaactgcacggtggaaattggggccgccaagggaagggcagtccagcaagtaatggaagtatgaagagttacagccactgcatgaagcacatagagagaggagagggaagctctgggttccccttccatctatctacctgccaatctggcaccagtaccttccattgactgaatctagccggaagccagttggcaagggattctgagaagtgtcccttcggagatccactctgcttacattatgtattagaccaggaaatggcagatgtgggggtaaacaggaaaatgattggcactaattttaatcctttacctcgcataaacatgtgctttcctccccccacctcctttgttctttctactactcgactgttggctttgtcatctccaaagcagactccaggaatttctatggaygttgggtgaactacgtttttgggaagtgacagatgatagaatggggaacatgctccaaacccttgttcacccctgttctgaagtatcccaggggctgttcctgtgccttgggcacttctgttcagcagcagaaggaccataaacttcctgycttgatcatgtggggtctttgaggaggcaccacatctaaaagatgccctttggcagtttcccccttacttaggcttgctaacgtttgatgtttttgctctgtttcagtgagggacatgtccttacattctgaagaatatgtttcagaacgtggagcacatttgtgttctttccctctcgagctattgccatttagacatgttggctttttatttattccataaacccaaatgccaagatgacaagaaatagcaatctgaatctgtgctaacattcagctcccccatcccggacttccatgtgtttagtggtttccttactgattctccmaaccttactggaaagaaagaagcctgcccatgtggtccgctcttctttcagatggggcagcccaagtgagattgtcatgaataattgggaacaaagtccagaggaaagctgatgtaagtcaacagttccctgggttacttctttagagttggctccatttgggagccaacttaatccgtaatattccccaagaacacaggatctgtatttccacttttgtttttttgaacatccaagatcagatcaatggatgtatttaatattcctaggctcctgcctacagtgagaatgatgcgctgtcattccatccaggccagatctggagtacaaggtgaaatacacactgaaaatagggtcagtggaggtgctaactctggaggcaagaggattgggtgctttcatgggaagggtaagctcaggatgttaagttacttacgtatcttacagagccttcaagtttrgggaactggatcagggtgttgcagggagggaggtgatctgtaatttaactaggcttctacatctctaatctctttagaacaaacctctgagacaagatgtccaaaaccaactcccttggggtcttccttatttctgttaccttggctttcaggggaaatccctgaggtacgattagaagagaacctctgctatgcaattccataccctctgggtcaatttgggcattccattttctctgacaaatgcgcaccagcttgtccccagcttgtcctccaactggtaggaggtgtgggaaggaagagcaatccaagggcttgctctgtgctgggcttctgcacagttcccacatactcttcatgcctgttgtttctccctgtcagaagctggctgcagcacagcctgagctgaatgctggcctttgcggtgggatggtttgctttaccagtcattctttatccacagattgtycaaagtcaattccacatctgggagctgatgctggtgcttttcctaaaaaatacttctcaggtttttccagcattctgatgccacattcatgcttttctgcatcatggtttcatttatgcttggtytagggycgtgggcctgtattgatttccacagcacctttgggccatttatgcaactgtggtgggagatattttacataagcttggaagagttactgcccaaccagggccaagaaattcttctgcccatcaatggcccagagtttgtccacctctgggcctgttggatacagcttcgtgattctccaggaaggctagacatggtagtgttcagttgcctgtagacatttgacatccaattcatttttattataatggtgcatggtctatcggccagcttacataaattttctcctgaatttgggcatctgcactgagtttagagaatttgtggcaggaaatttgccctggaaatgtactcagctgaatacttgcacttctyagcatggaaagactcccatccaagaatctcagcatgcttrtctataaacatgaatgaattaatcctcctagcaccactgtgtgctctttgccagctgggttattttaagggaagtgaccaacccagcagcctgtagtgagtcatgaaacagcgtgctgacaaccagagagactggactgcaggatggaaagagccaggggccacactgcagcctcccacctccastgcttgagtgtgaggaaggggtcaatgattaacacaataactctgggatctggccaccttytggctcagcacatcctccttcaaggagtttatyacctgccccctagaccatggcttagtcaaattaaatagyttttattttttggagtataaaaataatatgtgctaagtgtggaaaacctaagaagggaagtaaagaataaagaagaaaagtaaatcagctattatttcatctcctaggcagaccactataacccttttttaatgtaaattgtaatattgttgaatacttaactttgtatcatgattttaaaaattagtctcagaacataggaagttgtcaatcttattaaatatggtttattaatattatttcaatagttgcccaatattttatcatgtggatttattagtccttacccaatggttaaacatgtcacgaacatacttgtgcttatgtttttctcctgaattctgggctatttcaggagcattatatcaggtggatagattaccagaagctcaagatctttattcggtttctgggttcctctttgcccatgcttttgtgctgtctgcaggaattacacagatatgaccctcaacacatcaccagcatagaggggcagctttcgtagaattgcctttttgtcaccgcttaatcacgagtgaagtcaggtcacttaatccatgtccaagagctctcccattgacagttgcctttcctggacagcaggaggctgttgctcttcttgcatgtgtcactgagagaacagatgtcctggagcatagatgggtcatcatcttagatgttggggtccaattctggctagggagaaatttatctcatcctgggaatgggtgggttacttgtatcaaatcctggaactgtccacatcttctgaacccatcactaatgaagaaagagaattctggggcaatggatggatcaagagctcttcaatgaaggtattttatcagttggactaaggccaggttttggcaggggagtcaatgggacaaagggtgagctgtggctttatggctttagctccaagaagaaatgtgtcccggttggtaaatgattgaccgaaaaatgtatgaaacycccttcagtaactttaacttctggaaacaatttagaggacaagtagggtcagtctgacttccgagaaagggaacatttttcttattgtttggatgccgattttttttttcaactttacaacatgtacacacaaacagtgttgacctatggaaaatattattaatccacagaagagcacttaatacatgctttaatatgatgttctttactttagtaccattcttcatttgacagtgaactcccatcgatagtcactttatctccccacagaacctagggtatgccttcacacccttttgttgaatcatgaaaatgcagcataaacccccaaacaaatctgatagggctctttgaatttggaatgtgttttatgcttttccttacctgctttcccggttgtatatagtttaggacggtggctctgcacattcttaactatcgcacgttgtgaatccaaactgggcacctttgaaattctgaaaatgtaaattcttaatcgtgtctaaaataagtagatcttattaaaagggaagaagaggaggaagaagaaggaggaggagaagaataaagagaaagaataggaggagaaagaggagcagaaggagcagcaataactactattacaacaatagcaataactatggaccacagcgagcaccatattgaaacccagttgtgcatattttttagcctttatcccataactggagtgttccatgctatttctagctctctggagacacaggcaggaaacaaaggtggcagtggcacccagcttgtcagtcgtggtgcttggctggtgtttcttgtgcgtggtgtataacctgccacggccttagttccagctagagatgctggggccagtctccctgctttctctgttctaatttaatccatgtttggaggataggaaggggaacgcattccatctgagtttcctccttgaccttcctttagactcagagactcggacacataagcagagattgaggtctaatgtgaatttggctaaaatgattctgtgtccttcaagcctttgccagacaaagttaactctggagtgatccggtagagtggcagataatctacttgtaggaaagtgaaaagaatgggccagaactttagacaattggcagtgtaagagaatataggcaggccgaggagaagcggggaagttactcagagtcacaggctttgggccagatcccgatactggattttgtttcttccagttttaacatctctccttctgtctcctttctctggcagaagtggagacctggcagatagagggagggcctgaggtggatcaccagaaaaatgaggttagcatctttgggccagctgagtcctgaggggaagggtggagatgggaacactcgttcccctcagtcctttcagcctattgggtagacagaggattcaagattaactgagtttcccttgttttggattcagcagaaaggtctggcaacttgaaatctggaaggtggttggactgccagtktgagtcttggtaacaacagttctataaacaagccaggagttcccagttccccagagcccaccgtgtgtcatcgtccagctttcttccaggaaggtctataaactttctgtttttacactgacccctcttggctatttaattcctgtgttgtcacaatgccgatgacaatgttggcacccagggtaggggggatttagcattgcccttagccacctgccaaagttcctccaaacaggaaccatcacttagccctctgctttctggaagggaatgtttaaagaacttcgagacccacagagaactttaaacactaaagtttatctcatatctatatacgtggagtaaaaataatgttaaagaagtaaaacaagaataaatgcatgtggttcattcttgttaaatgacaccacttttgaacaacccagttgtctacaccagaaactttggagctgttttgaattgctcctttcctcttacttgccacacccgacgagcmccatggcagggttgaaccactcaccatctctggtatttaccccttcctgctcatcccctgagttcagggcctcatcaccacttgcctggcctacttcagtgaccctctaactggtctctcctcctttgtcaggcccccttccagtccattctccacactgtgtcagaggtatccatccagaatgcagatctgattatgtgactcccttgattaaaatcctctcatgctctccagagtttaggagattattttcaaatttcttggctttacccacaaggctctatgtggcccacctctccaacttcacctcccactccctgacatgagcctcttctgccgaacatttcccagctcctggcagctctctgagcgtctcttggtgtgtcatgcgttggtggctgtgcacatgcaaaagcctctttgcttggaacctgctttccctctctctatccagcacactccttcttgtcctagaaaacttagggctaatgacatctgctctgggaggtcatctctcactctctgggcaggcttagctcttggctcttgtattcatctcccatggctgctgcaacaagtgactgcaaacgggagggcttaaaacaacacaagttcattctctcatagttctggaggccagaagtccaaggtcaaggtgtcatcargcccacgttccctctgaagtctctaggagagaatccatctttgcctcttccagcccttggtggctccaggcatttcttaaattgtggctaaaccactccaatcgctgcttccatctttacatggctctctcctgtatctgtctcttctcccctctgtcacttacaaggacactgggaagtagactcagggcctaccctaaatccatgatgatctcatcttgagatccttaacttggttacatttgcaaagactttttttttttttccaagtcaggtcgtattcacaggttcctggggttagaacccgggcctatcatttagtgggtggagcacaattcaactgcttactaccctgtagcaacctgtatattccttttaggagaaattttactatagatgttttaaagcattaattgatactcctatctttccttcaagatgaactatctttgagagcttctgtttgaccttgtttctttggcttctagcacagggcctcactgcagctcggcacaacattttggttaaatgtaagaaataactacctaagggccgttagtaggtccttatcattaacttgggctgatatacgtgtgyttggagataggatttggacaccatgacctctgaaaagcctgttcagtcaagaagtctgtttctgcagttttgtttgcttcagaagtacatttttaggctaattgatttcaaggaatatccaaaggagggccttggaatattacaaatcatggggaggaacccaaactcgttaatctacattctagtctgtattgtctaatgtatgatgattgcgtgcacattatttttaaagttcccaagtggctgaaagggagcagtttcacatttttgagcatgtacaggcactgtctggattccccatatttcaaatgagagcttggatttcaaaaagaggagcaggtcttggggaactggtcagtaaattaaagtgtcttacgtatatgagacctgcaatttttattctctgggcctctgtatgaattagttttgcattgccatacagraatatctgagaccgggtaatttataaagaaaagagattcatgtgkcttatggttctgcaggctgtacaagcatggcaccagcatctgcttggccgctggggaggcctcaggaagctttcatggtggaaggtgaagagggagcgggcttgttacatggcaagagaggaagcaagagagggcagagggaggtcccagtctctttaaccagctctcacatgaactaatagagtgagaacttgctgatcaccatgagaatggcaccaagacattcctgagggatctgccyctatgacttatacacctcccaccaggctctacctccaacattagggatcaatttttttttttttttttgagacagagtctcgctctgtcgcccaggctggagtacagtggcgcgatctctgctcactgcaagctctgcctcccaggttcatgccattctcctgcctcagcctcctgagtagctgggactacaggcacatgccaccacgcccggctaattttttgtatttttagtagagacggggtttcaccgtgttagccaggatggtctcgatctcctgacctcgtgatcccgcctcggcctcccaaagtgctgggattacaggtgtgagccaccgcrcccggcccagggatcaatttcaaaatgagatttggaggagacaaacattcatactctatcagcctcagtttattttttttctttaaacagaattgatargaacatgactcccaacttcttgattctctctctctacttgtggttagcattttccctagaagtcagaactcccatgtaccagtcagtctccaaatgattcatgtggccctactgtgtgctatttccttatccataggcctggataaataaagccgtcctttgaagatctcatagtactttggaacatgaagtttacattactcagagggttttcatctttgtttacagaaggcaaatgtgaaaagcatttggcaagagacttccagctcctgtttaaccactgcctccattctttgaggtctccccatcccaactgacattaacaagcctgtttatatgaaacaatctattaaatcaaatattcttttggaaatgtgggggtgggggatgcaaactaattctcagtgcttggtaaactatttacaagaggcttaagtgttcttggtcatctctgccctgcatcactgacaagagggagaccttaktgtcaggcctcaggcctctttctctttgtagatctgaatacaccattagtgtctctgagctgctcttgcagcagccagggcctgtcccctctctccacagcaatcacctcttaccaattggcccagctttctggaagcaaagtctctacattcttgggctttcacaggggtcttcccatctgcaggaataacttgtaattacactaatctcacttttaagttctcgtcacttcttaacacttttcttcactcacgagcctcctggctagcatttctcctctcctattgaatcctcaactccaactacctaactcagctcactcacccaaagcgtgttcaaggccctgccctctcactccattttcactttcattttgtattttttctatttcccaccactgtcctggatccctgggccatctcccagcgcctatccgtttcctcttgcagtttcatctatgaccmcaagaccttctggcctaagatgctctgtccttacagaacagctgatgaggagaaggtaaggagaggagagcaggagtgaggctaatggacacactcayttgtcctaaaagtgtcgcttgtagaaaatatgaatagactctcaaagggattgaccagactgcgaatgaacacagagctgggtatggtaacctaaagagctggggaagcctaaggggcgaggatgccaaggaggaagattcctgcttcccgtggcttacctggaaggcctctggttggtaccaagcccaggggcaaatggaacctgagtccagtccaggatttgatttctttctgattgtagtagagatgaggtttaagtacttagaaggarttgagctagaaatattttgggaaaaaatacactgaggagaagggagatcattgaaggggagggcacactccttcctctcaaaggcatgatctggaatttgcacatctcgtgttccatagcccagaacttaggcaatggccgctcctaacaggaagaaaggctggagagtatagtggagagtatagtttttcttctggacagctatggaccctgttaaaaccaggagctctaacaccatgagggaggaaactggatagaggggaacaactatcgagctctgtgggacagcacatttagttgatcgtgtactcggtgtagtacataaggggcggcttttggaaaagtgaacctraagggaatttgcaaatggtctcaggtgatgttttatttaataatgtatttaaaaagtgcttattgagcacctactatgtgccagccactgtgctagcagctgtggatgcgaaagtgaataagacagatatgttttcaccktcatgaagcttacagtccatgggaaagactggcattaaacaaggaagtaattatttatatcatcattttattcagtgacacaaatggtgtgggactgtgtaacaggagaagctaggctagtctaaagggttgaggaaggctgtgctgatgaactgacatttaactaagacttagtaggagctggcaaggcagaagagaggacttgagaggacctagcatatgctgcatgtcttaccamgtgctgggccctgtttgaagcagttttaatctttataacatggggcttatgaggtaggtgcctttattatccctatcttgcagataaggaaattgattaaacaatggctctaaggtcacagggcattaggtggtagagcctggcttggcaccaaggcagctccactttgaggcacattccctgaaccactttgctgtgtcactcttaacagagagtgcatttagcaggtggaggaggtgagagaatgccttcatggtagaaggaagtgttgggagagttcctccagatgaggttgaaggtcaaagaggagctagatcatgcagagatgcagagcttggtagccctgactaagaatttgacctttttcttaaggccagtggaaagttactggaggattttagcaacaggggcactacgtaatcagatttgcattgtaaaatgttctgtggagagtgttgggggatataacaccatattcagagacattagtggggagtccatcagcagatgatgacagtgtcttctaggataagaaggaggtgtagatacgactgaagattactcaggagagygttcactgggtttggtgaagggaaaagaaccacgtgtaggtgtctagtttgaacaactggtaggtagtgattttatttactaaggcgtgggaagactggaaaagaagcagcctgggggaaagataatgagttcaattttggatgtgttgaatccaggtgtttataaaatatccatgtggagaagtcatttaggmagttgggtccagagctcagaagagaagtctgggccagaaatagaaatttggcattcagatggcactggacacatgggagtggacaatattgggatgtcttgtctgtcaacaaatattgtttagaacatatcatttagaaaaaatgaacacaagacagtttaccaacgtcagatagactggtgcaaattccacatacaccatctgttcagaggaaggagagaccaggggaaagctgagccggcttcaaatgttggaaatgtttcaaagataaactcggaaggtatgtttaacttggagaattggattgatgttctagaaagttgattgggtatcctctgggggtggggaaagctgggaacacattagatctggagaggacttcagagtcctgaattgggtcagaaaacttgcttctgatgctttctaaatgcaccaccttgagtcctctgaacttctsctctctataaaggatactatggacccatcctacctaactcaccgagtggtaatgactataaagaacagacatgatatagacctaaaggaattatgtaaattgtaaagctgtgcacatttgaaaagctrtattgtattagtttgttttcacactactataaagaactgcccgaaactgagtagtttataaaggaaagggatttagttggctcagttccacatggctggggaggcctcaggaaacttacaatcatggcagaaggtgaaagggaggcaaagcacatcttatatggcggcaggagagagagagtgcaggggagactgtcaattttcaattatcaaatctcatgagaactcctcactgtcatgagaacaacatgggggaaaccgtccccatgattcagtcaccttccaccaggtccctccctcgacatgtggggattacaattcgaatgagatttgggtggggacacagagacaaaccatatcatatattgttaaatacaattcaagattcagagtgatgtcattgtcccmaggtcacctggctggcaagtgcagaagttgggagtagaatcccggtcttacaagtttcagtgagaagcatgagcattggctgtgaattagtagctctatgtccttgggaaagttatttaacctccatgactcccaatttattcacatataacttaggaggtaacaccattaactcaaatgtcacaactatttgttgagtatttactatataccaggtgctgctctagaccatggggttatagcagtgagcaaagccaagtgcctattctcaaggagcttatattccagtggcaggaggacagacagtgacagagataaagaaatgaatacataatgtatcaggatgtgataagtactctgaggaaagatgaagcaaagtaaggggacagagagaaatggggcagtggctggagggaaaggcaatactttttagtaaggtggacagggaagatctctctgataagggcatgtttgagcagacagcatcacaaagtatgcatatctggggaaagagtgcacagacagagagatagcaagtgcaaaggccccggggcaggtatattcctgatgtgttagaggagcagtcaggcgtccagtgtgacaggatgggaaagagcaaaagggagyggggaggggatgagatctgagaggcagctggagacagggtcatgtagggcctcatcagcctccgtcagaactttggattttagtctgagcgagatggacagctacttcagagttttatacagaaacataagtgattgtatttgttctgttggtggaggttttgcgaggagaaaataaggtaatgtgcatgaaattgctttgtgaagcgggaagttaggttaaagaatattgccacggtcatataacaggccaggcagttgcaaagccagcgtacaatgcactttctctgaccctcggccacccttctttccayggcatcccgaatctcccccagaagggcacyrtgtcaacctagaaagagcttgaacccttaagcaaggtcaaagactcttcctcattcccaagccacagggctttgtgaaccttgtcgacctggcagcatttggcttttggaaagaaccacgggagcttgtgatcttaaatgggtagaaagaagggagttggaacagtctgaggcagtttgaagctgggtagaggagattgtcataaattaaatacagaccttgtctgctgaaggctggactagagaagcaaaaacatcaggatttaagaggcaaaaccaacagttatgatatgttttggagaactccattaatgtctagttaggaagccatagtgtggccaaaagcaatagtattggggtttgtaagaattcatagttgtttgtatagtattagacgtggattaaggagatgtaatagtgcatgcattgaggtacccagaagtgaccttgtattgcattccctttggaggaccagctcctatggatgagtacatctggcagagggtgcagcctggccttccctgtgtgtggatagattcacgtgatcctggtgggtgacgaggggaagtgtacctgtgattcttggcctgagagcccatggacagaagtctgctgcccttgtatctttgctgtttgtttaaagtrgrtagcattcatgctcttccccccttttctttctctccttttttcttctttctctttcaattttttcttcttttttctcctctcttgccrtgagcagatgagcaatgtttgatttgctctctattagrtttgtaattgtttataagttaactacccacatagctaacacccagcataaaccccctaaaagacaatgttatcatggaatctccattccccataaaacatatcctatatgccgactaagcggtcttcataaattatcagctcttaagaaaataaagtgtcataatttttttcagtgaaaccttgttggattccaactatatagataaaccataataatgtacaatctgttagtgaaattatgtttctgaccctaaggtacaattttcccagaagtgacagacaattgatatatcagttttaattacttaaagtaggttatgtttttaaaaatataaccaccttaaggtctatgtatttttcagataattcttgttataatctgtgatttctttgcatgcagttccttcatatctgaatcttggcaggctcagaaattaaaacatttcgtcagaaagcttagaaaatatggggcacaattgggaatatgtataggatgtstgtgttttggatacacacacacacacacacacacacacatacacacaccaagcacttactcttgctaaagaagctcacggtggggacttccaagggcagaatcaggtccaaatgccttcagggaagacagatttcagattctttggggaagaacttttttaactgtcaaatctgcccaccaacagaattgctgcattacaaagttcagtaaaaggctattctccctctccccaccgccatctccccaggattttgagaataccagaagcttccaatgacaggattgttataaaaacagcattcttttatgcccacccatttaaaagctatgctattataaaaagtaaagaacgagytgctctcaccagkgcgcatggtgggtatgtgacctgttgagctgtgaatgactggttrgtgatgctgcagaagccacatgggcggggtggatgcagattctaatagatattatggcagccttcataatgcaggagtcgtgagggktcccatacatttctccattttgtcaagtagctaaggctttgaaatatttaattgcaattctacaaatgtattatatgctgaagagtccctcttccccacccccacacccaatctttttgttcttttgatctaagcgtgaaaaacctcaaaaatagcaytcatccttttcagatcagatcctggacattctgaataagtaatcttctattgtagtgagctccccaattctggaaatgatcaaatagaccactatttgtcacacaggtgaatggatattgtcagaaacattaagtgaggaatttctgcattgggtggttagaggaaactgatactatttttttttaagttgggaaatattttgtatacacagaaaagtctaaggaataagctgccaggcacggtggctcacacctgtaatcccagcattttgggaggttgaagggctgatggcctgagcctgggattttgagaccagcctgggcaacataaggagaccctgtctctacaaaaaaattttaaaaactagccaggtgttgtggtgcacacctgtagtcccagctactcgggaggctgagttgggaggatcacttgagcctagggcctaggagttagaggctgcagtgagccatgattgtgccactgcactccagcctgggtgacagtagagtgagaccctgtctcaaaaaaaataaaaataaaaatgctaatgaatacccatggaaccatgacacagctttgcccataaaatacattttatcctattagcttcagatcatttataaagaaaaatgccgttacaaatataattgaagcatgtgggcgccccttactttctcaccctgttccttcccttccttgacgttaccactgctcttaacgttgtgtttaccattttcatatttttgtacttatattgtgcatacatacastaaatactgtatgatatttttgcagtttgtaaacttcatctaaattgtattatactatacatattatttagcattttgctctttttcttaatgttgtttcttagatgtatccactttgatatatgtaggcctcctgcattcatctcaactgaattaccatattctatggattaatatgccatcatttatttacccagtttcctgtttaagggcattgaggttgattccttattttctactaccagggatgcagttatgaatcctcttacatatgtgttttggaggcgtctatgttagaatttctctaggaatggaattactcatggagtacacacatatttacaggatataatcaaattattctctaaaataattgagcaaatttataaccccatcagcactgtctgaaaattcttcttattctatatccctaccagttcttgctgatagtagattttaattttttgtcaattgatgattatgaagtgatatttcattttaacttaaatgcagtcaaatatactgatcttttctcttcgatttgtatgtttttgtgtcttaagaaatgtctctctatccagcaagatcataaagctattctattattttcctaaaatgttggaagattgcttttccacatgaatcttggaaatacttggaatttatttttgtgtatagagtgcggaagagatcaatttcattgttttcggtatgatggtcttttttttttttgcattttttgggttgccagtaagaatgagcattttctccatgtttgttggccatgtgagttgttgttctcttttgctcattttgctgttgcatcatttgcttattggtttataggagctctttatatattatggatattatccattgttaatcatatgaatggcaaatattttctcccagtctgtggcttgtttttactatgactgtggtatcatatgttgaatcaaattgatattcttttgatttttttaatggaatttacttgtaaaamatgggcttgatatgcattctgcagcagtcagtgtagtgttattggttttttagatcaagtttgctaattgtggtttcacatcttctgtatacctgctgattttttgtcttcttacattatcaattactgaatgtgttgtgctgaaatctcccctatgarggaacatttatgaaagttgaccatacaccaagccagaagttctgaacatgtttcacagaatttacgttataaaaatcacattctttaacctccaattctattatttttttattttttatttttttctgtctttaggaatattttaattcggttggaaattaaaacaaacaatgctttgaaaaattaagaaggaataatcaattatccataatcgagttttagctgctgttgtatttgggtgagaagaaagttgaacagagacttgagatgctagagaaagctctaaataggtggaattttagttggtccttgaaaaatgtgcatctttgggaaaaaagaggaagagaccgttttagtttgaggaattagcatgaataaaggcttagaagctggagtttaggtacatgtgacttcaatgacacccgtttcaatgcagtttaagtgctaaggagtggtgagaaagctggagagatcagtcacatggagtcatggagggtcttaaactagccagagatactggaattgctttagtagatagcacagaattaaataagaatgctcttaagtggatgtgacaatttttattagattttcatgaataatctagaagtggtgtatcagaggacttgaatgaaggaggggacaggaagcaggaaagcctgtctggacacctttcaaggaatctaagtctaaacttattaggtccaggactaagggaaaaccaaggaaatggataaaatggggtaaatttgagagacatttcaataagaaaaatggcaaaatttggcatcagattaggaatcagcacacaaaaatagaaataagtcaaagataagcctagaataatagtgatatcctggacaaatagctaatgtcaagaagagtcaataattcatgaattcatagaaatttagaaacagcttggaaatgatatctgtagaccccgcttttcagagatgaggaaattaacagagagcttgagtgactagttcctggtcaccctgcccgggcgacagagtgagacttcgtctcaaaaaaaaaaaaaaaaaaaaaaaattgaaaatgactagaatcctagaggatttaccctgtaagaagttggtttaatgctacatcagtgttggacggatggatttgggagcatctgaaaggcaattggagccatgggagtggctgtgctcttccagtgagagattatatagggaagaaaaacgaggagcaaagataaagtcacaggaaatatctataattagggattcaaactagaaggaagatggttcctaagtaagtcaggtaaggatcaaacagacrtgaggagtcctcgtgcagtggttacaggcactttgtggggttgagtgggtggatcacttgaggccagcagtctgataacccctttatcattttttattgcttctatttgattcttctctcttttcttctttattagtcttgctggtgctctatcaattttgttgatcttttcaaaaaccagctcctggattcattgctttttgaaggtttttttgtatctctatctccttcagttctgctctgatattagttatttctggccttctgctagcttttgaatttgtttgctcttgcttctctagttcttttaattgtgatgttagggtattgattttagatctttcctgctttctcttgtgggcatttagtgctataaatttccctttacatactgctttaaatgtctcccagagattctggtatgttgtgtctttgttctcattggtttcaaagaacatctttatttctgccttcatttcgttttgtacccagtagtcattcaggagcaggttgttcagtttccatgtagttgagcagttttgagtgaatttcttaatcctgagttctagtttgattgcactgtggtctgagagacagtttgttataatttctgttcttttacatttgttgaggagtgctttacttccaactatgtggtcaattttggaataagtacaatgtggtgctgagaagaatgtatattctgttgatttggggtggagagttctgtagatgtctattaggtccgcttggtgcagagctgagttcaattcctggatatccttgttaattttctgtctcattgatctgtctaatgttgacagtggggtgttaaagtctcccattatgactgtgtgggagtctaagtctttttgtaggtctttaaggacttgctttatgaatctgagtgctcctgtattgggtgcatatatatttaggatagttagctcttcttgttgaattgatccctttaccattaggtaatggccttctttgtctcttttgatctttgttggtttaaagtctgttttatccgagactaggattgcaacccctgcctttttttgttttccatttgcttggtagatcttcctccatccctttattttgagcctaggtgtgtctctgcatgtgagatgggtctcctgaatacagcacactgatgggtcttgactctatccaatttgccagtctgtgtcttttaactggagcatttagcctatttacatttaagattaatatgttacgtgtgaatttgatcctgtcattatgatgttagctggttattttgctcgttagttgatgcagtttcttcctagtctcgatggtctttacagtttggcatgtctttgcagtggctggtatgggttgttcctttccatgtttagtgcttccttcaggagctcttgtaaggcaggcctggtggtgacaaaatctctcagcatttgcttgtttgtaaaggattttatgtctccttcccttatgaagcttagtttggctggatatgaaattctgggttgaaaattcttttctttaagaatgttraatattggcccccactctcttctggcttgtagagtttctgctgagagatctgctrttagtctgatgggctkccctttgtgggtaacccaacctttctctctggctgtccttaacattttttccttcacttcaactttggtgaatctgacaattatgtgtcttggagttgctcttctcgaggagtacctttgtggcattctctgtatttcctgaatttgaatgttggcttgccttgctaggttggggaagttctcctggrwaatatcctgaakagtgttttccagcttggttccattctccccgtcactttcaggtacaccaatcagatgtagatttggtcttttcacatagtcccatatttcttggaggctttgtttctttttactcttttttctctaaacttctcttctyacttcatttcattcatttgatcttcaatcactgataccctgtcttccagttgatcgaatcagctactgaagcttgtgcatgtgtcacatagttctcgtgccatggttttcagctccatcaggtcatttaaggacttctctacactggttattctagttagccattcgtctagtcttttttcaaggtttttagcttctttgcgacgggttcgaacatcctcctttagctcggagaaatttgattgtctgaagccttcttctctcaactcgtcaaagtcattctccatccagcttttttccattgctggcaaggagctgcgttcctttggaggagaagaggtactctgatttttagaattttcagcttttctggtctggtttctcctcatctttgtggttttatctacctttggtctttgatgayggtgacgtacagatggggttttggtgtggatgtcctttctgtttgttagttttccttctaacagtcagaaccctcagctgcaggtctgttggactttgctggaggtccactccagaccctgtttgcctgggtatcaccagcggagcctgcagaacagcgaatattgcagaatagcaaatgttgctgcctgatcgttcctctggaagcttcatctcagagggggacccagccatgtgaggtgtcagtcggcccctactgggaggtgcctcccagttaggctactcgggagtccgggacccacttgaggaggcagtctgtctgttctcagatctcaaactctgtgttgagagaaccactactctcttcaaagctgtcagacagggacatttaagtctgcagaaatttctgctgcctctatgccctgcccccagaggtggagtctacagaggcaggcaggcctccttgagctgtggtgagctccacccagtttgagcttcctggctgctttgtttacctactcaagcctcagcaatggtgggggcccctcccccagccttgctgccaccttgcagttcaatctcagactgctgtgctagcaatgagcgaggctccatgggcgtgggaccctccgagccaggtgcgggatataatctcctggtgtgccatttgctaggaccgttggataaagcgcagtattagggtgagagtgacccgattttccaggtgctgtctgtctcagcttcccttggctaggaaagggaattccctgaccccttgcgtttcccrggtgaggggatgcctcgccctgctttggctcatgcttggtgcgctgcacccaytgtcctgcacccactgtctgacaagccccagtgagatgaacccggtacctcagttggaaatgcagaaatcatccgtcttctgcatcgctcatgctgggagctgtagactggagctgttcctattcagccatcttggaacctctattttttttaattttttaattttatttatttattttttttgagactgagtcttgctctgttgcccaggctggagtgcagtggtgggatctcggctcactgcaagttccacctcctgggttcatgccattctcctgcttcagcctcctgagtagctgggactacagactcccaccaccacgcccggctaatttttcgtattttcagtagagacaggtttcaccatgttggccaggatggtcttgatctcctgatcttgtgatctgcctgcctcggcctcccagagtgctgggattacaggtgtgagccaccatgcccagcctccttttcaattcttacattttgtttccttttctagttctactgtatgaccagtggctttagtacagtgttgaataaaaatgtaggtgctaggtatctttattttattcctgtttttaaatggactgcttttagtattttactggtacataggatatttactatagtttttctgttgataccatttatcagattacagaaagtttccatctgttcctattttgctagcataatttaaattaaactaaactatgaaatgctttttctgcatcaatttaaataatcatgtagcttttctcctttaacctgcaaaggtactgaacttcactaatgcaaatcttaaactcttcatgtactcctgacagaagccaacttggtcgttatgtacttattttaatatattgctatgtttggtatgcttatatttcatttaggatttttgcatctctctttattagtgatgttgagctagagtttttctttcttacattttgtgtctggtttaagggccaagattgtacaagccacacagtatgagtttggagygctccttctttttctgttctctggaatacattatagaaaggcagggttatgtgttgcttgagagtttgataaaactcatttaaaaaaaatgtgtgccaacttctgggttttgtgagcagatttttaatttcaggcttttttttagtggttttgttatattcatgttttcattttcttcttgattccatattgktatattttcctatttatgtattttcaagttattggtatgaaatttttcatagaattgtcttttgaagaattgctacatctttgctgcatctgcaattatgttgcctttgtgattttaaatgttgtttgcgtttctttttaaaggtctgatcaatgtgttagatatttatctattttctctcttttgtcagtcttttcaagaagccagtgtttggttttgttcattcttcctattgtttgtcttctatttccttcattcaggctcttctatttattatgtccttcctttttctttctttggactgaactcygtttttctttgttgttggatgtttaactcattaatttgcagacactaaaaaaaaagcatgtaaactttttatcatttagttttttcatttactattttttccccctgtaactcaacacatatttatgtgccaggcactgttttaggttctgtggattcatcagtgagcaaaatagtcaaaaagcctgccctcatatcttaaaaattcaattatgaattctttattctatgggttattttattaattaattwatttatttattagagatggagtcttgctctgtcacccaggctgaagtgcaatggtgagatctcggctcaacaaaacctccgcctcccaggttcaagcgatgctcctacytcagcctcccaagtagctggggttacaggcacgcgccaccaggcccaactaatttttgtatttttagtagagayggggttttgccatgtaggccaggctggtttcgaactcctgacctcaggtgatctgcctgcctcagcctcccaaagtgctgggattgcaggcatgagccactgggcccagccctctgtgagttatttagaagtgtgttttgcatttctattgatgtaggggtggataggtttgtatcctggctatttctaatttacttgcattttgtttggagaatgtggcatgtatgatgttgatttttttggtacttttgagatttgctttgtgacctggaatgtgcttttttttttttttttaagttccatgtgtacttgaaaagaatgctgaccaatgatcttaagattcttttcaacttggtgagtcagtcgttccatatcaatgtcaaataaccctgcctgatctggcatgttgttcaragtcgtagttaaaagggcctaattcctgttgaggccaattcggtattgagtcaggagtggtgcttggagtgctctctactctaacacaaaaatttaatgaggaccatttcctttttcttctagggagcagtagggcagagaatcatggaatatcagaaaaatctgttgaaagttgtccacagccagcagcaaactagcggcttgaggaactattcagcagacacttatgtagcacttaagtatgcaccagacayggttctgagtggttttacaagtkccaactcacttcatcttcataccaggtcttgacagagttagttactatccctgtttctctaatgaggaaactggaccacagagaggttagggactaagggctcacaaacggtaagtggcatcatcagcactgaattcaggccatctctgacccagggccatgctctcagccctgccaccaatgctgcctcccacatgaaaattaatgctagttaaaaaacaaacaaacaaacaaacaaacaaaacaaagaaaaccagaaacctactcctttgctccactgcaaacttccagaattaaattctttccaggggcaaaattttgaaatcgatattctgatgaatagccagattttagaactactctcaggctaccctcttcattttatacatggggaaactgaggccgagagggggaagggatttgttcactagttagtggcatatgaaggaaaaatctggttccttgaaacttgcttctctgtaaactctttgtggggacactcgggagctggtgatcctagcgygggtcttaggaggcctggctcaccactcgctagtgggtctgaactgctcatccttccccaaagaggacccatgttggctgcctgtatctgacactctttctctctcctgtggctttctccttctctctcctctagctttctccttctgtccctatttgtgtctgttttatctctctctctctctctctctctctctctctctctgtctctggtaaacccttctgctaaggaactgaagcagagatcctcgaagctttggggactggcgcaggttggtggtgcacatttttttrtagtggagagttttggaatcaaacagagctggtaaattggccaccttctagttttgctatgttgatggaggcctcactctgttgcaggcacaaactctggggctgcagcattgaaaacaaatccctgctctcaaggggtttgcagtctagtaagaagatacagaccacaaatgaatagataaataccagataatatgttcactagcaatatgtaccatgaaggaaaacaaagcagagtgaagcagtagaaagtgaagaggctggtagggctgctccgggaatggtctctctggcacatggcagctgagcaaacccagatgcaagtggaggagctggtcatgtggcagtgaggggaaaggaatccgggcagaggaagcagcaaatgcaaaggtcctgatgtagagyaaactcgtgcaaggaacagcaaagaggtcagtgtggccggaccagccttgagagaggcagtggctggagaagaaggaaggagagggtctgggccagggtattgagggggtctctggatattttgaggactttggattgactccgaatgagatgggaagtcaccagggctctgagcagaagaccacaggatgagtctaatatttctgaatgctcactctggttgcttagtggagactagaccgtgggggcggggacagagtggggagccagtggaggcagttgcagtggtccaaggggaggtgacagtggcgcaaactagggtaggagccacggagatggtgagacaggttcaggtgctgactacgtttcaaaggcaaatcattcaatatttgttcatggagtgagtgtgaggcatgaaagaaagaggtcaaggatgacgccaagattttgatatgaacttgaagaatatcggtgagggaagacatcaggtatttacttatgaacatgtgacrtttgtgacagctgctgcatatccatgtagaaacgtgcaacattcaagggaatctcttagctggagagtcactgacatttagatgatttttcagccatgagaccttgtcagctcacccaatgggtagatgcagataaagaagagagatgtccctaaatgaaccctatgtctgtttgaagtttagagatgggatgatgatggatgcgccgaagtaactgagcagaagcggctagtgagataagaagaaaaccaacaaaaagtggagtcccagggggtcatgcgaggaacatgtctcaggatgaarggagttattaacgtctcccattattgttaataaacaaggatttttacaacaaggtgattggccctcggaaacaatacttttcaatcttctttgttctcagtctctcttttcctttgcctggcggaagcgttccctcacactgtctgcctcatgaacttcaggccctactacrgggcgcaggggacagcttcgtgccatcacacctccagaccacctaggctactgacatctcactacaaaatcaggctgtttcttgaygcaggggtttcacaggaaaactgcatggcaggtacatggcagcccacacttgggcactgtgaattgccgccaggacctgaacttagattcttgccattttctgagcctgaatatggcctaagacaagacctggatgtaggatctttaagcccttggccataggggaagggcttaggtgaagccaagaatttgtggcaacaaattcaggagtatatacatattcttgaatttaacattcactaacatcctgacatcaaccaacgaagaagtcagtggcttaaagaacttaagtatcttacttaagttcatccaaatctccagcttaaacatagatcttccttgaatatcttacataaagaaaatgaggaggacgaaaacgtaggagtcatcctagattctctgtgttccctcaaaccccatagttaatccactggtaagtgcctttractctactactaaaatctatccttgctctgaacatctttcactctgttcatactgcraacctagtccagatccccagcagttcttgccaggggtattgcatcatccgcctgcctgctgtatctggagcctcattcccttagagtctagtctccatacgttagctgaagtgagctttctggactgtaaatcagatcacatcactcgcccacataaaacccaccagagactttccccattatagcccaccaggcctcacaagatctggctgccrtctttcttcccttccatgcttcaccttattcaccactcttgaactacattcacttttttttttttaagatagtctcgctctgtcacccaggctggagtgcagtggcacatgatctcggcccacygcaggctctgctcctgggttcaagggattctcctgcctcagcctcccaagtagctgaaattacaggcatgcaccaccatgcctggctaattttgtatttttagtagagacggggttttgccatgttgcccaggctggtcttgaactcctgggctcaagggatctgcctgtctcagcctcccaaaatgccagaattataggtgtgagccactgtgcctggcctgcattcactcttctttctgttcctcccacacaccagtgcatatccaccccagggtctttgastggctcttccttcttctggaaggctcttactcaatgatggctttggctacctgctcctcactctgccctctcctcatcaccatctcagccctggctgcagtgatctgtcttcctgycttcatctgtggaatttgctttattccacctaycaggacctgcaatggtctttttcatttgcttatttctttttttctttttcttcttcttcttyttttttttttttttttttttgagatggagtcttgctctgttgcccaggctggagtgcaatggtgcgatctcggctcactgcaacctccgcctcccaagttcaagtgattctcatgcctcagcctcctgagtagctgggattacaagcatgtgccaccacgcctggctaatttttgtatttgtagtagagacgaggtttcaccacgttggtcaggctggtctcaagctcctgacctcgtgatctgcctgcctcagcctcccaaagtgctgggattacaggcgtgagccacygcacctggccttatttgcttatttctttgccggccgtctctccattttaatatgtaagctcctgtgagatgggggctctgttggacttgtcattgtcatatgctccctatatgtgtcagtgcatagcacttagtaggtgttcaataaatgcctgatgactgacaatctgaaattgaaaaattattttaggcgtaattcctgatttttattagatttctgtttttgttggtgttcatttttatgctcaggatggggtgacattctaaatgtgatgaaaggaggtgattcttcctgagcttaggagttagctgagacctagatcgtgagactgtctttctcaagggaagagtcataggctgcacccaccctccactcccagcctatgtgttcttgccaacccatgccgcattacgaggtgatacttgggatgcttaaggtgcccctgggaagccttggacaatcactctttggaactcttgccccagggtgacttggctgatgccttagctggaatcagaagagcccaggcccagagcaaaggaggcattcactgtgctgaggatgctgactttcaggaatccatagctggccaagttgtgttaacgtgaagctggccaagagctttggttgcctcatttcctcctgaagatccaaagtcagtagcagctgtggctcccccagtgtcagggcacccaatcttatttggctttgtttttttaagagtatgtttcttcaggggaatccagagtgagaaaatattgaggctcagaggagggaaatttcaaagccagatgttttggtgctgactttgggactggattctgagttttcttttgagamctttgccactttccctgtagtgtgttggtgtccgccttcaatcccataagctcggttgagaatgcctgtattagggagtgacttcatcattaactccagccagtcaactgtttctcagcaccaaaatctgcttgaatcactggagaattgactttgccctgctgtgcctrcttgtacagggtctgtggagagccagtttctgcaagtggtctgagacttacacatgtcactgctgctctcacactgcccacatggggcagtcactataggagtttgtcttatgtcagcatcttgcataagaaacattttatccaccttgctttgggaaacatcctttcccattagaagactcaaagaagggaagtcaaatgcaactatttcttgagtgcttrctrtgtgccagacacttggctggggactcaataaggccacatcttaagctgagccacagggaagatcaaagactgtgggagggcagatgtcacttcttaagcctatccagtgctgtaggcttcccctacaggagtccgtgtccacctacttgtgtgttatgctgggatggaagaaaagcacaccaaattcagagawcctaggtgagtttggaaggaaagatagaacccgtcacagcggtgagccagtgtcagtgagagcttggaagcaggatctcgttcaccaggttaccatcaatgaaccaggaaacctgtcctggatgtcacatctaggaggagctgagaggccaggcccacatttagaatagcagatcctagatttcaccaagaaggcactgaaatgaagccaatttatgcctcccataaaaagcctgtctctgtgctaacaacctcatctctccttgtctactcctgggcttttactctaaaatgatctcttttcttttgcattgatgatctctaactcctcgtatctcctgttctctaaccaaaattaggtcaaagattctgccctcctaattaaactctccctcagatatgtacctgcctcaagttcccttgcttttggtaccaacctctcccttttctcaagaccrttcttcttgaaattcccactttggtttccttacattcctttggcttctttagtaacctcacaatttgtttttttcctcaaatctcctgaaactggtctctctagtgatcactagttaccttcttaattaataattagttatcttcctaatcaatacatcctgtggctttcaccttctctttcctcattcctccatgcctctccatttcacacctagtgagatcataagacttgcacttcttgtgcacaacagcaggaaaaggacataggaggcaggtgtgctgatcctcctgtgttaggtaggagacatagagtcttccttggcacttgagaagctccgaccaaaaaaaaaaaaaaaaaaaaggatactcccatgggtcagggttttgtctttaacaaagtgaaggaacaggaaggcctgagttagaggcaccctagacttggatgaactggatgctgcccaggccctattacattttgacctgttttcagagtaataggcaaatttggattaaactgtgtgccattgtttctaggtttagataaagcagcatgcctaattgagattttcaccttttgggtctcagctcattatatctaggttcccaaggatttgagtagatgcagataggattagtcaatattttaagcctccctcataagggagtacaagagtcaaacctttgtttggagacagctggggctttaaggattgactggaagaaaatcctttgtgagggttatagctggggctttggattaattaagaaagccctctgattagagtagagaggggtgaccagtcctgctggtgatgggttgtcyttgcttcggcctcttgtagcactcarccagcctttgcctcccgttctccagttcaggccaggcttccttccctttgctaatttcccaaagcactgcacattccaaagccatcyccattccccaagagaatgggtgagctcagccccactgctcaggtcccgatttggagtacggttttggcatattttccatcacagttgttgtttctaggtttcattttattctttgtttctgttccccccacaaggtcttaaagactgaactaggaacctgtaagaagaagagagcgtggggtgatgattaatacaatttttcaatggtcttgtcagattttacaggatgttcatgatgctaattcagcagtccttataatatatacctttctttaatgcttttaaatctcaacacaaggtyaaggcaaagtcaggagagggaaccagtgtgggacattggacctgacctcctggtgttgttgttgttgttgttttggcagtcctgtatttgctgtgtaaccttgagaaactttctttccatctctgggccttgttsccccacatactgaacagaagtaatcatgctggtcccctccctgcctcagagggaatgagaggatgaatgagatcatgtctgtaagcatgttgaattccttggagaaaggtgttgtggaaatgcacagatgttgggtatttgtgcagcactccaagttcttggaaacagggcctcatgcagaggacaccttgcacgctgctagcatctggcctasagccaaakcatccataacgtgcaagagggactgggtgtccccaagcctccatcaggaccccacctgaccagcccagactgatggatgccaactctatccatagagtttcttaagcaaggaaattgcacatgcttcrttggaagtatatccagggtttcaagaatcctccctttagggargtcttctcagtgtggagttgcactcactttcacttcgttttgtcctgtatgcagtggggtgaaagaactgcagggcgttcattcgtatttacttacttttctcaccaggcacaggacgaggtggtgaacagtgcaatccttatggagttgtggggctggtggaaaataactcaagagagtagaacaggaaatgtgtgtaattctaataagtggaggcagcgccttgtccgatcatttggtaacctagcttaactcagttggttaaaacactgttcctcaactattctcagtccaagatgtgccaagtgcttaactcagttggttaaaatgattttctrtatttcctagatggcatccctctttctctttcatccagggggtgtctgtcaccctttccctccatccagatwagggcatgtgcatgcacacccatatgtcctctgctagggctgagatctttcacctttgctgtcaagtctgttttgcaaaacctacccaggtttccagaagcactaagtgggacttgrtggatgcacttgaggcttaagtgacaaggtgggctcatagtgtttccattgtctgtgtgaggaaggaactaagggcattgatggaactggtgttgygagtcctcaggacagcacrgctcccaccactgctgtgatccagcctgtgaacgtcagcgcagctggtgtccttgggtgggcgcttgctgcctgctttggtgccacatgcccgcttcccagaggggcccatggaggggatggtggcctctagagtaaaggccccyccagccttctcttaacatgtccccacactttcactgggattaatcrctcccctgtgtgcttctgtggtccttaaatrtacctctattttatgatgagtgacagccaactatggtttgtggcactccttaacagtaggagtctgtttcccctcattgagggagggaattgagtcagctttatctttgtctccctattaacccagcacatagtatgtgcttaataaatatttgggagggaaagaggaatataggaattttatacactgaggttcatctaaggggagctctggaaattcctgtccatggtatctagttagcaccacagaaaataggggttwaagaaagatgctgatgatgygggtagtggtcctgcagggttgacaggtttggctgacagcctgtaagagcacaagtatgcttttcatgttgtgggggtgcagagggaagtggagagagtggggaggggaaggggactttactgttctcgagagctacccgggacttgcycctgggkgagtttcccacctgcttgctaggtggaggttatcccccttgcctgggggctggcttgtctctgctgcctgataccaaagctgatccttttcaggatgggaagcagccagctggttttaagagaatgctctcttctgcccttgaggggagtgctgctccagcggtrggactggggaaatggccagccctctgtgggcagatcagctatttccagaagccaggcaggcaggagaagcctacgtcaccattctgttggacgagccaggcagtcgacaggcagtcgtcccggttttgtgttttttgtgttttttgttttgttttgttgttgttgttgagacagggtctcactttgttgcccaggctggagtgcagtggcatgatcacagctcattgcagcctcaacctcctagactcaagtgactcagctccccacatagctggactgtgggtggcatgcaccaccatgcccagctactttttgtattttttgtagaggcagcatttcgccatgttgcccgggctggtcttaaactcctgggctcaactgatctaccagcctctgcctcccaaatgttgggattayaggcctgagccactgtgcccagccccaggctcttcctgtggcttctcttctctgttccagttgggcagaggtggcatggtgarggcagtgctgggagtgaaggaaaggacttgatctgactgggagggccaagctgtcttgggaccttgcccctcccatccttccccaccatggagactcgtggagacccctggggccatgccaagagtcttattgctaccctgtaagcccccacttccctagcactcttccccagtcctctgagaatggccaggttcagagacagcccattgagcctgatgacctgaggaccargcccttctccaagtggctgagcaaatacttggagctttcttggcctttcctgccactcaccagcccaggagtggacaggactcgtgcctcatacctgagccaaggtgggcataggatgttgctgggtcacatgagtctctgctgtgtctggaacaaaargaactctgacttcttgagaacctactatgtgcctaggaactagaccatttacctacattaggtcattacagtaggttaatgacatacattgcatagaggaaaaacagcagctcaccaaaacaggtcatgtgcttgagtctcccaggctaataagcagtagagccagaatttgcacccaggacccctgactccarcacctgygctgtgaaccactgttttagcaccagcttctctctgggatctctatagggaagaygaaaacaagtaaacaatgtgggctgcattctcaagggagtcgtgatcagaatgggagtcaatatagcacataggaaagaggcaccagcaacatctgcagaggggtgtggcatgccgtgtcccatatgctcagaggtttagagtggaatatggctagttggggtgggtttcctaggtgaagtgatgtttttgagcaagactttgaaggctcgctcaaagacaagtagagttgctgagaagaagttgtackctgtggaggactgacatttctagatggacagcyrctcactttcagccaagaccacttgtcctcccactgcccccagagaagggcagctccccacagagtgtccraggtccatgcactgacttcttgtactcrtctgtttccccyactgcatgatcgacttctccatggcagagaccttctcctgctcattagtagattgcctgtgtcaagcccatggcagggactcaatgaatatttttgaattggagccctgatccctatccctctgaggagcagcagtcctggtgttagctgtgacccaggctgtgaaaaaccagagagcagctggcatttctggtggggctgcttgctgacagatcttggtgccacatggygagcagaggagccccagggctyggtggaggtgtgggagggacacctggcatgaagggtcccagggcatatacttggcctgcctatgccttgcctgtgactgcagtggtggtagggagggaagtggattacagtcacccctgcactccctcctgtccctgcacacatctgccatggtgaattatagatgttgggacactgtgctacccaggaaggacccaaatggagtaractcaagagagagatgaaagtaggaggggagacwagacagcttggaggctgagccttggaagagccaggctacctggtcagcccagtgtgctcactgctccatccttcaagccctgccctgcctcctccaggaagccctccctaccctgccctgtcctcactgagttctctctcctccctcctctaaagttctcttacaccgatcatctgtttgactttttggtgactctgtagtctaccacggtttcagcaccaggtttcctctaagatttctttaaaaaattaaaataagtaaacggtatggcsactctgttttctgaactgaaaattaggacatggacawgtgatgtggcatgagactggatgtgaaagttgatgctgttcagaaaaatacggtgtatgtggccaacacagagatgactccatggccctcctccaaggtctgatttgcctatttaaatctgttgtttgcttgtctgttttttaactcacttgtctaagccttgtctcttcatttggattaaagttccttgggggctttttgtgtatcaaagggtgtacattgcatttccttgatatttttgaatctcctaaagacctctgccacttcatccctgcttttgatggtgggagagagacacgtcaatctttttcctgtttcttgatttttctttttccctaaaataagataatttaggctcttacctgagctcttattttctacctttaattgtggagttaaatagagagaaggagatggaagacttatgatgataatagggggcagagctggaggtaggttgtcttacaatccaggattggcatctacttcagagtgcacagggtacacagagtgcacagtatacagtctctactgggtcaagggtgtggcagagaagaggcaggcttggggttktggtgacatcatcacagtccccagtactcaaggggtccacggtccmcagtactcatggtcaccaccactcctctgtgctttctcttgagtgtggaaaagaacaactcagcatcatcttgtccttccgtctgcttccaaataagatcaarctttacmcattccacccagatgagcatctgttttgaatgctcatagatatctgctagatggttagctccttaaaggttcagatccacagtttatcccttcatttctcactttagttggcatggcggtagacatgtagcagcagctcaaaawatccttaacacatagggaaagagatggctgagttcttctctgtcacttgtttctgagcttaactgtcttcacatacagggctcttccaatgcctaacgtggtatttcttggcttgcagggcatgacctgagctggggggcagaaagttcccaggacattggaactgaacagcatgaactgcaggagctcttagccttgcctscagcccgaacccttgactgccataakcacagttctttttatctcagacccattactacccaggcctccagccccaktgtcaccactgacctcccatattccccaccctttgcctagccctccagcctgagagagctggggtggaggagtargagagagagacagasagagagagagagagagagagagaragagaaagagagagatagatagatcagagaatatagtttataactcatcaagagtctataattcaatctagtagaaatgctcatttatctcttaaaatctcaaaagaccagaattcttggcctactttttgtttttgataaatataggagttgggaaaatttaagaatgccaaactgtgggataggaagcatagaatgagagaaacagatcttaggataaagaattcaagagccactgatctacatggatctctatgcattcatttttttccttcttccttggctaaagggaaacttgattaaagagaagaaactggtaccatttttaaagtaagttgaaagggaaagaaatggacctcttttttccatgattttccccaattatcccttccacccgtctgttttccagcagaatctgttcttatcctctggacccatgaaaggaacttccaagagaccrtctgctttcttgggagcctagtgaaagggaaatatagatttgtgggtcaaatagggtaatgagagaaaagtagggccttcaaggaaaagatgtaagagcttaatagcttgttgactcaaaaaacaaccacaggggtctatgagtagtaatggactccagggaataagaagaggatatgaaactgaataaggaaggaaaaggttagaggaagagagtacatttcctccagggtggaagtgacccagagaacagtagggcatttgttcattaacttttaatgcgacttgcacttttagcattattcccagggatgtgagtgggaaaatgaatggggtcaggatttctcagccatcaagtctcctccacgcctggccccaactccaaaaactccttaaggaccttgtctcctgggacactctgctttggcctcatcctggtgggatattgrctgcaccttgggcactctgcccttccccaaatcttctgtccagtgaccttgatgtcactgagacaaaagtgaaattcatgattcataaaaaatgtgagtggtagagggaccaaccttacatttcaccaatcctgccttcactttacagaagataacactgagaccacatagcggaagtgacttccttgaaatcagatggcgggcaagctgttttcggcccagactttcacctgaaatgctgcctgttgctctgggtttacctggagtctctttcctgcttagcaatcacctccccacatggagcagaaggcagtgctctgtgcaaatccctktgtgcaggttgtgtggcaggaaccaatgtcgggaggagagaggacactgctattaccagggcctggarctagtacccrtgttcccctttattctgcttytgtctcgctttgagcttggggcagaggaactcttctgctcttccytgtacarcaggtctgtcatgcagaggctggttcttataaaagattaaccttgtctccctcctatagcctaagaccacctgtgagtcacctcccattaatccacctctgaccagaattccagcaggtgcctagctgccacttatcccctatctgattcttattgttccctgggatcgtttctttcatcattgcatgaccctgaatttatagagtcccagttggaagggacaatttaggggctttcagtaatgtttctwcatatttctggcaggtgctcatttagtgtctgtttgaatacttctagggatgtcgaattcactactttataatgcagcttgttcccccttttgatcagggagcccacaatttccrtgtctcctaaggcagctctctgagcccacacagaggaggcagagccagctccacacggccgttcttcagatgtttgaaggcagccgttctgccttgcttgagtatcttccattcctaccaaagcacttgcatttattttagccgttccttacttaacaatgtttccagaccctctcctagtctggcccctctttcctttttttcaatatccctcttaattgtaggtcccagatagaaactccaaaagtgggtgcaggtggattctttttcttttcattaacttttattttaagttctggggcacatgtgcagaatatacaggtttgttacacaggtaaaagtgtgtcatggtggtttgctgcacagatcatcccatcagctaggaatgaagcccagcatccattagctattcttcctgatgctcttcctcccaccataaccaccaccaacaggccccagtgtgtgttgttcccccartgtgtccatgtgttctcatcattcagcttccacttataagtgagaacatgyggtgtttggtttctgtttctgtgttagtttgccgagaataatggcttccaactccatccatgtccatgcaaaggacatgatctcattcctttttatggctgcatagtgttctatggcgtatctgtaccacattttctttatctagtctatcattgatgggcatttaggttaattccatgtctttgctattgtgaatagtgctgcaatgaatatatgtgtgcatgtgtctttataatagaatgatttatattccttgcattatacatcccataatgggattgctgggtcaaatggtatttctggttctaggtctttgaggaatcrccacgctgtcttccacaacggytgaagtaatttacattcccatcaaaagtgtaaagcattcctatttcttcctaacctcaccaacatctgttgttttttgactttttaatgatagccattctgacgggcatgtgatggtatctcattgtggtttttgatttgcatttttataatgatcagtgatattgagcttttttcatatatttgttggctkcatgtatgtcttcttttgagaagtgtctgtttatgtcctctgcccactttttaatggggttgtttgttttcttcttgtaaatttgcttaagttscttgyagattctggatattagacctttgtcagatggataggttgcaaaaattttctcccattctgcgggtcatctattcactctgatgatagtttcttttgctgtgcagaagctctttagcttaattagatcttatttgtcaatttttgcttttgttgcgattgcttttgacattttcatcgtgaaatctttgtttgtgtctgtgttctgaattgtattgcctagattttcttttagggtttttatagttgggattttacatttaagtatttaatccatcttgagttaatttttgtacaaagtgtaaggaaggactcttacttaatttgctccaaatgttacacatatgtcaatgctgtctgagttttagaggtcgtgtcayacttttggcttatgccgagttcagattcaactggctccctgaatgcttgtccacctgagctggcattgatgtgagctatacccactcgcntgcttttctgaacctaaatgtagakccttacagttgaccmgttcaaatgtcccttgttaagttcagccaaccttgctaggcacctgagatcttcacggatatacctgctgccaagcagtgttttatctgctttccaacctagtgatatctgcaaattttaagctggatttttctttatccaaatcactgataaaaaatgttgatcaggagaaggtgaaagagagtggcaggagaaggagaaagaaagtcaaggattttctttcatcatttcattaatcaatactctttagatatgtttacttcaccaattgcaagcccttctaattccacgtagcacagaagacrgcattcagtccccstcagaaatgcgttccagtaaatcccttggaaaattttgaactcagtccycagtctttgcctttatatatctttttacataaaaactgtggccccaaatgtgtccatctttcctctggcaaagagaaggccgaraatttggcttcctaacccagagcctggagataccccygccacccagttggcgccctgaggatctyggctcaagtgtgggcaggcttggagccagtgtccaggcacttgtccagatctctggttggacagcccttcagaattcctaatgtaaatgatgctgtcacatctggtggagggtagagatatagccatcaagcrtatgcagcccatgttccaaactaagtctttctcaatcagcgtcaggacatctttaaggccaccccaggaacctacatgtaaamatctgccagcatcaattatctagcgaccactacctctgaatcaggactgaaaagtagtgcttctcacaaagaagcgagcttggtccacatcagacctgaggggtttgatggcttaagggtgggaagctgggtgccctcattctcactcttccctgggtacatttcttccctacctctctgatcttccctcctgcttatcwtgtccaaactgcaggtttgttttcacaaccttccattcattgaaatgccactctgctgctcgtccctttcwaagatgctaagaggatgtggcctatgggagaaggggagccrtctarggaaattgcccccatgctggaagtgggaayggcagggaagagggccctattttccattgaagaaaagccgggacaaatgcttcttttctctttcccaggaatgaagcaccttttgaaaggtgtaaatcctcactggtagtcatttcctttgggtatggtagctgagccttcctctctcccaatgcttgacctccagtaggcatgggtggtgcagtggtatggtcagggatggaggtgggtgggattctcatgctcctctccactctgctcctcagagtggagaacagcatagagaagtttcccaactcatcagaggcacttacccagrggtctcagcggaatcagaacrtctgttgctcccctttctgcaagtttgtttcttcctaagatgggagaagaatagggatagagaggggatttgggtgctgtgaactttctttttccttgaaggaggacatcagctccacatggatggtaacaccactttacctttttgggtctctagattttagggacagaataatttcttgcttatattctgaaatagtaagtggcttgacactgtkgcctttggggacataatggtttgcatttcctgtttgtgacagcaatttatgcttcatgctaccttctccttccccatgggtgccaaaggcctccccagcaccaccccactgttccagatgtgaatcatggagcctcttcctttttctgcatcattctcccccccaatcctgagacccccgtctcttctcttatgcctgaagctcctatgtttccttcttctttatttttttattttttgagacagagtcttactctgtcacccaggctggagtgtagtgatatgatcttggcttactgcaacctccacctgccaggttcaagtgattctcctgtctcagcctcccaagtagctgggattacaggtgtgcaccaccacgcctggttaatttttgtacttttagtagagacagggtttcaccgtgttggccaggctggtcttgaaatccygacctcaagtgatctgcctggctcggcctcccaaagtgctgggattataggaatgagccaccgggcccagcctgtttccttctttttgattgtatgtcatctttacagtacagttgtaaagagacaaaccttttatttttagtattctactttcaaaaacttaggatgaggggcatttaaaaataagttactatattttttctctttacaaaataatctttgtttactgcaggaaaaaaaaatggaaactcacataagttctttagaaaaaaagcaaagaacaattattctgaatttgaccaccgttaacattttggtatagtttmtcctaatccttgcatgcatgtgtgtgcttgtgggtgtaaataaaacgagatgtactgtacattttgtgacctgagttttctactcaataattattgtgaacagggagccatacttagcctggcgttttggcacgatgcttctaaaaccaaacagaggggcatctttttgttgttcatcccctgcctgttcaagtgactgyccagcatgtttgccttttatctaagccatggctgagtgttcttttcatttctctccatatgtccatgagatcttgtttctgtggcttgacgcctttctaaacgcatatttcttgctttggtatctgggtkcccagagaacatcttcccctccaggagaggccatcagtgacttttgctgcaactttgtctgctcttgatcctgtgactgggaaggtcagcatatctcatccctggtgaggagcagaaacccagatgaggaaggggaacaaagtggtgcccagaattgtcagcctggaagatgtgatgtggctccgagtccagagccctgtgtccaggagaggcctggagagaaataagtgtggaaactcgtggaaggaggaggctagggtgggaccaagacaggcctcccagtctcagaagggccgtacaactggaagtacatgtgtcccactctccgtggccctgagactggggcaagcacatgagttgcacraatggccacagcagatgagaatgcacagatcattgagatctttattttacagatgaaaaaactgaatcccagaaggagaacattcctatagcaagtaatgacagagctgggtcttrgaagcacatctcctgtctgtcaggacagagttatcctrtatcccaaccttagggcagatctgagaactgacgacagcaaggcaagggaatgggttacgaggccaaggacaagtgtggctcctcagcgaaaaatgtcaaacgtaaagttgagttcccttcctctttcctataagaaaggctagggtttggaaatacgagggtctggaggaggtgacaattggctccctttcccccwaaagaagccagccaaccagaaagtgcttcttaagagcctgatttaagctgagactgagactaagaagtccagtggctcagaagtggtctctgcccccagagagtttgaggtctaataaattgttatattgtgtggcagagactgtgtgtatcatggaagcacgatgggaagagatgggtatgatgagctgcagctggcagaaaactcttggaagatgctggttttacaaggacaaataggatatgtgtgtatatgtgtgtgtgtctgtggaaacggagcaggaagagtgtagcatctgaccatggagtcacactgacctaggctcaaattccatcttctcagttacattcattcatccatccatctattcattcattcagcttgtattgatggargstcaggaactgttgtaggtttggggaacacaacagrcaacccccctattctatggagctttcattccagtaaggctgcagagtgaccttgggcaactcgactgcccatcccttagctttcaagctgcagtactgcctcccacctcacaggctgtgggttcctaagagccgtaatgatgatgataaaataagtactatttactcagcactaacaacctaccaatactctgctaagcattttgcaaggataatttcctctactcttcacaacttccccaggggacagggttttacagatgtggaaactgaggcttagagaattgaaataatgatycagaatcaagtgacagagacaggattcaaacccagcaatcataaccactgcagtcaakgtggcccacctgaagtgtgttgggagtggctggaactgacacctgaggagctctgtgacccagcagaattctgtgcttttcctggggagagcttcttctaagaagaggtggccacgacagcygatagaaggctgtgacctgagtgcaagccacgtgccagccactttctgtatgtgagaccrtgctgcttgccaaaagctgttagttccttccattctggctggctgggagagatttctcatggttgygygtggggagagttgacatgtttatgtggaggtaatgactgtgttggctccttaaggaagaattaggatgagagcccagttccctgtttggggacttgaacttagattctctggtggcctggaaaaggtggataccttgcaggttaatgtaggaagttaccatcccatgacaattttattttactcttctttcctttgcccattagctactgcaaacttaaaattacctatagtggakagtggtartagtctacttcaaaaacagcaaattcccagggatttgccctcacttttggaatcttagctaaatatttttttctctatgggatcaccctcttttgcatgtgactgaggcaagccttaaagatcaagctgatgttagagcagaggaactgctggttggtaaggatgcctcagagatgaaaaggagaggagggtggtctcagagaaccagaagaggagtgggwaagttggtcctggaagaggacttctcactccttccccaagccttgccctgtctcttgacctcccttgactccctgctcttccagctcagctttgtccatgggctggactgaatattgccagcaggtagtcataaggacccatgcgatcccctaaatcaatactgaatacaaaggaagctgttgtttctgcttctctggmaggagaataggaagtgaccactggcttgagaagggctgtgctaccaaagtaaaccatcaygggactggttctgaaatgatccaattccctgtctctttaggatgaatctctttaatccaagtaccattaaaatggaatgtagtgatcattcagattcaactaatgtttattttatgaagtggctactatgaaccaagcactgggataaagctttagtacagttaggccattttattcacttaaagagcaaagggctcaaagtttacctttccgtgatctatgagaaaaaagstttaccaagcaaatgagtgctatatgcaagattgccaaggggagattttaaaccacttayaaggacaaactgcttcccagaggcctgccaatgcttcttaagtactcccttgtgtgggcaaacacagacccaggagacaagcgggaaggacctaggacaaaaagtcagcaggctagattccacttctggttctgcactgagctagccacatgcctgctactgcatggtgtcatctagtccccatttcttgtccacaaaactagcatgagccctccacaaaagccttgctgagcaaggggttcagtgtgccccttttgcataaaaaagggagaaaataagaatgaacatgcacacacatttgtatttgcttccatgttcacaatgacatccataagcttattcaagaaattaataatcatggttacctatggggagtggagaggtaggagtgagacctgggcagatdgagacatagatgggaggaagattcctccccatggatatattgggttttgttgaaccgtaggaatacattacctatttaaaaatttaattcgtgggaagggcctcctaaaatccagacataagactatgtagaacttccaaacaaaaagaaagtcgtgttggyattacctgttctattatactgatgttggctcttcctaatcattaattttttttctaagtgctcccaaactatccttaaattgttcatttctagactcttgcctggggtggatgatattcctcagtgccaggtcactgggcagagatttttcactgtattggatctcttctgctttgtctactttcttatttgtgaaaatatgtgtgcatacacacagagacatacacacatgtgcacacacacatgcatgtgcacacacacacacacacacgagctgactsccttaaaccaggtagctgacctccatgggtccacactctrggtccaaactcaactgaaggaaagtgaactgaaggagacatttgtgaatttgattctccaacctaaggactttgcttttcaaaccaagagtgttcagaagggcacagactgcagaacatgaagacttctgttaccattaacatagttccccggctccatgagacatgaacagcctctctgagaatgcaccgacaactcagcatgccttgtaaacagaccayaattatagagcttggttttgactttttttccagggccttaaagttgatatatttttacatttcctggattggagggtagggagcatggctttgrgtttagcttttgctctgctgattatctcttggctctgtgaaaaaccttggcagtgctgtggggaattggtgcggtggggaatggaggcttgaagagtcagttgacctgcagaccgagatagagcttaaggtggaaacttggatgaaacctttaggctgtcccttccagtcctcagcgagamcctagggatcaccatgtgcaatgctatgtggatgtggcgtgtgacaccacaggcaccagagggagtttctgaggttgcagaggtgactgagcaatatcttccaagctccctggtgtattctggtttggccaagcaatgtgttgctgcaagagctcawggaaaagttaacacatgggaagggaaagaaatccattaggtgactgcattaatggatggggagagacttccaggacacagactttggcaaaatatggtcatcataaagaaaatggctragtatatctctaggctttcragtattgtcatttgcactgtgttatttttccctccaaggggttatttggggaaaattgtatacatcccaggrttgaacttccaaacaaatgcaagctgcagccagccccagagctgcagatgggcatgtccctagggtggctttagaaaaatgtagttctctctgtgctcagctcaacctgccccctctgccctgagatgcacacacacacactcacacacacacgccactcccccccgccaccccccacacagttccttcctttgcagaagagatgagaaaacctctctttctttgtactgtagagcarttcctttggaggacaaagactgttgcaatgagctttttgtctcggcagagtttgctaatacactttaaaatatttattgtgaatgggttggaggaggttgctgtgggaagccctgtgtgttawgtatacctttgcatgcttcagcaatgcctgcccagtgctttggggactcagcagatgtccacagatgatgatagtgactttgaggaacccccatatttcttgaatttttcataatgagtgtagaaagaggtcccagcactggaaaggaaggtggggagctgttcccctcattgcttacagtggtctrcctcttgtagacacaaacctctaccttgaggagcccctttctgagggcaagtgtgcttctgagagggcagatgccagccatgcatcacaatctagggaggtgggaagtgtgaagttgcatggaggcagggaacctgggctctagacacgactctgcctctaacattytgtggaaacctcaggcttctgtcgctttgagccttggttttccatgggtaaagtgagaccatggagacccaccttacataattgttgagaggwttgtttaaaatacatattttggccaggtgtggtggctcacaccrgtaatcccagcgctctgggaggctgaagcaggaggatcacttgagaccaggagttcgagatcaacgtgggcaacatgaagagacctcatctctataacattttttaaaaaaaaattagccaggaatggtggtacaagcctctagtcccaactacttgggagggtgtggtgggaggattaactggctccaaaagttcaaggctgcagtgagctatgattgtgccactgtactccagcctgggcaatagagtgagaccccatctctaaaataaataaatttaaaaaattaatacatgtggaacatttcaaaaacatgaaataatagggaaaacaatgtagtgaaacttcactttctttcatccaacttcagtaattgtcagctcccagttttgtgtcatctctattcccactcccagccccttcccattatttccccttaatgccagaatatgaggacttcatggcatggaacagtggcatggaagtgccctccagagtatctaacacatagcagatgcttagaaaatgtttgtggaatctgaactatttaatagtacatgctttataattattacctactgtaacatggccagagggtacaatatttctcactgccytatggatgagatgacctagtctcaggtcaagtgacttgcctaagatcatgcagccacataggaatatggtgctatcctaraaccatggtttccaaatcccacacgtgtgctcttggcrgtatgctctgctgcctctgtgttgatttttccttttgaatatcttcttagagaggaayaggagacttgtaaagttttatgtgggctcacagtttaaagagaacctgtttatggggttgtaataaccatgtattcayggacacaactgyttatgtctgtgaaggatcagcaattcatcagacacttwgtgagttaytttcttctctgattgtcagagtgaaaggtgagtaagatcacttctctcagggagctcacagtcatatgcactgagtcacatgacayagagtggagagtgatgagcgtaatggcaacagcatgaaccaagtactgaggktgcatggaggaaggttgtttaactcctagcttctgtcttcattaagaattaccaatacttccagccatttatgacaaacccacagccaatatcatcctgaatgggcaaaagctggaagcattccccttgaaaaccaacacaaggcaaggatgccctctttcaccgctcctattcaacatagtattggaagttctggctaggacaatcaggtaagagaaataaacaaagatattcaaataggaagagaggaaattgaattgtctttgcagatgacatgctcctatatctagaaaaccccatcatctcagccccaaaacttcttaagctgataagcaacttcagcaaagtctcaggatacacaatcaatgtgcaaaagtcacaaacattcctatacaccaacaacagacaagcagaaagccaaatcatgaatgaactcccattcacgattgctacaaagagaataaaatacctaggaatacagctaacaaagggaagtgaaggacctcttcaaggagaaccacaaaccattgctcaagggaataagagaggacacaaacaaatggaaaaacattccattctcatggataggaagaatcaatattgtgaaaatggcccacagtaatttgtagactcaatgctattctcattaagctaccattgaaattcttcacagaattagaagaaackattttaaaattcatatggtactaaaaaaagagcttgtataaccaagacaatcctaagcaaaaagagcaaagctggaggcatcacgctacccaacttcaaactgtactacraggctacagtaaccaaaacgccatggtgctggtacaaaaaaaggcacacagaccaatggaacaggatagagaactcagaaataagaccatacgtctacaaccatctgatcttcgagaaatctggcaaaaacaagcaatggggaaaggattccctatttaataaatggtgctgggagatctggctagccgtatgcagaaaattgaaacyggacccctttcttacaccttataccaaaagtaattcaagatggatcaaatagttaaatgtmaaacccaaaactataaaaccatwgaagaaaatctaggcaataccgttcaggacataggcacgggcaaagatttcatgacaaaattgctaacagcaatttcaacaaaagcgaaaattgacaaacaagatctaattaaaccaaagagcttctgcacatggtaagaaactattgcagagtgagcaggcagcctacagagtgggagaaaatttttgcaatttatccatctgataaaggtttaatatccagaatctgcaaggagcttaaacaagtttataagaaaaaaaaaacattaaaaagtggggaraggacaggaatggacacttctcaaaagaagamattcgtgcagccaacaaacataygaataaaagctcaacatcactgatcattagagaaatgcaaatcaaaaaccacaatgagatgctatcttacaccagtcagaatarctactattaaaaagtcaaaaaacaacagatgctggtgaggttgcagagaaacaggaacgctttacactgttggtgggaatgtcaattagttaaactattgtggaagatagtgtggaaattccttaaagatctagaaccagaaataccatttgacccagcaatcacattactgagtatatacccgaaggaatataaatcattctattacaaagatacatkcacatgtatgttcattgtagcactattcacaatagcaaacacatggaatcaacccaaatgtccatcartgatagagtggataaagataatgtggtacatatataccatggaatactatgcagccatagaaaggaatgttatyatgttctttgcagggacatggatggagctggaagtcattgtcctcagcaaactaatccaggaatggaaaacccaaacaccgcatgttctcacttataagtgggagctgaacaaatgagaacacatggacacagggaggggagcaacacacactggggcctgtyrggagatggaarggggtagggagagcattaggcaamatatctaatggatgctgggcttaatacctaggtgatgggttgataggtgcagcaaaataccatggcacacgtttacctatgtaacaaacctgcaygtcctccacatgtaccctggaacttgaaataaaaataaacattttttaaaaagagctrtcaatacttccaaaagttgtgaccctggaaccatggcaatttgtactcacrcttatacaatcctagaagctgactactaggtttaatcttttcatgaactaggagtcttcatkaggtcaatgtaccagattargaatgaccacaccaggagaggtgccatctayttatctattaatcaatattaacactgaagttttaggccaactgtaaagagctaaccaactgtgaagtgtgggaacttgatctacacttctgacagcaattgcaaattcaagggtcccgataatttgttagaaggactcatagaactcactaaagtctgttgtacttaaggttatggtttattacagggaagggatgcaggtcccttcttcaaccaagggaagaaatgcatagggtggggtcccagaaagcagcaaacgcagagcttccgggtgtcctccttccatcaagccaggacagtgtttctttctcagcatcggcatgtgacagtaagttcagagtattgccagccagggacactcatgcaagccttgtgtccagagtttttactgaggcttgagcacattccacctgcatggttgaccttcagtcaccagcccttctgggggtagacctgatacaatgtggctcaaaacccccttcatagatctcgttagaagattgtccaacggccaaagccccaaggcaaacaaagacactcccatcaggcagggcattctatggagatcacttcccagaagctggggtgggtgggggggccagctgctgcaaaggcgctctttggttgaggttaattctttgccccacagccaccraagagtcttcatctgagaacatctaaatggccaacttttggagatcagggggaaaaaaggggtgractaagtaatgagcatagttctgaaaactgttttattttttcaaggtaaaatttggtaacgaggagcttaaacaatttttttttccttctgggtcatgaaacgtcacacagcagataaataatggcagagctcaggtygctgtgcrtttcatgagtgcttgtcaaccagtggtgatggtgagccctgactcgggcagtcctgggatacctgcccaaatgaataaggggtgaaagaagaggacacaagggtggcyccctttgggaagagcagaagttgaggctctcgttccttcccttctgtcttcactccttccctaccatcaatgtttctctactgcatgatgaacaaagatgggtgggaaagagagaaagactctcttcatttctgttatgtattcattgtcctggtagctttttccaggytgcctactcttttcagtgaggtaggtttctcttctctttcccagcctcaaccttcactattctgtttctgtatcagaagacaatcaaaacctaacacatcatccacaaattctgacctggcatgtccaggattccagagrgccctggttaccctttgtccagggcctgcagttgggtgatgatgatgagaccaaggagagggcaagctcttacattaagctgtgcattttgttcactaagtaaagagttgccttgtgcgtgttctggaggccaactccagccayttctgtgcgttaatcatttgttaygatttgagctcatwggaaaaaaatcccccagccagtggcacaggggggtggctctgtaccctgtggtacagagtaggaagcctggctggatcagctgaggctgtggattccctggccgtcactccccaaccatgcagtgagtcagggcctggagtgcaaagagaygatgtgttgactccctgggtgggggtgggggtggggggtggygggaccagrgtgggaccagggacyggaatgtggggcaggmtgcagagtggagaggctcgctcagrtgaaggcactactgtgtcaccattggctcctgggtcctggctccaggtggggagaagcagtttctctttctggggcaacaaataaaatccctccgrgcacaggagtgctcattgctggttggttatgccagtstgtctctatttttagaaagarcyacaagarggaggaaaagaatctagagaaataagtacagwtggattcctccctgrggcagaagctgggktctgtgggwtgaagcacagayrcaaagccattgtcctgccacccagcagtgsagtcggagatrgatggcatgaatctagaataccatgggaatgggtccttgccctgggccagtaaacatttgagactcagagccaggagataggatgaraagattgcagtgatgagacccacaragggcagcagccatctcttaagggrtcaacttggagaccaaatccatcacttcttggaggtccagtagcccctgcaccytctgcgcyttgcagagacatcctgcagttcagggaagaaacggagctgaagggcatgtgraagaagaatgtcacggagatgcaaggggttggrttattggttggcttaaggtcaaatcaytatttgctgcctgaagaaaaaaaaaagaccttgcttagggacagaagtccttgtcctggtcttaggtcagatgagggggtaaagraactcttccaactgtcaaggaattgggtattttgccaccaaaaagtttcatgatcaaataatgatgatcataatcagtgaaagctggattaaactgaaaatagtacaggacttctccaagcctttcctatgaatttgcccattaaattycctaaaagagagagagaggctatgcgtattgaatatctgttagtacctggaaaatccagttttctgtttttcagtatgggggagaacagaaccctgcttgagtgttgaaacaaattcctctgaacacagtatggggaattcagaagagattaaaagaacatacgattggaattattcagatctggatgagaagcctgggtcagctgtttactagtgtactagtgtaaccctggtcaagcaaccaaacttcttgggtcttaattttcttatgtataagatgagactaataattcatatctcataaagttattgagaggaataaatgaaatcagataagtaaagaatccttaaaagagcctgtaacatagtaagcatataagaaatggatggatgcatgtatggatggatggatagatgggtatatgaatggatggatggatggatggatgcctggatggatggttagatgggtgggtggatagatggaaagatgggtagatagatgggtagaatgatggatgcctggatggataggtagatgggtggrtggatgggtggaaggatgggtagatagatggatggaatgattaatcttggcccactaccttagctagatagggtcattgttctagcacatacccagaccaccaagcatgagtttgygtgtatgcacatgcatgcgtgygcacatatgtgcataagtatatgtaagcactcatgtatgaattttcctgaatcttttccaaagacagaaaatttagaagctcttmcaccatgcttccataatatcctggccmtggctatatcacaactactccactgcactgtaactgtttcatagcccatctatctctgytagaacactaagcatmctggaccacaaaggtcatagcccagtccccacaacaccatgaatgcttataaaatcattgtaaaatgattcttctcaattgtctaggcaagtagggccactgcaccagtgacatcttagaggcctgacccgaccagcctatcagtgtatcttaacccctcttgaggstcagaacaaattcctctgaactcagcactcactagggagttggagggggctgatgacagggctggtgtctagagtaggatgagatgagttctgggagccatagcagtgcagaggttcctgccatcagcatttcagggtatgggctgagcatttcagcatttcagggacctgggcctgggtctcaggtgttcccttccttgccacatgggatggtgagtgggtgatcatgtgcaggagctgagtcttagttggatttgtggagttcattcagtctgctctccaatgctaagacctgcacatactgctgtattcagcagtcccctgcacacagggcctagtcctgggccctgtgggtgagagtgagaaaggaggaaagagactctacctgctcattcacccacagtgtaaccattccctgcttcatttcctccgcttaatggatttttcttcctctgtttggctccgcttttcctctctgcaccaaggcttgttgagttgaggcccatgcccagctgaagcccctcgtgccaaggacacagacttgcttctgccactgagctgtgactctgtccaggatgccttcagcctagcaggacagggcagrctsctggacacggagagcactgggcccagagaagaggcaggcatgtgtggggcatggtctctsctcgcctgcaggccacgcaggaaggaggaatccttcttaacgggtcatttcacttactcatttcagaactggttactgagcagtatgtgttatagtggctctgagtgtgtctgcaggaagtgtcagggcccagctttggaaatgattctgttcccctgaaacataatggacaacttgtctctcagggtgttcccaggtttggagaaggtctaggaagtgcttccccatgtcctacccaactwgccttttttggggtcctatcccatttattctggccccttgattttaataaagaagaagaactamccaccattctctgttagttaacaaaatttgaaaccaaaccaacaaacattgcgtgctaggggagttcagtgttatcaaataccatgatgagggccaattgcagcgtctttttttggccagtttattattgttgcaagttcctgaaaatggtttcttctgccatcctagttaaaaaacaaacactattttagatgtaygttgtctgcatcctggcataagagcgatgactgtccataggtggrggctagaactgattgatgttgctaacaaaacaatgaacaatgtttctttacttttctgaccagagcacatggctgttggcaagactcattattgtgcatgtgaaattgatttcaaagggcacaatctttaaataaaaattaccaacacatttcaaaatgtcattttttttttcacactaagaagcctggcacctctgctttgaatggaggacaccaaccatctcttaagttgtaggatctaaggtacttgttaaagtgctttgtgtgtagtgaggaattttaaaacccaataaattcacaaaatgcaaggtagctgcataggtctaggtcttctctggtgtgtcaagcagatgctttgaaaatcaaaacaagctttggctgcaggcctggcggcacgcccaccttcagttcttgcccttcttactccctgaacaactgcgagagtgcagtgggtctgaagttcatccctggactgagtgtcatcagcatctgccccagccctgtaatcagcttgagggtgggggagaagggaggggcgccatgggagccagttggcgagttggcggggctgcctgacagctgacatggcggatcctgtgttgacaccatgcatgagggaattgtctccaagcttgtttccaccctgtgagctcctctcagagaatctgttcacagaggaacaagccacaggartacaggccctggagcaaaamcagcgagggaggggtagttaaaaaacagcatttcccagcattgcccgtgaagcattttcaaaaacagattcctggccctcycccaggttctgagttggcagatctagggaagggccaggaatcggggtatttttaaaagccccccatgtgattccatggattagctaaagtgggacccagtggcatcgccctcatgtcccatcccagcctctgcctgtcacagtgktggcctgtcttccccatggcctgagcgtcactgagtgccaagccccagctctcctcttcccatcctcctgggctgaaggcctgtgtttcaagtccccacccacccccagcacagtaagctataggcaccccttagagctccatcaaggcacagaagggagttgatacagacaggaacaaaggattctgattcccttccatgtttatgtagtaggaaaactaatggtaggaactaggagtattgagcctgaagaaaataagaataagaggagatttcatcaagaactttaaacaaatgctctaaggttccrttctccagtctgtggkctagaacataaagaaaaggacccaaattaagctgcaggcctggagttcagactaagaaattctatgtgacccaaagggacaggaagcactaggcagaggagstgagtgtggctgcaggatggccgttgtagacgtctttgtgatgagcacaggaggctcatggcctgctcgctagaggcaggagggtagatcagatcatagctgggtgtcacttaacactccttgctgcaatgcatatgagaaaagctgctcttcakgtctgtggrccacgcaattgactatttttctcaaactgttgagaggttgctatgaaccttttgcatttttccttcggttttcctcagatccatgagagattggcactggtgtgtcacctgaagcagtggcacaaaattgctttgtggggttcttcctatgcaaaactagatttgaccaacacagcgactgaatactcattcccaatattatgagcatggagcaccaccaaaatgagcccggctattgtttccaaactgatatccactctctgagtcatccatgcaaatgaattctgtgatcagcgtgacccaagtgctggatccatgttgaatgagatttgragttccttgcttttatggagctgatgttttccttaaaaagccagttaggagatgaataaataaacaagatcactttggatagcaataagtgctgtggtagagaataacatggaccagggatggacaaggggcgtgggaaagttctcattgtgggagtgatgctggaatcgagaattgaaggctgagctgagggaggagctgggtggagagtgaggagaggagtcatgctaaggttttgctatggaagccrgcttggcgtgtyctaagaamaggaaggaagccagtgtggctgagatggagtayacaaaagattgcatggyaagagatraagttggagaggagtcaaagcccggatcatggtaagcattggaggccacagcacagggtttagatgtattcaaagttcatagtcatttggcttaagatgttcgtatgatggtatagaaaaggctgtatatcaaggattcatatstcaggatgctccttgacttacagtggggttatggtggataaacctgtcataagtcagaaatattaaaagtagaaaatgcatttaatggcctgataaacctgttgtaaagtsgaaaaattgtaagtcgaaccatcattaagtcagggaccttctgcagtactaatggaggttgctgatagctttaggctggcctctctattttgcagacaagraggctcagagagggatgacgacttgcttgccccaggccttcccacctcattaggagcaacccatcaaagactcattgtaccactatcacaaaataaaagggcctcccttgagagtgactggggagaggcgtctccaatcccaatccaggcagggcacacagcagaacagctgggatttagggaatgaccacagagaagctcagcccagtactggaacccagggaggacgaggcagcgagctgagaaaaagaaagtggagctgcaagctctctggggagccagaaagagcagagcaagtgagctggaccccaggaggggagaaggggagccagagtgttttctgtgtctgctaggaaaaccaagcagtgggaggaagaaaraatgttttccattttagccacaaattacactgcgttctgtcctgggctttaggcatgcctgcagacttaggtgctgtgccacatgactgccttatgcccttttgccaagattcccctcctagactgaggccctgtccctgaagtctttctctactgctggaaggcttcgagggtcagtcataggtgagtccacggggctgaggggtgggacctggaggctcagctccagagaggctgggtgtgcttgggctgtggggagcaagaccattttgcaggctgacattatggtgacaggagctatgggaggctaatgctcagtgaaaggaaagatgtgcattcaaatactggccttactcctctggtcaggccatgaaggcttcctggaggaggaagtattttaagagggagacctaaagagagaaagaagatgatgaagttggtgggggaacctctgctgctatagtaggtgctgtttgtgagaggccttgaaagctcacccagcagagagagagagcatcgagcagcttgggtctgaggggacagtgggaccaggtggtggaatgagttcacacaaggcagttgtgagattttgggataagaagagcagcccctgggtttgtgctgtagaaaacattgcccatmattaactgggtttccttatcagttggggccacagggtccctggtggataaagcaatgatgrtgatgatgctgctgttgctgatgatgattttaatgatgataatgatgttgatgatgatgatgatattgatgacaaggataatattgatgctgctgatgatttaatgatgatgttgatgatgatgatattgatgacaatgataatattgatgctgatgatgatttaatgatgataatgatgttgatgatgatgatgatgatattgatgacaatgataatattgatgctgatgatgatttaatgatgataatgatgttgatgatgatgatgatgatattgatgacaatgataatattgatgctgatgatgatttaatgatgataatgatgttgatgatgatgatgatgatattgatgacaatgataatattgatgttgatgatgatttaatgatgataatratgatgatgatgatattgatgacaatgataatattgatgttggtgattatattgattttgatacgatgatattgatgttgatgattatattgattttgatacgatgatattgatgatgatgatgatagtgatgatatgatgatgatgttgatgattatgttaattttgatggtatggttatgatgatgataacaatgacgatgatgatgttgttgatgatgatgataggcaacaagtattgggttctaactatgtgccagggacagttctatgtatattccatgcattacctcatttcatctccatagcagcaatctcataccgttggcactattttcaatctctttgttatgggtgaggaagtggaggtatagagmagttggtaacatgcctgaagtcacacgttcaattagcgtgcaagctgggaattgaacccaggcagccacctccaggctagaccatactgcagtattcccaggacatggtgagatgccctccagcaaggaagaagaaaagggggatgaggagagggagagaaagacaaatgagcaaataatatwttttctcaaatgtaactttatggtcccrtttcacagattgctggccytgaacctcactatctctttctcctttgtttcagtcyacatatatgtggagggctaaggtggcctgaagtcacaagccaggagatcacagcataactcctctcagtgtatggcttgcatttattttgtgaaagcagtcagagtcccctctctgcccttgaacakgccattctgtgagaggctaaatttatagcattggctgccagattattaatctccacctgaaattgcactggggaatcccccacactcagggcaactgatgcacacagtgggctggctcataaaaatgcataaagctcattaaccagagaccttcagccatgtgagaccagatggccacttgtacmtcctccctgagcccaggagcacctgggttttccttgattctcatctctgacaatgtcccaagggccctcaaatggaaaagcatactgcactccaacctgggtgacagarcaagatcctatttcaaaaaagcataacaaaaaaaaaaaaatggaaaagtatattgcacttcttcacatttttcctctctttctggagtttcgctgtttctcagccttccctcccctaagcgctccacatattcatgtctcctcaagccagccatatcaaatcacaatgtgtcatggaggcacccagyacgggaatctcataagtggtgcttgatcaactttaggagcttgtgttcttgatgaggactttggaacaaactactgctatttgactctttctcagacatagttgaacctgggctttagccttccactgccacctccaccccccatcaagtcaatctctaaatcccactctgccrtgagtccttttgtctgggaccagctcctatctgtcatgcaatttaagctgccctggtttactgaagtcattcgtggaaacaggctcccccaagtgacttccytcagaaaccctgtcctggccctgccaaccytctccatccacagttccctgtggtgtctctgaccacaggcrtttggcttcagtcacctcccaatccgtagatgacctcggcctgctgcaatgtctgggtcccctgtcctgggaaatcaaggcagacaaagtgtccrtgaagacagggatgagaaactgtccattttatttctacctgccactggcctcagtgaattctaatagtgtctaggccatgccctgcatgcctccttacataragagggatctaagtgaggctggttaaatgctrccaagatkgttttcagaactgaggtcctgatagcacctgataggagacacactggttgaacaaacaattaaagagcttgcactatgtatctgacactatggttagacaccagctatatggcctctgctctcctggaactgacagttcatgaagaggaaagacaagaaaatcaataggtacagtgggtggggaatgagtcagctgtgcagggcctgaactaagccatcagaagtacgaatggacaggagaggaagatcaggaggtttaagaagtagaccccatgacamctggggctgatcaaatgtgagtgtgtgggaggaaataacccaagggaatgcctctgtttcaggtgttgcccgctcaaagggtcatggttcagttcacgtggttgagttaggataaaaaakaaggtttaaggaacaagatgatccattctttttgtgacatttgagcttaggacattccactgaagatgctcactaggcagttggacaaatgagtttggagcttaacagagagatctgggctggtgataagaatttgagggtcctcaacaggtgggtggtcacttttagctaggaaaagagtatggggaagtgctggtattaaactcactgcaaccctgtgttccctctaacttcttaagaaagcaaactatagctgckctcccctcaccttccatccacttccttatcatctgcagtgttggttttactcccactattcccttgaaatttcctcacaarggttgcagatgatcttaatggcaaattctaatggacgccttgctgctcttaacttacttgawctctctgtcaagaagagctgtgcctctatgtcccttcctgagttttggtcacactrttctcttcttactccttccaatattttggctacttcatggtccatgtattttttagatgacagagcattgcacgacatgagaggctgtggagtacaaggaaggcactggactcacacacattggattccagagctgccacttattcacttgtgaaygagttccataaccttctggaaccttcaggtcctacggctatagaatgggaataataatcacacctcacgagttattgcagtaattaaatgggatatgtctaaggcacatagccaattgtcagtcacattgcmaacaatttaaaaatggtggctcttattttttggtgcgtctgcaggctgggtggccacacccagcagaaggaaatggtttaagagagttaatacagttccctgactagcagcaatacagcagcagcagcactcactgtacctgaaaacttattaaaaatgcaaattctcaggccccattccagagccactgaattagaatctttgggaatggagcccagaaatctgttttaacaagtcctgcgggtgatttttaaggtacctgcaaaagtctgaaaacagttttaagataaaggagaacaaagtcctagaggagaggctgagatttaaaggaaaggcggaaagactggcagtcaacaagagggagggacatctctccaaatgagacagaaaggtcagatgtgaaaaaacgaagataaaattgtaggtggcaaaaggagaagttgagattctcacatgatgatcttgagtttttttttcccaataaaaaagtgaggttatgtaatgagtgggagaaaagggatagaagaataggggacttgcgtagagagaggggcaatttggacacaaccgatgggtrtataggagaatgagaaaagtatggccaggcagcaacgggggcacacctgatgttgccagttgtgactgcatagtgacatcaatccatgcagttgtgtaattttttaagtggcaytcaggatcccttatcttattgagaagtgggatggctgctctgattcaatatgaggcactgttatgtggctctgttggaagaactcaggcacagaagcatgtgtgtgatgtttagtgtgactggagtgatgggccagactgtaaataagagactaagagtagtggaagaataggaagtgaagagttccaaatatcaacattacttggactgtggtgaggagctgctggccaaagtgaagtagggttgacattaggacattgaagagcaagtcagtttctggatctcagttgcttgtgatgatggcaggattggggaagatartgatgcaratgataawcacaaagtacaagtccttatggctgaatggtgtgccccccaaaggagaggctctcatagacagaagagtaaaggcttggaagtgataggcagacagcacctcagctccgctcctcagacagtacacagaactgaatgcaagtaagcaattgctttcaatattttccaccatcagaataaatcaactactatggcattaaaacataattcatgttttaaaggcccctgaatattatttagaattaaaaatctagaagcaaccattccttataaaggaaccagttagcaacagccttctaaacaactgaacagaaatatcagaggccctgttctggtgttgcctggaatgaagtcactcactagccatgggtgtgtcacctctcctcctgtacttcaggactgatctgatcagtaagggactggattatttgtcctctatgacccctgccagcctactatcagatgacttgctatctgctagttagaagtctcattctgttctgatttttgatccttcatgtcataatgaaagatgcactgtagattaccagatagtcaggaatctgagttaaccttatctacctaaaaccctgctgctgtgtataatactaacttctcattacacggagccatttgatcatactctgtgttatggtatctccatgcttttgcatatggtgctttctctggaataccctcatcccccttttcatcccgggaaactctaatcattctttaatcacagttgaaatgtctcctagtcattgaagtctctcyttaatcctctgggctggaagtcactccctcctctatgtttccatgacactttgtatgtcacatcatgtcataatttgcgttcatctttctcagtttctgctactacctagggccaagaatttgagctgttctyctatgtatgcctagtgcctggtgctagcatgatgcttggtacatatttgatgttcaatgtatgcytcctgtatagaaacaagagtaatacaactcacaattatacagaacttataattttccaagtactgtcacatatgtggtatactcattgagtgctcagtaaggaaagttaccagttgtcccattagaccccattagagatgctgatttgaggrcacagataatttgaacaatatgccctaggttgctcagcttataaagaggtggagacggaatgaagcccacatcctgtatttccaaatccattgtatttctcttctctttgccactgcccccaaaatatttgccagaacatagggtcaatgtatgaacattttgatagaagccagtctgacctattcctggccctcttgttattatctggagggttgaggcagatgatrawaatgaagtggccagtgacgatggcaaggtttggcttcctgtcctttgtgggcttcccaaagaatgaggaccacagcctgcttcttttgaagcccaaayccagttccactccagtcctggccacttggcatttatcgtcttcattctctttttagggttgggagtaacctgcactggtttcacattggtatgactgagtatctcttctttacagtcctgctttaagcaaattcaaaatataaaaatctggattaaaaacctaggagaatctgtagatactgccccttcagagaggtggagtgtaattcccmcaccttaaatgtgggcactttgtgactttcttctgaagagtaaagtatggaaaggagaaaaaaagaaactttgcaatagaaaaatctgacagatatgatctccaccaggagatcaaggttgacatcatcagtgatcagtcatattctagcctgtacccttgatatgatgtgatgaaaatggccccttccctctgtggtcttcctcccccaaatgcataacttcagtctaatcatgggaaaaacttcagacaagcctgtgttgagggacattctacaaaatacttgaccagtacacctcaaaactaacaaagtcaccaccaccaagaaaagtctgagaaactatcacagcttcgaggagtctaaggggacatgacaactaaatataaggtgttttcttggaggggaccttggaacaggaaatggatattaggtaaaaactaatataaatggtacattattaaatttaagtaatattagattttatgttatatttataagaaaatatggataaagtatgaactttaataatactgtacaatatcggttcattggttgtgaaaaatgtacttaactaatgtaataggggaaactgggtgcagggtatatgggaactcctttgaagcttttctgtaagtctaaaactattctaaattaaaaatttatttaataaaagaaagaaaatagaggaaggaaataccatatcttattaatggaaattcaaaatggtacacccactttgggaaattgtctggcagtttcttataaagtcaaacatatacttaccctatgacttggtaattccatttcttggtaattatccaagggaaatgaaaacctatgttcacaccaaaaacagtgcacagccacttttacaatggctttattcataattgccaaaaactggaaacaattcaaacatccctcagatagtgaaaggataaatgaactgyggtacatccacacagtggaatattattcagcaataaaaaygaacaaactaccaagacatgcaaccacatggacaacatgaatttcaaatgcactatgctaagtcagagaagccagactcaacagcctgcatactctatgaatccacttatatgacattttggaaaagataaaaccagaggggcataaaacagatcttgtcaggttctggggattgggggaggtgatagactacaaagggacatgggagaataatgggaagtgatggtattgttctatgtcttgattgtggtcgtggttatatgactatatatttatcaaaacttacagaagtaaacactaatgaaggtgaaatttactgtgtgtaaattatatcttaattaaaaatgaagccagctgtggtgtcctatgcctgtaatttcagctaatctggaggctgaggcaggaggatcacttgagcccaggagttggaggttgcagtgagctatgattgtgcaaytgcactccagcctgggtggcagagtgagactttgtctctaaaaaaagaaaaagagaaaaaaaaaagaaaagaagaaaacaactcaaggatgattgccactttacaaaattattcttcaagggatttgtttaaatagcactctcacctattgccttttcagtgatttcatttccaaatgtttagcttgccaaaagggcacttatgtggttttattactgtgctacttgctgtctggaggctcagaatgggagccatcatcaagggacatagacacaaagagctgagamaaagaagctagcacagaggacagctaggctcctgtcttaacaacgattgcattagctaagtgctttatagtcacctgcttttgatataatcatgaagctggttagaccttacttttatgagccttccagtttacaaagctctctcatatgcatgcactcatgtgatcccacaatacctgggccacttaggtgggacaagtgttatttccattttaaaaggagagagaggtgctaagagttctcatacctctgtgtgcctgcactctcttgacctgcttcataggttgggtaattttaaatgcatggcaatttggtgtgatagatctaactatattttrcagatagggcacataaattattttacagataaggaagctgatgatctgggaatttcccaaggtcactcacctaagaagtaccagagccaagagttcagaacttggatgtcctggttccaagcctacttctctttgtactgtcttatatgctggctataggatttttaagcagagtatatttaaattaaggatattttgctgcaagtcttcgtattgttaatgtatccrtgaayggagagttttaattggcttccattattagagccagattattataagtaaagactactttactcactgtcatctttactagtgactttggcagcttggaagacagtggtgcaatctttgtgtttctcttggcttcttatgttgggagtgtctgaatgcatgagcactgtgtgtgtgytgggagctgtgacttccagaaaaaagagatcaccaatgtaaacatgagaaggggtgatttttcaacatccactagaatgttatatcaaaatgagcattttttctttaagttgctttgagaggacatttaatttggttgctttttagttatgtctcatttttatgcaaaatagtaatgccaccttcctamtctggtttagcttagaagtgcttttccttgtttccttggtggtctctgagctcctcctgggcagagctgaaccttctcctcagcgtgtcctyagtatctagcacagagcctggcccattggcactgttcagactgtgtctgttgagtgggactgaaccaagactccagggggrctcaggaaaagtccctccctggcccctcaaatttctcttcagaatccctattgagtgttatcattcgtcagcccatcctcagttttccttgtcaacagcttaaagaaaaatcttttaaaaatacccttaggtggctgggtgcagtggctcacrcctgtaatcccatcattttgggaggccaaggcaggcggatcagatcamgaggtcaggagatcgagaccatcctggctaatatggtgaaatcccgtctttactaaaaaaatacmcacacacacacacacacacacatgcacacatgcacaaacttagctgggggcatcgtggcatgtgcctgtagtcccagctagtcgggaggctgagacaggaraatcactcgaacctgggaggyggaggttgcagtgagccaagatcataccactgcactctagcctgggcaacagagtgagactccatccccaccccmcaaaaaaatacccttaaggaaaactttagtgtgtgagtgaaactaagaattaatactgaaggaaaatgaaagaagctctactccctcttgatgtttggccttatctggaagaatatgaaygagtcttgttctaatcccatcagaaataggttcatatgttcytatttcttcaggatggccacaagatgtagttaccttgttctcattgtgtgatggaaagcctgttgggctaagagtctagcaaccggattctatcactaagtctgtgcaaacctgaatctattgcttgtktacataatctgtaaatgcaagtgctaattaccaagtgaattcagctataacactcatttctaccacaatttagtaagccaactcgacccatcgctcagttccaggcatgcactgagaattttcctcttctcagctcccttcaggctcgctcccaagataaccctcactcccaaactgaccagggattcttaaacctttcggtgtgtgggtgtcatctctgtttccttagcctgtgagctccccaggagtagtgatcatgtcaattttcttctgtctcccactgtgcgtggcaccaagatcaatgcacagtgggccccagagggatttttagaaagaaatcttttagtataagaatgtccttcacttacagtacaagctttcaaaggctagatggcactgttgctagcaccaaatcaggtgtgttctgagtatcagtggtgaggaggggagaggagagagagcaggggccctggagcgctcaccgctgagccccattcagacaccttgcagaagtactcctggattcttgccttactggcagggagtgctctgccatattctcggcaccttcccaaacacggcttcagatggtcttcccagctaccttgtgtagtaggcaggacagctgtatcaattctaattttatagaactgcagctcagagaaatcaagtgcctgaactaaatttatacagcagagctgtttaattagcagagctgtttaccattcatagctgttggcagcccctcccctgtcccccaccaaatgacggtcctcagagcacgctgaaggaggactctggttactgataacgattgtcgcaggataatggcctgggtgaactggacccagtccgaggggaaaagggtaggattctcagccaagttgattgaatggatcagcttaacctgtgcctcaaaatgtttggatttgtgacgagggggagcacataatactacatgtagcctctttgaggaacaaaattgtgggtaatttgcacaacgattaggctctgagatcagtggttggtattttatttagcagataatctatttataggatgctgccctgtggttgggtcgtatctgtcatttgtccactgctttactatattcacatggttctcactcaaacaaaacaaagaaaactgtcctgtgtagyaggcagggcaggtatcactaccgtgcccaatttacagatgaaaaaataaatgtcagaaatgttaataagagacatatctaggatcacacagctgataagtggttgaactagaaattcagccccrtgtgaggctgaaatcaartcttgttttttcactgtagtttttccaggctatgccaacttatctagaaattacaaaattagaagggcagttgttgatatggagagtaaggcatcagtgactagaaatatatctatatagagtgataatgatcaatcgcatgcaaatatatgcaaatgaragcaaattaatatctgttatttgtgcctcctgattgtctctactctccygtttctccccaggatgatgaagataaactgacctggaaggatcgtttcccaggttacctgatgaactttgcctccatcttattcatggtaatttccttgagggaccacttgcctgtgactgcatgcatgtagatgctgttatgtgactactgtggrtattatattctgctatggaaataatgagmggctggtaaagsggaagccacagtcctgtgtagaggggcaggatcttgtctgatagtgaggccattgaccacccatgctagaatttggaacttccagggagtgggttgcgagatggtgcttctgcatggagacagaccaaaaacttggagaaggaatcaggtaagatggctgcaattgcagcagcctgtttgggctgtggggyggccctctctgacgtttgtggatagaccagrgtctggaagccacaggagatagccagcttgggctcggtaagtgtgatccttccgctttcctgtagttgctgggtttatttccttgcgctttaccttagagtttggtacagcccttctgcaagacccagacggtctcagctgcgtcagggaaagctcagggaaaaccctgtgattcgtatttgacttagatcaataaagtggtagcagttcattcttcgttgccagcatgggcaagacmgcagtatctgaagctagaggaccttggggaaggcaaaaatcagaggactaagttagggttactaataccccatatctctttatggaaatcttccttacagtattcaagattggaggttctgctttacaaaggagtgtgtgtactcacagctcagagcatttctaagtagggctacacattagttgcagggtggaagagggatcacttattccaaaaattggtctggaaattgttgtaactctgactctggcctgaggttaccactaccattatttttgccatcgtgaccgttaactacaggaattgtgttttcgtctcagaaatttaaaaggtgaaggaaacttagatatcaccaattcaactcctcatttttcagatgaagtacagagttgatgggtgccttgccaaagtttagaagtctaaatttgttttcttctcattgcttaacaagtgcaagccatgtggaatttattcaagaggatgtggtgagttgccgtgtgttaagctgcaatgatagaaagtttaatttagcacttcaaagccccccgcaatatgcatattattgttaaagagtttattcattcattcaatatttaatgagtcaaacgatgtgcttgacaccatgcttagacactggggatacagcagaaaacaaaacaaaataatccctctcttaaaaaatttgcagacaataaatgagtaaataaataataaaaaataggtaaaaataaacttctatctccagtagtagtaggttaggatatttgtaacatcccattttgctaaaatttattttwaaaaattggataaatgtatttttcaatcttctcaaagcctcgaagggctgacaggataggaagtaataccaggctaaaatctaaaggaaaatgggaaccaaagaaacaaatacctgggcactagagctgcttttaccttgagaacattttcccatctcggcaaacctaggctttggttttggtggttttatgggagcarggaggatagaaattagggttgatggatggccccaaatggggattgtaacaggatgtcctcaccaaattaaatcagaactccaaagggctatgttcagagtaaagatgaaactgaactatacacaccctttcccacttatgagactgcagaaaaaacttgttatggatctaagcagaaaagggagaaaaggggaaacaaaatcctgtgcttaagaagtggccaggggcaatccctactgtggctttctatcctgggtcaccacataagaggatcagggaacctcaggttgtgaacttaacctaacactagtagggctcccaggtgctcagcagaagcaaatacaacctctctctgtagggaagcatatttatgccaggcctcaaaaaatcacccaaaagaatttttcaagggcaataaagagaacacagtcaaaaacaactaattactcaagaagttgaagcaccatatgaaagaaccagkgggaacagacagcaaagaccagagatattgaaaatatcagtcacaggttaaaacagcaaccttaaaaatatacacaaagaataagaaactattttgaaaattatctagcagataatgaaaactaaccaataaacctctatctgctagaaataaatatatatagaaattaacaaaaatattattgktatatatatgatttttatatgccatgtatatatgtgtatatatrtgtgtacacacacacacacacacattcacacacacacgaccatggatagatttkttttttcttgagacggagtctgattctgtcacccaggctggagtgcagtggtacaatcttggctcactgcaacctccgccccccgggttcaagcgattctcctgcctcaaccatggatagacttaacaacaaattagacaaagctgaagagagaatttgtaaactgcaatacaggctggaataaattatccgtaatacagcatagcgataaaaaagattggcaatatggaaaacaggttgaaagagaacaggtaatgagggagatataaggactggtggtttcctaatttgatgcagtacaccaatccatagattgaagaatcctagtgaaacccaggcagaaaaagtaaaaataaatctgcatctagatgcatcatagtgaaattatagagtatataaggcacaagaaaagtctcaaaagcagccttaaatccaaaggcaaattaccttcaatggaaagacacctggacttacaactgatattttatagcacattggaagtcagaatacaatgaaatgccctcttcacgtgctgaaaacaaaacaatttctaactaagaattctatgcccaagaaaaatatcatgtagtgataaggataaaataaagatatttatagacaaatagaaactgagagtttgctaycaaccgaatctctcattaaaagaaattctaagaatgtaccttggatgtgatcccatatggaagaccatggttttagaaaggaatgaagaacttttaaagtggtaaatatgtgagaaaacctatatgaaccttgactgtgaaaataataatgccaattctcatgaggttaaaaaagatagaactaaaatatatgcaacaayactatgtaagttgggtggacaataaatagaacaataatgttctaaggtctttagattgtccagtcgataaactgattttaagatttatgtggaagcacaaaggctaagaatagtcaagaaactcttgaaggatggatatgttactctaattataaaactacaatgagtaagataatgttacattcttgtgagaagagatgatgagaccaatggaacaaaatagaaaaccaagaaccagattaatgcaagtggcactgcatataagtggggaaaagaatgaacttctcagtaagtgcttctgggacagctgggtgtccaaacagaagaaaataaaactgggccttgttcacaccactcaaaaacatcaattttaggtgtattttaaagagggactgtgaaaggcaaaacaatcgagtttttaaatatataagaaaaaaatattttcatgaccttggggtagggaagaatttcttgagcaagatacaaaaagcacaaccataataaaatgctggtaaatttgactatattagaattaagaatttaagttcataaaatacctaataaactctgtgagaagacaaattatcagaatgggataatatatttgcaacaactataactctcaaagaatttttcttaacatatataaagaattaaaaaacatggaaaacagtaattcagtacaaaataggaaaaagatgaatatgtasttcacaaaagagggaatccaaatggccaatgagcctataaaatggtacccaatctcattagtaatcctggaaattctaatttaaaccacaatgagataccatatatgcccaaaagtctgtcagtaacaagtgttggaaaagatatagatcaaaagagcatcttaaactctactatagggagtataagttgaaaaaacaaaaacactttggatatagtttggcattatctagtgaaactgaaagtacatatatcctggggcccagaaattctactcctggatatcygtcttagaaaaacttgtgtacatgagcagcaaaatacgtgtacaagaacgtctatggaagccctgcttataataactcaacctggaaacagtccaaatgcctgtcaccaccagaatggatacataaattgaggcatattcatacaattaaatactacacagtcatgaaaatgagcaaactaatagctatgtataacatcaagggtgaaaaaaacaagatgaaagaatatayacagtttgattctactcatagagagttcagagacaatactcaactatattgtttaaggatgcatacctctgtgttaaaactatcaaatgagcaagagaatgattatcataaaattctgcacagtggttggatccaaaggagcagcagggatgggagatcatgtatgtgtacgggggagaagggaattcagagctgctggcagtgctggtctgggctatattggtgtttgttttattcattgkgtgtgtgtgtgtgtgtgtgtgtaaaatggatttttctgcrtgttcacaataaaatttaaaaagacacaaaatacatatattaaataggttggtcaggtaagttctcattaagatgacattttatcaaggatctggaggaggtggaggagccagccacatggatattctaggggaaacattctgggcagaggaaacagcaagagaaaaagcccaaggggagcaatgcctggcatcaggagggacagcaggaaagagccacagtgtggctggagctgagcactctgcagcggggagtgcacagggagacacagtgagagaagtaacgaggagccctgtaggtagggccctggagaccacagtaaggacatgggctaattctatgtgagatgagaacacctaataggaggtcttgcaaggagtgacatgacctgacatacatttcaaaaggatcattctggctgctggggtgagaaaatgctggtagaaaggcaagggtgggaagagggacatcaagtaggaatctgttgtgataatgcaagaagtgcggtggcctgggcagggtgagattgaagagtgttcagatgctagttctattttgaaggtggactgaaagaatttgatcatgtggtacaaaactgaaaagaaatcaagaatgactctaaggcttttatcctgagcagcccaaaatctgccagttattccttaactcagttgccctcctgatgcatatgagtctggagttcagggaagacgtccaggctggagacctaatcactatagaaggcatttaaagctataagattgcatgagatcaccaagagaatgagagtagatagagaaaatttccaaggaccaagtcccgggacactgctatgctgaagtttgggagcatgaggaggagacagaaaaragaattgaaaagggataggggagaatagagagtcccagaagtcaagaaagcatttcaaaggggcaggacaatcaattgtattagatgccactgataagtcaggcaaggagaggactgaaactaggagcttgtctgctgcctgagagaaaaatctgtgtcatcatcaatgtcatcatcatcatcatcaacaacaaatagatcactggaccaccattcaacaaatactaaaaactgggtcaatggtgggtcatcttgccaaagttctaagttttttctttttttaaaattccattgatacctcctaaagctagactggaaagtgggaatatttttattgttcacaaataatacataattatctctcctttgtaaaatcttccctttcccagccccacccaactccaaatcttgatataaatgcaagattctgtatcagaaccaataastaattgagaatctcactatgcctggggtcccacaactgccaccagcaagttccgggaactgaaccatgtgggcaggagctgggagcagagtggtgggaatggggrgagccccctttacacatcacccttcacagtcaggtgctcaagctcgtccaggcttaagcttccagaccagggagaattattaatagcacttcttctttactctcaaaagtattccagattggacaatacattatattgtttcctgcctatttgattttttaaaatccttatttggcactaacttgtccccgtttctttttcccacttaaaaaaaagcccagttttctttattttttaatttttaattttttgttatgcattaagttctagggtacatgtgcacaatgtgcaggtttgctacctaggtatacatgtgccatgttgctttgctgcacccattaacttgtcatttacattaggtatttctcctaatgctatccctccccctgccccccaccccctgacaggccccaatgtgtgatgttcctcgcccygtgtccaagtgttctcattgttcagttccaacctatgagtgagaacatgtggtgtttggttttctgcccttgtgatagtttgctcagaatgatggtttccagctgcatccgtgtccctgcaaagaacatgaactcatccatttttatggctgcatagtattccatggtgtatatgtgccacattttcttaatccagtctatcactgatggacatttgggttggttccaagtctttgctgttgtgaatagtgctgcaataaacatatgtgtgcatgtgtctttatagtagattgatttataatcctttgggtatgtacccagtagtgggatcactaggtcaaatggtatttctagttctagatccttgaggaatcgccacactgtcttccacaatcgttgaactagttcacgctcccaccaacagygtaaaagtgttcctatttctccgcatcctctccagcatctgttgtttcctgacttttaatgatygccattctaactggtgtgggatggtayctcattgtggttttgatttgcatttctctgatgrccagtgatgatgagcattttttcatgtgtctgttggctgcataaatgtcttcttttgagaagtgtctgttcatatcctttgcaccctttttgatggggttgtttttttcttgtaaatttgtttaagttctttgtagattcaggatattagccctttgtcagatgggcagattgcaaaaatttcctcccattctgtaggttgcctgttcactctgatgttttctaaagaaaaaggacttagcattaccctagaacaaggtgtggagcatgagatgaaggggtcagggtggtgcttagaaggaagtaactttctgtgataaagttcgggtaagccaaagacacctaccgtatctctcatctcattcctttcttcacccctgtgcttgaacctaggcagaagatgccaggaccatgggcattaggaaggtttcaggcatgccaatcyaccgagtcagttgggaatgcttttcatggggtgatgagagcaaagaaatgccccagtgctatttcatctgcctccttgtgtwagaaaccagcatggacaaagacgaatttcctctccgccaatcctgtgtgttcagctaaagtttcctttttgaatggtccctcctgttttcttcttgtaaggggggaattgtcrgaggcgatgtccctcctctagagctaggtgcctgagctttcctcctgtgccccagatactcattttcttacacttggatattgggagtccaccatcagaaatcctcctccacagcctggaytctcatcatagccccttcactgatctccctatttgcacactgcccctgacagatcatcagcatgctaacttttaaaacctaaaccaactcacatcactcctctgctcagaactctctgatggcttcccrtctcctgaggtgtggaagcccacatcctcacactacagggccccctcctggctgcctgcccatctcccactccwcctgtccccttgctcactcagtgtcagccactgcctgcctgaaacacccttcccttaaatccttcctttaggtatttggtaaaaggtcactttctcagctgtctctttcccaaccaccctattttaaattgcaaccgatccctataccctgtttgccttctttgtctccacggtatttctcgtgctgraggtactacttattttacctatttattagtttattgtctatgttttcccactagaagatccactctgtgagggtagtgctttctgtttcctttttccactggaacctagaactgagactggcacaaggaggagcttaagacacattttatgaatgactgaatgggtaaataaactaggtggaggtcataggcagcgtactatgtcgatgatgaagttgctagtgtgtgcgcgtgcctgtatttttatacttgagctactatcrtrtgccatgctggggatcagcagaggttacttgtgccttgtgcattgctacttgcccctcttccctttyctggaaagttcttccttcttattctttcctctaagtctttcccataggaaactgtcccaaaacttttttctgtggmgttttctctgactaatccccctgctctctgctaagagcatacyagaagctcgtgaacggaggcctgtgactccatccagctgctactaggatcatctttgttgtatgtgtgcaatgattttctcaactttgcttcagaatgcaagttccggagggtggcgaagaggtcttctctcttacctgtctctctcttggcrtcaagtaggactctggactctgtagcctggcttatgttgcrttttgtttatgtcccagaagtaaagttatgatattaaaacaccaaaarcaacaggaaccataataaaatgaccatgtgccrggcagccagatcccctagagctgctgaccagcgaatctttaccaaaccagttctacgggaggcgctgctgtgaagtggcttaaggcacagaatgtggtaaaagacaarcctccttttgacctagttggaagagattgaccacaaacatggaatatacccagtgcagtgggtcgcacaataagcggccagaaaatacgtattgaacttaataaagaaaatcaataatgtgggccrgccatggtggctcaygcctgtaatcccagcactttgggaggccgaggtgggcagatcgtgaggtcaggagatcgagaccatcctggctaacatgatgaaaccctgtctctactaaaaatacaaaaaattagccaggagtggtggcaggtgcctgtagccccagctacttgggaggctgaagcaggagaatggcgtgaacccaggaggcggagcttgcagtgagcccagatcgcaccactgcactccaacctgggtgacggagtgagactccgtctcaaaaaaaaaaaaaaaagraaaagaaacagtgctagtgaagatatgcatcgaataaagacatctagaaggcacaaatggttcagctggtattgatgatgttatcaccattaacatctcagctctacmgtataccctccagaccttggatcaatcacattgttgcctcttgggcttcagtttccttatgtatgagactaaagactgtacatagatgattcctaaatgctaagattttaaaatttctaccatgrtccagaagagtagcattgtagtccacaccttgtggacttcagcaaattgcatcacttttccatgcccgtttcttcatctccaaaatggtcaygtgactgggttggtrctctgcaagttcctgcagctcgaaagctctgtgaatcttgagatgctctgggaaacaccaaacgagaggttcagagcttgatttctatagtgggataggaaattaagaccagagaaggtaaacctgcaaagaaccagagagctgaagtgaggtgtgccaggggtggggctagggaggaaaggagggtgggaaagaaggcttttctagataaggagaacagtgctccttgaatttgaaaaagaattctgttamaatgcaggttccaggtcagtaggtctggagttgtgcttgagattccgcatttcaatcaagcttccagctgatgcagctggtccttggaccacatttttgagtagcaaagagtgttcttccttctctagtttagcagctgggcctcttagagaagaacagaagctgatctccccacgtcttccttcatgtccctcccacaagaccctaaayaaaggatgtttttgccattgttttttttcccctagtccgtctcccaatcccaaccccaaatacacacacacrtmcacacacacacacacacacattcactcactcctcaataccctcacctccccagcctcatcaatactttcatcactggtcttcactgcaaaagtgatttttggggaaaagaatctcacaccacattttctaggcccttactatctggcagtgacaatcccagagraatgggaagtgaaaatgtctacattgttggagaggggtgatgtcatgtccaggttttcccagttacacgrtagtagtccctacttagtcctggaggctggtgtttctgccgctccccacccccaccctgcagcagaagaggggcctcacacagagtgtttttcccatctaacctctcctctccccacacccacacacacccaaacacacacagccttcctctacccagagaacgccacctttctcccttccttaccaagggcttctttttcacaacacggcccatagggcaattactggtattttttgaagcctaccaggataaagagctgagtctgccaccagcacaccccaggtaccccccagaggtctgaaaacatccatacctggacacatctgccacccattagcaagccactggagtgtcattcacactgcttgcaaagcactgcccaagccagaggcccccacttcccctcccctttcctcctgtgcctctcctcccctcctcttaccccctccttcctgcctccctccctgtgcatgcktgtgtgtgtgtgtgtgtgtgtgtgtgtgtgtgtgtgtgtgtgtagtccagcacagcttattttttcagggagccttccacctgcygttttctctccctacgttttctatttagtccttcatarccagtgcccattctctgtcctgcggaggaaataggacctgaacagcttcctttacagaaagagtcctaagaaggaagtcttctttcttgaagaagtcttgacttgactgaagcaaattagaatttgctctgagtggggcatgcacctagcagttgtctctccttcttctatcccctctaagaggctttactcagggcacttgcttctcatagcatccttgtgcttcctggaaatgatccttccttggttgsgatggggacaggaggggacgtggggacagaagaaggaagaggggctgttgggcagatctaggtctaagagagtcccttcttattcttaggttctagagagaggaaatgaggggaacccttagaggtcacgtggctataaccctccttttggagcacagcagctagacatttctctaccaaatgaggaatctgagtcctccatttcaagtcacctagtagagaaatcttacagtgatattttgttcatcttgaggactgagattcctaaaatctcactcctgatgtattccctcttttctcctttgagcaaccttcttgcctctacttatcaagctgtaactcatcccttctcagctcaggtaccttcaatggctttctatttcttctcatgaaaactccattttaaatcccactgtctccacaaactattccctgaccactcaaatttactttctcccgtgtacttggagttccttcagcaattatactcctcatttagcacttaataccttcttgggcattatttactatggtttatttaaaaggagttcatgttatctctttagaagatcaaaagctccctaatgaaagaaattgcgtcatgtgtgttgaacactccacagggtccagcatgttcatccttattgtgtgtgtgtgtgtgtgtgtgtgtgtgtgataaatcatttggaatctgacaaaaattaagacattctcccctggaaaatgcacctccactcagaactctgcctaaaaatttgttacccacccaaatattccagactaataatatctggaatcccttgttacccaacaaaagattccagattaataatatctgataacagcaaatggtactgttggcagagcaaatagtaggtgctcggtaattgccggctgatgtgtacttctctctgttttcccaaacagattgccctgacattctcaatcgtctttggggtgatagtgtatcgaataacaactgcagccgctctgtctctcaataaggctacacgctccaatgtccgggtgacagtgacagcaacagcagtcatcatcaacctcgtggtcatcctcatcctggacgagatctacggcgctgtggccaagtggctcaccaaaattggtactgtgtcaccgagacttctggctgtcctaggccctctttaagtcaatgcgtgcaaggcttttggtgataaaataaaaaaaatgggacagggacaggatgctttgtacagtgcattttaattagagaaatggggaagtgcaacgtgtgtgtatttgtagggctgtcaaagggctttctctaaaggcgggaatccttcctgtaatgttcttgatcaagtcctctggcctgtgttgattgcctcatgtgacagggcactcactatcccctaagggtaaaccgtggggtctgttctttttagcctaacctgggaagcaaggcagactcaagacttcctgttaaaaattacagagctttagctctcattttcccagcagcatctataaagttgaggaaagccttttgacacttgagcccaagagggtcttactggtcttatctatccccgtattgtcagaggccccagaaaatccacacattccccaggcactgagtagacttcaaagaggcatatcagacttcccacgcttcaagccagtgagaaaaatgcaacggcctcaatattcaggtgtgtcatttgagctgcaagtcgctgttgcccgagcaccacatcttggcatttggcattcatgcttattgggtgggggaggctgacagtcaagaccctgtcccattgtatttactctgggtggcctggattcatcccttccctctctgaatgtagggatttccctctctgaccctagtaacgaggagccccagcttcttgttaacctcatacggaggttgcattcatagtacgtatgatgcctttaattcatggacccttgataggataaccacctcctcaagagccttctcctaatgactggagaattccggaaagttgctctgtctgtgcctttcccttgcttggcctctactgtaacactacccacggtgagcactttgctttgacttctgtgttgctatcggcagcttaccatcctcaggggcagctctgctctttccaggcatgtgcatatttgtgaacgttatctgtgtttcttcataagcatcttgagaaaaataagcagagaattttaattcagcatatttaatgayagacaggattctatggaagcacttcggaagaacatccaacactcctggggactcaggaggctttggagggagaggcgtttgactggagagcccagagataagtgagagtcagacaggcatgcatatagggaggaggggatgggcaggaggagaggaagattcctggcaaaggaaaccaagtgagaaacacggcactgaagggagtgatcagatccctggggtcaggaaaggcatgcaggaaagtggcaaatgagccacttgggtggttgggagagtcttggtcaagctaaacaccagtggaacrggagctgagctcagcgtacgggagaaagaaagcatgaagtgtrcgcaggatgccaggggagcccggtgccggggctctacgtccagggcacatccagggcacgatggagtgggaaactgkgctgacggagttgaccagaacgtgttttttkttttgttttgttttgctttttgatggaaaatctaaaatgccaggctgaggactccgatttttttcatagacaatggaaaagtgtttgctggagttcccaggggcattcagccataaacagtaccatcttcctggcctgattactgaaccagctgagaaattagatcaaggcaagagtrgacaaagccaaaatatcagctgtaaaactgagagcggctacatgggaggtagtagcttaggaagagagccaaacagacattctctctccatggcaggcagtggcggatgggccagccctgtgaacttagaacttggagaggcatagaagaacacctgcttcctgcaggccctttgctcccctccaaggaagggcagaaaaagaggctaggcaaggaatgccagcgtcctcttctagacttaacaataagataagctactcctccttctctcacccaagaggagaaatggttgagctgggggaagacaagctgagccattacaactaattacactcccaccgcatggaggaaacaccaggagtagaaataaatgtcccctacccgctccatgtggtcctgatctagcaccactgaagattttttttaagagcgtggcatgacgggagctgtctgcaaaattacttagcagggaaataggatgtgacagaatagggagaggtaggagatccaatgtaaagggtattgctgagtgtgcgggcaggaagtagggaaaagagggacagaaagtcaatggtgatgtagacctttctccttcctgttcatttgtgtcacattatctcacttttcttgcattgctctagatagtgataaagatgaaagacaaatagagttggcaacaatagaaaactcattaataagtatttagtgagtacttcccatatgcaaggcggggccttaactcttctgtttgaagccataaataaaatgggctgtracagagctttcacatcatgaagctatgttcactgtttctactggcacaccctccttgcccagaccaaagcggctaccctgggctgttagatcaatgtccaggactccataagaaagtctgtgccctggaaaggagataaaatcctaacaagcacattttgttctctctgagagtgatactcataaagtatttttaaacttaaaataaaatttgtaactccatttcatcttcacaaaaactgcatggccagcaagggmagtgttatacgctcactttactaaggttcagactcagattctacctctaaaatgtgaatctcttttgtgtgactttgatgtcagtttctcaccatctgtactgaagtggtgtgttgggtctccatcaggaaccccagtgagcattgttctggggcattgctcttgtctaccttatactgggtactccagagagctcagagagggactgctgaatttgagaatccagtggaaagaagctttgagctctagacttggctccttctgctccctgagctgtgtggcagtgggtatcggggaagttttttggacaaagatttcctgatccttccttcttcatattcctcctgtcctctggtcatcccctctgtctggatggttttcacagcctaacgcctgtgccattgtcctcagcctctttcaatgggcctctagcttggaaatccccatccagccaacctttcccgaacagtgggtttggggacattgctcccagtcagcaccctcagacagcttcccttggtcctagagcacctatagttagcatttcaagytctcagctactttcttcccactgtgctcctccaccccaactgacccactcagctcatggtcaccctagcctccctgtgttgtcccaccccggccttgctcatgctgctgtgactgccaaaacgacctcagtgaccctccttcaaagggcttctcctttgtaaatcctcttctggcctctcggctgtcagtggtcatcctcccacttccagactcccctggcacacaccctctgtttctgrgttcatccatcagctgttgatggagtgcttgctccgtgccaggcacagttctggaaacacagcaaagacaagcgacaaggtccctgctctcattttgctttcactgtgaccagggaaagatggacagcaagcagggccattccacagaatctgaggaaggtgtgatgagatagacagtggtctggggctgtgcactctgggggagttggtcaggaaaggtatttcaaggtggtagctttatagctgagacccagatggcaggagggagcaacccacaaaaagatctagaaggagaactyttaggaagatggaacagtaaaggcaaagcctgcagaccaaggctaagcttggagactcttatccacactattcattggatgctgatcaggtactgtctgatcttaccgcatcrcacatatatgtgtgttcccagtgttagaatagactaggctctgctggggtaataaattcatctcaatatcttggttgcatcacataaagtcatctgtgttcttgctcagcccacatatctagtgcgatcaggcaggggtctctgctgcacacaattgctcagggacccagactgatgggggctgccgtggacaccatgtcaggggaagacagctggagagttgactggggctgttaaatgcttcagcctccaagtgtcatcattcatcccatctgctcacagatcactggctagaatcggcctaattatgaagaacttggaaaatttgttaaagtacatggtcattctgtaagcaggaaaagtctctgtcacttgctcccaaccaggctgcaaggctcttgagaacagtgaccctgtctttcatttatttttatttcctgcgcagtgcctggcccatggcagatcttagcacatttttgtcaatgcagttattggtgaaatacgtctctctcttcattcatgcatgtaaaaagacatttttcaaggaatgcccataggctaggtatcttttaagtcacagtagaggctacagtgagcatttatgtattccttatttcaactctgtctgcctacagaaggatgtgatcttattgagatgaataaggccaaggcaaagctgacacaatgggatagtgactgaaagaggcaccaagagtatcaggagacttgaagtttccttaatggcaaagaatacccacactaacagagatggtctcacaaagtaggtcccagcagtatccccacaggcagagatacggttacagggttcccccaggctccatggggacataaagctatggataatgccacctaatggaatgagaagtctgccaggcttaagacttcgtttgccattctcacgctgggtttaacacccgcttggcttcctgccccagatctcttgatagttgaggaggctgtgagtatacgctttgctcaccaggtgcaaacagctggtgtcaataaccccagtaagtccccaagtgtttcccacagggctgagtaatggaagaccagtttcctgggagcatccctcaagaggctgaggtgtcaggcctatctgaggtccattcttgctgcaaatatgtatcacagaaggcaagatttgttaatttccttgagaatgatatctaccgctagcagcagtggcggataaaaacagtgattgtcctcctggctgccataacaatactcaggagcgtagatgcaaggcatgctggaatctggaggcaacgcagcactggtgaggcaggactgagctgaaccctggggtggtgggaagggggctttctagggaatgcatttggagctgtgtcctagagggagcctggctggccaagacacagtgtacagagtgtgttgccagtgtcagcaagcatcagtattggagtttgagtgctgcgggggtaggattccagtggatgggtgggacaaagtctcttagtccccagtgatccattcactccaggaggggatacaggtggtggctgtagagaaagggtccgggtcctaggggaggaagcaggcaaaatctgggcaggtcactgggcctctggacatacagcaaatagggctgcagcatggtaggaggataaggcaggaggcaagaagaaagagcaatggagctgactggtgcaagrtgtgcttcctcctcaggtcaggacccagtggggtattgtgcctttgagccatacatctgggagcaggaaaactataggatcttagcataaccaacataggcaatggtcaggcttggcctggaaaggcggyctgtctctactctagctttggagaattcttcaaataagaggcagtatggaggaggcacagctgatggcaggcttctaggctgaatactcaaaatgctgttggcttgctgcctccttttccttcttgtcttttctttcaaaactctttgcagaatgctggctggtgtacggggtggtgcacttcatccctccctcgccrtccaacctctccaagtcacagggttgggttcattgtagttgcttgaaaaaagagtattagtcaagtcaaggtttttaggaaaatggctgtgcttgggaggtgctyagacattactgacagcccactcctgagtgtcactgccccagatgctcctgaagcggggccagggatgagagtgaaaggagkgatggggaaaggccgtgagttccattgagggcccacctcataccaacactggtttgcatactttgccccacattatgacagtaacactgggaatgggtcatttctttcattttacttatgagaaggctgaagaggtttagaaacttgaccgaagcatacagttagtagtgtgcatgagtgtgcattgatgcacaccctgcttaccctatatctcacacacatgcacacacttgtacacatgcatgcatgcacatgtgcacgcacgcgtgcgcgcgcrcrcacrcacacacacacacactctctgcttaccctgtaccaaacactgttctaagcactttacatatatcagtatgtttaatccttaaaacagccccaggagggtaggtaatcttaatactcccatttagagacaggaagactgaagacacagagaagaagatcagaggcccaaggtcatggaactgataagtggtgagtctgacctcattgtccttgctaaaaccatgacactctagtgccttttaatatgtagctgtccttgttccccagaaaagtttaaatttattgggagagcaacaggaaacaccacaaaggttccagaagatttagaatgcagtgcactcacatatgtgaatgacaagaggtcgagtatttctggggatggggacaaccgtgtgggtcagatgacccaggcagggaggacagcagggaggcaagctgtgagtgcagccgcctgtcccacatgcacagagagagaggagctccacaggctttggggtcctgcgagctttataagttttaacaaagaaagaatttttttttaaatttgaaaggccaccaggaatctctctctcttttttcaaaaatagacagggtctcactctgttgccccgactggggtgcagcggcatggtcataactcacaacagccttgagctcatgagctcaagggatcctcccacstcagcctcctgagtagctgggactactggtgtgtgccacagcatctggctaattttttttttttaactttttgtagagaaggggatctcattttgtttcccaggctggtcttgaactcctgggctcaagtgattctcctgcctcagcctctccaaatgctgggactactggtgtgagccagcgtgcctggcccctaccaggaagtcttgagtctaaacttttcctccaattctaagctactctagcaaaaggcaatatattattactgaggagagaagagcaggaggaaaggaaaaggatgggggaaaaatcagtgtcacmggtacaaatggctgccggggcaccaaacattctttaaagaagaatattttgagcatatatgaatctaatcttctaaatgtggacagtgtttgtttttggagcatggggtgaaagtgttggctttattggatgcagtgctctgggatggggggtctgctctctgcagcggagcctgatcagggacagagtccagcayaggacatgggtgggcctggccggcgtgggctgcagaggggaatggggcctatgcctctctgcrgggacgccacagtgctggtcatttgcaatctggcctgaaagttgggtctgctggcttgtattctcttcctgctttgcaccaggatcctggctctctggggctcccggctctctgggtggcctcaggcagtgggggagaaagaacctcccagggtctggccaggggggattctatgcttgttgggggaccccctccatgatgttggcttaaattattctaaatgttgtctgggaaacagagaggatggcaggaggctgtgactactaataaaacgatgtgagtacggttataggccaagtatgtggagcacccctaccagttatgtaagactatggtcagtaattctactgtttagaacacagtgtaactggtaagaattccttcccagacatgagctgtgaccatgaacacatctctcatttccctrcaragtccttgcagcaytcatctcttctgttagcaagaagtccaatatcttcctgtctttctctttggattttctaggagcccagggactaaagcatccagaagagaaggaagggctgtggtgctcctcctttgtttgcaccttttctccctcactagggaattggggtgttttcctctgcttctccctgatgctcccacatctctggagaaaattcatctcttcataactgcagctcttgcaggatgaattctccctcttggttcttcctgggcatcagccatgccatttcctctccttgtctcttcactgctgtgagtaagggcttcattagagtcgcttcctttgaaccrtccaaggggaattgtttyctgctgcaatcctcagtggtagaggggtcaggccaacatccgaagttaaacatggagatgcctgggtagaacctgcccttcgctccttgggtctcactcctatggaacattgctgctggacactagccccacccctctgatgggagaggctggactgcggctgaggtggcccctccgtactccaggcctggacagcatgggctcttccagggaggacagtcttctcctttaggctgggctcagtctaggggctgcagctgtcagggtttcctgtttctaggacacatatgttacctccacccgcatctccaggatgccatccgacaccctgacccatagcaagggcccctgctctccctgggaactcaccctgggagcacacagcttgccaccttcaatcttcaaaacgcaacagatcctgtgattgcctatttcacctccctggccctcagcgagattcctagggacctcaccaccccaagtgatgccaaaatgcactccccaaccttctaagagagctctgtaggggatttttagctaacttgctaacacttcttttactaaggaagtggaaacaaatgtgcaaatctctgcagtgccttgctgtgccatcaaaataagagcaaatctttgagcccttacaccatgcttgatgctttccatgctttatttcccaacaaatgttgaaggaaggtaccattttatgaattaggacactgaggctcagaaagataaattcccttatctggggactcttagacagaaaggtcttctgacttccagcccagagtccccctctagtcttccgtcaaagcctcgtgaatcatattgtagagcacagaagaccagaagcaggaagaacctgggaaatcacccagtccaaccttgacgttgaggcttggatttgcttgaggtgctgactcctccaggctggctggctacttcgaaggatgattctcggttcaaacaatattctaatggccttgggtcatgagctggggtttgggggttttgggttttggggagcagaatcacaggggccaaggagaagcataggggccaagaatttaatgtgtccaactttgagaacttaatttttcctccaaacctggtgcctttcaccgattcttcccatctcaggagatggcaccagcagccacccaaatgctcacttcaaagtccaagtgctatcctggctctctctttctctctctccctggcactctcactccctggagctctctctctctctctctcacccctaggatccagtctgctggtaagtattgttctttctaccttcaaacatatcccagatctgaccatttttcacaagtttcatcctcatattgactggtttgtgcctggacaacaacacactcacaatttgtctgtctgcttccacttctgtctctgtgccgcactsccccccacaccattcactttctgtgattttttaaaaatttaatttygtcacatccttcccctgttcagaaatctacaacagcttcccgttgtacttcctgtggctcacagagccacacatttactctccggccttcctctccaattccccctcccagtayttccaccaggctcaggaygcttcgcttgtgtggactggccagttccttgcacagccttggggctctccatcaagactttgcccaggctgatgcgtccccctagagctctccccagcccctggggctggttcctccttaccctgcaggtctcagcttagaggtcacctcctcagaggcctttcctgaccactctgaccaaaacagccttcccatcgccctttccttctgcttctcatttcactacatattccttcaacactcaccgctctctaaatctaaaacggttgcagttgtcgccctcacccttctagactgggagctccacacggcgggagctgattggattgtccaccactgcacagctggggcccaacaccaggcacatgatcatcctcagtagatatttgtcgaatgagaaaagataatggtgggaaaggcaggagaatttcctgtgggttgttttcctctgggaagacatgaggggtgggctgagaatggactgaccgtatgcctcctccctcaggttttagaccagtgtgtgcatttgccagatgacccaggggtgttgggggtgtctgtgatcagggacagggcacaccttcctgctctctcctcactcctgtccttgtcacagggagaaaaatcttagggaagttgtcaagtgcttgtatggtgcttggcacatagtaggtgctggatataggaggattctcatgattggcctataacagaatacgcctctgtctgtctgtctctctgtctgtctgtctgtctgtttctctctctctctctctctccagtgctcccttcctgtttaggtcccttttttcttaaaaggagatgtgctgggggtgctgtcaccctggcctaggctgctagccagctcagtaggtctcatgctcctttgcataggggcaagagttacctttctgactctgagggataggccccctgtgctaggaagctctctgggccacaggagtatctcaggcacaccctctagatccccagttcaggggctttcagctccctcaggtcatgcgctggctgccttgttacccagctggctggcttctcctagggtgatttccaccctacccatggcactaccagggcaacagcatgacaccaggtacccagacagtccctccacccaccccccattcccaaatgaagggcagcccagwtggttgtgctgtcagcaaacattgctgtttgcaaaggcatgacctgccttarggagaggtaaggggaagagcaggcacttttgcttgggcatcttcttgttcttttttgctgccatcgttatgcatttgccagctgggctgtcgaagacaccagtcaggaggagctgcttttccaagattcaragcctgcagctggcgtcctctcctggccatgctgtttccataggattaagatggagctctggggactttcagtcctgagctggccccctgggatgaagctgggctttcatactaattgttttccaaggcagtttacagctgggtcatttgcactcatattttttcatgacacgatgcagcagaggattaacacgtaaaagaaaagggctgatggtgggaatggctctgcacagaaattcccgattgtcctttctggcgggaagtggagtctgccctctttgttgggatcctgctccacagtttggaagcaggtgaaactttcagatggcctctaatcaacctggggtgcttccyggcggaggtgctatgttagggggcacgtgaataatagagagggttgcctatctcctcaccctctctccattagattcccctccatcgtatccccatagccatgcaatctgaaggtactttatttggagttgttcaaagcacaaggctggaccattttttcatggggttgagattcagacccctccagaagtctgtcttatgaggaatcctgcctagtggcctgagatgcagacagcccttcctgaacctcagatgtcaccccaccccacctggcctctggaaacacttgctccattccatttcttcatttctttccttcctttcttttcgtttctttttttttttttttttgagacagagccttgcatcgttgtccaggctggagtgcggtggcacgatctcagctcactgcaacctctgcctcctgagttcaagagattttcacgcctcagcctcccgagtagctgggattgtagctgcataccaccacgcccagctaatttttgtatttgtagtagagacagagttttgccatgtttgccaggctggtctcaaactcttggcctcaagtgatctgccctcctcagcctcccaaagtgctgggatgagccactgcacctgcccacttgctccatttcttcagccatgtagtctctgtcctaggcaggtgaggccctctgtgttggcttgtgagagagatccaaaagtcaaagtggcactccaggctgtggcatccctccttgcctcaaaccttcatttgttccctcactgggaggtgcttccctgaggcccctttcccagaagtctcggccaagcacacactgtgactcagagctgctccaagctggggcaccgagctgattttgtggcctgtcacatggatttggatcgtttattggaaatgctccttgtttatggtggctcatggccctaaagcacaggcacaggctgttttttagaagtaaaactcataaataatagccaggcctatgatttatcagtatggaggaagggaatcactcatttccagttggaggaaaggcctctgaaatgactagatcctctttgcagggaacttggagggaattgctgtagggactgggagatctgaggacacacagttcaaaggggatgataaaataaaattaaagacatatgccactccacatctcatcctgatcaccttctagatatgttttcaagatatgttttccaaattttcggaccctcagatctgattacttatttttttaggtgacatgggcttaaattttcttgcccccaaaatatttaagagagatgagatgtgattgtgttgttgttaaattggatgcctcaggcaccctggacagaggctcaaattcctattgaaaaaaggaaaaagaaaaagaaaaaacatcctattgaaaagttctccctttcttccttccctttcctttcatccctcctccctcttcctccttctttttcccccttcccttctctttcttcttcctcttctcctcctctgccttccacggtgtctgcctgtttccctaatctctctcgttggttacccagatcagtctctgctccttccccatgctcatctggaagtagaacccagtccttcagcagtcccccaagagtgaatccagaacaatttcaaggaatcatgattgaagattctgtggagaggcacacgaagaggtcacactgcaaacctcacagcagcacttaatgaaaattcccagcgggccctccccgcacctgtcagtccatttcctctctgcccttcccctcccatcgcactggccctcacccttccgggtcctgcctccaactccagcacccccgcctcttatgttaggtcggtgagtttgagtcttctggctgctcctgtcatatggttacacctgtcatctgctcagaaaaagacgtccctccttagaatttgtcctccttggaatacgacagggaatttttaatatgggacaaaattttttttcattcttccaaacacatttttcctgtcattcattcactcattcatttattcaatgcatgttcatagtagagcacatctggcaatagctggggtctgcytggaagatgtctctctgggactttgcttatggagagaagccctccaaactgtatgcgggggtggggcaagagtgggagtgtggcgagcgcgagggttcagagtcacatgagggtgcagagtgatgagatctcgaaaccgaaagtgacctttcaatggcagacacttccactgggcctcagaattgtctcctgtagttaaggggwatgagaatcaggccaaagatggggatgtggcacgttcaggctggtgaggacctgatatgcacaaatcaggcagggaggacctggcctcttggtggcagagaggggaaaggcctaagaagctaaagatcttatggggcatttgctaacatacataactatagaagaaatgacagaagcggcagcgctagctgtaaatggtgagcacagatcattatccagatgatyatttggtgaagcagtgcaggatcacccaggtcttttatctcggggggccatacccacccaggcaggaccggaaggagaaaaccacaaagctttccaccagcagaggaatatcacggaaggcttttcctactcctatagaattctagttcaactcctatagaattccaattcaacgcctgctatagaattccaattcaactcctgtagaattccaattcaactcctgctatagaattccaattcaactcctatagaattccaatttagcccctatagaattccaattcaactcctgtagaattccagttcaacccctgtagaattccaattcaacccctgtagatttacactgctgtctccagattccctagcgggcaatgctctttgcaaagtagcgccaaaggatcgcttagctttcccactctcaagtcccttcccagggctgtgggtcctagggtctcacccctgcctgtctctttaataggtctctgatcaagcttggactatgacagatgctgttggtcccctggctctgctgcctttctccactaatactgttttactactgtatctacagcttagaaatttcctctctgaattactgcaggtctttcttagaactccaaaatgttgtttaacttgctcagttttggaggatgtgctgtttggataatgttggcatcaattcccagtgatttatactagacggtattagagtgtcacactcaaacactgtttctctcaaacacatttctcctcacctacaactgaccactggttcaacaggcatataggccttggactttggccctagccaccctcagtgacctctgggcctgctcagaaacagtgtccatactttacgaggccttgagttggggcaagtctttctcttcacttaggaaagttacaagtggtacctcaggacctgcctgtcccagtttccctcgccagctgcagtagttcagtttcagcacgtctaaatgttggagcacattcaggagaaatgttgtaaacctccaatatttagttcttgcttctattgtagttaagccagacgtttggaggacagcgttccacatggcaattcaggaatctgggcttcctctttccagtggtactattgacattttccacaggagatgagggaagagagatagagagagcagaggacctcacaggaaaaattaaggcccaggcttggaagcagcatacgccacctccactcatgtctgtctggccacagctccttcatattgcccccatctagctgtgtatccaggaggagggaatgcgtgtgatgagcccctggccaatctctgcctccctatctcacccaggaggctggggaggcctcacacaagtaggactcttgtgggtctgctcttgtcctccagcgttattcttcctgcaataacccttgctatagatgaatttttaatattaaaatctgtacgtgtctacctatatttctattaaatcttttacaacatttttaccaaatayggtatttcctaaacaatgcattatgcrgttgaagatgctcggcaaagtaatcctattcactacagttctcaatcccattgagttttctctggcagcttagtccccatacagagacccctacattggtggtcttcaagccttggacacattagaggctctccaagactcaggggaggcctacatgctttgatcttcctctaaagggccatctttacacatgcagttgtgcagtgtgagagggttgttggtaatgcaccagtaagagcagtcatcactgccagcagcatcatctcctaatattgaagacagtgttgtaggattggcagtgaattaagggctcactgtgctgtgtgggaaactggaacatggcaatgcagcctttccctaagactctttctgccatgagacgggagatgatactctgctgctgacaggtcaatctgggagagacttggcagtgagcaaaagcctctccacagagaccttgctcagtgaagctccttgaaggaaggggaaaacttcattcattttggcctggcacctgacacacagctggtgcttgatgaatgtgacctgccaagtacaaatatttcttaggcgcatcaggttagactgggagtggaaagtggggaggtgaaagagagtgtttgatgaaaacaataatgggtcagacattctgattgcaaaaagtggtgttgttaaaaactagtttttttgaggcaggcagatctgggttcacatcttacacctgtcacttatctgctgtgtgatcttgagcaaggctgtaacctctctgggcctcaattcccttcatccacagaagtgaaatgtaatacctcgctcacccagggaggtgaggattaagtgagataatgacagtgcacacctacgtatgatgccttctgtcatacacagaggatgggagcagacgcttttgtgcagcacccacctcccattggcccacgctggaggtgaccttcagatggttcctctttgcaccaatggcttcctcccactctctgtctatgggcgttctctgattgtgggagcaggttcacctgtgcataggacaggctggaagagscagggagttagccccaaaggtgaccttcaggcagggaggggctcctgtttggtctcccctttcagtgtgcaaatttggaggtgtgcttcacacagtttcttaggaggtctccagtgggactgaaccccagttgatgcagcattaacctgttcatgagcacatttatcttaggtttccactttcctcattctcaccatcctactccttcacaaagctttctgggagcccctctcaaataaaccacttcctcctaaatcctcgccttagggagaatccaaacacatggactgaggaatcagtgataatgactattgtcaattttcaaagggcgtgggtgtgggtagttaacacagggacatataaagcataacggaagaaaacaaaaaaataactacctgctgaaggcatgtagtaacgcttccggaaagagagcgtggcactgtgtgatctggagagtgtggcacactgtgatccggagagtgtggtacagtgtgatcttgaggttgtgatacagtgttatctggagagtgcggtacgacgtaatctggagaaggtggcacactgtgatctggagagtttggtatgctgtgaattggagagtgtggtacatcrtgatcttgagggtgtggtacagtgtggtctggagagtgtgacacactgtgatccagaaggtgtggtacggtgtgatcttgaggttgtgatacagtgttatctggagagtgcggtacgacgtaatctggagaaggtggcacactgtgatctggagagtttggtatggtgtgaattggagagtgtggtacattgtgatcttgagggtgtggtacagtgtgatctgcagagtgtggcacactgtgatccagaaggtgtggtacggtgtgagcttgaggttgtgatacagtgttatctggagagtgtggtacgatgtaatctggagagggtggtacactgtgatctggagagtttggtatggtgtgaattggagagtgtggtacattgtgatcttgagggtgtggtacagtgtgatctggagagtgcagtatggtgcaatctggagaggttggtacactgtggtctggagagtgtggtacagtgtgatcttgagggtgtggtacagtgtgatctggagagtgcggtacggtgtaatctggagaaggtggtacactgtgatctggagagtgctatggcgtgaattggagagtgtggtactatgtggtctggaggatgcggtactgtgtgatctggagagtgtgttatggtgtgatctggagagtgtggcactgtgtgatctggagagtttggtatggtgtgaattggagattgtggtactgtgtggtctggaggatgtggtactgtgtgatctggagagtgttgtacagtctgatctggagagtgtggtagtaactcacctatatattaaaggatataaaggatttctgtataaggtgatgggtgagggaagggtattccttggaagaaacaaagttttgtgtccatttcttcagcgattcctacaaaagctatatgtgaatttgtggagcaggcaagttagggggcccatacactagtctcatctggacgcagaactcctcagctggcatggccctgttgtcatgtatctgtgcttagtccactttcaggctgtgcttcttggtccatatgatgtagtattagtgcttttcttctacctctgaagactgtggccctgtgctataagcctaatayttgtgttccccaaaattcctatgttgaaattctaactgccaaggtgatggtattaggaggtgtggtgtatgggaggtgatgaggccatgagggcagagcacacatacatgggaaagagtcctatgtaagaggcctgagagagatgcctttcccyttgaccatgagaggacagtgagaaggtgctgtctataagccaaaagacaggccctcaccagacaccaaatctaccttgatctcagacttgcaaacctccagaatttgagaagtaaatgccaggttttcttgaacactcagtttatggtagcttgttatagcatcccaaatggactaagatcaccctgtcacctcttgtccttgtcatgccatttgtcactgtctgtggagtcccttggaagtgtcctgaaccattgtccaytggttcctgtgtctctagtcttctgaaggcacctctgaggtttctgctcagtgtctctgagtccttytgggaatgccagctgactcctctgcttggayctgatagaacacccagggcccgtgacctatgagtcaaaccttaggctcaagctgtttgtttcactcatcttgtctatgacaagcctttatcatttgagtgtatgactgggaagtgtcttaggttccccacaggacaygcagatgaatgctttcctgcattcatccaaattaatgctcaaattcattcagcattttttctgctaaaaatgaaggagagaaagaggaatcaagtcatggtacccttgtaactctagttcagtggytaataagctttttgaccagggaccttggttcaagtaaaatctcatggaagtggaaatgacacaggtgaaaactgaattccccttggtgcagaaaagggggtggttgcaagctctgcatgctcatggccctctttgaggagggcggtgtgaaaccactccttgagtagacaagaggaggaaggtggacggagaaagacagtgatcctatattttttatccttctgtaacttcgtattacctggcagaccacctggggcctcccagatgasttcagttctaatgtgccagagagatgggtctcgtgatttttgctgtgaaggagtcagctgagagatagtagctcatgtctaggtcaaaactctggagaggtgagaaatctcaccccaatctcatcagcctcgctcttctcttacagaggttccgaaaacagaacagacttttgaagagcgcctgatcctcaaagctttcttgctcaagtttgtcaatgcctactcccccatcttctatgtggcctttttcaaagggaggtgagtataatggtgtcatgtgtagaaaggcaatttgccactaagactgggttctctactgtcaggacaatagggtcagcctgtccccattgtccactcagcgtcagccccttctccgccccactttcacctgccttcccatggagaaggaatgttagcaggcaatcattttgaattagcatcttcagactctgatgaccctggcactttacagggatttggctgtggtccctgaagagagagttttgaaagaatttgtgtctctcaactttgaggatgaggcaggagggaatttcatgtctagccagtggctcctggatcttgtaatgcaattctgatgccaactacctgtagttaatacagatttcataggttaagggcacggcccctcacaagacttccctcatttcagacaccagtggcaagctctgggattctcaggccaccggcagttatgacccactggctrtaattccagagctctcattactccatcagattcaataattcactagaatgactcacagaactcagaaatgtgctatacttacaactgaagttttatagtagtagagggatgtaaatccaaatcagcaaatggaagagacatatagagccaggtttaggaggttcttaatcatgaagcttccatgtcctcaggatgtgtcaccctcctggcacactggattgtgattctatcagtcatttgtgattgatggaatcatttgccatgtgagtgaactcgatctccaatgcccttcccttgccctgagattgggctagtatcacatgactcagagcctcaaccaacatggttgatctttctggcatggcctgcccccatcctgagtaatctcattagcctaaatttaggtatagtcctaggggtctgccaggaataacaargayactcctatggagggaaattccaaggatttagatgttcatgcaggaatcggggacaaaggccagtgaaattctttattttacagtcagtctggatgtaaaatcactttgataaatattttttatgatcaagccagttggctacttacaaggaaatttcccaataggcgtcaaccaacaacatcaggaaagcttccctagaactaaaagttcattaagcaggcactaatagcacgagctgtcatcatccacacttgataatttcttacagaggtgtttgtcatccaaaccacagcccccttctcaggacctctccccttggctgtcatgaaattatggaagcagagagactgtccatattaagaagtatacacttcattggtgctttcaatgtcgatttcgtggcagtagcaaattacatgcatatgacgttttaggcaagaaaaaaggatcctgaggcttagaagaactgtgctatactagaagagatagccttagcaacagcacactatcatctccagtaagtgattctatccagtaagtgatctaataagaggtataaataaagtgttgggggaacagttatgaacggagacaacaagaagacttcagcaaaggaaaggcttacacagccttaaatggatgagtaggatttcarcaggtgaacacagggatgaccctgcaagtaagtaggattattctgattgtctgtctggttccatggtgggcttttactgttttgcttccccgacctgcacagtcttattgtcccccaataaaatagactctacttagaagaggaatgagacaagcttcttttattcctttgaatattttcagcaagaagtcaagatttttcttttctgaccccaggaatctctattcgcaactttagtccatctcaccctcgctttcctgggaatcagaaactcttactaaggagttgcaaccagagctgtgttcttgacaccagctagggaagaaggtgtgacgacagtgcacttagagataatccaaactgcatggtgtttaggctcacacacacacacatacacgcacacacaccaggcccagcttcatcctctgcccagcttattcctatcgtctgacatttgactgggttaagaagtgaaccccaggtgttataggggattacttgctgataacagtgtgcactcctatccctgagtgatctagcactcgccctgaccagtgctttcgaagaggacagtggtggtggtattcccctcagaagacatgtcctygagccaccctgcatgctttctcttcccctaactcttcccacactgtttgatttcaggtttgtgggcaggcctggaagctacgtctatgtattcgatggttaccgcatggaagaggcaagtacagccactggtgtttcatgcctggcaccccaacccagccccattcttatctccagcacagcatggcttcattcgcgcccctgcttctcagagctcccbtttgttctaaccggtcctttccttatcttctccctgcagtgtgctccagggggctgtctcatggagctctgcattcagctcagcatcatcatgttggggaagcagttgatccagaacaacatctttgagattggagtcccgtatgtaatgaactcctctaacctctctccttgctgccaggggttagcccagaagtgccagcctttcagcaggttttctatggcctttcctcttcttagacagcttggtgatttaattctctgtcaatttgccaataactttccccatggggcaaactttgcttgccaatctgatttgagatgttggaggctcagaaggatttaccctttgcttaagtacacataactagtaagtagcagagccaggagtcagatgtcttggcccccagagtgcataatatcttaatgctatttgtcctctcagtgagtaagtaaaagagatgttcagtatggtggatagatgaatgtgaattattgaaatgtaatggaatcatttaggrcaatctatacgaagaaaatgtggaatacataatcttaggaggggagggtggaatagttggtgaatgagttattatcatgtggattcccccctatgctccccagggttttatgaaaatgtcataggacttctttcaatcaggttttgcatttagatagtcatgaaaataaacacggactcactttatactggacctaaaagaaagaaagatggagcaagttaaaatatgcttacaggtcaaagaaaaatgtaaccccctctgcttttccttcctattgcctggtggctttgaagaagaatctgtttcaggggatgcttttaggcagcccagcatcagaaagctagggaatgatagagatgcccaggggtaactgagaggctgggccagttctgcttaggaggataggatggacagcttgttccaggcccagggttcttcgaaaatcactttaaagatgaccattctgggatgggtgtaatcgtcagacaggacccataagattctgtgacacatttttcatcctcttagagatacattaattgttttgagaagtcctccaataatgaaccttttaaaatcactttctttccaaatatatttcctcatgtttgcccagggttcttagctgcagcagttggaattcagggtggctactttaagcaacaaaggcatttgtttcagaataaagtggctgacagagaatactgtattctttaaaggccagagagtaggccctgagctacataaccaggaataacactgtttacactgtagggggacttgcaggggacaccactgcctctatctcatggctcatatggctaagacagtaaaagaaaaatgtagatgaaacggcccttgtcttctcagagcttaactttttagtctgggagacaaaatagactgcatataaccgcatattctatgtatgaattcagaattcagaataagtaaaggtcaggagtttgggagcagtcaaagaagtcttcaaaagcagagaggtttctggccaggtgtggtggctcaccgctgtaatcccagcactttgggaagctgaggtgggcggatcacgaggtcaggaatttgagaccagcctggccaatatggtgacaccccatctctcttaaaaaatacaaaattagccgggtgtggttgtgtgcgcctgtagtcccagctacttgggaggctgaggcaggagaattgcttgaaccctggaggtggagggtrcagtgagcagagaccatgccactgcactccagcctggcaacagagcaagactctgtctcaaaaaaaaaaaaaaaaagcagagaagtttgttccaggatgtgtctgtgtcttgaaagaagactaccaccatcatatgttacaagatggactgccatcattttctttatagaaataatttcccttagggttgtgtgtgtgtgtgtgtgtgtgtgtgtgtgtgtgtgtgtgtgtatggacaactctgatgggctgggccagctgggccatgaacatgataggctgggccttttccatgttatttattttcatatatatatatatatatatatatgtatatatgtgtacacatacatgtatttgcccttgccaggttcctgacatgccccaagaccctggtcagagatttatatataratatatacatatatataaatatatacatatataaatataaatatatttataaatataaatataaatatatttgttttatatatattttataaaacataaaatatgttttatacatataaaaatttgtatataaatttatayctatatgaaatatagatatattttataaaatgtatatatatttatgtataaatatatgcatttatatatttatgtataaatatatgcatttatatatttatgtataaatatatgcatttatatatttatgtataaatatatgcatttatatatttatgtataaatatatgcatttatatatttatgtataaatatatgcatttatatatttatgtataaatatatgcatttatatatttatgtataaatatatgcatttatatatttatataagtatatatttatataagtatttatataagtatatatttatataagtatttatataagtaatataaatttrtatatataaatatatttatataagtatgtgtaatatatacttaaaaaataaaatataatatamatatatatatttatattatatataacataaatatttatatataatatatttatatttatctataatataaatatattatagataaatatacttatatataaatatataaatgcatatatttatacataaatgtatgtatacattttataaaatatatctatatttcatatagatataaatttatatacaaatttttatatgtataaaacatatatatatatatacattttctaaacaagcaatagactaattctggtttatcacaaacacctatgacccagttggtgctacaggtagagaaggtaaggcccaatgagctggcagttctttgaccagggtcttggggtgtgtcagggacctggtaagggcaaaagcccagaatctctctaaatctatcgaaagattgtggagtcctaggttgcttgggctgaatggaaccactaaaggatgtatatcccaatcccccattccatgtaaaattatactgcagccacctgctcccttggtcctcagagaaggctcccttttggtcttcctcaaaaatatatttgtagagctaaagttataatggagacagtttaatttacctggaaataatatcatttttaatgagagccctgcttcaaggaatgagaatccacaacattcccttctaacactgggtcatctaagcatgcagggtgcttttctgaccttgtactgggacaacctcagagggcacttgggcatgtattttctttggggaggattggcgggatcattggtgtctggttgcctcactccacctccctgcctaagccagcctctagtcatcagtcaggaagtcagcaaccttgagaaattcagcctttgaagctgtgccccccgttccctgctttctgacagaaagtcactcagtgataaagtcaagcaaagctagatgatgcttgttcttgttccatgcagatgacacttgttctctaggagcttaccatcttagagagacatcatttgttatggaaaaacaaccagagaatatgcagatggtaccaaagccrcatctggcccctttgaaaccatgaggccagctcctccacaactgctataaagaaaagtcttcatcctaattaaacatctgggaaaaacaccagccttcccagtacattgttattttgctgtgagtagaattatttacagctttcatccctggtcatctgatctacagcttagcccattctctctggacccagaaggcttttgtagaatacaagagaggcaagaactcgggcatgtgtttggacaacacgttggcatgtctccacccctcaactccatccaccccataacaggtgaaaatagcacatggcgtatgccttgaaggctaaattttcttgtttatgactgatgtgtgcttaatactttgtatgttttaaaatatgccaccctttaaacaatggcaattgcacagtaactcataaagccatgggcaagctgcttctcagagtctaactgtcctcatctcttgatgaatatggtggcattaaaatcatatgtaaggtgtcttcaarctctaacaccctatgaatttctctcgaatgagcaaagctggtcactgctgmttccaaatacaagccacccctctttcaaaagatgtttcctttcaatttctactctgccagaggatgtgtacaacataattatgtagttaaattcaaggatgtagaacaaaaattcttttgccaaatcctaggatcttttatccccaaagttctttataatttgtacaattataaaggttgtattttgagtttggtcatacgagatcactatgattatgattactggatcttcgactctcaataaatcagaccccttcaactcagagttgaagtacctggcatggatgacacagatgaaacataaacaagaaaaagaaagtctttcatagtcagaagagaaatgatgattgagcctgccagtgaggaaggagtcatgtaaattataaaaattagacccagtagttttcaacacatctgtagggcaaagatttggtggcctaacacagtggtccccagtctttttggcacaggggacaggtttcctggaagacagtttttccgtggaccgggggagtggggtgtgattttgggatgattcaactgcattacatttattgtacactttatttctattatwattaaattgcaatatataatgaaataattttacaacttaccataatgtagaatcagtgggagacctgagcttatttttctgcaactagacagtcccatctgggggtgacgggagacagtaacagatcatcaggcattggattctcataaggascacacaacctagatccctcgcatgcacagttcacgtagggttcacrctcctgtgagaatctgatgccgccaccggcctgacaagaggcagagctcaggtgttaatgaggatggagagtggctataaatacagatgaagcttcactcactcacctgctgctcacctgctgctgtgtggcccggttcttaacagaccaaggacgggtactggtctgtggcccagggattggggatccctggcctaccagatctgggtttaaatccaggctttacaatatactcactgtgtgaccttggcaaagttattctagaaatattgccatctaacttaaaaaaaaaaaaggtttttacgttaaaacaaaactaaactaaaaaccagcttggataaatgcttagctatccagaaaacataaaatgtggacatcggaggaaaaaagaaccattcttggggtttccaggtggccaacattttactgtgtggcataggcttttgtgtttaacggtgatgctttggaagtgttgggactccagggagtgaaaccggagagaacaactcagggacagtcgttttctcttctgttcctggctcagtggcttttagtgggcagtacagctcttatgtaccttcagagcctacatggaattctttccccaagggaggtacatattcattttaaaggccagatttgttttttttttttttaaatagaggcaagtctggggggttagatgggtgattgtgctggataagaatgtttgggaataaaaatgtaataagaatttacaattaaaagatttatcatctttagttgattctttacttctaaaagcaattttctaagattcttccaaagaaaatttttaaatgtttaagagtgtctaattgacccttattagtaggccaggtagtcagctataatttatctctttctctgagggtgcaacattctcattagattctgtatgtgcgtgtgcacaaacatgcatgtgtgtgtgtgcatgtatgtgtattgaaaaaaataacataattttgatggccttgagaatcttacaatctagcaggcttcttgaattagaacattgcttcccactcttcagtcattttttaatcaacttttaaatttccccccattacctatgcaaacagctatttgcatattagtttcctccaaaccaacttgctttttaattaaaatcctcacatttctgaaattggaaaactaacaccatcagtttccataaataggaaatgatgtgaaaagaaatacaacaaaaacaaaccattattattaaacaatcaatgacattatttcctctccaaggctttctgactaagatctgccttctctttgtaaaaaatgagagtgcaagccctggcagttgtcaaaggcataccagtagcaagccaaagatgttttttcttgatggtaatgagagagactgaacaagagcagcaaaggaaataactaaataactccttcccaagggcctctaatgagatgcaaggccaagtgcaggatcttccaaagggtcmcatgaactgccacctctacttctggaaggtgccccagacaggaccactgtggaagccccactctctgtccaggcatcttccatcaggcagcagccgcccccatcattgctaggcctggcttagagaccctggagatgggaaacaaaatgcttcaaagggaggcagtaaaatggggtcaccgagcacttgaaaggcagctctgtgactaatgccatgataatagataaaacttggttgcgtgatctggctttgaatggtccccactcacacaaccccaggctcttggggcctgacacagttgtggccgatgcttcccagagaggatcggatggttttaaacattttgggccccaggatgatgttcatacgcatctccttctgagattacttcatacatggcgagcagcgtggctgaatctgrkcttgtggtatttattatctgaatccatggatgggaatttccctcctcccctccctgcaccttgcctttcccatatatgttcatgcaaaatagactttggatccagactgcatagtgcccccgaaacacatgccacaccacagcccaactctttgctataattccatctcaaatttagctccggtccacatcgaagcaaaattggaaatgggctcttctcatatggagaggtgggtttttggtgaaagggtaaatgccacctttttcacrtaccacattgtttcctgggcatgctttgagacagacagagcagatagacagatcaatactgccacggtcaaaatgtctcgccatctctattctaactaaaagctccagatcatatccaaaaatagctgttaaatgtacccctggacacagctagtaagatttcataaactttctgctttctttttgtaaatgtgataaatgttatatttccagacataaaacaggctctctttaaagccaacacgggagggaggtctgtgttctcctcaaatacagtggaatctggccataaatcagaagtttaaggaacaaatttgaaccttgtcaggtatcaggaaaaggaataggaatacatagcttagaagtggatgtgttcctcatctttggtcatttagggctaggttctgccttctttatttaatgaggctaaagatctgtggagccacgtctgtagggacctgtctagggcccagattcctgctgcagggaggcccaaggtgtgatggacactcaccatggtcctggggtgaccctgtggggcacaggcagagggaatgctctgagccttccggaaagagtttctgagacttgtcattaaaaagggacggaaaaatagcaaattaaaaaaaaaaaagaaaagcaaggggggtaacatcaaaggagttactttaatgagtgagtgcatcatacggtcggaatcgtaatctgaaggtttccaaaagcccatctgtatgttatacaacttccaggattcctgttaaattctgctctggagggacttcctttattattattttttttwatggtcactgggatatccaggaggaaatctgggaatgataaattcacaggactatttgtggatattttcccctgcatttgttttgacctacccacactggatgggactttgatcacaaagcccctcccgtagcccctgtgtcttcccttgcctttgccacacagtcttacagttgccttctgttcccatgactctccttctttgtcctttgaaggctcctttccctctatcccatcccataacttttctgacgcacgctctatccatagttggcattgctcattcctagggcttccgccgctctttccacgatgattctcagatctccatcagtcccagatygttccagggctctaggcacagatatgcagttgcctactggacatctctacttagttgtctcgtgggtttccccacttagacatggcaagaacaactcctcctcctcctcctcctyatcctcatcaaaactgcctcttacgttgtattctctatcgtagccatcggcaccaccaaccacacacatgccctaagaccatgagaatcatcgctgattcctcattgtccttcccttctgtgtacgatccaccatccactttttaattctacctcttatgcatgtctcaaatatatctacttcccttcatgtccgttgctatcaccccagactctgctaccataatctctcgcctgaaccactgcataatatggtgtacaaggtctttgatgccatgagcctacactacctttcaagacttacctttcatcattttcttttttttttttttttttttttttgagacggaatctcgctctttcacccaggacggactgcagtggcgctatctcagctcactgcaacctccgcctcccgggttcatgccattctcctgcctcagcckcccgagtagctgggactacaggcgcccaccaccgtgccctgctaattttttgtatttttagtagaggcggggtttcaccgtgttagccaggatggtcttgatctcctgacctcgtgatcygcccgcctcggcttcccaaagtgctggaattacaggcgtgagccactgcgcccggcctcatcattttcttgattgtactctatgctgcaagcattttgaattcccttcagtcctttctatgagccattttcacatttgccttaggctgttgcataaataactctccctgcctagaataacctctttgcccctcacactctctccacctttctctttcttcttctaccrtctttcattatttagtcttaaatagtaagagtaaattatttatttagtaaattaagttagtttacacatctcttcctcaaagagaacttcgctgccttaggccaggttaggacttttrtgttctcataatcactaaacttctccctttataacactcttatattggtcactcttgttttaytggtcgttattggtcacttttgtttaaatgtccccattgccagtgagattatttcatcaaacacatcacatgtcttattagtcacatttttttttcctggagatgatttctaggaatcctctgttctcccgggcaaaccagaactgctcatttgctaaaccttctatagagctatcaagctgagttgcttcaataccttctttcttttgtggggtttctgtttgctggattctgtatgttttcttccttgctttatatccttggttggtgaaattcatcctccaggagcttcatgagaatggatgcatgcataraaagttcatttttttkraaccttgcatacttaaaagtgtctttagtctgtctttgactttcgtctatactttggctgggtataggagtctatgctgaaaattatttgccttctgaatgtaaatacatttctgcagagtcttctartgtcaagggctgatctggagaattgtaacctatttttgattcccaattatttgtagaggatcyatatgtttgtttctctggatctrgaagcttttagaatcctttccatyattcctaaagttctgaaatctcatgacgatatgttttgctggaggcttttttttcaccattatgctgagtgggtccttccaatcagaaaatgcatgtccttcacctctgggacattttcttttatttcttttgcactttcttccccaccattgtctctgtcttctctttctgattaagtgttggagtttcaggccgggtgtggyggttcgtgcttgtaatccttgwactttgggaggcctaagtgggtggatcatctgagcccaggagtttaagaccagcatgggcaatatggtgaaaccctgtctttactaaaaatacaaaaaatattagctgggcctggtggtgcatgcctgtagtcctagctacttgggaggctgaggtgggatgatagcttgagcctgggagacagaggttgaagtgagcygaaatcacaccactgcaccccatcctgggctatgcagcaagactcttgtctcaaaaaaaaaaagagttcctagatcaattaattttttaatgttttctttcctattgtccatttctatgtctgttctactttttttccgagagatagtattgattttaatctttctgtcattttattgaattcatttcagatctagatttttcctggctcatttttctcttcagaataaacttcttgcycctgttggtattgggaagtgctagtcacctaggcaacatgcgtacagagccattggcgtctactgttccttaagcagagctttgaccagtcaccaccccctgccttggggatacctggtgcctccaactcctgagcctttctgagatttacagcatgagttggcttgtttctctctaccatcttccactgtgaacagttgataccagtcacacagctttgctgactccctcgtacactgtccgtcttccaagatattcatcaacattcctcacacactactatattcatgactattttcattaatttgtggttttatactttttaaaattcattcattggtattttagtggcatttcagaagtggataaatatatgtttatattcaattttctatgtataatcaaaaccactaattttttactaaagatttgaacacgtcgtctgattactgttcatggaggagaagtctcactttgaattctggttctagacttccctcactttcctttcttcttttcttctctctctctttgatttttcctgcatcttctccttctgttctgactcacagacaggatcacaaccagctcacatatttagcttcagaatctgtaggctccatctagttttttttcaattttttattatcacagaattattgcttacttttttcttagaaattttttactatgaaatttttcttatgaaattctaaagaatttcagctcactctttaaatccttctgtgataaagatgataataggaacaatgatatatttgtctatctttatttatcttgataaatgtctatcagagcatgtatcttggtacatgctcttaacatgtatcaagccctaaatgaagcatgctgtatagattatgtcttttaactcaccctrtgggcaagttaatatttatttctccattttaaagataagaaaactaaagcttatagagttgtaataacttgcccatggacatatagttggtgatttgtgaaatctggttttatacaatttctggcaccaaagatgagacttttatccactatactacatcctcttgataggaaataggaatattagaccagaaactgatcaaaacattattttgaactattagattttcattagctgttagaggcactttcaaacaaggatgggatgcctaatcataccagaagtgctcctctggaaatatctacacaggggttgggtggtcttgggtgaagaatgttgggggacatggggaggttcctacatccagatgaagcatggacttcaaaatcccgtttaaacacttcaagtctttgattcttaccattttactgtctcccaactattaggttgctgcttaaagtaattgcagtttttgccattaaaaagtaattgcaaaaactgcaattccattccctgtacattgtgcatcaatgggaagkatgaaataactccaccctaaggtgtattttagcattcggtattaaaaataataacaggtatcatctattcaatgcttactgtgtccagatattgtgctaaggactgtataaacattgtttcacttaattcttatttcaaccctgagaaattgggccattattatcattctasaccaaaaaagtcctgaatgtagttgtcttagtctgctcaggctgctgtaacaaaatgccataggcttaaytgacagaaatttattttctcatagttctagaggctgaaagkttcaagatcaaagtcgaaaagggttgaatttctgatgagggctcttcttacaggtagctgccttttctctgtgtcctcagatggtcttgagatatccctttctctcttcctctactcataaagccaccaatcctattgaataggaccccacctttttgacctyatttaatctaaattacctcctaaaagtcatatctcccaatacagtcacattggggattagagcttcaacaaatgaatttcagcagacatcattcagtccatagtagtggtgggcaatgtttagcttggttttaatggaaagatgatgctattaatgttattgagacctgaaaaatgtttcacctaggaggagaacagmcctgtgttcccccatgaagagggtggatagatcacctgttggacaataggactggtgccgtctcagcattggcaggaagggccaactctcttgttgcttgtcagacagcaggaagaattcaaaagtattttggggtttgaagaaacctcatcctttgtggagggagtctgcacgatctttataaaggacttcctcaggttgcctttaggagaaaagtagtctctttagtgtctctctatctctacttgtttttggatcagagatggctttagtgtcaaaacttttgtgttctttttcttttttctgtctgcaaaaccaaccctgttctccagaggctttttgtaacttaatccatttcttttccaggaagctaaagaaactatttcgaaagctgaaagatgagaccgaagctggagaaactgactctgcccattcgaaacatccagagcagtgggacctagactacagcttggaaccatacacaggactgactccggagtacatggaaatgagtgagaacccatggtcctgccttccactgggggcaggttcagacaaggggtctgtggggttgaagggggaaggtaggggattggggaaaatgactgggacagcctctgcttcttcatgagcttcatggctattcagtgttcccttcagtgccacatgaaagttgagaagaatggggcagaaagagacctgggaggagaacctggagcagctcagtcaacagtttggtggataattctaggatgatgttctcttttccttgtgattcctctcctcatctataaactaaagtttgatctctcaggcccctttccatggtttctattattgataaagctgaaagggaaatagtacaatctgaaatttaagaatatagtttccatgaaagtcttccttcatggaaagtatccgatgacacttgggtcaaggatatctacattttgacttggagaatatataagagcatcccctactttgatcagataaggctggataagatgaaagctttttaacaaaaagttgggtctatttcggtagggagtgagaggtgtatttctagttgcagagcctctagttgttttcgataaggcttgaaggcaggagcacatgtagtacaggctgatggaacacaatcattttagatgtggcttggaagccatgagttctttattatgagaagggtcccaacttaggccagctgcctttgcactgttggctacttgactataatcctgatcttctattgggatggatgtttgagaagtctctttccaagacttggggctaatgaattaaaagcataggataccaaagatcaagagcttaggtataagaygagcgcagtggctcatgcctgtcatcccagcactttgggaagcagaggcaggtggatcacctgaggtcaggagtttgagatcagtctggccaacatggtgaaactccayctctactaaaaatacaaaaattagccaggaatggtggcaggcacctgtaatcccagctacttgggaggctgaggcacgagaattgcttgagcctgggagacacagcttgcactgagctgagattgtgtcactctactccagcctggccaacagartgagagtctgtctcaaaaataaataaataaagatcttagctataatgtctaaacattctaaacatttactcaatggggaaccatcaataagatccatcaaaaaaatcactcaatgtttaattcagtgcttagtatcattgcacctatcactgtgtttgcatatgactcctgctcccttcacctmgtcacttgtagcagagggccgtcagtacctttttgtgcacaggctacctcactcatcatttctaatgggcattcctcctattctgttataggaaattgcatgtgtttgttagcagtggagtaatgggcagggtctagatcagacggccatggaaatattgtcctagccctgggatgtctacaattctagggaaagcctcaactttgtaatctgaaacaactcaccagagaacaaacaatcattaagtctgcttcagaaacaatatgtaaagaaaatatcaagacctggtttaaggaaacgtgtagcccctttatgcctttcatgtttggctaagagctacctctaatccctctctgatgctgtatttacacaaaggatattgctcatatttcagacgccattctacatctgccattctctcacccagaatgaaagaaagtgctgccagagattgggacttccatttggggaagggcctacattaggaacccctgagatctgtttgtctgcctccaccctctgacgccagtggtcccacttccgycgccaccaattagctgtgtgggtttcacatgcttgtcaaccttgtctgttcagctatttcaaagcttcctcttttgrgtgattagagcagagaccccaaagttttctagtttatgtatatagacgtgttcataatagcaaagaatacattccacctaaatgctcatcaatgataggctgggtaaagaaaacrtagtacactgtggactaccatgcagccgtgaaaaagaatgagttcrtgttctttgaaggaacatggatggagatggaggccattatctttagcatactaatgcaggaacagaaaaccaaatactggatgttttcacttataagtgggagctaaaccatgagaacacatggacacacagagaggaacaacacacactggggcccatcagagggtggggatgagaagagggagaggatcaggaaaaagaactaatgggtactaggcttaatacctgggtgatgaaataatctgtacaacaaacccccatgacacaagtttacctgtgtgacaaacctgcacttgcacccctaaacttaaaagttaaaaaaagagaaataaaacattaaaatacaacaaagaggagcagagacccttgaaccatacttcctgggctcaaatcccagcttttgaccaactagctgggtaaccctgtgtaagttacccacttgcccttatcaagactcctatgygtcttgatttgcttgcctattaaaaaaagataataatataataggattgtcaggagtagtgaatgaattagtatctgtgaatagaagagggtcttagtgcttagtgctaatacagtgcttagaagagggcctaacacatacaaaagytgtgtattaagtgtccagtgttattcctcttaatggtcttgaagcctgaggaaggcagagttagggaaatatactctactttgtcagggccatgccactgaatacacatctaccatgttattatgtgtttcaacttgggtgcttaccaagaaatgagaagaatgaaaaaaaaagtaaagaactagaagatttacttggtgactttgggaaggaaytcacaccaagattgtagagagtgagattcagaccatagactgaaaaaccagaaagaaaaacaaaccccaaaccccacaccttaaaatgaataaaacaatcttatacctggaatcttgaaaacagaagagaacctgtctcccaaatccaaccttttaatttttttaaaccattttggtgctgtttcttagaccctttttgtatgtacatgaatttaaaaataaaattttgatcatactcacatttttttatttcccattatatggataaatattttaagttatcacataacattcaaaatgaatagctgcgtaataatccctttaataagcatgccatagttcacttgcctatcttccagtgaaggctyatttaacaattctccctattttaatcctctatctttgttgctcaggctgatcttgagctcctggcctcaagcaatcctcctgcctcggcctcccaaagtgctgggtttataagcactatctttgtgcatataatcttttatttatattattatttcacccagatagattcacataggtgtgattaggtatggtcattctatggttcttgattcattttaccaaattgctttytgaaagaataagaacaattcacccaggcatgggcaatatatgagaataccctttcagtgagtataaatcacttaatatcctgaatcctaaagtcatgtgatatgaaagaattatcagtgtataggaagcttgggattcccagccccctacgccactccattccacgttgttgacctgaatattctagactcatccttagcttagttttacacggtgcttcctctaggaagtcttcccaggtcaagccccagttcctcttgagagaaatcatcacttktttctgtcctagtattgtgtttggtacacacgctgatggcatcttactgaattatggtagtattgcttacacatatgttyttcaacagacccagtcaaggagtgactctgaagagcagtaggtagggaccatggcttattcatcttcacagcctccagagtctagcacatttcctggcatataacagacactccaggccaggtgcagtggctcatgcttataaacccagcactttgggaggctgagacaggaggattgcttgaggccaggagctcaagatgagcctgagcaacataatgagaccctgtctctacaaaaaggaaaaagaaaagaaaagaaaagaaaaaaaaacagtagagtgtagtgttgtacacctatagtcctagctacttgggaggctgwggtgggaggattgcttgagcccaggagtctgaggctgcagtgagctatgattgtgccactgcacactccagcctaagtgacagagtgacaccccatctctaaaaaaaacaaaaacaaaactcaaacactcggtatgtctgatacacaaagatgagggaatgaatgaatgcatgcatgcgctaattaatgagaaaaggtttcttgacagagttaactctataataataactttacaagacaagtaaaggatttacattttcaaagcagggcttaattgatggtgaactacggatgttctgaagaggtttccagcygtaagtgggaggttgatttagtaatcccaagatctcttctgattctggagatctacatatagatgataagaacagagaagagcactccagggaaaaggactggcaagtgcagcgagtctcctggccatgagtaactgtttttgttgttgttgttgttttgttttgacacagggtcttgctacatcacccaggctggagtgcagtggcaccatcatgggtcactgcagcctggacctcccaggctcaagtgaccctctcacctcagcctccctagtaactggcactacaggcatgcaccgccaaacccagctaatttgtttgatttttttgtagctgtgaggtttcactgtsttgcccaggctggtctctaactccagaactcaagcaatcctcccgccttggcctctgaaattgctgggattacaggcatgagccaccacacccggccacgagtaactgttgacaaggaaaagcaaatggtagttttgaggtatggaaggttcagatacagacctgggattagtggaaaaccctgaagaccagacaggtttgcatttcacatcagaccatatgaagtagttgtaaaatcttggccaatgtggtgactgtatactctttgcttgggaaattgggcagcaagtgcagaggagggatagtaaggctcaggaggaaaagagaaaacacaggtgcaagaattcayttatcaattcattcatcaaacatttattaagcacctggagggaggagcaagtctggagaccaggacagtctcttgagcaattcaggttgttcctgatattgattgagtcaacaattcagttgatattgatgcaatcttatctggaagaggaatcatacaggggtttttcaagctggattggctcatagaattctttagtctattttgctatgactttcaatcttaagagatgtgttttagagacatggctattttatttcatattttattaagtgtgaggacaatgttttctggattaggtttcgttcatctcttttatctctggactatcctcttaatcctttaaggacatactttttctcaagtacaaagactgggctgcagaataaccctcattaaagttcatcaagcagctaagtgtggttaggggtggtactgccgttgaaccactgggctttcaaacctaaccctgctgcatgctagctacatgactctggttttgaggcttaaagtcagccaggtccaattctcccatctgaaaagtaggtttgatgataatagcacctacctcataggactattctgggartcagttgatgcatgtagagtgcttccacatgtagaccgtcaatgaacattggccaccrttgttattgtccagagttcagtttctctcaaatctagaaagtttttgactcaaaacagtttgaagctcctgaatacggtgatctctggaggttcttcctgtactgtgagtgtaggctgtgccctaattattaaagaatgagggtaccagaccccaaggcatacctaagaatcagaagcctgagctctaaacactccaagatgtttgtcytttcagtaaactctaagccctcagggctctattgacaagtctggactctcagatgggctctttttgtcatctgtttatctaaaacccacaagcttttgttcctctagtcatccaaaaaataatcgctattataatcctgcctcaggaattcaattatctcccttacrgccttcccccagcttcttaaatgcaaccacagttttgaggcccttgggctattactgtgggtgatgagatgaatttcttctgtcattcattcacacagtcatgagagcagatcttatttttcttggtcatgagcttatatcctgtcaaaccctcacagaaagggaagtgcatccatgattgcatgtttacttattcattcatttggagtaaaagccagataattattttgaaaggcagagacccccagcctctcctgctctctggaagtgtgcaccaaggcctgtagaaatcaccgtgtcaaggaaatgcatagggcaggttcctctcggagaccagatgttaaagctcttgtggccgctttcaagttgtctcctgaaatggcaagtctgagcttctgggttcaggaggaacgcctgtggactcttaacctccatgactactttctgactttgcgtgaaccctaactggggagagtttctatttgtggatacttacctcgctgactttgcctctactgagaattttggattcttatttgaaccctcaccatttctccttggaattactggaaatgcatcctaagttgactccctgcttctttttcactccttctacctttccttcttgctttttagaacggcttttaaaagatgcaagccagattgcattcatttttctacttaaaatccttcaacgctacagacttcttttcagataaagttcacacgcccagtgcagcagatgaggtcatcccaagctggctcttgttttgcatcttcttgcaggcccgcgtgtgtgtatctggttatctcacactctcacgtccaatttgcctatgccatgtcgcctacccgtgactgcttgctgagtgttgcaggctcagacacatttgcccttggcaccattttctcattctcccatcctcagtttttctcttcccctcttctcctgtacctgcaccctttcaawcatgtgagtgctttggggacagggacaatgtcttattcctctctagtcgcaacactcagcatgggtactagaacctgataacacaatgaaataattattaaatgaatggcctcataagtccttttccttcattggtagagaaatagaagtcccgcttctcttgatcccatgacctgtgggccaccttcttcactatggacatatttgtgtaatttttaatgtgcaataattttagtctcctaagaccaaaatgaaccatgtttattatcagagtttctctcaaagaaaagtcacttctgattttaatttattcctttccctaaggggtcaagtcattagtgttagtggacagggtgagatgatctctttcagacttggctctgacctcaactccaaggccacatccctgcctctgcagtgactcccctcctgccctcccccggggcagcrctgtggtgtctgcactgctgccaggcactggggacacagagacaacagacatgcctgttccctccagagtttcagggtctggtgtgagagagagatgtgtgaaggagctcagggaacttcaccccaaagtatgactccctggcatagtaagtattttgatttaaagatcctagagatgaacagtgctaaaggagatttttcccctatgtatgtaaagaccagtcagacctaccaaggagaacgatctctcccacccttctctcaatcctctacctctctcaacacacaggctgaatttcccttagctgcctaaaagtctggacctactaaagaaaagaacaattacttccaatcccttccctgagttttcatgaactgaacccacattgcaggaaagaagactaaagtcggtcaacaaacctggacagacttttgtcacaaatcattgtctgctctgcagattcaatagactttgccccaaaccattgcatgttctttaagcccatgaaattcctctgaaatcacttactatccccctaaaatcatccgcacttcccacaccctttcccctaagaagcagggtatgtaagcacctgtactacattgggatactgggcaatcactctgtgattttccccgtgtgcatagcagtaacaaattggtagtttttgttttgttttgagacagtttcgctcttgttgcccaggctggagtgcagtggcgcaatcttggctcactgcaacctctgcctcccaggttcaagcaattctcctgcctcagccttccgagtagttgtgattataggcattcccgtcacgccctgctaattttttgtatttttagtagagacggggtttcaccatgaccaggtctcgaactcctgacctcaggtgatctgcccgacttggcctcccaaagtgctgggattacaggtgtgagccaccacgctcggccgctagttttttctcttgttaatctgccttatcatgagttggtttttcagcagaccttcccaggacaaaggggaaattccattggcccccatatgggcacacagacagttataagaaaggacctactgttctagaaaatagtttgcctagtgatgcttgctgcagaggctaggtctttgctgcttccggttgaccagcagagaggtgtgctcgaagatcgcctgctcttctcattcttttggccttgtctttgggttttagaaaccacctactgaggccargcaaactctgaactggatgcaggaggctcttctcccgcttactgccccaggcttgtctcgagacttcaaacaaggcagggaagggcccagaccagaatccatttcggggaaacatttctaagcctttctgcctgcaggcttcatacccttgactgttttctgagttctgtgccacattaatggccccaccatcctccaggcccctggctgagaaatctaacatcactgctcattctctgttccgtctccatgtgcctcccatccagtaggcttgctgtgtcgacgatctttcctctagagctggggtgtccaatcttctggcttccctgggccacattggaagaagaagaagtgtcttgggccacacataaaatatagtaacactaatgatagctgatgagcaaaaaaaaatctcataatgttttaagaaagtttacgaatttgtgttgagccacattcaaagctgtcctgggccgtatgtggcccatgggccaggggttggacaagcttgcaatagggtatcttaggaatctgctgtgtctgccctgcctcctccctggtgcttttgctttttcttttttttttaactacatcctcaacacagccacttgcagccaccaccgtctcrccactgcctcatttattccttccgaggtgtagtgttggtcatatccctccggtgtccaaaaaccatcagggttcccgtgctcctagcgaggccctcccagagcatccttctcgtytatttaatcctaggtccttctccatgtcctgtggtccaggaaagtgaatcctccgcaccctacagctccctcctgccctgcctgtcctgagtgctctcccrgccctgggcttgcctgcgccttctcatgcgtgcatccaaagccacctctcgtgtcacctgctccttaccacctcccccttccccctgccccacaggatttcagacaagctgtctcctaaaatagagatgcctttggtaattaatttcccaagggccgattcttcaaattgcagggccttgcccagcacccccccgccagggcatagtcactaaaaacatattgggtaagcctgtaaaggggggtaactgaataaatgagtgtatcatttatgtcttcggctttctcttacctaggctaacagaatctcactttctagtgatgctgagccgtggtcaattctcatttatttatgggctgataatccagtgagtggattatcaagagaggtggttatccttatttctctttctcctcttcctccttccctgtctccctctcctgccaccccttttcttcctctgcctcctcccctcccccatcccaggcctattaggcactcctttctagcgagtaagccagggaaataagagaaggtgtaacgtgaacccacccatgcagttcaaagatcgcagcagctctgggaactagcttggtgggagagaagatgaagttcacagcagatgtcaaaacttcattgggggcaatagtttctgccgtctccatggataactaagacttggcggcagtcaccttatcattacttctgatttctctgcaccctcgtctttgaagtaaaagccccttcacatctgctgcctcttgtatctttagatgaccattgtaggcagagtgagcgtctctccttcccatgttcccagggtgycaggtgagactcgggtgcagatgcagctctgcttctatctagcagtgtggcctagggcatggcrtcgtataatttccctggcttcccttttttcctggaaattgtagggaattagaccagagaatgagtttttccctgcagtgatgcaacccaccggtctgtggtcaaaaccaattgtgcaatgtgtcacaagtaatgcactactgccaatgttttagaaatacaaggtaaaacagagtcagtgccaccctcactttcttagatktctagatgttttttgaggaagggacgtttcagcatacacaaatggaagtgcaggtcatcatttttcattgagtgtcttgacaggaataataagtttcagaccatgagaccagctgaccttcagggcgccttccagtgatgacatgatggttcatacatcctagttgaacagtgcacctcaaagccaagaggcccagggtaatgtgagttgcctaaggtcacccagatgactcactagtggaattgaggttagagccactttccagaccattccacgggagacgtgcttcaagacctgtagkaacttgggcttctgtggaaggatggaatgaagtgaggcttcctccctccttcctaactggctagacctcccccgttccagaagggcccatgtcttggacttygaacaaaaatgagagcaatgaaaccaaagctgccccccgcctctggtgtgcttgacatggaaggatggaatgaagtgaggcttcctccttccttcccgactggctagacctcccccgttccagaagggcccatgtcttggactttgaacaaaaatgagagcaatgaaaccaaagctgccccccgcctctggtgtgcttgacatggtgatccccggcccagctctcagctgtcagcctctttccctgagatccccaggaccacccatgcagacaggaagtgcgctgagcccactctgggcctgtcagtaggaatggtggggcaggtcctcaacggagggaggcagcagggggagatgtattatatttacatttttctaaattgaactggaacctgggctggggcccagcaggcttgggggaggggctgcgaggtgaagggaggctgggatcagcctgaggaggtgcatgggggtggggagcctcctcaggccagtggatgtggggatgggctggctccagacaaagggaaacctgagagggagggattaagctggagaaacctgggagggtagcagctggctttcgagggaatctccaatatcaaaccttttcctgaagggcttactaagaaggactttaggaatcgtctcccactcccccatctcggaggggatgaaagaaaactggcccaagagatggccatgacattaatcatcactgtcccctaccccaaaatggggcttcaaagctccattgccgcaggcccctcacagccctgtcatggggttwtcctcagggcygatgagaggaaattcttcatttgctttaagagctgcaagcttaagttctctggacacttgcagccatttgacttttcctcctgagcagaaggatgtagrcccaagtttaatcccggaagagtttagtgacaagtcccaaaaaaatctcttggtaaagttttatcaccgtttcattcagataaataaatgatgtgattgtcagttcttctcacctgaagaccaatggcccagggtcatgatactcactaaattgtgatggaagcttcttgagggtgagatttgtgtcttattgattcacagcacttcaccacaaggcctggcgtacagtaagtgctctatgaatgttttcttaagaaggaagaatgaaagaagtgatcctgtagtgaggaccttttgggccggctgggtgtggggasgggctgtcagttggactctgcagacgttacctttcatgaaaactctccagacatccttgtggtattgatttagttgggacaacctacaccaccccttgcagtgcaaagtctccttattttgaagtgctagtaattagggaatgctgtcatccatagagctggtctcctatagcagcataaattgatgaacttatgcaattatctggatagttcaggaaaactaccccatatattagayaactactgctatgataatgctttgtagcaaatactccagagtcccggtgacttaaaacggagacagagaatcaaaaacaatgaaaatgacgggctctggtactgagttccctgcctgacaatgatcaggtgaaagtggacacttattaaaggagcagaatggcctgagcttcagatggagggataacttaggtgacaccacattcttttcaactctgatattctttggtcatggatggtaaagactgcaatgggtaatttccaaatttccaacagaggctggatgtaagtgatcagattttctagaatacctgagaaaccatcagcactgaggcccacatattctgtcacaaagaactgcaagtgtgtgtgtgttacaagccaatggctcaaagaaccaggaaattcctttccctgggccatcctgtttacacacgctgagtcattccactggataatgaggctcctgccatcttctccaaatggcgtttaaacacaattgaggcagcatcgaggggctggcttcagcatttctgagaagtaggttgagtcccaggtcatttctgtccttttgctgctgaggcatagattgcttggtgttatctgccctagactgcatccccacgcctttaagaaaaaaggcaaaagtgtatctggataccacagccctcagcgtaccacaaaaggcttctgggatacagaagatgcctagtcagtgcttgaggagggaaggaaggaatggagggaaggcagtcttttagtttaaaactgatgaagaactgtactgctgccccatttctcttcttgctctaacaaccgggaagctcagagtaaacgttactgctcaaacatagctgcattgtggttccccgagttttcttacttgttttgtcctcttttctgtgctccttatttccgttttctaaaatcctataaacctaattttattttcattttgttcacttttgcacaaaccttttgggaagaggtagaggagaaagaataaagcaaagaaaggtcctcagtaatgatttgttgcttgggaacttcattccaatcatgactggtttcattgcccttcgaactcacgcactacattaccacagtccaaatgagaggatggagggatgggaggaaggatgaatgaataattgtccttcacactcccatcttgcaggtggataacgtaaacaagagtgagaaagccagaccattcatttgttatttcagtaaatatttactggaagttcaccagtctgtcstccaggaagtggatcagtagatcttgccaactcaagtctccctagctttgatgtgggacgggagaaagagcagggactgagtctcctttaaacacaaagaaatgaagaaaactcggagccaaatgtgccttactgatctgtcccagcattgcattgctttgcatgcagtaaactcttaatacctaagctgtgacttcaagcctgtcccttcctgttatgacttcccaggctttttgaatcaggcccgatccattgtgtaaacccccaggtgactccatgcagactgaaaaggaattccacatattgtccttatttcttaagtagttttttgtgaatttggatcagtgaatttgcaggaacgaccttaactaccaaccatatagcaaattttcttatgcgtcttctacttgttcttcacgtggagcccagtgatgaatggtgcaaagcctccatgggtctgctggtgacagtcagttacctctgcccagcactctacagcactgttaatgctggcattttgttctcaccacgtgaggctgtcaaggattgtttccatgtccatcttccccacagcatattctgagcccttggaaggatgccacagtaatctgctcatcttcgtatttagcaatgcacatggtctccagtatatagaatgtgctcagtaaatgcttgctgaatgaatgcatgagtgagtggatggtgagtgatggacgttgagaactctcttatgtttctgtcaaggcttcaccatttttctaagcaatggaggcccatgctgaggatctaaaatagctcgtgccttttcttctcactgtcttttcctakttatgtgtacaatcgacacttgcaattctttttatgccagacgttgtcagcccaaagcatagttggcttcccttgctcttgggaaaaggggatccctgggcacagtcrtaaaatatgggctgakgaaataaatagttatgaccttcccctgctgtgctcttacataagtatgtactaatgggctgtttctagcggaatctttcacttactgcctcctgagtgagaagacaagctcataccagtgtgtccttccatgattcccttgcactgctcattaatggctcataagaaggaggattctttttttaagcatttcagttatttttaattaaagaaaaacagccttctccaagggccacaaagtgaactgaatgtcagaaggaagctgggtgtgagtttctcacaagctcttgctccaaaacctgttagtgaggagaaagggccctccgggagctctggggaaggttggtgcacacaggagtccctttggcggggtaggcagagccgccagccctcacatggtcactggattggttcgagtgggctctaaggcaactgccgtgtgccagtctgttgacatgatcaacattaatattcttgcggcggggggggggtgttcattaaattaaggaatgacacagggagccaagagaatggcttatttgtttggattctgaatcacaatcgggaaatagtctttatctggtgcaaccataattccattttacttggagcaaattcgaaggaaggtgagatcattctgggggtcactttcatgcatggtgctccgtgccttcaggatgaagctgtgcaggaagctggcacactctgtggtggtgaggttgaccatggtgctcttgatgggaatgccatctttgttcaccatgatgatattctgcactcccctctggctctgaagtcacttcagtgtctcctccacctctgatatttacaaccgatctggtagtcctgctttgccaacactcaaaaaggagaattcttaagcccccaatattcaacttctttaagcagactgtgttgcttttattaaacaatagaaagcatttttttttttttttttttttttttttgagacgragtcccgctctttagcccaggccggattgcagtggcacaatcttggctcactgcaagctccgcctcccaggttcacgccattctcctgcctcagcctcccgagtagctgggactacaggcgcccgccactgcgcccggctaattttttgtatttttagtagagacggggtttcaccgtgttagccaagatggtctcgatctcctgaccttgtgatccgcccgcctcggcctcccaaagtgctgggattacaggcgtgagccaccgcgcccagccagaaagcatttttttaaaagctataatcattttcattagaattggactctcctaaccaactgtttttactacaactttcttcgaagtcttctgtgccgattgcagcaatgagaattgcgatgtagaggtgttcatacttcatgtctacctctctyttcaccatcagcaagtgcagtgctctcaggtcacacattttcatttttgaccttgtatgtgtgtgtgtgtttcacaactggtgaaaataaggtcagatttatgaaacagataatctttgagcatctgctatgtgataggcaccacaaaagatggtgagtgaggacttggaaaagaatcaaataaggcccctggtctcaaggggctttccatctagggagcaggtcaaataaacagagaggcgtgtcaaggcattatgggagtgaggatgagagatgcccaaggcaccgagttccacctgcagtgctggtgggaaatggaggtggaggggagtcttcatacagaaggcgaagtttgagttgagcctgagagatgaatagcatcytactcagccgaccagaagaaaaggaaaattacagacagtagtggcatgtaccaaggctcagaaatgtagaaatcatggtgagtttggggaagtacaaatggtcttggaatggttggaaggcaggcggagttgatctccaacatacttgctaaatatttgcccttagcacagaacatgggtggggaggaaatggttctggatatgttcactgaaaaatcttaaataaatgagtaaaaaatcagaattgtattccatcaaaatcttctccaccaatcctggcaagtccattctattttatctactatactgtttgtgttctctaaacagattgtcttgaaacrtccttgttgaatattgtcttggttagtttaacccactcttccttgttattttaacctaaactcaggaaatcactgatgcagaaatgtctccagcttcaggcagtgtagggctgatggttattctagaagatccttggctgctgaagggtgagaagagaaaaccaatggggtttgcatggaggagtttccagcctttgagctcagcattactggagcattttacagcaggctttataaagatttggttgaaaatcaactcaaagtttcctccctaattggcttggccaggcttaatctgttattggtcaggccgagctggcttctattatgcagcgcacggaggatttccggtgttgctcttattctaatggaggcttgctgcttttagaaacaaatcttggtgttggcaaaagccggtatcattgtatcctctgaagtgagcccagaaggactcccagcattttagacctttgactgaaaagagcgagtcttggatttggaatttgcatgctagagagttatggttttatgttttattctcccccaaataaaacaaaacttcctatttgtttctgcctctttgggttgaatcctggcaatgctcagattacccagtctgagcaggcgacatctgcagcaatggggcgtctgcagagagggcctgttcttggctcaggataccatggagtaacaccagaggaggggacaggaggatcttgtcacttcaggtccagcattgctgagcccagtctcttgaggccatccagtgctgarcatagagacttacatggcgaggggaaggaggagggacattttgttatgggactggggtgattaacaggagctattagagagcatcaagccagcactggaagatgtttgcgttgacagaagagggacaccagagagtccatgtctggagagtttgtgaaggtaaagaagcaaaccagcagggaagccctagaagacagcattcatgtctgcctctggagttcaratgaagagagaagaggaagtggagagtcccattttycctataaccctggaaggaagttagatttcagagtaccatgtgcacgaatgtggtgagggcatgctgtgtacatttgcaatccctcagaagtaaactgcccttctccctccccatcagtctccttgccaaacccttgcggaggctctggggagtttgcacatttctgctggaggaagtcactcatgataagaacatttgccctgctgaactgagctcattagaatcaagaagaccagcttataactccataaatatacatccatccatacacttaaacacagacatgcattttacaggttttagaatgctagtctaacatctgttttcgtttccttgttaattccattcatccccacaccctcctggccttatccccattcctgactccaaagtgawttcctcagcaaagctttatttaaaagatgagagagatcctgcattttgaactggcttccagagcttgtttttggggatttctccaccaccctccaatcgttgttggccagccagctagtcaggtgatcactctaaggtcccaaccttgacaaatctgtgtatttcggtgcagktgtcttgctaccgaccagcacttgccggcctcctagggcctgcaggaacmtactgggcaccaaggacaatggcagtggacagggttgaatcagcaagaacagtgacccacaactgtgggctgagcaaactgccaaatcaaaagcagttgggctggggaaagttccatgcctgttccctttcctgaaacttctattgtggttgctcttatccctctgtagaaacagaatttttttcccatttgtgtcagttttttcattcttcatttgaatattctagactcacgaagcttgtctaagacaatgcgaaccatagcatcacagcaaatcagagttggaggcaatttaaaccggtcccttcaatttatcaatgaggttgctgatgcccattgaaacaaacaggcttggccaaaatcatacctctagttagaagcatatccaggtctagaagtygggtctctctcattcagtgcttaaaccttaagtttgtgtctgtttagcatataagtatacagtatacattgcagtcatctgtacatgttgatatttattccaataagaataaaattacacataawagataccatttattaaacagttattatgtatccaacattgtacatattgtacattgtatgtacattgtacatattttgtatgtaatatcatttacccttctgggaaccctattgggtgggtattactattatcttcaatttacagttgaagtacctgaagcacagaaagtttaataatttgcccttagtatgtaggggagtcctactacattgtaactttcctggactctgggttgtgtttccatcagcaaatatgtactgaacccctagaagggacggaggccttgccttctcagtgggaaataaagatgtgtgagcaagtcaatcacagaagcacacagtgatggctgcaacagaagcctgaacacagggtggtggggtccagaggaggagggatggggcttcaccaaggaggtggcatttgagtgatcccagggatgcatagaagcttgccagccagagtgtatgcttatgcacaaatgagtggaaagaactaatgtggcaggggacaattaggagggtgagaaggcaggaccatggtcgttgctggggagatgctaggagatgaagctagggaggcagattggaggcagattataaagcacctgtatgcaccggtagggactttggattatattcagtgaacagagtggagccaacaggaatttttataagcaggtagataacagaatcaggtgagaggggctgtgtgctggatagactctagcatcctgggagaatggtgacaagaaaccccgtcaggaggctgttgcaatggtccaggtagggctggactctttccagctgtctcatgggcatgggctgtgccaccatgcttttgctcacactgcttccatagcttagaaggtctctttgacttaatcctcaagaaaactgcatgcccatctttccagactgtgctgagggactctacatggagacccattcagtccctgccctgaacaatgtacgttcctctccatttgggccttctctatcactagtacattctttattctctcttggcatacataaaaccttgttgcacatgtttgcctacacttaactctccactttcaaacccagcttcttgcaggcmagaacagacctttgccttcttaaatacttggtacagggcctgacatttataaatgctctccataaatgcgtgatggatgaataaactttctaaacaaaggcagtgactgtagacatggaaagaagagtccaaatctgggaggtggtttttaaagctatttcaagggaaggcaaactgtggccygtgggccaaacctagtcactttatatattgcttttgtaaataaagttttattggaactcagccaagcccacttgttgatgtgctgtctatagctgtttttactgtataatggcagagttgagtcgttgtgacaaaaccatatggcctgcaaatccaaaaatgtttattatgatctggccttttactaaaaaagtttaccaaaccctgagttagatcagtaggattagtgactggcagtaaagggtaaaggaagcaattaagacttttttttcttgtatctccccaccatgcctaatccagagctttgctcccaagtgatggcattgaccracaggcctgcaggtacttagaaagaaataccgtgtatgtgacacaggaggaaaagggagactaaaaattaccccatatgggaaagatacccaaggcagaaaggacaaggggctgtagctgcaagccagaagggacctgagtcctgcttgttcctgctgaagccctcatgctgtgctctctcgcagtcatccagtttggttttgtcaccctcttcgtggcctcctttcccctggcacctgtgtttgccctcctcaacaacgtcattgaagtgcggctcgatgcaaagaagtttgttacagagctgagacggccggatgctgtaagaaccaaagatatcggtacgtgccccacttagaggccccaccaggcccatccttctgccattctgtcccctctggccacagtcacaccacaccaggaatcaagagggctgggaaagcccctcttccctttgggtccctcatcctcatatcctgaagtgcagggacgccttctgagaccgctttatccacccccacttgtgatctgagcttccagatgggggggctacctaagcctttccagacaagcccattctgggggggcccagcaaagctgctccgtagttcacctgcaaaacatcacctggagcttcagcgttgtcatcactgggccgagggcgggagtgagccagacgctgtcttttctgtcttgtaggaatctggtttgacattctctctggaattggcaagttctctgttatcagcaacgtaagtacttgcattcatgacacactcgctctgtgggaagggcttccagagaagctgaggtcttcaaagtgggaagccagcccttgcacctcccagccttttccatttgtagctttattggtgacagtgctctggttaacagctcacaaatgccttgtaacccatcatgctgtcgctgaggctgtgtaggtttaattttaatttcacaaagagaaagaaaggtaattatccatcagaatgcataccttggccctgacggtcaaaatcagatctttccttggagccaagaataatgaggaaagaattccacatatctattcatctctttcctttcttactctactcctgagttaaacaatacctggagcattgcccaggctacaatccctaattaccgttcctccaggttgtcagtgcaaaatcttaattatccccgtggactctggcactgcgtaggttaagataggacatagaagaagggtcccacctgtggtgacctccttaactcccttgccagatatgtctacactgcagaggaaatcctgctgggccccagccagctccttttctgctgtattctctaaggacagtggccaggaagggcctcctgtcccacctcccaggaacatatcagccagctcagtgcacacaaagaaagccacagcccttttcccttggraggcaaacagtgatttgactctgacctgatttcctacccasatcacataaaatggctggaaggtgtgaggtgaggcagagcaaatcagcccactgcattttgaatgttgtgatgtaggaagtgcacatctcgaggcttagaaataaggtgcaagttggaaaacagatcagtccgctactttgaagttgtgtctgttaraacagaggccctgagtattaatcactttccatctacagtacgaaatgacgtgcagtcttacttccctggcctctttaagacttgtttacttatctgtcaaatgggagataataatagtacccaccaaataagatcatttgggaaattaaatggcatgatgaaaggacatataacaagtgcccagtaagttgtagctatgattatgatgttattcactctcaaatatggttctggccgttcacattcacatacacatttagagaacaatatctgaactacattttggtaaagggctttaattgttggtgcaggatgcagtataaacacctgccaaaaagatttaagactttctttgcagaaagtacccctgtgttcaaatacgcaatcattcatttgtcatttggtttgctccatggacatttatagagcacttagacatgccagatgctgtgttgggtgtgtgtggctccacctagcaggacctgtttctttctccactgtgtctccgttttcttaagtaaaatggatacaagaataacttctattacatgacatgctaaaaagtgttgagagataatggtcaaattaagcaaactgtggaatcatattcttggtatttctggctttctggtactactcaggggcagatgtacatgggcattccatttccttgcccattacacttacgtagtaccctcatcactataggtaatttttttcaggaaagcktgcaccctgttttggcttgctcaacagcaatgttagatatctcagaagtggtttaatccttccagcaccaaatggtccaaattgacttagcatgctttgctgcagtggttgacrtgtgctcttttgacagccactgtctggtggacttattatacttatacacatcaaagatggaaaaggcatgtgactcagctgcatgagctcagggacctgatcatgctgcatgagcttctgtatcagtcagagcagctccttctgatggggagcctaagagtggacagtcctttttagcatcaatcctggctactcagtgcttatggttctgtccctcaggcttttgtcattgcsatcacctccgactttatcccccgcctggtgtaccagtactcctacagtcacaatgggactctgcacggctttgtcaaccacaccctctcctttttcaacgtcagccagctgaaggaggggacgcagccagaaaactcacagtttgaccaggaggttcagttctgcaggtaaagtaatcttcaggagaagggcagcagaggaccagaagcaatagatccaaataattacrgggacgacctagaattacaaccctgcacaacatgatgatgttttggacaacagcagaccacatatatggcgattgtcccgtaagattataataccatatttttaccatacatcttctgtatttagatatatttaggtacacaaatacttaccactatattactgcctacagtattcagtacagtaatatgccgtacaagtttgtagcctgggagcaatagactatactttatagcctaggtgtgaygtaggctatatagcatctagatttgtataagcacgttctgtgatgtttgcaaagtcacctaatgatgcatgtctcagaacatatccccatcgttaagcaacacacgactgtacatcattctcctttccctctgtctcctgctctctctgcagttgttataaatcaattgttataaatcagctttgatgactcaaaaaatatttatggactgcctttttctagacactatggagcagacaaagagccttgtcctcaccatcaagggggctatggtctggttgagaagaaaataagcagaacagataggaaatagcaggttatttggtgagcttatgtatggaccatgagcattgtgggtgctcagaggagarggagattacttgagggactagaatggaaagggtgggcctcctggaggggcagctaggtgttgtaagagagaaaagaaaaacattctaggtggggagtcgtcatgggcaaagtcatggggtggggacaaatgtgggctgttggataaagacttggtgctaggtgatatggttagcaaggagacacagtaaagggattaataaaggaaatacagtaaatgtagaaactcctacaccagcataagccaaaaggttgttgaatttgaagagatgggataaagtacataatgggaagtcctgaaatctaacgggaattagaatgtgatgcaataggaagacactggacttttttagtgtcagggaatgataggataaagggaaggtttagagaaattgatctgttctcagtgaggacaatgggctagagttggtaggacccagggagcgcagctgggctgctgcatcatttagacatgaactgtgctgggcataaaccagggtggcgggaggaattaagaggagaggagaagatgagctatttcacatgaaatattgcagagttggtgacagtagacataggagagtggctgagctaggattatctccaaarcttggactgaagtcagaggactgggatktggttacattgatagggagagggaatatgctgagagagtctaattttatgctacatatgatgaatttgatttcaatcatgttacatwtaaaacgatgttaagaaatccaagaggtcattttcacccaactccttgacacactaagctggacttctggagacgtccaacttagagtcctgattgaaggccatcagcactggggtcactgaagccaagaaatggaaaactctccactatttacccaagaagggcaaatgaagagaataagagcagaggggaataatttattcaacccatttgtaccctggttaaaagatagtcccaataaagcacttgaccaaagatcctacctcatatatataaatcagaatagttaattacaccaataacaaaaacctaagagaaggtattgtgggaccaacatagggctttcttagaccatccccaataatatttgatgtaaaagctgtgttttcagttgtgttggcagcagtgatgaccctgggcatgtctgccatgcttggtgcccaaggccagcctttcgtaagacagccacataggttcagatttgtggtctgagaccatgaacgagagaacaccaattggttttcccaacctgggtggctgagttaaacaactgtaccaatctatggtttaaatagaagggtattccagttccaggaacaacaacttcagggttccactgtcgtcaaccaagaaaagataaaaaatgaggaaccagacacaagaattgatgaataaatttactcataagtgtcaatttatattagcctagatgtttcaggatttttcgcatctgggcctataaagagtctkactctcatactaaaatcacattgcaggcagatttgctgccaggctatgcactgcctgggggcccctctgcatggctgacatgctagactgtctgtccatggtgctggacttgggtctgcagaccccagcgacatagttccacagcacagagggtctggaccagctcgaggcctttccagtagcatctaggtcttctcaaagcagggtctaaagctcacatctctctaagagcgcaggtctccacctccrtgtccaatgggaggcagcaccagtgtgacttgtcgtgtgggaaagccaggctcacatcgtctgtttctttagttgctctagaagcacttgtcctcagagcacaagggtctctgatcttgcccttgaccattggattttccactaacacctatgaatatgcttttcaggtatatcactggtgaaacaggcttaaatcaataggaattttaatggtccctatgggaagttgaaggtagatctaatcttaggcaagttttcattcaatccagtctgcccaaatccagtctctgcccacctcccagttccactgcagtcaatgttgactgtgtttttaagttccgtatgattgccaggaactgtggtgagaaataaggcaaatgggtgctactcagccaaaacaaccaatgcccaggacaccaggtattgtgaatatrtgtggatcagattgagctttcttgtatctgccttcagagtcactggattttccggccagctataaggctctgatagttgtctccccattattcccatgcaagtagataagatcatggcttgtttgtggcccgttttagaaaaaaatctgacaccgagtggcagaattatcagtgggcacatgcatagaaagtgcactttcattctatatttctgccaaraaaatttatttgcagaaaataaatcatcccaagatcaagctgaagtgactttgaagcatccatcatttttccttcctctctcagtaccagtgaggattacagattcattaggcaaatatttttgagaccctactaaaggcttggcattggttgtataatagggagcgagatatagtgcatccctcaagaactctagatggagcagacaataagtaaacaaggaattaaaattaaaatacagctttaatgattgacaatagggcaacagcagagagctaagggatccctaaggagggaggccctgcacctaacacagacttaagtgtttaggggattttcaagggagatgaaacctgaagaatgaacagtacaagaatggccatggagacaatcacattgaaactcctcactcatgtggccatgtcagcctggctggtaagtggggtggggagggtggtaggtcatggggcagcaaggggtgtgtcaggtagtgatggaggttccgagagaacactgtattccagggagacaggctcaggtgagaggggtaagctatgagagaggaggctgaaagaaaaaaacaaactccatattaaggagaggatgctggtcctgttgaggtgcgtggagtctctcttagggccacagggtaccactgtaggggtttcagagggcagtgatgagatcaagctttttattggtgttacatctctgcctacagtgtgaagactattgggttacactgagggttatgtttaacataaagagatgccctactgtgaaatrtaggtagatgttcagaaaataaggtcagcatgtgatctagacataatatgtcaaataggtgtgctctgggggctgcgtttcctagattgataagggttgttgatggaaatctctgcctcatatgagtcctatccactgcctgctgtgtgaacttgactgggtcactcaattctctggagatttagaaagcagaggcataacctctatggatgtctttctaagtcaggaattgagatycttgagataattccgtatacatatatgtgtacatggaagagagagagagagagagaagaaagagagaggggaggaggaggagaagggactatgatagagaagtattttgagaaacagagataactcttcagctagtcctagagccagttaaaactgcttccgtggtgggaaacaaggtttgccatgattttctggcaaatagcgttgggaacttgttgacccttcttattcttagctttcagtgacctctggagataaatgtggtcaaataaaactgaggtctccgactccaacccagcctcgccagggatagaggtatcttaaaaatagcaataaaagttagcacaagtctccggctgcccgtttgagatgcattcccagcattttggagcgatgcttgcctctgtcatctgactgctctggcagggctgctccgtaaacagtccygtgacatcaatctgcaggcatgattagcagcatttgacagggtcgaagggccgccacgtcctggaggacggatgtaggcttgacttcccagctcagctggaagggagcatagatatcttgtctcagagctcgaagagcctacctgggcattgtcaacccagcgggtctgcttggaggtgtttgttgagcatccagcagcagcttctgtggatggcttctgccaggttttcctgcaggtcctaagggcttgcacaccccgtatcctgacaaaagtctttgaagaggggtgctcccttccagcccatggctgcctcccatctgcttcccaccgaaaccagaggctgttagcttttctgggtgccacatttcctgattcttatcaaccactggattgacatgctactcattagttcctaattgcctgtactgttttcctttgttaagggtcaattccaggaggcagttttaagtagctcagatggtatgaaaatattgtatgtagttgtgttcagcattaacatgacattaatttccactgrggctactaaaatgttttttacatgccactatttggagttgagaaatgcatttactagctgattcattacataacaaaagctcattaaaaagctgttactgatcgttgacttcagcactgtccctgcccacagtgattttgtgttgtgatgaattgtggcagatgtcactgtcactagtcaccctgcaagtgaggacaggatgaggacatctgagccctgagtctctctcctctctgtacctcagttttttcatctgtaaaaatggagactttggaataaaaaatcttcaaagattcttttcttttttttttttaaacttcaggtttaatgrcatgtcatttattaatctagttctacaaaaattctaaacattacaggtaaccactccacctctgttttgcctccaccctaacccctgcccaaccccaggcatccttccaacagtaatagggtgatacttacgggtgaatgttytctaggcatttttctatgcattaacatagtattaacttgtaggacttttaaggtattgtttcatgggtttgttttataatgaaatatattttgagttaatggaaatcttatttaagtcatgtacaaactcaattcaatcaatgtgagttttcacaaagttmgaacaatctagataaaatattaacataattttaaagctaaaacataatgttgatttctgtatcactttcatttattatatgagtctgttcaaattaacataattttgctcaggaaagcttactataaaaatgtacttgaatcaactgtgtattgccattaattacattcatcttttaccattttgaactttttaattgwaaaagtaattaatttcatagacacatattgtgtatgtatataagaagaaaagtgtcacttctcagcccccaccccagctgttctatcccagaagaaactgttgtgttcattttctgcaaaagctccrgaaatcatattcacctagattgtcttatttaattctcacagtgtctttctttaaaatgcaaggtatacacacaagcagacacacacgcacacacatctattattcactcctggctgggattgagacagctcctctatgctcagcgctgggatacacattttgggagttccactctgtagatcagggacctaggttcggaaatggggaatgacttcctcggtctcttacaggtagtaagtggcrtagctgctccaggtgcagactagctttttagacaggctagttgtctcattattggaagtctctccttattagaaaactcaggggaactctcaaaatttatgttatttaagcctcaaggaaaatgaaggaggactggaggggtgagggtgagatccaggaacatccctaaaataatatgctggggataaaactctgcttctctttgggggccacggctggcagctgcaggagkctgaccagttgtgggggctcacccagtgctggggaactcagtgggactttgggaggcccgagctccccaagccatgggaacgggtctgttgtggagctgtctggcagcctccacccaccagccagcacttgcccatttcatgctatttacctggacagaggtcctgagagaagccctgtatggctgtgcccttggctgactcctgatttgcactaaaacttgcagcatttagtgcttacatgttcaaaaatccttctggaaagctaggaggaactggaagccgtgrtctacatgctctgtcctcttttaacagaaaaggtgtattccataagtaacctccagtaaaaagagaaagaatagttgctatttattgggttcctctgatgggccagatagtgtgcggagcactcggcgttgaccctccgtcttcagaacaactctgtgatggaaagttcaggcccactttatagatgagaaagctgggcatcagaaggttaggtaacttgcaagaggacagagaacgacagtgctggacagggctttcaacccctcacctgctacctccaaagcacgaactgtcgccagtgctaagcactgggtttagaaacaaaacacgcagcatcacggtggtggaaattattcggttgattagccactctctttggtgaacacttctattcttaaagctaattgtctctttgtttaattagtgtcttctaagttactcagtgaaacatttgataagcccgacttcttagggtaaaatttaaaaacaattgtgaaatctgaacttactgttggaatgtaaacaacgagtcatttacctggtggtaggggcttaggagaatcaaggtttttcaaactatgagtcatggttcattagtgaattatgaaatcactttagtgggtcatgatcggcattttgaagaatagggtgggttggccagcacgggcggatcaggaggtcaggagatcgagaccatcttggctaacacagtgaaaccacgtctctactaaaaatacaaaaaattagccgggtgtggtggcgggcgcctgtagtcccagctgagggactgaggctgaggcaggagaatggcgtgaacctgggaggcggaggttgcagtgagccgagatcacgttcctgcactccagcctgggcgacagagcgagactccatctcaaaaaaaaaaaaaaaaaaaaagcatagggtgggttaggatcagatagagtagaataggaaaatactagtgcattctagtgcattgcacacaacaaagtatgttttgtgtaatttttattgcagtctgtgtatgtgcatgaatgtaaaatgtatttctcactgtaggtcatagtttttataaagttagctttggaaagaaatgtgaacagatgaatattaaattgctcactgttcttttctgtggcatggcttaccatcagttcctaacggagctacacttagcctatctgcatcgagctattttcaagtagagttttctgaacagatctctgtgttagtctttctgmagatcctcaattagatggatatgcttgttaaacttaaaacatgttttagacactgagggagracaaagtgacatttccaaaagctggggtgagttaatagcagaggtggaaccagaattagattatttatggattcttttcagactggaaaaaagaggggtgagcagtggctcgcatmcygaggtcagtgagcagctgttcctgcagagatgcagctagagaacaagagaaatggactttcattgtagcagtagggattgggctgaacccagggaaggatttccccatggtaaggagtgtgcgtgtgtgcacacatgtgagtgtgtgtatgtgtgtgtggcacccttctctggaggtctctagaagagtgagataaattgctgttgccatggcgtcctgtctgggggcgacgggaggataggtgagtctgaggtttttcccaccccaagatgttcttattcatttagccacgctctccctctctgccatcagcaaggataatctggagctggccatgtttctgtcctcagctgaggacggttatgatgaatcccgtggtgctctgctgggctgcagttagctttgcttttcatccggatgtcaaaccaagcttgcggcagctgtgatcagctgttgggagagggggagtcgggcagggagagggtagctcctggcctcctgccaagccctagtcgagtccccagtgtccacctctcagttgtgtctttctgttgctgattctatcactgcgctcttttttatctttgtgtgtgcgtctctttttctcttcctctttttctcttctcttcttctctcatctctctttggacaatggaaaacaaactagcttttgcatggaccttttagagcagctaattcatttatggcaggagaagggaccaaagagcacctacttgtgaatgtcccctaaactgcrgtcactggtaagatgccctgtgataatgggaagaaagcctagattcagccagactcgcattcctaccctgactccacctttactggtcacgagactctggccacacacttcaacttctccaagcctcagtttcctcctgtgttatgctggggtaacaatgcctgcctgaggatgttgtcgtgaagatgaaatgtgaaaccttccagaaaaaccctttgctcagggattgacccgggcagagtccctacctgccttccttggcagccactatcattgcttggtggcctgacaccacccacctctttctctggcccaggatgagcaaagatttgttgaattccatggagaaaactgttccaggaagggtcatagttctggtaccagccccttgtcatttttccaggcttagaaaaatgtgagtctgagaaaatgagctagtattcacatgaatcattctgggatgggggtgaaaaggcaagggtgagggaaaacccaaggcttctctatgggtctgagaaagaggcatgarmtcacgtcaggcattaacattttgtagtttaaaccatgcagacagatcaggaagatgattagcaaaasagaatactgatcaactgtgatgcttaatgaccctcccatcccaaattcactcagcctccagcttggtctggatcagccttctttttggttcaagaatgcagccatgaagcaaggccagcccctctagtggccgtagtcctgaagcatctggaaggggaagaasyccaagactgcctgctggtgtctgcatcttccccaacccccccggctgcagagcaccattcagggtgtctgggtctcccctacccacacagaggccacaggctagtgggaggcccargtggacccactggcctggactaccctcagatgccctgggctcctttgggagttgatgcctgacaccaaagtaagctttgggagctattggagagggtagtagaaatgtctttttaggacatttctaggctgacattggctttcttggactttagtcctttttggaaatttgttggttaggccatagattccccccacttccccctgcttctcaagtcaatgccaagggcatgcgtgcctgatgctccagccagccctcgaggtttcacccagagaatgaccacccttttctccatgcgctcctgatcttaacaccacatttctctttgggcaggtttaaggattaccgagagccgccatgggccccgaacccttatgagttttcgaaacagtactggtttattctgtcygcccgtctggcttttgtcataatcttccaggtgagttgctgggatagggaatagcccattygaatccgggctgcaggagtaaggacactgcactcattgcttgcacctacctccaggttccggtggtactctgtgacataagaaagcttcatgtgtggcaggcagaagtgagggctcctttccgggttgaagcaggaggactcttgagagggctttctttaatgggtggactttgcagacagaggataaaacacagtgtaaggttacaagacagatgtggaataagttgcagggtggagatagattcctgtttaaacctaaggcaaagaaaggaaaagggccattgaaaccagagtcccagcctggggcagacaaacagccccatctcatctctgcagccatgaaagagctcaggtttggaacctttcttcttgcactctgggctccctcctttgttagtgttgttttagccactgagacatctggtgagaagggcccccagagccatcgagccatccctgaatgaatagcaaactcgagcccagtgattcctatctgggacaatagccacagctccaattgcatcgctgagattctctgagctcgagggcccccaattcccactctgggtgcccccggtcttcaagcagggctggagaacgagcccagatccttttctctttggctccctcaggcttttgtattccctgaaggcagatctctggggggctctaaagtatcctgcccccagaccccagcccagaaagtggagaagcccatcggctagtctttcacctaaagaagacagccattcttcctctggagagatggaggcgatatgtttgaatgatcgctcagacatcccctgctgccccacccccaggagtctcctcactttcccgtatgtcacatgtcacatttcactcayacaggaaggagtggattcagaggaagagtgtgtgacttggtgaagcagctcccaagcacccaagatgcccaggagcctctggaagcagcagttggtccccagtgtcttcccctgaacccctaggaacatgtagggttcaagggctcagtcccagtctcagaggggaaaaggcatgtgagcgtgcaactggcagccagggaagtgtatcacaatgggaggagtgtgttgggtaaagctgggtgaagtgtggcctggggaaatggatgggaatcagatgcattcattgagccatgccaggcattgttgtcctatattcattcattgagacagtaagtgctctggggaaaaggtagtcctagcctactgtgtgcaccagcaaagggatgtggcttagcagcyaggaggaagwccactgcaagtgtgtgccaaagcctagacccaatcggggcaagctggatgcaggggttcccagacaggcagggttagccgaggtggctgcagtgactgagaccggtataaggtgaatgtcagcagtgggttgggtcagtgaaggcccgaagtcaaggcaaaaacctcaagtccgtctctagtgtagaggatagagagagccagatggagggaggagaggaacaagtggcaccgtgacagcccaggagaagccactgggctttgtgaccacttgctagaaagccactttccattttctaaagcagggagggcctggaggcttagaggccaagaagcaagaactggacacatgggaacactctgaagatggtgtgggggcacaagtcctggggaaggggagaagcagtaactactactgatggagtcctgctctgtgccaggcactgcggcagatgctccacatgtatgaacccgtttcatcctgacaaccactccagggtaggcagtgtttccgctccattttatgggtgaggacaccaaggtagagttatgctcactggttgcgatcactgggctggtaagttgcaaagccaggattgacacagaggcattctgctccagggccgccacctccccaggccgggcctctccaactcagcccctctctccttggctttttgcagaacctcgtgatgttcctgagcgtcctcgtggactggatgattccagacatccccacggacatcagcgaccagatcaagaaagagaagagcttattagtggatttcttcctgaaagaggagcatgagaagctcaagctgatggatgagccggctctgaggagcccaggaggtggggatcgaagcaggagccgggcagccagctcagcaccttcaggccaaagccagctgggcagcatgatgtcgtcaggctctcagcacaccaatgtgtgagcagttcagcctgcagcagaggagggcacggcagcagagacacgcacatgcacgtaagcatgttcctacacccacatggcgtgctgtctgtctgcaggggcctggcttgatggggtcttgaagagggggcagtgtgtaaaaagaaagagcctgacagaatgagtgtaggaaggaagagaaatgatgctacatctcagaaacttcaagcttaagtttcttttaggtccccttttaagctgcatccttttgagggattggaaccccactggggtctctccaccccagagtctcaggcaccgcgagcattcccatgtaccctggggcaccctcttgtacttcaccatcatttctgactttgaccagctgtaagagaaatgcagtcaggagcacagcatcccctacttactatcactacaagaaaactgagtcacttgcagtggggctgccacagtctcagcagatgcaaattaagttacaaggctgaatggtgcagccgctggacctgatagtaaggtgcaaaggtccaaacctgggcttgtctccacttcacgtcacaaaaacgtttggagctaaatgcagataaccatcattttatgaaagttcagatttaaaataataaaataaatggacacattctttataaagatgcatctgttgtctttggtgccttgtctctctctcctttcctttcttttcctctcctctcctctcctctcctctcctctcctctcctctcgtctcctctcctctcgtctcctctcctctcstctcctctcctctcctctcctctcctctcctctcctttcctttcctatttattgagcttctactatgtgccaggcattgttctcagactggagatagagcagaagataaaggagacaaaatccctgcctcatgaagcttacatcccggggaaagacagatgataagctaaatgtacagtgttttggatagtaataagtgccgtggagaaatatyaggtaagacaagtagacaggaagtgtgaaggcacaggaggtaaggggtttaccattctaaatacaaattaatgacaaaccccgatggtgaagaggttacatcttgcaatactaacataatcaattggtagcagcttcccagagtgctgtgctgagatcatgwtgtaaagttggaagcacgggccaaacatcactcatcattgccgttcatacacctcaggcccacctgctgcccagaaatctgttgcacaatcacttcatcctggttccttgcaggtcagcgggactagagtccaacgaaatgtctgagtggaagttgcaggggggatggtactccagaggaaaaatgagagctatggttmtgctgtttgagcacacctggcaatgtgcgggcctgtaggtgctggctggtcaccagtgctgcccaccacctttctgatttcctcctaggaacatgcagaattgcactgactgccaaacctcgctcaggaaagcggcttcttcttttgtgggactaataggacatagatacagctcttagtgagagcrgtaggctaacgtrtaccaggccactcctgtacaggaaatcttacaaccagttttaatttcctcagatttttttttttaagacggagtttcactcttcttgcccaggctggagcacaacgstgcaatctcggctcaccacaacctccgcctcccaggttcaagcgattctcctgcctcagcctcctgagtagctgggattacaggcatgcgccaccatgcctggttaattttgtatttttagtagagayggggtttctccatgttagtcaggctggtctcgaactcctgacctcaggtgatctgaccgccttggcctcccaaagtgctgggattacaggtgtgagccaccgtatccggcctctcacatcttaatatgcaaacttaccacttgagctgaggttcaaactacagcagtatggaacactgcatcatttgacaataggctttacctgatttggggagagtgcggtgaccagtgggaggaagttgtwattgcaaggagcattgatgacacggagattccaggcctatcaaaggaagcaatccccagggatgactgccagtgtgggtggtgttgacatttgcaggaagcagtgacagtccatggtcaaggttgagggctgcctccaccgccaagacacccacttggctccaacygygctatctccaggcccactggctgctcatggctggttcaggacccacttgtttttcttcctcttttttaaattaaaagaaacatttttgtatcatcataaaggttaagctcgcataccaagaaatgttcggatagtccaacaaacaatgaagcaaataaaatcacccacaatccccaaatctataattggcattggcacttgctgtgtcttggagactctcattcccccctcacacacatctaatttcttttaaccacagttatgctattttaaagcagaaaagtatctgagacaagtctcaatcaatttggaagtttattttgccaaggtgaaggacatccccagaaggaaagaacacggaatcacagaaggtctgtggtctgtgcctttttctgaagatgatgttgagggcttcaatatttaaaggtaaaaagtgggctgagggtgggtaagagggagggtgtgatcttgttactgaatccacatgttmcaagagaaaaggagcaggtaggagaacagctgattttgtgtttttctggtgctcagtaaatcagcattttacataagataaggtgaacgtagagtagcttcctgtggagctatctagacttttctgtgtagctgtctgcttaggagcaaaaggaaaggcagtttcttgcatgactcagctttcagcttcattttttccttttggcagattgctttggggtcctgagtttttatcttcctttcatgctatatgtgctgtcttttcatcttttttcactacatgtgtctcatcagtccttttattccaataaacatagattcattcaaaagtgtgtactgaggccgggcgyggtaatccctcaggccgggcgcctgtaatcccagcactttgggaggccgaggcgggtggatcacgaggtcaagagatcgagaccatcctggctaacacagtgaaaccccgtctctactaaaaatacaaaaaattagccagatgtggtggcgggcgcctgtagtcccagctactggggaggctgaggcaggagaatggcgtgaacccgggaggtggagcttgcagtgagccgatcgcgccactgcactccagcctgggggacagagcgagattctgtctcaaaaaaaaaaaaaaaaaaaagtgtgtactgagcttctactatgtgtcagcctctgtgaggtgctttggatacatcaccccacagaacacagattcctgccctcaggagcttatgctctgtgtgtgggtcagagaggcagagcaacagtgagagcaaactactagtatacagtgggtcagaaggtgatctctgctgtgcaaaaggaaaaagaagagcaaggtaagcgtgctgggagtgagggtacaggctctctggctgccacctccaggaacctccaagtgttcagctatctggcagctgtggaacccagtcatttttggtttttatggaagcttcatcagtaggcaggattggttaaatcactggccgtccttgaacaacttaacctacagcccctctcccctctccacatgttgggggtgggactgaaagtctcaaccctctaatgctgcctccgtctttctggtgaccagccccatcctgaagctacccagggtctgccagccatcaactcattagcatacgaaatgacacttcactttgggattccactgattttaggagttatatgtcaagaaacaaggatgaagtccaaatgtgtacttcactatatcacagaccatagacagatttatgctcgggagggattcaactttcttccccttttccactagaaggaatataggaattttataatttgcccccatccccaggcccaaagtctcagtagcactcatgttactagccagaccaccagatgtgcttgcttcaccccagcagcggtagaggtttaggctaagtaaagagaactttccaacggacttgctaacctgggtgaagacatggtaggtgcactttcaatttaaaaataaagcaaacaatgaagactccttccctgagctctttaaggaaataatgaacattttttattccattgtgacatgcmaaaaaaaaaaaattgtgagcaaaaatctgaaacactgaagaaagaaaaagaaattgctcattatccaattcctcctttctagaaataatagtagttaataattcagtttaattgtgatcctrtggtatatgtacaataacattcattgatttgtaatagcatttatttggtttaattataaaagtgatccatgctcattgaagaagacttagaaaatgcaagaaataaaatgtcaagtaaaaagtttaaattacctgaatttttacctccaagaactaatttgcaatcagtcttttttcccattcacttattttcatgtacaattgcaatcactccacacacactaacttctagactttgttaacagagacatctaccagccccaggtagacgctgttatgaagggttgtctgtcactgagtggtttcgccattcttttcttatgaaaaacaaaaataaatgaaatcaacttgatggttgattcagataaataatcttaaggctattttctttatgtgctctttgtgcaaaagaatagtataaagtaagagatgagacgttccttcacgtgctctccttcacagcccttccagatccaaagggtctactacatcccacttgtgatgatggaattattctatcctcaagaaagcttttaaagatggagaaaattgccactacatctctgctcaatgaaatggcctaattttgcttttcagtaagagaaataggattcttttgttttgctaatcctcccagcacaatattctaaccttgcaggtagattagtcattgttaagaaaaatagaaagggaatgtgccagttgctcttctgagtggtcataaattgtggtaggacattctgatagatgcaggaggaagataagggggacggtccccggagaatcttccaccagcctgcactgggaggagggggtagagactsgggaagtttgagcagtttgcagaggggaggagcctagcctctccagtgcctgggtggtgacctgggattcaatctgtgagatgggggtctgttaacaggaactcctctcactttgctgagagattctttccttttcacccaataaaccctgccctactcaccctacaatgtgtccatgtgcctaaattatcccgggcatgtgacaagaacccgttgtttttttctacaatkccagcaggctgtggaaagcatttcctggagcaaggaaaagaatgagatgggaaaccaagggacgaatctttgccccatagcttatttgaaatatatagccatgcagggtttgtggttaaaaatgaattaggaaaactctttgctctttttatattgtcatttccgtcccttggttcacctgactacaccttcaggttgaaaaaaaattaacaaggtcgtgttaaagttgccaccaaagtccctcaggacttaggtgttcattcctcagctggtgatggtcacaggtgggtcactctggaattgcctcagctgtaagggaactgcccaggccatggtcactgtcccactctggggcagcccacatccagtgactcatcactgcaggggggtaaggcccaccttgccttgattccaactctaaatgctactccagctccagagctttctgtgggattggctgaggcctctgttgcaacatattgcagttcgacttctccctccgcctaattctgcttccctcactaagcagatgccccaggaatctctagcacgcaaggtctgcaggtcttagactctgctttccagagaaactgacctaagacatggggtatttgggtggtatattctctgagcatatacatctctgaaattgcttttatgttggaacaatgacttggctggatttaccattctcagatcaccattcttcctttcaaaatattgtggctatggcgattaatccacactcttctagggtttcagaggaacagcctctggaagaagcctgattgatatgcttttgtaagcctttttcccctactgctttggtgctagcagggttttgaaatttattcttgtaactcaaaaatttcactgggatgtgtctccatgtgcgtttcttttatttaatgtggcctaaaatgtaatgatcatatttggtctgcrcagttacttacttttcatctctgaaaagtattcttccagcacaggaayggatctcagcatatctattctgactgtttcggttgctttgggaaaacactccagttttagcttggttctccagtttttaatcttcagtccaccatcttctttctcaacatgtgatgtccttgtcccattcccctatacttcagaagcacactcctcccagtgttactcttttctctgtccccttcccctgaatcaatctatcctccccactatgtttttcaagc

SEQ ID NO: 13474 - DNA, 187786 bp, Homo sapiens
  misc_feature (1)...(187786): n = A,T,C or G, or insertion/deletion polymorphism (see Tables 1-2)
ttttgtatttttagtagagacggggtttcaccatgttggccaggatggtctaaatctcttgacctcgtgatccacaggcctcggcctcccaaaacgctgggattacaggcgtgagcaccgcgcccggccttgttctggtttttaaagggaaagtggcttccattttaccataagtatgaaatatgctctgtgtctcaggccaaggaccttcccttctttttataggttacttaagtgttttgtttacttgttttccataactgggtgttgttgacttttacaaaactgaaagcttttctgctttataatttaatcgttttttaaaataaattttaagcttatattatgaagtgcacataaatctatagattccatcttcctggtgcattgatctttgtatcacctttttctactctttggtgctaatgatgactttgatcttaaggtccactgtgtgtgatagtggtataaaacgcttttccttggccatcacttgcctctcctttcttttccttacggtctttgtgtgtttatattttaggactgtctcttgaacattgctggattgtgtgcctttttaaagaaatccaatttgataatctctacctttttattattgattattgatctgtttgaattttttgtactgttgcatttacattttatactatttgtcttgctttttccatttttctcctagatcaatctagtttttaaaaatttcttgttttttttcgataggtttagaaaacatacattcaattctattctttcagtagcctcccttaaaatcttactatgcagtatagccttaactaagtctaaagtgatcatgacctgtttcttccttctgagccatacaaggaccttaatacactttcactcctgtcttacatgtcattgctatctggtattttggttctaatttttaataactctccaacttatcattaccattgttattgttttatataatgactgcctgctcatatttacccccatatttactattttatttatttaccttttcttggcatcctgtttctaggctgaattttcttcttcctggcagggcgaggtggctcacacctgtaatcccagcactttgagaggccgaagnnnnnnnnnnnnnnnnnnnntttttgtactgttgcatttacattttatactatttgtcttgctttttccatttttctcctagatcaatctagtttttaaaaatttcttgttttttttcgataggtttagaaaacatacattcaattctattctttcagtagcctcccttaaaatcttactatgcagtatagccttaactaagtctaaagtgatcatgacctgtttcttccttctgagccatgcaaggaccttaatacactttcactcctgtcttacatgtcattgctatctggtattttggttctaatttttaataactctccaacttatcattaccattgttattgttttatataatgactgcctgctcatatttacccccatatttactattttatttatttaccttttcttggcatcctgtttctaggctgaattttcttcttcctggcagggcgaggtggctcacacctgtaatcccagcactttgagaggccgaagcaggaagactgcttgagcccaggagctctaggagtttgagaccagcctaggtaacatggcaaaaccctgtctctacaaaaaaatacaaaaattagccaggtatggtggtacatgcccatagtcccagctactagggaggctgaggtgggaggatcgcttgagcccagaaggtttaggctgcagtgagttgtgactgtgtcactgcgctccaccctgggtgacagagaccctgtctcagaaacaataacaaaaaatgttttttctccctgaaattccttctttagtagtttcttcagaaaggactgttaatgttaagcccactctgtttttccaaaaaaaaaaaaaaaaaaaagtctatgtttcctcaactctgaacaataatttacaggtagaccagatgttacagtccctctgccacggccctctaaccccatctctccgtttcttctagactaccagtgtctgctcctccgtgcctgagggccagaagtgttgagggctgaatgcctcctgaagcagccttgacaataactgacaggaaggagtaagtgtagaaactctcctgctccctgacccaagagtgggaagattcagaggcatggatcttacattttcccagacttccctccagaaggaagctttcttgtccacttggtggctggcataataaacatcttttattgactgctttccctgccccgtatcacattcccacttccctgccgatgcttcctgtcctcccaaatcaattatctacactaaaatactcagggtctgcttctgggacttcaaactaagacactgcatatagaattctccacaaatggacttcttctctcagcacttctctttggatcttctaattctatcatgtttcttaattctgcctccattttttttttttttttttttttttttgagatggagtctcactctgtcacccaggccaaagtgcagtggtgtgatcttggctcactgcaacctctgcctcctgggttcaagcaatcctcctgccccagcctcttgaatagctggaattacaggcatgcaccaccatgcaaggctaatagttgtatttttagtagagatgggatttcaacacgttggccaggctggtctcgaactcctgaccacaagtgatctgccttacttgggctcccaaagtgctgggattacaggcataagccactgtgcctggctgctcttccattttttcatctctatatttgagtgatttctttagaaccatttttcagctttttttttcccaaaaatatctggtgtttttgaatttttcaattaatttactatatacatttcttaaagttctttttttttttttttgggacagtatctcactctattggctaggctggagtgcgcgattatggctcactgcaacctcaacctcctgggctcaaggggtcctccctcctacctcagcctcctgagtagctgtgaccacaggcatgcaccgccaggcccagctaattttttatttttattttttgtagagatggggtcttgctgtgttgtgtaggctagtctcaaattactgagcacagacaatcctcttgcctctgcctcccaaagtgttaggattacaggtgtgagcctccacgtctggccttaaagttctttttcaagttttcctcctgttctttcttttttttttttttttaacggactctcactcggtcaccaggctggagtgctgtggcatgatcttggctcactgcagcctccgcttcccgggttcaagcgattctcctgcctcagcctccagagtagctgggactacaggtgcgtgccaccatgcccagctgatttttgtatttttagtagagatggggtttcaccatattggccaggatggtcttgatctgttgaccttgtgatccacccaccgtgagccaccgtgccctgccttgaaaaaagtttattctttgtaaagacagggtcttgctgtgttgcccaggctggtcttgaactcctggtctcaagcgattatcccatctcagcctcccaaagtgccaggattatagacatgaaccaccgtgcctagcctctattataattttaaacactcatttttttctttttatctttctctgatgattttattatctgaaattcttagggatttaattcttgctcatggtagattgttttctcaagtgttgaaaaatttgtgattttgaattcatcgtcaagagagctttatttgcatgagtgcaaaggatgaaaattctagactgggcgtggtggctcacgcctgtaatcccagcactttgggagaccgaggtgggcagatcacgaggtcaggagtttgagaccagcctggctaacatagtggaaccccatctctactaaaaatacaaaaaattagctgggtgtagtggtgtgtgcatgtaatcccagctacttgggaggctgaggcaggagaattgcttgaagccgggaggcagaggttgcagtgagccatgattgcatcactgcactccagcccagcggacagtgcgagactccatctcaaaaaaaaaaaaagaaagaaaagaatattctaaaaaaagacttaattccccccgccaccccaccccaaaacaagtggagacaggcaaacttccttatcttctaggttgggggatggatttttttcctggtccactgtttggaagatgtttcccttcaaactttcagcttttgcagggatctccgttctagttctccctctgggtcaggcccgtagctgcactgcccattcttgtaatgtgcggcctccagtctggagggttcccagactggcctacgctaggccacccatgggcctaccctgcctcatgctcatttaggctcctcttcctcattgaccctttaagatattccttactttcctcccagatcaactgtggatttaaagaacatttgttgtatttagcacagcatttaaagatattttgtaatgaaagggttttcagattagttatttagtttttttaaataagagctggaagtggaaatcccgatggccttttcttttcttttcttttttttcttgagacggagtcttgctctgtcacccaggctggagtgcagtggctcgatctcagctcactgcaagctccgcctcccgggttcacgccattttcctgcctcagcctcccgagtagctgggactacaggcgcccgccaccgcgcctggctaattttttgtgtttttagtagagacggggtttcactatgttagccaggatggtcttgatcccttgacctcgtgatccgcccacctcggcctcccaaagtgctgggattacaggcgtgaaccaccatgcccggccccccaatggccttttctactgtctcatgctgattctgcctctggtgccatttttcttccttgggagtgtgcatcttcctctcctggggcggtaaagggagtagcagagtgcgaggtatgtgggaagggaggaggttggaacctagtggtttctcaaagtcttagggcaggaggtatcatggagaagcagtgaggaggtcttccatacccagacatgcctcagggtgcttgtctcagtgcctggaatcccagcacgagagtcatcttccccccaccgctgcccattgcatcagttacttattttagtaggaattagtttagcagatggtgttgagaattaggcttttgggaatgggaggctgggaagaagaattgtgtgtgtgtgtgtgtgtgtgtgtgtgtgtgtgtgtgtaagatcagggtaccagaagtgggtggaaatgtccttgagaattagaattattagaatgtagcaacagtagaagtattagactcaaaccatcactccccaccttcaccattttacaaaggcttaggcttgtggccaagaccttcatctttagccgatccattcaaccctggccaggatccaaatggactgtttttgtcagggccaggaccggatccttcatacctggggtgcataggaagtgttagtactccccttcctccaaacacagcagcaaaattggctcaggttgaggtgtttttctcaacttccctggagtccagccctggaagctggatcaggaagctgtgttgttctactgtgattccccctggcctgtatcagcttgccctgaaacaaccagcattcctggttatcccacacaggtggggcactctaggaagaccagggatcaagtgtgggggtgtagggatagggggtgtttggggagggcaaggcagttaattaaggcagctgccaggaggtctccctccaaactctacaaagctttatcagcttggaggtacttctaataccatttcctttcattgtttccttttggtaattaaaaggaggccaatcccctgttgtggcagctcacagctattgtggtgggaaagggagggtggttggtggatgtcacagcttgggctttatctcccccagcagtggggactccacagcccctgggctacataacagcaagacagtccggagctgtagcagacctgattgagcctttgcagcagctgagagcatggcctagggtgggcggcaccattgtccagcagctgagtttcccagggaccttggagatagccgcagccctcatttgcaggggaaggtatggcctttggaaggagagctggctcagttgtgggaggaagatgcaggactgactgatccctgctcctggggagctggagttctctgtcgctggactagaagggctttgtttggaggggcaattcaattcagccagggatgatcctaatactccctcctccacttgcctctgagggtcctggggctgcttttcttcatgcagtgggttttactgtttgatagtacttcactcaaatgagttggaatgaagtttgccctcacctctgagaacctgggagcagctgaatgtacctgcgtgttaggactgggaggggacacctgcttggagaccgagacctggcagtatctgacatctcagtgttccttccacagatgtatcacagattggcttgatttcacctttggctggatgggaccttaggtaggaagggagtcacccccagtgaatctcaggcagcagattctgcacttcatttaacaacttttcccgaggagaggggctacagcaggggctctaagtgacttggggtacgctctgccagccaggatgaattgtccctctcttgggggtcacacagtggggaagtctgcctgcatccagggccgctggactcctgtccattttttcagatgaactcagcaaacatttgctgggcatctcctgggtgctaagcatcttgccaggtgctggggttggaggcaagggagacagcctttgctcttgtgaaggcacttgtggtacagagtcaggggccaacaagcaaaccgtcaagttggtggttcctgagcattctctatgtctgggctgctgtggtgggcacacaagtgtaagacggttcctactcgccagtttggatgcagaggcaggaaggaatgaggtgtgtgttagctcccagctgcttcaggaggcagggatgtgaggcccagcgggcctggagggaaggcagcgttttcctcctgtcttgggcctgggactgctgtctgtggaaaggtgcccacaggtcccagctcacagcgattgttacccttgggcctggcactggccaggggttttttcgggggccagaagtccatgttcaaaggggaaaagggggtcacgaggatcaatcttttctcctgctttaaagaaatgtttttgctactgcatgccctgatagtygccacaccagcagccgcctacctgggcagcaatgaccagctcacgtctcttgcttctttgcagatgattcctgccagatttgccggggtgctgcttgctctggccctcattttgccaggtaggtacaaaagggcctccatttctcattcctgccccagggccatctggagtgacacctttccgggaatcagcaggtgtgtctggagctcacctgtgtgcccagccctaacttaggctgttggttgcctcctgtgaaggttctgcggagttcccacccttgacttgtattccagagaccaggtgcctgcaaatgccatctcctgttggggaattaagaagcataaaggtggcacagaactgtcctatattatgggggcacaggatgaggaggaaggaatccaagacttggatggattattagttttcgataagattgtggaggtcaccttgttgaacctcccatggtacaatgaagagactgagggtcagagaggagaaatgactgctccaaagtctcctagagccaaaatcagaggtcagtcttcctgggttccaggccaacaccctttccactgcactgcatcatactgctgcccttcccttgctaagattctgggtctgcaaatggcgggaggggacttttgaccttgggcgctttccacttagatctctcaggtcagcagcatccagctactgcccacaggtgagtctgggaaaaaaaatacacatttgtcacactctctgcatcttcctactaggtgggtcttttgccggggaacccagaacacttagagatttactgctgtatttccccacctgccgacacacacacacccatagtcagtgaaggagttagcctgtgacgccggaggatttcacacttcagagagtctatgtgtcaggcacacagtctgatctgtttaaaatttaacatgcccaagacatgctagtagatttatgtacaaagatgctcactgcaatctatctataatattaaaacatggaaaaatgctagaaacctaacaatagagggctatactatagacattcagatgcaaaatataatgcagccactaaaaaccgcatattggaagtatatacactagcacgacaaattgtttacaatctattgagaaataaacagaggttataggtagtttgcacaagttggtcaccaatttataaaaaacccacagctgtatatatgctatacaacaaaatggaaagatgaacattgaaatgttaactctaatcatcgctgaatgttgggttacagatggttttaacttctttgtcttttcttttctttttctttttcttttttttttcgagacagagtctcactctgtcgcccagtctagagtgcagtggtatgatgttggctccctgcaacctctgcctccygggctcaagtgattctcctgcctcagcctcaccagtagctgggattacaggcgcccaccactacacccggytagtttttgtatttttagtagagacagggtttcgccatgttgggcagrctggtcttgaattcctgacctcaggtgatctgcccacctcggcctcccaaagtgctgggattataggcgtgagccactgygcccggccagcttctttgttttcttctgtatgccccaaatttttaataatggacatgatgacattttaaatcagtaagtaaatgtcattgaaactaatggatttcctgaaaaactgttccttagttattgctgtgagtctggggtcatatctgggagctgaaagcaacagctttagtctcatttaggatggaaaatacctccccacagcccagtttctatcagaggcagtctaatttctacgaggccagagaggtttgagctgatggtcccagttgtgccctgagatcaccagcccaacctgtggcctctccctccagggaccctttgtgcagaaggaactcgcggcaggtcatccacggcccgatgcagccttttyggaagtgacttcgtcaacacctttgatgggagcatgtacagctttgcgggatactgcagttacctcctggcagggggctgccagaaacgctccttctcgattattggtgagttctgggcactgcagggaggacttcagagggagggctggctgagctcagccctggtgtgggggaggattcctgctctcaggacagtgtctgagcggaaaggtcactgctgagaacaaggagaggaacagcctttctgtgacacgtagcccctcttggctttccccgggtctctccccacgggagccgggtgggatggatgaagagagtcttcatctttggtagtccactgtgtccgttgctctggggcccggcgatgccctgggaactccacagcatcaaggcaaatgatgaactagagaaggtgctttggaacgtgtaaaactccttgccagagagaagactcgttgttgttttcttggtggcctgtggatcagaacatcagcttatgctgaggacttcctgtattcctgcagaagggctggtactgtccctgccatgtccctgcatccccacaacagccctgggatgtagctgtagtcatcccagttttaccaatggagaaccaaggctcatgaaggttgcatgatccttccaaggcctgacagacaataaaaggtggagctgaggccgggcacggtggctcatgcctgtaatcccagtactttgggaggccaaggtgggtggatcacctgaggtcaagagtttgagaccagcctggccaacatggtgaaaccccatctctactaaaaatacaaaaattagccgggtgtggtggtgtgtgtctataatcccagctacttgggaggctgaggcaggagaatcgcttgaacctggttgcaataagctgagatacactccagcctgggcaacagagcgagactccatctcaaaaaaaaaaacaacccacaaaaaacaaaaaaactggactaagcaggccaaggacagagcccaaggccaaggcttaatctagaagagggctcagaagtgccccactcaagtttggtcaaggagggagtctttggcaacacctggacacttacctgagatctgggctgtagggctcctggggtcattgctccatcagtcagcggggactgacacagggtcctccatgtgcccagcactgggctaggctctgtctagcacctggctatagctatgagctccccgcattcctgctttctccctgaggccatctttgctacctgccctgactctgctgggaaacttatcacatatgacttctgggcactgccatccttcccactcctccatgagctcctcagggacaaggagcatgtctcactcatctgtgtttcctggtgcttagctcaccgagttctctgttgtgctgaagattatgtatttatttatttatttttgagacggagtcttgctctgttgcccaggctggagtgcagtgagtggtgcgatcttggctcactgcaacctccgcctcctgggttcaagcaattctcctgcctcagcctcccaagtagctgggattacaggtgccaccatgcttggctaatttttgtatttttagtagagacagggtttcaccatattggccaggctggtctcgaactcctgacctcaggtgatccacccgcctcagcctcccaaagtgctgggattacaggcatgagccaccatgcctggtctgaagatgtttacagagtgtgtgtgaggagccctagggaaggagctttgattggccagagaagacaggggagggtgctgcatgtggtggggacagcatgagaagtggggaggctggaaggggcatgtactcctgacatggagccctggggaggtcagtgtggctggagcagcagttgccaaactccaggctgcatcaggaccacccggagagctgtgacaaacagatcactgggccctgcccctggagttctgactcagtagaaatggaagggggcctgaaaatttcccaactgctgctgctgctyttagrgtgggtaaccagactttgagggtgcgggactggaggagagtaggctgggaggctgtaccatcgggtgaagctgcagtgtagggtcttggagtctgatggggactttgagtcgattccgcaggctgtgaggaactagtatagggtcttgtgcagcagggaagtggtgagaggaaactggttctttgccaagatggtcctgaaaaggagagaggtaggaggcggaatggccttggccgtggtaaccagggaggtagtgaaaaggccagaggcgccccagggcatgacaaataagaaagtcatcttcaacactgaccgtgagggtcccaacttgcttcagaggctgcagctggggaggagctggaagagcagctggagagaacccctgaacccctgcccctgggaagctgaaggctcatgccctccctaccttggtgaccccagattttatttaaagtggattttcccattttataaatcacggcagagctgatacagaccactacctgtgatggctctggggttgtcagtgggaatggagggttagaagtgaccggaagaggccgggtgcacgggtgcaatggctcatgcttgcagtcccagcactttgggaggccgaggggggcggatcacctgaggttgggagatcgagaccagcctggccaacatggtgaaaccccgtcactactaaaaatacaaaaattagccaggcgttgtggtgggtgcctgtatcccagctgctcgggaggttgaggcacaagaatcacttgaacttgggaggtggaggttgctgtgagccgagattgcgccattgcactccagcctgggcacagagtgagactctgtctcaaaaaaaaaaaaaaaaaaaaaaaaaaaaaagtgaccagaggaagattttgatggagacactgcagtgcccggggtgggggcgggtggattgctgtctggactccataatctctgttagttcagctctgctctggactccctgccccgagacgggctggtaaacaacacatactaataccttagtcccaggcacagagttcatgttctgggctcagagagccaagtcagcatgttgaaaaagctcccttcccctatttgagcccaactccagacctctccccaagtcagggtagccctaccaggtggggacatgtagcgtgtgctggtgcctctgggctgtctcggtcacctccttcaggaagccctcttgcccattccacccgtccagcactgggctcatcaactcgtgctcactggtcggtttccgtcccacagaactgggtggctctgcccccagcaggaaatggaagcacagacagagccagagttgcagtcggaaaacccgtgttctcctctgctctccctcttcactgagtgttccgagggcagttgtgctgtcttagcctccaattcctcatcttttgaaatggaatctcrctcgtgttgtccaggctggaaggctggattgcagtggtgcgatctyggctcactgcaacctccscctcccaggttcaagcrattctcctgcctcagcctcccragtagctgggattacaggcgtgcgccaccacaccctgctaattttgtrtttttagtagagacggggtttctccatgttggtcaggctggtctcgaactccygacctcaggtgatccgcccgcctcggccttggttcctcatctttaaaatggagatactgtgagcatcaagggagacaggttatctgaaaatgtgactgcttagccaagctgagttattgaaagcagccagcttaacatggggtgttcacttggaatcgccatgcagagacaggggctgctgggcccccaggcatttccacgaggtcagggtcacttgagtttcaactccccctcataatccacacaggtttgtgctagaggtctggcctctcgggccaccgttttctgggtttcagtggtcacagaggaatttgaagggccatggaaggcctgtctacctcaaaaccccttggtgggattccccaccaggtcattattcttttcttataagctgtttgcccttgtgaagtgtccattttctgggagattgtttgcctaaacaaggttatggatcaaacacactttaatgtaaattgatttcattttcaccaaaaccgtgctgctaacatcatagagaatgggtggctgctttgcctcttgttggtggtggtggcaggtttggggtgtgtgggagaagaggaagaattagaggggggtgggctggcattggtgcatcagggcagccaggggcactgggtcaggggagggagcccaggacttgggccctgcagtttcagtttccgtgcacatgcctaccttcttttccattgttctgcaatgacatcctgtctccttgaccgtaaatcgcacatccacattcctcccgagtgcctgtggaccttattcatatcctgggaaaagtgtttatgtacgcacacgaagggccacctggtgccaaggcgaggcccctgtccttgattctgtctcctggtgaggcaggctccagggttcgaggccaaggcgacacggctgtttgccagacagcacagaggccagagagagactatgggagtcctggttcctgctcctccgtagagactgctcttcctaagctacggctgcaggatctggctctcatacctgccaagagagagccatcaacaaccaacagcctgctgagtcacttcccccggggagccttagtttccgtggcatggtcagaccagacccctgttctcagtttggagggagggtcacctgcaccagaatcacgggcatagaaggtagagtgtttagtggaaatgcagatgagtgagttccacactaaagcctaagagagcgcccaggtctgacggtagttccagctcctggcctgcttctgaaggtcccaggattcctctcactctaatatgtgggctaggagcttactcctcactcagcgccttaatcactgcgttcagcaggcctggtgggagcctctgggagagcttcgctggcttgtcttgcctctttggggtgacagccagcctctcttttcctaagagttatagaaagtgctaacctggaggtctgtggagtgcaggggtctctcctgggctcaccggcgatttctaatggctcgttttcctaatggctgcacatcatctgatccccctgagttctgcatggagggaatgagggaaataaaatgcaaggctggtctggagttctccctgcattagtgattagtgcaatcctagaacactccgatgccctgttacrcagctttgtgttgcaaaaaggggatttggacagtcaaaaaagcctgagtgtaggctctgctccatttccacagtggaaaccaggggttctcagtcggggtggttttccccctgaggacattttgcagtgtctggagacattttgggttgtcacaactgtggagtgggtgctgctggcatctagtgggtagagaccaggaggctgctggttctcccaccatgcacagggaagtgtctggcgctgaatgcaatagtaatgcagtggagaaatcctgctgtaaacctaggccttcgtttctccgtctgtaaaatgaagtcagcctagatcattgttttctgaactgagtcatgggccatgggtcctaaaatgagttgagtggttataactagcatttaaaaagacagaaaaggttagaaaacatcagaaaatatcagagtgcatggcacacggcaagggtaaatatgatatgaaacgtgtgtgtgtgtgtcctgagtcataaagttgtgtttttactgtgctttctgagcaaaagagtttaagagccgcttatttagattcttcctgctgccatagtatgtttttctgaattataggcctagatcacactttgaaaaatctcattgccaggctggacacagttactcatgcctataatcccaatgctttgggaggctgaagcgggaggattgcttgagcccaggagttcgatgccagcctgggcaacatagcgagacccccatctgtacaaaaatatacaaaaattagctgggcatggtggcacacacctgtagttccagctatttgggaagttgtgacaataggattgcttgagcccaggagttcgagggtgaagtgagctgtgatcatatcactacatgtcatcctgagcgatagagcaagacctcaaaacaaaagaaaacaaaaccccaaattcccttgccactcccctgctccggctgtggactgactgctcttcaagccccctcagccatccagggccaggaattctccttgccatgcagttcaatcctcactgaagggcacgatgcagccccactcctgcccctagactcctgtttttggtttgtctctgggtggatgggggctggttaccagaacctgaatcatccccttcaggagccccagttcctgcggtaggtgaagctccaagggcagccagccccacgtcccctggctgcctggagctgcctcacacrggctcagccctgggctgccccttggacttcctgatgctggtctctccttgggctgcccagagcaagcccttgacatacttaaaacagcactcgcttgagtcccagctcttcatcactgactagctctgtgatgataggcaagttaccmcagggtctgccgcctggccagccccgagccccgcagcctgtgtggacaggttcctctgttatttactctaggagggctggggctctccttctctcccatacacttctcctggttctctcctgtttgatttttctgcttctgctgaattcttggtttattcagccttgcaggccttactttacaaacttatagccatagcgacctccgggctcccctgtggcacccgctcagctctgcctcctgtggaacgagtaccttgcttaagtgattttgcatctttggaagcctctaagagctgtagatcagcagccacagggccatgccaaccccaagctgcctggctgcctctgaagcgttccctacccattctccagccacagtccctgggagacttggtcccacccaccctttctgcatccccaggagaaggagaaacaccaaggaggggctcacgggggttcctttcccatttccaggagggagatgcctttggctcggaggtgacatattggttgagttacccagtgaagccgaggcagaactccctgtgagatgggatgaaaggaggattcactgatggggagacaggctcagtggtaatagggacacagacccctgagcccagacctcgtgggctcatttgtctgccatctggcaggtggaggcttctgctctggcaggtctccagtgaggagtgtgaagtgggtccctgccctgtcacatgggctcactctgggctgtgtgtagtgttcagagctccagccccagaaaaggccgagggagggatttggtcttgggcccagtgcaaatgcctagggccctggaagggagagggtgcaaactggaggttgttacctggttgtcccatttgtttggtttttcgacattttcttatggaaattttgaaacatacagaaaagttgaaagacttcaagatccatatactcctcactcagattctaccattactggtaaatacattactgaaaaaaagaaaaagttactttgcagggcacggtggctcacgcctgtaatcctagcactttgggaggcccaggcaggcagatcatgaggtcaggagatcgagaccatcctggctatggtgaaaccccatctgtactaaaaatacaacaaattagctgggcatggtggcgggcacctgtagtcccagctactcgggaggctgaggcaggagaatggcgtgaacccgggaggcggagctkgcagtgagccgagatcgcgccactgcactccagcctgggcgacagagcgagactctgtctcaaaaaaaaaaaaaaaaaagtttctctacgcaatcacttttccagttgtttctttttctttggccaatttcttgctgtcagtaagtttgttcagcttctaaaggtttgcttgctgtaaaaactgttctaggtgggaatgcagagcaagggagacacctcagctcaaacaggacaagtcccctttcatttggcaggcatctccattttctcccagttgtgttgatctggagctccgcagaatgtggtttatggactgtgagtggtctgtgtgtctttcctggtggctgctgctgctggcatatcattaaaactattcctagaatagacttattatttacgtgggagagccctcactgaatttccaccagaaacaagtctattctgtagctcattcgkgttggtttggagtgtttgtgtgttccagggtgcatgctatgtgtgtgcatggtgtgtgtgcgtgtggtgtgtgtgtgtgtgtgtgtgtgtgtctgtgtgtctgtgtgtgtggttgtcctcctgcagcctcagttcagcccagagccctgctggggactcttcctctcctggctaggagtgaggagacctctgccccagctcctctggccatgacagcaacaccttgagtcaacagacctgccaggtcttctgggcttcgttccacggacatcttagcctcttcttgccaagaagaagcccacactcccctatcccttctaggagaagagagatttgctcatttttaagaccaactttacccctgagtcctatgccccattccttcaggacctcaaggcattgtgccccacacgtcagctctttgttttctctggctgcccctatctttcctatttccattaatttctcagtctccaaggcttgagaccagactctctattttcccttctgggtcttttgattcttatgaccaattagttatctttgaatatcaaagacccaccacgagtagcagttcttagaaactaggtgaggtttgctaagctttggtcacgctgtgaaaaatgtcttgcctgtgtttcctctttcatgctggccaccgtcccatcacccttgtcaccctgttcagccctcacaaccacaccattctcagagcctattttatcatgtgtctggatcttcagacatttccattgtcaaccatttagtgtgtccttattaattccatgtgctgtgtaaggcgtttgacccacacgatctgtaaactcctggataatcaaattcagcaaacttaggtggagctcatgaatctccattttaaacaaacagcccagggattctgacttgggctgtcctaagataccattttatttatttatttatttttattttttattttttttgagacagagtcttgctctgtcacccaggctggagtgcagtggcgcgatctccgctcactgcaagctccgcctcctgggttcacgccgttcttctgcctcagcctcccaaagaactgggaccacagacgccagccacctcgcctggctaattttttttttcttcatatttttagtagagacggggtttcaccgtgttagccaggatggtctcgatctcctgacctcgtgatccacccgcctcagcctcccaaagtgctgggattacaggcgtgagccaccgcactcgaccgataccattttaaatagcactgctaggccagagcggggtggctcatgcctgtaattactygcaccaaggagctcaagaccagcctgggcgacacggtgagatcttgtctctacaaaaagaaaaaaaaaattagctggatgtggtggtacatacttgtgatcccagttaccctggaggctgaggtgggaggataacctgggcccaggaggcagaaactgcagcgagccatgttcacatcactgcaccccaacctgggcaacagagcacaaccctgtctcaataagtgaatgaatgaatgaataaataacactctcctagagcacctgttaccagtaactcacagtgttgcctttttgtttgctgccttacaatatactcaattgtcgcatgtttgtcttctatttatacgcaggttgtaaactcccagaagcaaaagatcatgcttttagatttttcttttgtgatgtttgagagcctacctgagggcaatgtatccagaagtcactcaataattatttttagatgaatggaaaaatgggtgagaaaatgagatttttagggagatttttgttgctcgcttgtaaagactttttggggcgttttctgctgagaaaaggttacgtagataatgattcttaatcaatgtattcattttttgagaggagtaataatcactactattgacttttttctctttcaggggacttccagaatggcaagagagtgagcctctccgtgtatcttggggaattttttgacatccatttgtttgtcaatggtaccgtgacacagggggaccaaaggtaagccaacaatgtctgagttagaaaggaccctagggatcccctgacacaaccccctcatttttagatgaggaagctggggcccagagaatggaagcaaatgttccaaggaagtsagtagcagggctgggtgagagccagctctcccgattgctgatctaggtcctcagccactttgcaycatgttctgaaccctacaacatggggttggggttagaaggtgggagagacatccagaaaatgcacaagaagcccacttctgaacttagcctttgccctccagagtctccatgccctatgcctccaaagggctgtatctagaaactgaggctgggtactacaagctgtcyggtgaggcctatggctttgtggccaggatcgatggcagcggcaactttcaagtcctgcwgtcagacagatacttcaacaagacctgcgggctgtgtggcaactttaacatctttgctgaagatgactttatgacccaagaaggtaagatgttctgggataccatttccctaaagtgtggccatgctttttatttccttgctcataaaccttcactaacatgccttccctggcattcaagcctcactgtgacctcacctcaatttatgttgccaaccttatctctttgcattccattccaatgcctagacctctagtgaaaccaggtcttagagctcctcaaagctgacttcgttcaactttgaattctctgtagcaacttgcacgtggcagatggttggtcaatgctgggtagtttgagtcgatcctcctcagcccactacagtggagtggataaaatctatggagtggtcggtcctccacaccatccaaaaaggccagtttatgtgtgtgtgcatgtgtgtgttcacgagcaatagaaagtaatatggataatgtgaaaacactaggctgggcgcagtggcttacccctgtaatcccagcattttgggaggccgaggcaggcggatcatgaggtcaggagattgagaccatcctggctaacatggtgaaaccatgtctctactaaaaatacagaaaattagccaggcgtggtggcgggtgcctgtagttccagctacttgggaggctgagacaggagaatggcgtgaacccgggagggagaacttgcagtgagcagtgatcgtgccgcttcactccagcctgggcgacagagcgagactccgtctcaaaaaaaaaagaaaacactaaagatgaatatttcaatcttctttaatttcaattacataaacattcaattagtgatgttcccttgccaaagctaaacacttacatatgttatctttcttccttatgacccaaccactttctgattagagagtaaacatgcagagaaacaattgactcttcctttcattggaatgtaccatattggaaaatagcatgatagtttattttttggttttctccagcactgattttattgtctgatatgtacatttagggctataaatttccctctaaatatcactttagttgcactctatatatgtgtgtgtgtttgtgtaaatatgtatatatactgtatatgtgtgtatatatgtaattatatatgtgtgtgtatatatatgtatatatatacacgtgtgtgtgtgtgtctgtgtgtctctgtgtgtgtgtatttagagataaggtcttgctaagttgcccaaactgatcttgaactcttgggctcaaggaatcctcttgcctcagccttcctagtggaattataggtgtgtgttactgtgcccagctgtaccaattttgatatgtaacatatttcatgttttaaattttctaacttccattttgagctctttctgaacctatatacatttacaaattcaaaagtttgaatttttttttttttttttttgagacggagtctcgctctgtcacccaggctggagtgcagtggcgcgatctcggctcactgcaagctctgcctcctgggttcacgccattctcctgcctcagccttccgagtagctgggactacaggcacccgccaccatgcctggctaattttttgtatttttagtagagacagggtttcactgtgttagccagggtggtctccaactcctgacctcgtgatctgcccccctcggcctcccaaagtgctgggcttacaggtgtgagccactgtacctggcctgaagtttttaaagttacctatttgtaactaaattgatttctaaatttggttaaaaaattgtggcctagttaaaaaattgtagacttgtttgcagcctttttttttttttttacaagtgttctatgtatgcccaaaaataatgtattctctgattggtgcaggactctacctatacttcttgaattaagctttttaattgtgttttccagatcttctgtatgtgtactacttcttgtctgcttattaatgacccattactaaaagagctaaatttttctataatggtggtgaatttgtcactttcttcatgtaattctgtcaaattttgctttgtgtgtgtgtgtgtgtgtgtgtgtgtgtgtgtatatatttctttctttctttctttctttttttttttttttaaagacagagtcttgctctgtcacccaggccggattgcagtggtgagatctcagctcactacagcctccacctcccagattcaagcgattcttctacctcagcctcctgagtagctgggactacatccaggtgtcaccacgcctggctaatttttgtatttttagtagagatgaggtttcagcatgttggccaggctagtcttgaactcctgacctcaagtgatctctccgcctctgcctcccaaagtgctgggattacaggcgtgagtcaccgtgcctggcctgctttgtatatcttgagcctttgttattagtgtttagaaatactgaatctttcggctgggtgcggtggctcaagcctgtcatcccagcaytttgggaggccgaagtgggcggatcatgaggtcaggagatggagactatcctggctaccacggtgaaaccccgtctctactaaaaatacaraaaatkagccaggygtggtggcrggtgcctgtagtyccagctactcgggaagctgagrcaggagaatggcatgaaccttggaggcggagcttgcagtgagctgaaatcgcaccactgcactccagcctgggcgacagagtgagactccgtctcaaaaaaaatatatatatatatattgaatctttctagggaattgttcctttaatgtaatgactctcatttttaccagtgctttttgccttcaatctgtctgatattagtatagctattccacctttcttttggttagtgtttgtttgatgtatctttttccattctttcaacctttctatgtgattttgtttcagatgtgtgtcatggaagcaccacatggctctattttattattgttctttcaaaagtcagatttattgaggttaatttacagacagtaaaattcaccctttcacatacagttctctgagttttcgcaaaagcgtagagtcatgtaaccaccacaatcaaactatagaacagttttgtcaccctcaaaatcaccatgctcctttgtagtcaaatcttcccccaactcctagctcctggtggccactgatcttttatctgtttctgtagtcttgatatttccaaaattcatatgactgtaatcataccctatttgcagtatttagtcttgtaagtctggcttctttcatttaacatggtccgtgagaggttaatccatattggtgcatgtatcagtagtttgttcctatttattgctaaggagtagttaccacaatttgtttacccattcaccagttgaaggatgctttgttgtttccaattatggaaaattatgaacaaagccagtgtaaacatttgtgtatagatttctacaccccgccgcattttttattgtgctatgatacatgtaacataaaatttactatcttttttttttttttttttttttttgagtcggagtttcactcttgttgcccaggctgcagtgcaatggtgtgatctcagctcactccaacctccgcctcccgggctgaagcaattctccagtctcagcttccctagtagctgggattacaggtgtccgctactatgtccagctaatttttgtatttttagtagagacggggtttcaccatgttggccaggctgctcttgaactcctgacctcaggtgatccgcctccgcttagcctcccaaagtgctgggattacaggcgtgagccaccgcgcctggccaaaatttattatcttaaccatttttatgtatatagttcagtggtatcaggtacattcatgtagttgtacaaccatcaccaccatccatctccagaactcttttcatcttgcagaactgaaactttatattcattacacaataacttcccattcttccctctgggctcctggaaaccatcattttactttctgtctatgattttgactactctaagtatctcatataagtggaatcatacagcatttgtctttttgtggctggcttatttcactttgcataatgtcctcaaggttcattcatgttgtggtgtatgtcagaattttcttcctttttaaggatgaataatattccattgtatcagaggaatttgaggaaaagaaaaaaaatttcattgtgcatacagaccgtacgtactttgcttatccatttatccatcagtagacacttagattgcttccacgttttgcctatagtgaataaagctgctatgagtataggtgtacaaataactctttaaaaccctgctttcaattcttctttattttttttgagatggagtttccctctgtcgccaggctgaagtgcagtggcctgatctcggcttactgcaacctccacctcccgggttcaagtgattctcctgcctcagcctcctgagtagctgggactacaggcgcatgccaccacgcacagctaatttttttttttttgtatttttagtagagatggggtttcaccatgttggccaggagggtctccatctcttgacctcttgatctgcccaccttggcctcccagagtgctgggattacaggcatgaaccaccgcgtccggctcaattcttttgagtatattcccagaggcagaattcctggatgatttctaatggcaattctattttcttcatatatttcatgatttatttttcaggtatgtgaaattttaaaatattccttttacaatatctatttctctttacttaaaaggagaaaaatttgatatgcaatttcttcttaaacattttttaaattttttctttttaaaaatttgtataaggccgggcgtggtggcccacgcctgtaatcctgtaatcccagcacttcaggaggccgaggtggatggatcatttgaggtcagaagttcaagaccagcctggccaacatgtgaaaccccatctctactaaaaatataaaaattagctgggggtggtagcacatgcctgtaatcctagctactagggaggctgaggcaggagagttgcttgaacccaggggacggaggttgcaatgagccgagatcgccccactgcactctagcctgggtgacaaagcgagactctgtctcaaaaaaaaaattgtataaatttatggggtacaagcgcaattttgttacatgcacagattgtgtagtggtcaagtcaggacttttagggtacaatatactttgtacccattaagtaatttctcatcatctgccccactcccactctctctcacctttctgagtctccaatatctatcattctactctttctgtctgtgtgtacacatcttttagtaaccactttttggtgagaacatgtcatatttgactttatgtggtttgtttcacttaacataatgacctccaatcccacccatgttgctgcaaaagatgcgatttcattcttatggccaaatagtcttccattgtgtatatgtaccacattttcttcatctaatcatctgttgatgggcatttaggttcataccatgtctttgctattgtgaataatgcacaataaatatactagtgcaggtatatttttgatatattgatttcttttcctttgggtagatatccagtagtgggattgctggattgaatggtagtcctatatattttttttttttccgagacagagtctcactctgttgcccaggctggagtgcagtggcctgatctcagctcactgcaacctccagttcccgggttcaagcaattctcctgcctcagactcctgagtagctgggactacaggcgcatgtcaccacgtccggctcatttttttttcttttgtatttttttagtagaggcggggtttcaccatgttggccaggctggtctcaaactcctgacctcgtgatacgcccgcctcagcctcccaaagtgctgggattacaggtgtgagccaccgcgcctggcagtcctattttttttttttttaaagttctttgaaaaatctgcatactgttttccatagaggttgtactcatttacattcccaccaacagtgtgtaagagttcccctttttcctcatccttgccaacatctgttattttctgtctttttaataataaccgttgtgactagggtaagatgatatctcattgtggttttaatttgcatttctctcatgacaagttatgttgaccatttttttcacattcctgtcagatatttgtatgtcttcctttgaaaaatgtctactcatgtcctttgcccacttcttgctgatattatttgttatttttcattgttgttgagttgtttgagttccttgtgtattctggatactagtctcttgctggatgaaaaagtttgcaaatattttcttccattctgcaagctgtctcttcactctgttgatgatttcttttgctgtgcagaagatttttagtttaatgaagtctcatttatctatttttgtttttgttgcctgtgtttttgaagtcttagtcagaaattccttgcctaggccaatgtccagtacagttttcccaaggtttttttctaggatttttatagtttcagaccttacattcaagtctttaatacatcttgagttgatttttttttgtatatggtgagagataggggtccagtttcattcttctgcatatggcaatccagttttcccagcaacatttgttgaagagggtgtcctttccctagtatatattcttgtcagctttgtcaaatatcaactggctctatctctgggtgtctattctattccattgatctgtgtgtgtgtgtgtgtgtgtgtgtgtgtgtgtgtgtgtatacatatatgtgtatatacacatatgtgtgtatatatatacgtgtgtgtatacacatatatgtatatacacacatatgtgtatatacacatatatgtgtatgtatatacacacgtgtgtatacacacacgtgtgtatacacacacgtgtatacacacacgtgtatacacacacacacatatatatgtatatatacacacatatatatatatattttttgagacggagtctcgctctgttgcccaggctggagtgcagtggcgtggattggctcactgcaagctccgcctcctgggttcatgccattctcctgcctcagcctccctagtagctgggactacaggtgcccaccaccacacccggctaattttttgtatttttagtagagatggggtttcaccgtgttagccagggatggtctcaatctcctgaccttgtgatccacccaccttggcctcccaaagtgctgggattacaggcatgagccaccacgcctggccgatctatgtgtatatttttataccagtaccatactgtttgattactatattcttgtaatatattttgaagtcacatattgtgatgcctccagctttgttctttttgttcaggattgctttggctattcggtctgtttttcagttccatatgaattttaagattgcattttctaattctgtgaaaaatgacattggtactttgataaggattacattgaatctgtagattgctttgggcagtatggtcattttaacaatatgaattctgatccattagcatggcaattctatttttaatttttttttttttttgagacggagtctcgctcagtcacccaggctgggtgcagtggcacaatctcggctcactgcaaggtccacctcccaggttcatgccattctcctgcctcagcctcctgagtagctgggactacaggcgcctgccaccacgcctggctaatttttgtatttttagtagagacggggtttcaccgtgttggccaggatggtctggatctcttgacctcgtgatccgcctgcctcggcctcccacagtgctgggattacaggtgtgagccaacgtgctctgcctgtttttgtttttttgagacagtcttactgtgtagcccagtctggagtgcagcagagcaatctcggctcactgcaacctccacctcccaggttcaagctattctcctgcctcagcctctggagtagctgggattacaggcacacatcaccatgcgcagctaatttttgtatgtttattrgagacagggtttcaccatgttgaccaagctggtctcaaactcctgacctcaagtggtccgcccacctcggcctcccgaagtgctgggattacaggtgtgagccaccttgcccagctgactgtaatggttttgaacatttttaatgcagctgctgttcaataaatatttgttgattgaataaaagaatcagcccttccctttctgagcacatgcagaatctgtgccttcttctggtttttaactaacacctagttttaagagagaaaattccgccctcccccataaatgtcatgttctgtctgtcatttggacatgacccaaaagcttaattttctaaaaagccaaagtgctgggattacaggcatgagccaccacgcctggccctgatgcttcctatctttcatcagatttagaacattttcagtcatttttttctcctttgggaactgtgagaaatatgttggattactttatttttattattattatttttttctttttgagatggagtctcactctgtcgcctaggctggagtgcagcggcgtgtctcggctcacagcaacctccgcctgccgggttcaagcaattgtcctgcctcagcctcctgaataactgggactacaggcgcccgccaccatgcctggctaattttttgtatttttaatagagacrgggtttcaccatatcggccaggctggtctcaatctcctgacgtcgtgatctgccctcctcggcctcccaaaatgctgagattacaggcgtgagccaccgcgcctggcctggatatttttatttcatcccttttttaatctttaccttacttccattttttttttttaagctctttatccctctgtgttgcttttttaggtcgtttgcttggctcaagtgttgtgctcatgctggttggtgagaattgattgtgtgtatctcttcccagctccacattcactgatatcacattggtagcttgaaactggccatggtaggagtatttacacgatggaaaccagcaaatgctacaaatcagagctttgcttttttcctggagaaggggattatcagctcatctctacttagatctatcttctaatccactaattctctctcaactgtgtctaatcggcaggtgatgtctaaccaccatcaatagaggtttctgttcatttcattaactatatttgtaattttagaaggtaaacctggctctttttctactctattatttttcttattatcttgttcttttatgaaatttccatttcttctttacaacaataattttaaatatgtttgttttataacctttatatagaaattttattatctgaagtttttgaagctctactcttgctatttctgtgtctttctttattattattattatgctttaagttttagggtacatgtgcacaatgtgcaggttagttacatatgtatacatgtgccatgctggtgtgctgcacccattaactcgtcatttagcattaggtatatctcctaatgctatccctccccactctcccaaccccacaacagtccccagagtgtgatgttccccttcctgtgtccatgtgttctcattgctcaattcccatctatgagtgagaacatgcggtgtttggttttttgtccttgcaatagtttactgagaatgatgatttccaatttcatccatgtccctacaaaggacatgaactcatccttttttatggctgcatagtattccatggtgtatatgtgccacattttcttaatccagtctatcattgttggacatttgggttggttccaagtctttgctattgtgaatagtgccgcaataaacacacgtgtgcatgtgtctttatagcagcatgatttgtagtactttgggtatatacccagtaatgggatggctgggtcaaatggtatttctagttctagatccctgaggaatcaccacactgacttccacaatggttgaactagtttacagtcccaccaacagtgtaaaagtgttcctatttctccacatcctctccagcacctgttgtttcctgactttttaatgattgccattctaactggtgtgagatggtatctcatgtggttttgatttgcatttctctgatggccagtgatgatgagcattttttcatgtgttttttggctgcataaatgtcttcttttgagaagtgtctgctcatgtccttcacccactttttgacggggttgtttgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggctttcgttgccattgcttttggtgttttagacatgaagttcttgcccatgcctatgtcctgaatggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcccttccccattgcttatttttctcaggtttgtcaaagatcagatagttgtagattatttctgtgtcttttgactcttgcttagagtggactgtttcatcatgtttcataattttcgattgtgaactcatctttgaagggttttgtgttaatatttcaatatggagttactaaatcttataagaagtataaataggaatctcaaatccatatgagggctttcccacaagtacagatattgagggagacgtttttcctcacttatccagaacttagactaggttaacaaacttttgcttccttggtttttttttttttttttttttttgagatagagtcttgctctgtcccccaggctggagtgcagtggcgcgatcggggctcactgcaacctcctctgcccagttcaagtggttcttctgcctcagcctcctgagtagctgggattacaggcatccacccccacgcctggctaatttttgtagttttagtagaaacagggtttcaccatgttggacaggctgatcttgaactcttgacctcaagtgatccacctgcctcggcctcccaaagtgcaagaattatagatgtgagccactgtggccagcccattgtttcttagagtagattttttttcttgtgaactttctcatggagggtgttgtcatcctttaagggtcccagcttcacaatgggggtctcaggatctccttcctacatcatggagatccaaagctgttaaacccacaccccttcgttggcaagattgccacccttgccccgacttcaacactcaccaggtctgtttttcctttttctctccttatcctttccccctctttctttttgtcttttgaaatttctttttttttgagatggtgtctctgttgcccatgctggagtgcagtggtgccatcttggctcactgcaaggtccgcctcccaggttcacaccattctcctgcctcagcctcccgagtagctgggactacaggtgcctgccaccacacctggctaatttttgtttatttttagtagagatggggtttcaccatgttagccaggatggtctcgatctcccgacctcgtgatccgcccgcctcggcctcccaaagtgctgggattacaagcatgaaccactgcgccaggcttgtcttttgaaatttcttatacttttttgtgagattagtcatgaattcaatagggcatttgttcattgtagtggcacgtgtttcagtgttttctaatctgtcatgttgctagaaatggaagtcccagccctaaaatatctttcatattcccaggctttaaggtttaaaaactgaaaatgaagtctatactgtgttggtgtttgttggtaaaaattcaggactctggtaatatttcagaaaccatcctcaaaggactgggggtttagttgtctttggttgttaaagactcaacaatgtttgtccccaaacagttaactttccttcctgacttctaggaatctgctcagcttggcttttacttaggctttcagagagttttctctaagcaagaatatttgtaattccatctcttggacagtgtatgtctcgtttcagatctagcctgtaaagtttcacttcatagatggtcagggctaaaaacgaccctagaagtcatctagtctaactccttatttgcacataaggaattgggatcagcccagatcacacagggtcacagaggggctttgcccaggcaacaacatgaagcctcctctatgtcccttccttaatgtggtttattagaaagtgtcaaaacctgtgtgatatggagtgactgagtacccagagagtacctgtcacaatgtctggcacacagtcaacatgccacaaatttaagttctcttgcctttggcttctcccatgtatcagtttcctgtggctaccaacacattaccacaaactcggtggcttgaaacaactgaaatttattctttcatggttctggaggtcagaagtttgcaatcaaggtgttgggagggccaaaactccctccagaagctctcgggaagcatctgttcctggcctcttctaccatctgcagtcatacctgactcatggctacatcattccagtctctgcctctgtcttcacattgctttctcctgtgtgtgtgtctttgcccgtctccctctgcccatgtctttttttgttttgttttgttttgttttgtcttttgttttgggatggagtcatgctctgtcaccaggctggagtgcagtggtgcattctcggctcactgtagtcttcgccttccaggttcaagcaattctcctgcctcagcctcccgagtaactgggattacaggcacgtgccaccatgcctggctaatttttttgtatttttagtagagacggggtttcaccatcttggccaggatggtcttgatctcctgacctcgtgatccaccctccttggcctcccaaagtgctggattacaggtgtcagccaccgtgcccggcctctacccatctcttataaggatacaggtgattgcatttaggcttacccaagtaatccaagagaaactcttcctctcaagatccctaactcaagcacatcttttgccatatgagataatatttacatgctccagggattaggaagtgaatatatctttggtgtgggggggatctttttctgcctatcaaacccccacataccaactgactatattccaaggtctcatttatattttccttccctggggacagtttatttactatttgcaaatgcattacttgaccttgagacctacttctctcttccaggcctggctatgcagaaaactgctcatcccaatactgcaaaggtagtagtctcatactgcctttgtaatacagattacgcaattactttgcactaggccatgtaggtccacgaggccctcacagtctattgtgagtagctgacagtagcatgagcactataagtactaaagcacagatgctgtgagagcctggagtatgcagtgacttggggactgggcttaggttccatgtcatattcttaccttcrttctgcaaaaatattttgagcattcgtaatccactgtataagaatttagagataagagacwcagcccatacccttaagtaaggagctcacagttgaatgggagatgaatatgagcaaaaagaatacaaaccaaaggtgatgagtgttttggtagagggatgcccaggtgccatggggcacagggaaggtgacacccatacaggctggggtgcgaaatgggagtagagctgttcagaaaggaccattcactcaccaggaccacacctggaggcagtggttcttgagctgcatcttgaagaaggaatggagatagttaaggcaataagggggaggagaacattccacatggagggagaaaggcacatgaaggcatggagaagtgacagggaaagggcatttcctcatcatctttcacctcatctccctcatcgtaattgtaaccgtccrtccatccatccatccatccatccatccatccatccatccatccatctatccatccatccttcttcagtctccaagcgtctgctgagctctgatgcccatgccctgtggtgttaggttgagcactgtatgcatgcttattgtttaatttaatacaagtttgattcaggtaaaaacagacctagagcctggtgtggtggcccacacctgcattcccagctactggggaggctgatgkgggaggattgcttgagcccaggtgttctgggctgcagagcactatgcatcaatatgggggcctcctggggagtgggggacaactgggttgcctgaggaggggtgaaccagccaagccagagatgggtcaagtcaaaactcctgtgctgctcagtagtgggattgcacttgtgaatagccgcgcactccagcctgggaaacatagccagaccctgtctctttataaaaaattaaaacaaaacacacaaaaccaccagcagacctagaattttcacccagaagttctgggacaggcataactgaagcattactttcctgaaactttcctccacagggaccttgacctcggacccttatgactttgccaactcatgggctctgagcagtggagaacagtggtgtgaacgggcatctcctcccagcagctcatgcaacatctcctctggggaaatgyagaaggtgggtgtggactggcctgggtgcacctggatggtgtgtgatttctggatctaaaagacagaaggactcagtctcatatccttccatctgggggaggaatggacttacgcagggccatttcctccaaaactaactgtggctagagtctaattctaatacatctcgagcctgaagctctaaaaatgagtctgggctaatgacttggtgtagtgtctcagtccatttgtgctgctataacaaatgcctgagactgggtaattttaaggaacataaattatcttttatagttctggaggctaggcagcccaaaatcaaggtaccagcattcagtgtcttgcaaggaccttcttgctgtgacctgaagccgggtcctgtggctcattcctgtaatcccagcactttgggaggccaaggtgggtggatcacgagatcaggagatcgaaaccatctgggcgcctgtagtcccagctactcgggagactgaggcaggagaatgacgtgaacccaggaggcggagcttagcactccagcctgggcgacagagtgagactctgtctcaaaaaaaaaaaaaaaaaaaaaaaattagctgggcatggtggcatgtgcctataatcccagctactcaggaggctgaggcaggagaattgcttgaacctgggaggtggaggtttcagtgaactgagatcgtgccactgcactccatcctgggtgacagagccagactctgtctcaattaaaaaaaaagaaaaaaagtacactgaagtgctctcatctgcctcttttatcagagcactaatccattcacgaaggcagagccctcaggacttcatcacttcctaaaaggcgccaccttttaatagcgtcactttggggtttaggttccaacacatggattttggaggacgtagacagttgaaccatagcaataagtaactatgcttttctgttttagactccagtgccctcttttgtccccaaatatctccatcatcacctgctaggtgtctgaaattttaccgatagaaaaaagccacttctttcttaagtggctgttgtaaactagaaataggagggaaagcctcctcttataccagctcagctggaaggaaaactactttatagttgcagacactgaagggagtctgagtgagaggctgtgcctgaagtgacatagcttggatgtcaggatggcttcctgaagctgctgtaacaaattatctcatactcaatggcttaaaacagtaggcatttattttctcccagttctggaggctggaggtccaaatttagtttccctgggctgagatcaaggtgttggctggctttgctccttccagaggctctaggtccttgcttccgtcatttttgggtggcagcggcattccctgtctttgggctcatgacttcaatttctgcctctgtggtcacatggccttctcctctcctgtgtgtgctaatgcctgccaaccctgacaaggctgggaggactgccccaccccttccacagagccctgttgccacttacaaggtagccttgtagcagctctgtctgcatcagagttgccattcatgatctcactcaccaggacctcacactggagagaaggggaggtggggaggggtggccagaccacactctgccttcacctgccacaggtaaagatggtctttgtgcctctctgtgtgtgggtgtttggggcaagaatgctttatgtggggcaagacctcactcaatgggtaattccctccccactgtggaacaggctgacttgggctgaggaggtaggtgcagctgtgaagctggactcctgtggggaacaggggttgttgcccttttgggattgtgctcagagactcatcatctgaggagcaaggttccttggtggtgctgtgagtcagcctccctgggcgggacgtttgtatgcaggaggtttactggggagctctcgagcagccttggttaggaagtgagagaagcagagttgggcagtgggagaagttgaactgcttgtgatagcaytgatagagcttcagcggggcctcagctgatccttcaaggagctctggaaggtggagtggcccctgttggtcactggatgtgggctgccctgggtaaggaggtggaactcccttgggctgagggccattcctgaggaatgactcagcggtgagcccttggcagccaacactggacagctggtggatgagtcctcgggctctgaatgggcacctacgctgtgccccgacacctacgctgtgccccgacaccctctacaaagctgctctgcttgacagcaccaccttcctgcccttatccagagagcaaccacactgtcaaaaatgtcaactgaagaatcacaaggttcataaacttagagaggagagcttttcttattcagagttgtggcctgcaggctggccatcctgcaggctgggaagtgtagcctctggtagaaactgaaagcaggcacttcaagggagaaaggggtggaatagaaacttattccaaaagggttggctcagtgtacatatttaacaggttatgggaggagctatgaatattcataatgggaggaggyatttgcatatacagtaagcaaacatacatgttacatatgtcccacattcattttgggatggagacttaacatttaaatgcattaaaattagcctctataggtcaaaaggtgaaatggaggacacagaggcatcttgtgcacagcctctgtaaatcagccagaaccattccgtggttggtggtctcttaccaggaaggaatgctggtcagtacacacacacacacacacacacacacacacacacacacacactctctctctcwcwcwctcactcactcactmactaactagctgggcatggtggcatgcacgcacgcacacacactagctgggcatggtggcacrcgcgcgtgcacacacacacacacacacaaacacatactagctgggcatggtggtgcaccagtaatcccagctaatgggagggctgaggtgggaagatggcttgaacctgggaggcagaagctgcagtgagttgagattgcatcactacactccagcctgggtgaaaatgtgagaccctgtctcaaaagaaaaaaaaaaacccgcaaaaagggaagggagwccctgctgggccagttctgtttaactcttaggaaagaaagtctaatggtggttagcgagggagagggtataaggaggggtgttcaacctcccatcctatcatggccaggaactcagttttaatatttctctggggtccctttggccaagggggagtccgtttagtcggtaggggggcttaggattttatttttttctgaaaacctacaaacatgcacaaagagggtggcccctgcctatacccaggaccatggtcatgatggacgcgacaggccacagttgcctttgtctgggcaygggccactctgcagagcgtgagtgcatgctgcagtcacccgagtgcgcagcccatcagcagagcagtagggcaggtgctctgtgattttgttcatcccatgagaaaacaagccataggaggttaagtagctgccccaagtcgccagctagcaaggtgcagagccaggactcatgccctgcctggctccctccctttcctgttcrggtcacattggttcaggctactcaagttatttctaccagtgggcccttgtgtttctcttggggagttgggctttgcaggttcttaaggtttctttaagttctaaaaccctttattagcctggtgcggtggctcatacctgtagacccagctgctcaggaggctgagtcaggaggatcacttgagcccaggaggtagaggctgcagtgagctacaattgcaccactgcactccagcctgggcaacagagtgagaccctgtctataaaacaaaaccaaaaccaaaactctttcattatgtgtttctgtggattgggctatagagacagtatataataggtcttaataaatattggatgggtggatgaatggaaattggtggtgtaatttatctagggattgtgacctccacaataatccagactcctttacttgtagaaatctgatttatctaagtaagtacataagtagagaaacccagccctctcctattccagaaacaaaataaaacacacccacatctccctcctcccacccaccccccatcacrgtaacacgaggaagcttcgttttagctggttattaattcagtgagtcttcatcttcatggaacawtttgacctctgaccaaggagaatgtcagacccagaaaaatattctgagttgatgctaaatccagctgcctaaattgtgaacagacaatctccaccttataaacaagtacattccaaaagactttttcccttggactttggtggtgctaggtcctctggttagtccatcaaagtctgcatcacctggatcctagcccagtaccggcactaacaaaggcggactgagttctagcacgtgaggggagggtgctgtcttgtggaagggaggagtttcctcttctttgcagtcaaagttctaaatgcctgaaccatacccttgatagccccttgagtgtctctcaccctgggcctcggcgtgagcgtggtgctaagggtgtgggtttgagtcagctcacttactggctttgtgaatctgggcaagacaagtgcctttgcagagcctcagtttccacatttgtaaagcagaaatagtacctgctgggtcactgaaaaggtaagagagggataatatgtatagagtttagcccagtggggctcaactgttaagagccatgatgatgatgaggaggaggaggaggacgagaaggaggaggaggaggaggaggaggagttgttgttagctggctccccatattctcccactgtcccgtgttttccgctggagtgcccctgccttgagaatgggagccggcagaagcaggacaagcacacgccgggctttaagcacaagtttcaacacgcattctttttctccttccccctcgcaactataacccattccttttgggtagccgagcacagcttgaggttagaaggaaaacaaggtgcccagatatctccacacctccaagtgggtaagtgacaggaaccagccttccttctagagcggtttgtgaacccagatggatttcaaattgagtgcactcgaggtattgtgtaagagaggacagattttcggccgggcrcggtggctcacgcctgtaatcccagcactttgggaggctgaggtgggtggatcacgaggtcaggagattgagaccatcctggctaacatggtgaaaccccgtctctactaaaaatacaaaaaattagccaggtgtggtggcaggtgcctgtagtcccagctactcgggaggctgaggcaggagaatggcatgaacctgggaggcagagcttgcagtgagccgagattgcactactgcactccagcctgggtgacacagcgagactccatctcaaacaaaaaaaaagaaaaaagaggacagattttcataatttctttctttttttcccaaacatasagttgtgctgttggcaggtgggtcaccctcggctgcccttcagtgttctccaggcagatgaaggggaggtggtgggtgcttcagtgggtgaggtggggtcagggtggctgtggaggtacctctaatactgaaacatgscttcaaagatttattatttttggtctcattttattttgcaaacatagcccagtgcagagtaagtacttgacaaatgttccctaccctcggaatacaaaggaatgatctcatttatccatactgagtgggaggtaaagacaggattctcaagtggagaacctgatcctgaggtcgggttgaggagggagactgggaggtttgtctcctggagacaaargggagggagaatgcaagagaagccttgtttgcctcccggggcacctttctgaggctccagctgtaccctagctactcgctttgtctcctgggtgcattaaagtccttactaaccagtgtcctgggaacagctgaaaaaactgggtaccaggttcttcgtgttgggctgaggccacaaacacgtgagacctcccagaggcacaagctcctcccagctcagaactcccggtttcaggttgtttacctgagaagagaagactgctttgtcctcagccaatcagatagtgtttgcccacaaccgaggttttttcactggctcggaagcacaatgactcgtctcccaagaggtgattaatatggccttttgaattgttcacagcctgtgtagtcccgcagggcccccaggttcagaagtccggtctggtaaatgccgcatcatttatgagtgtctgctgttgtggctccaagggccgttcrgggtgacagagtgttytgtgtgggagttcacactgaccttgaaactttccttgacagcctccagaatctacttccccaaccctctggtgctttctgtctttctagggcatagcaaggagtcagctcattctgagagccaggtcatattacttgttagttatacctagggaatgaatgtttccttgttatgccaacaaaacccaatgcctgtctccactgggactgataatggccttgtttgattgcatgcaaatttgcagttttttcagcttttcaaactgaaggcaagatggttggagtttggagccccaagctatgaacattcagataattgatgttcatctgcaggtaactatcacaaagtgtacctttgagaaagaaagacccttagatcactttaaaaaaattcgatcagactggggaaggccagcaaggactgaaccttacaaagggatcttggctttgtcctgtagtcctgtctgcaacaggaagcccaaggctccggggggctgggcttgggctgcatccagctcatagcatgcttttgctaattagaaaaaggcacccctttctctctctctctctcgctttttttttttttttagacagagtctcgctctgtcgcccaggctggagtgcagtagtgcgatcttggctcactgcaagctccgcctcccgggttcacgccattctcccgcctcagcctcccgagtagctgggactacatgcgcctgtcaccacgcccagttaattctttatattttttagtagagacggggtttcaccgtgttagccaggatggtctcgatctcctgatctcatgatctgcccgcctcggcctccgaaagtgttgggattacaggcgtgagccaccgcgcccggccaaaggcacccctttctcaagaaacttcaccaccacctgccgggaaacggccaagataaacataataactgaacatataatgtacatgtatatacctctacaatgtctaccatatgaacagtagtcacttggtgtgttgccactgtgtggactgtgtggcttgcatcatgacatgtgatggtgttggcctggcttcctcagggaggcacagtctctgtgaccatcatctcctcgctcaggatcacctcctcaaggcgatcagtctctattgagaaactgagtgcaccagttaccactctacctaccgtagagtggtgaatcattcagcagcagcagcaacctccgacagctgtctgaagtggaagaaatttcttttcatcaatgttaggaatcttaggctcataagaactcagagttggttgagaatctagcagatatctacttcaaccccctacctgccgcatgaatgctctccacaaactgtgtctgggtagacaggttatgctgtgaccttgactgtaagagttaaatcttggccaggcgcgggggctcagcctgtaatcccggcactttgggaggccgaggcgggcggatcacgaggtcaggaggtcgagaccatcctggctaacacagtgaagccccgtctctactaacaatacaaaaaaaaaaaaattagccgggcgtggtggcgggcgcctgtagtcccagctactcgggaggctgaagcaggagaatggcgtgaacccgggaggcgaagcttgcagtgagccgagatcgcaccactgcactccagcctgggcgacagggtgagactctgtctccaaaaaaaaaaaaaaaaaaaaagagttaagtctttgagacacccttgctgggcgcttcccagccatcttgcagacctcagccctaggcagccctcctttactccctggtaaattccttctttcattgtatgcccgttcgaagctaaagccctgtccttccgtgtccctgaatactggagaagcaggtgctttgggtctggtttctcctggtctggctcaggagctcacatcaattgcagtcctgtcagtcactgaatagcctcagatttcctgttttccactggtctctgaatttggtgtttattaggtgaacacaagccttattttctttggccattcatgtcttcacattctctcgcktcctccattatcttgtagaactctttccgcctcctctgaaacagcatgcagttcacctgtgattcctcttcctcccagaaaatcacctgtcctgcttgagctaacattttaaacagtcatgttgactttgaataatcacagcatgcctcctcagtagcccaaagaggcacagaaaatacccattccgttagagacaaagcagttcactcttcatgttctcattaaatattgctcaagccttttatttgcaaaggacctaccagccctttctgctatttctgctcatggtgactctgaaagggaaattcacaggcatggagggaggcaatgtaagcccagcggacttgggtctcactgtctaggcccacttctgccttccctccttcttctccttgcctcttccattcacttaattggcagttttggtctggaatggacttttcttggagactgggaagaattttgttacattwgtttgcttggtagcatagttgtgattcatagagtacagttgtcaggggagagcctggcccagagaaggtcagtagatctcaaggaaggacccttggaatgcaggatcccagagaagttagttgtcagatgatggccctggttttagagttggggtgcccacccactatgccccagtgacaccragctcagagctggggtttgcaataagtacacacgtgtctttccccgttttgatgagaactgctctctcaagtctctctttcttgagtcattgataggctaaggaatgaggacttatttcaagtgctttastgaggtccaagaatccagggggcagtccytggtttggcccaattctctgcatgtcctcgtgtaagttactttcctactctgcctctcagtcttccctctctgaggtaaacagagctccacggaaccccccatggataggcaccctttctttacagcagactggctcacctgagtgcaggatgggagaagggcagggagccaatggttgtggtgaaacagtggtgaccttggccactgttcccttgggggtctagcctcatggcagaggtcagtggctaccatggggttttgcagatttcccttgaacttggcctttaaaaatttttttttaaaattttactttaagttctgggatacatgtgctgaacgtgcaggtttgttacataggcatacatgtgccatggtagtttgctgcacctatcaacccatcatttaggttttaagccccacatgcattaggtgtttgtcctaatgctcgctctctccttgcccccgccccccgcgccccccctccccgcccacaggccgtggtgtgtgatgttcccctccctgtgtccatgtgttctcattggaacttggckttttatgttgctcatttgacaagcccttgaggagagttggataaggacctagcacccaagcattcaattcaaaggcctccctaacataatgttcccaaaatcctttaacgaactatttctcaggtgggttcctttcccttttccttttccctggtgagsarcagaatggacaagaatctgatggtgcccataagtgcatattcactgagatgtttcatatggcttgcgtswtacaasgtagactaagggacaagacacgtaagagaaattaaaccatgaaagactgtctggggttagtaaatgacaaatcgccaagtgaatggtaagtgatagcgcagcttaggggaattagctcctgtcacagagctgatgcttttttcttgctgggagcaggatgggtgagtgattcagaaagggctgctttccatccccagagcttggtaggccctagactgggaaccagggaatggtgccccgtccttgtccatccagccagcatgccctaatccctagaagctgctcagatgcctccaggagccccaaggagaaggtgaggagggtcccttagagagstccatggccaagtctcctacttctcatgagcactggaccccagctatcttagagagaggwatgtcaagctctgcagaaaccatccatttggtggaaatctatcaacaggtttcaccaggtccttgtgagtcagaatcttggaatgcgggtgggaatcttgggccggccagaagttataaatagaatcagctaccctcccccacccatcattacagctgaccaatgagaaagtattccctgctgcagggtgaattcttgaacccactactttggagcagctcagactccaggcgcctccatacctaccaggggctgctgcagggcacccatcccagagctagaaagatcagggcttgtggaacaatattgcactctatgtattagactttcctttctttgttcactcagtcctaggaatgtccccctcccttctcctttgtcagctgcttgggagcaaacacaatagctaagcttcagatctctggctctgctttctctcctcctgctgcctgccactgagatgtgcttgytttccctcctcctcccctgcacccgcctgatgtctccagggaagatgcctggtcttctttaatgaactggaaatgtgattaagatgggccacaattgggcctgcacaccaacccaggcatggtgaggtcatggctggatgggctggggcagctgctctcccgcagctcctggcacsgccgacaggagttgaaagaagacaggagtagctgatgcagggccttggagccagggagatgctggaagtgtgcaaattagctggcccttgttttgcatccctgccagaatggtttagcagagaactgaggagccagtaccgattgcaggcaaatgagaatagttataagcatttgatttcctggtgtcatctcatttgatttcattttgcagaaaccatctagggtaggtccaagtactgctgtctgtgtcagttaggagtaggttcagctgtgagtgacaggacttatacaatctaagtttatttatctctyatgtaaagaagtttggggtaggatgtccagggccatgcaagatctcatggtgttgggatccagggtccctctgtcttatttctctgttgtccccagtgggggcttctaccttgtgcaccaaaacgccrgctcaagcttcaggcatcacaactacattcccgcagtagaaagagaagggactaaggaagaagcagtcccttattttgaggacacttggtggaggttgcacaagacccctctgcttatagcctactgggtattgcttagtcatatggctgcccccagctgcaagggaggctgagaaatggaatcttattcctagcagctctgtgccccgygggggtgggaaattgaaaactgaggattctgtgactaagaaggggagaatagctcctggacaactttcaacctcttccacttttcccctctttcacaggtagggaaatgaggatgcagagaggcaagataattttccttttcttttttgttttttgcgacggagtctcgctctcttgcccaggctggagtgccgtggtgcaatcttggctcactgcaacctctgcctcccaggctcaagtgatcctcccacctcagcctctctagtagctgagactacaggcacgtgccaccacgcctggctaattttggatatttttgtagagataaggttttgccatattgctggtctcaaactcctggactcaagtgatctgcccactttggcctccaaaagtgctgggatcaggccggttgcggtggctcacgcctgtaatcccagtactttgggaggccgaggtgggtggatcatgaggtcagaagtttgagactacccttccaacccttccaacatggcaaaaccccatctctactaaaaatacaagagtgctgggattacaggtgtgagccactgcacttggccaagatcattttcttaaagtcacacgctttgaaagtgatgggttgcgagaggcagaggttgcattgagctgagatcacgccattgcactccagcctgggcaacaagagcgagacttcatctaaaaaaagaaagtgatgggttgagattctagcccaaccatgcttctaaaacctgagctacagccactgtatgaccctgtcttctaatctgattgctaggaaacaggagtgggagggcaggatggaaaactgtaatttgtggtttggaatggactcaggcactcagggtttgcaccccatcactagtgttaaaagaaaaacctgagacaaattaaatttaacagggtttacttgagcaaagaatgatgcatgaaccaggcagcccccgaatcagaacaggctcagagagactctggcctgcctcatggtcaaagaagatttatggacagaaaaagacaagtgacttacagaaactggaagtgaggtagagaaacagttggattggctacagcgcaacatttgccttattagaacgtagtttgaacagtgggctgccccaagaggaggttacagtgtgtttacatctccagttaggttacagttcattatgtagggagaaacctttaggcctaacttaaaatatgtaaggaggcagctttcggctaaacttaaaatttaacgattgtatagcagttctccaactgtttaatcgcagggcccctgtatactcttaaaaaataatgaaggactttaaagagattttgtttatgtgggtcataactcttgatacttaccatattagatattaaaacaaatttaaaacattttttgattcattttaaaataacaagctcatcatatttaatgtaaagaacatatttttaggccaggcgcggtggctcacgcctgcaatcccagcactttgggaggcctaggcgggcagatcatgaggtcaggagttcgagaccagcctgaccaacatggtggaacccagtctctactaaaaatacaaaaattagccgggcgtggtggtgtgcacctgtaatatcagctactcaggaggctgaggcaagagaattgcttgaaccctagaggcagaggttgcagtgagccgagattgtgccactgcactccagcctgggcgacagagcgagactgcgtttcaaaaaaaaaaacaccatatttttaaataaaaagaacgataaattccaagccaaaaaataatttaggggaaaaatgacactgttttacagttttgcaaatctccttgctgtctggcttcagatacatcatctggactctcatatctgcgtctgcatttaaatctgttgggatatctcatgtctcatagcctcggaaaactgcactgcactctggtgaaagagtgagagaaaaaattgcaaatagcatcttagtattattataaaaacagttttgacctcgtgcactgctgaaaggatcttgggagtcctaggcgatccctggacctcaccttaagaaccactgacttaggccaggtgccgtggctcactcctgtaatcccagagctttgggaggcaaaggcgggtggatcacgaggtcaggagatcgaggccatcctggccaacatggtgaaactccgtctgtactaaaaatacaaaaattagctgggcatggttgcgcgtacctgtaatcccagctacttgggaggctgaggcaggagaatcccttgaaccaggaagtcggaggttgcagtgagctgagatcgtgccactatactccagcctggtgacagagcgagactctrtctcaaaacaaaacaaaacaaaamaaaaaacaccactggcctagtaaattctttacccactccatgcttcagtttctaaatctgaaaggctgtctgtatcagcctttgtctgaggagagctgtgttctttggaggtgtcttcaggcctctgaagggcccatttgtggcatgggtgatgagatggtctctgaaagtactttaggtgggctaggagagaggtcagctgtggagaaggaggtgaggtttgcctcagcctttcctgaacgcaggaggatgggcggagaatctgtggagggccttctgggcagggagctctatgagccaatagccccccgtgactgagtggatggtaagagccagagatgcctggcctaggcatcccgcctggctcctgctgcccaccccacccactggtgtgcatgattgtgccaattcccacaggaaaagagggcacacggagccgtttctaagccatggagggcataacctagggggagtgagagaaaggggtctatgagaacttcgcgcaggcaggaacacacgcggaagggtctgagggcgtgggaacaggcggaaagtagacacctactcaaggagagcttggttgggtttggattatgatggggccgtaactacctgctaagagaagctgaggccacagacttggaacagcctctcagcgggcagctgtgcctttcctggggaatctgtcggcaagactgggctggagtcttagtgctcggctcagccgtggtgactctgtttcttctcctgcctgagcttatgccattggcttcacctgacatggcctccctcctgccctgcagcctaagtcctatgttgcatccagggccctgtgcagactgccttctgttaggcagccttccctgatgtctcagctgcaggtttcttgctgctgccattggctgcaccattgggaagacacctctaggtgagaaccaagtcttcaggctgttaggcaaacatccccatggaaacacccggttcaggtagattgaatgccagttaagagctggagggcatgaaaggcatgacttactcctgtctgcrttcatcactgttaggtttgattcagcatatccttattccctgccatgagtgccctgggaatacagctcctgtctttgaaaagcttgcagagaaatggaggagacggccacagaaatggaccatttcagtacaagaatagaggcccccagagggctgtgagaacacctaactcggcagagtggggagaaggacctgtcagagaagccttcctggaaaaggaggctcttgatctgaagtgtggggtgggagttagtgggggccaaagaagggggaaatgcaggagggcagatgggatgggtagagggcagatttccctgctgggctttatgagggggatctgtttgctttctattgcattccttgagcctggcacagtgtgtgaggtggggagcagggagggtgaggctggagagccaggctggggtcagatcatgaaggctgagcttcctggctttgctgtgtcctaatgagctagagctttgccctgtcagccagggtgggacatacatagttagacttgcattttatatgggcttggacaccctgctggagacccagaggccacactgctaatgcttgttgagtgaatgttttggtcactacctgcatcccagtgtctctgccacgagcctgagagtacaagacgccaactcctctttggacctatttttttttttttttcgagacagagtctcactctgtcgcccaggctagagtgcagtggtgcgatctcagctcactgcaagcgttgcctcccggcttcatgccattctcctgcctcagcctcccgaatagctgggactacaggtgcccgccaccatgcccggctaattttttttttgtatttttagtagagatggggtttcaccgtgttagccaggatggtcttgatctcctgacctcttgatccgcccgccttggcctccaaaagtgctgggattacaggtgtgagccaccgcgcctggcccttggacctgtttctgtgtcctgtctcaggacctggtctggtctggcagggctacctgtggcagaacagggaagctgggagcagcagagatagccacctaaacatgccatgtggtatggctgcaggtgagtgcggatccagctgcaagtcctgcctggctctcagctgtgcccactcaggtggaccaagttcaggccaagcctgaccagaggaagactgaaggacaaaatgggaggacagactttatcttttgtttctgctaagaaagaaaccctaggcagatttcagaagtttgtacagtggaggccaaaggaattgttctaagaagggaggtggctgtttctgcagaaatccactcccatcctgcaggcaaatcatcagaaacacccttcttgctaaggctttctataagccatttaatgcctccagggacctcccaggaaatgtgctggagtactgttcccattatccctctgagtgggaaaagagtgatttggaaatgctggagatgggccatgctgggctctgtctggtcacggctctgagaggggagggtgcctggattcctgggtctcttctttcccttggctggtactgtgtcctgctggtgagaatccctggttccttgtccctgtgcctgcaggaatcagtcctgtggtgcagggactgctccgagccactctgctacagcccaggtgatggcagcagtcatagcaatgaccaggaaaaccccagggagtgcatttttgaggttttctctagtttcaaattgtgggtggggaaaaggctagacaatagcctgagcacatgaccctctctgggacamcctcatctgcactctgagttcagtgacgtaattctctgaatgacatttttgatggggtaggcagcatggcagaatggagggaaagacacaggcctcagtctccttccctgagccccaacttggcagtgaggatgggaagttctgcctattgcaaagaagagaggttccctccctgctactagaaactcactttgttctggagaagtgtgaacttcccaaatgaaagatgaatacaagcagcccctctgttccctaaggagcacgcaagatactaggaagtgataatgctcggcaaccattcatctcagtatagcccagggtgatggagataaggggaaaaggagaaaggtgtccttctgtcctgctggggacctgctcactattctagagggtaagcctagtggccggagggatctctctggaggccaggagatgatgaagatgatgatgatgatgataggggtcatcatttattaaggtaagtcttccgcgtgcatattccattcagtcttcactagtcttgtcccagaggaactgttactattctcccctgttttgcagaggaggggttgagtaaacagcttagctcacacgctagcatggggaagacgctgggctgaatctggggctgtggaagtcatgatgaggccaaggcaggcctgcccacctctgtcagtctccctcgtcattgctttcagaagcctcaggttccccttgtgtaaaatgctcagggtgaccaatggaaggctgcatgtaaccacctgagacctaagtggtcccgggacccacaacagtggcctgcattcatggctggcctacgtggtgctggcattgtggcatcttcacgtggccccaacaggccgtctgggactggtcatttccacaggtcattctcactctgggacactcttctctgaccaggtgagctgatttgcctaagtccccaccgccagtaagtggcagagctgggctttaaggcctaggcttktcatagccaygccgtgggtgcccgcccggcagaaggggattgggcaaggcagggccgtggaggggctgctgttggccccgagacgcagagcagctgatggctgtccccatgagcctacctgctgcacttctgcagttgagcagcccatgccggtgggtgctttcctaaggtgcagagagaacccggcttgttttttgagacagggtctcgctctgtcacccaggctgaagtgcagtggcacaatctcagctcactttaacctccacccctgccccgccgttcaagcaattctcttgccccagcctcccgagtagctgggattacaagcatgcgccaccacgccccactaagttttatattttcagtagagatggggtctcaccatattggccaggctggtttcaaattcctgatctcaagtgatccgcccgacttggcctcccaaagtgctgggattacaagtgtgggcatcttttccaggcctgcctgcttggctttgatggtgaagtgggtggaggcctagcaagcggcagggccctagcaccaggcattggggctaggacactgatttccttaggaccaacgtccctgtgctgccggactggatttcgagaacggtgagcagatggggtcaggtttctattcctgtgggctttctgtggcgccgcaaaacaggaggcccacaggcctggcccctggccccgactgtagatttatacaggcttgctctggagacccttggtacaattcaagctgattgaatttccctctcctcaaaacgggtcrtttctttcctcttttttgctgtcccctttcccaaataccaactggctccagtttacccttcaggacccagtccttccattgagatattcttgcacttttttctttttagctgaagatcataagttttttcatgaacttgcagctttgtcagtcagagagtattgcattatgcatccaagaagttatgcaagaaagaaatcatggggatcatatatatccatgactctgtgttgtgccaaagctaagaaagacatcatggattctaagacacaccattgttctgtgtatcgctcagaaacaaaagcctaccaattcaaatatgatagccatcctaagacgcaatccaacttcagagatgttacactgtgggaaaaagrtgtatttagagtcattaacatacagaatggagagatgtttctaggtaaaacgtagggtcgttgatactcgtgagtgagcagaagtaggaaatgatgacaattccaaagctgcctgtgttatcaggttgagggcatcagcaaagtggtagaaccaagaatactcgtgcttgctgcagtgtgtctgggacattccacagaatcagcgcatgctgttgctgatgggaactggtcccgtctggccccagcaatcwcctggggagtgtttaaaaaaaaaaaamtcttgctgatccccatcccaaactactgcattcagatctcctagggtgagacccagaaatctctataaagccccttgtcccatccccctcattcatagtgaagaagatcaaggtcagggaggggagctgaacaggtcagtgcagaaccgatgctgacagcattcctggactctgcagccacccaggccaactccagggcgcatgctctttgtgcttctctccatcctctgtccgttcctaggacactgcccaccatggcaatccagggccttggactctgcatttccaggactcagtctaggatgtaaccttagccttggtctacttcacattgcacgggtccagcatcttttccttggtcgatgggctggtgcattgaacacatgcatgtgcttggtgccagcctgtcccaggtgctgagggagctgccttggtttccctagcagggctaagtctcagtgccacactcagggagacactaacggagcataccgctgaggcggcccctcttcctgcagggcctgtgrgagcagtgccagcttctgaagagcacctcggtgtttgcccgctgccaccctctggtggaccccgagccttttgtggccctgtgtgagaagactttgtgtgagtgtgctggggggctggagtgcgcctgccctgccctcctggagtacgccyggaccwgtgcccaggagggaatggtgctgtacggctggaccgaccacagcgcgtgcagtaagtcggccccctgccccgtcctgccctgccggggatgaacggtctgtcctgggtggtgtcccttagggtgcttcggggctgtgtcacgtatgtgcggctttaccacacccagccagccagtgactacaaagccacgtgtcccggacccatttcctgaatggctcctgccctctgtcaaacgggcttcccaaagccccgtgtcctgcccctgcctccgtcccgcccccacgcctcccctggcgccccctgacttccctcaggaaatccgacccctgcactcacacagtgttctctgcttcccaccaagatcttggcagttgcggttttggtttttgtcttcaccgcctgcccgccygaattgatgaggagcaggacgctgacctggctgtccgtgtgtggtgatctttgagagagcagaaagcattcattaagttcttctcttttattaaatctctctcctccaggctaatgaccgctatccctcctgccttactcgtgctgtgtgtttcatcttccagtctcaatgggtgcctagttatggtcactgtccccaaattatcaggattaagtggggacttctgaggtcaccttgcaagaagtctcctctttccccagcccttccagtgattaaaagccatgcagacggataagcagtctgtgatggttccacagatgagctgagccggccacatctttacactgcacacgtgtgtctcagtgtgtggcaaatagctgctgaattcaaactttctgcctgtggtgggggtgtgaggaaggaggatgctagcagctggtttcttctctgtaaagccgagtggctgtttttttttttttttttttttttaggtctgtgaatgtagggtaggggagataacctgatgtatcttggagaagggttaaggggcaatagtttggtgtcagaaagcccagaaaagagtgcttatgtgtttcggtctttcagtcagcctgaatgtcgctcagctacagggtagagagaggaaggaggagagcctgtccttgcagtgaggagctggttccattgggaagaacagagagtgcttaggtgatatctgtgaaggcagccttgtggcagagtggaaataaatatggaatgagtgtcaccatgcaggcaaatgtgccctgtgctgggtggggcatttgattggggccaatttcatggggaaaaggaggagggatgggatggagggcaccatggctccttgctttgtcgtaggactccacttgttttgagcctagaggagtttggtgtcactctgaaagggttttaggtgaaggggaggaaagaatgccaagttatacatggagagcaggcgaccaaggggaagggtgggggtcctgggtgcccccgatgggtcttggtaagggcctcacaagatggaagatgttcatctaagggaggggtggcctcaggggggcacgtggctcactgggggtgagaaggacctggaagcctgaagacagaggggagcagtcagagtgggcacgagaggctcaggctgtggcatggctggtgagatgatgcaccggtgggacctgccctgggtagacccctttgatgttccttttcaggcccagtgtgccctgctggtatggagtataggcagtgtgtgtccccttgcgccaggacctgccagagcctgcacatcaawgaaatgtgtcaggagygatgcgtggatggctgcagctgccctggtaatgaacttcccactttatttacagatcagagaccttgccagcacccttggctttgggaagtgagatgaaggccacttgtgtttgctccccgttgctgaaatcagaagccttttattaagtttttaaatgtctttgtccagcgtgatcaggattgagctggtctttatttttaatgtacgttgtcctgttgtactgtatccatgaacgcacttgtgttgagggaaattggagggtggcctgggccccaacagtaactttgtttggggaactcgtggcccatctgagctgagctgttttctcaattaggtgtgtcagggaaccgatctgggaaaaagatctcctgggtttgtcatgtgagctcagctgaaaaagggctctgcactagaaagtcttttcaggggaggcttggtgggctttggggaaaacccctgtttaattactgagagcaaggctgggtgcggtggctcatgcctgtaatcccagcacttttggaagccgagatgggcggatcacttgagttcaggagtttgagaccagcctggccaacmtggtgaaatcccgtctccactaaaaatacaaaaattagctgggggtggtggtgcacacctataatcccagctacttgggaaactgaggcaggagaatcacttgaacccaggcggcggaagttgcagtgaaccgagatcgcaccactgcactccatcctgggtgacagaacgagactcggtctcaaaaaaaaaaaaaagttattgagagtgagtcctgtgtgtttcaactcatgacttctctactggaagaacttgaacaaaactcttgactcccttcatctgtggaatggtaatgagtagtcttctccctctcacgttgcattaatgtgtaagggaagcagcacacacattcttgagcttcctggaagaagccctaagcccagacttgtgcctcccctactggatgacctggaacaaaattcttttgctcatgtcttcatctgtagtaatggagatgaggaatttcccttccttatattgcattatgtgaaagataaacaccacagaacaagttctttgagcttcctggaagaaacccaaccattgtccctggggattctatagttgtgggatgagtgacgcaatgacaatgttgaggyctttgtcttgatgcccttgaccccagagggacagctcctggatgaaggcctctgcgtggagagcaccgagtgtccctgcgtgcattccggaaagcgctaccctcccggcacctccctctctygagactgcaacacctggtaatgggggctgcgcagcgtgctctgggagacctgcctgggggactggggagggaagctgggtcagcaggggtggtggcaggtggaaaagaacctggaccgtgccaagaaagaagagactgagttggaggctactggtgggggctagggacaggtgtggcaggcaatgayggggagcaaagagtatattacagataaataagccttgaagatggggaggtcaggaagggcaggatccttcacgtgcagacatcatctctagctgtccctccaaactatgctttcataaatgatcctttccccctggaggagggctgtatcactaagcagtacgtaggtccttctctccttgaaatctctcatctgctaggtggtaggaagttgcagtggccagtggaaactcacaccagtctgccctcccttggtccctgcagtaggccaggcccagcctggcttctgtcatctcaagaagcacccctggatgtcacctctggctggctttgccagtctcctgcacagcagggacaactcgtttggtccccaggcctcctccctttgctatcttagcagccttctgtgtgcactgagcccccaggttctcagtcggccaccgcccaccacacttctgggctgggagctacccatttccatatcgctctcttgctctctgccactcactgtgtgtggggtaggaatttgacttcttggtatctgagtagattttcagggggatcaggtagtttttttttctttcttctttttctctgttggggtttcttcccctgggtaatatctctaagattcctttgtggccaaagctctgtcctgtacaattttaaccctatgaagattctgctagcaccagctcttttcttttcccacatcccttcgtttggggactgtgataactaccawgagctctaaatccatttgcatacccttgtgtttgcagaaccaccaatgacctgtgctttttccctccaacagcatttgcygaaacagccagtgkatctgcagcaatgaagaatgtccaggtaggcgacctgccgctcattctcttcctccttccctgaatcggggaggcgtctcctcctctcttaccagacagggagggccacaactcaaggcagcgagaagttgccctctctgcacaggttggctgcaaccacgtgaccccagctctggtttcaggtaccagctatgctaacccattcacaggccagaggtgggagccctgcaacagctgaaagcggagaatgcacctgcgttcagatgttattgtctgtccttattacctgtttgctgaaaggattaaggttgatgagctgtaaggcctgtatggtcatgattgactaaacaaagaggatacacattctttggaaaattaagaggtagaagggcctggtaattctttaggcttgaagggacagttctaatggaactttccagaatgcctaatatgaagaccatggcgtggtccaagagctcggaaaaccagrtcaccaaatgattcctcccatcctgtccctgccctggaaaatctgcttaggaaaaattattgagcaatctctgccatttgctttctcctctgtttggccccaactctattctatttactgcaaaccttgcccattcaaagctcccttctgccccaccttccaatgacctcagaccttgccctctgtgctcactcacgtggtgttttctatgtgctggccactgtgctaaacactttccggttacaacctgtgaggcaggtgcaatttattctcattttaggaaagcagaaacagacctagagaggttaaatgacttgcccaaagtcacacagctgctacgaggcagagccagggcttgaactcacaactgcctgacttcttactttttcccttccctttcttctccttcccagtactaacctttggtggcctgaagtgggttgagcttggatacctgggactgtatttagggtctgtgagttaaagactttaggatgactcaggacctcatccagtgtcctctacactggraaaattctggaactagatgtgggctagatcagttagtcttgcaaagagatggtcacccagccaggttatcttttgtgtaacccttaaagaaggcacgaaggagaaaagattgctcttgaaagggatatctgtgctccactgaacgtaattacaccatgtccaagactaaaggagctctttggaagacatatgagttgctgcaattaacctgtgaaaacacttttaacatttaaataataagcactcattgtatgagatctgtgagccacagtggatggaattaggaattcagtttattgtgtgtgtttttttagacgtttgtaaccaccagattaggaagttttaacaagtacttactatagggtgaatcttccgtccatcatccttccaactgtccattcatccaagtactatttgaacaccaactatgtacatgatggactgttttctggggcagacaatacagtcctctggtcttcaattcaaaatctagaagatgactttgctgaggatgtaagacattctcttgatgtcttgatgaaaagataaacagtgtcaattctgtctactaagtggtttgatattttgccaacaaaaccactacgctcttctctgcattctcaaagccctggctctgaccatctttttctagtttgggagttttgttgatcatcgcctcccggtccatttgcacccacgcacacaagcatatttccacaccctgccatgactcagcaggcagtggggctgtctgatgctcccagtgtgatgactgcagatagagcttctgatgggaagaataggcggtatggttctggaggggatatgcttggctctgcttgtaaagtgaggagcaggccggagcttctctgcagcccctggaggaggattagaatgacatcagccatgtgagaaatggtaggagccaacccgggaggcagttttaggtggcatcaagggctctgggctctgcagctggacagacctgcccgtattcagatccctgttcagtttctttgggaacttggatgagttgaacttctctatgcttcagtttcctcatctgtaaactggggataataatgagcacttcataggagcaatcaatgagatggtttccatggagcacttggaaatgtatcttatgccaggcatggtggctcacgcctgtaatcccagctytttgggaggctcagtgggcagagcgcttgagcccaggggttggagaccagcctgggcaacatggtgaaaccccatggctacaaaaaatacaaacattagccaggcatagtggtgtgtgcctgtagtcccaggtacttgggaggctgagatggggggatygcttgagcctgggagattaaggctgcagtgagctgtgatggcatcactgcactccagcctgctgggtgacagagatcctatcacacacacatacacacacacacacacacacacacacacacacrcaaaaaaaaaaaaaaaaggaagaaaaagaaaaaaaaatgcatcttgggccaggcgcggcagctcatgcctgtaatcccagcactttgggaggccaaggcaggtggatcatttgaggtcaggagtttgagaccaacctggccaatggtgaaaccctgtctatactaaaaacaaaaacaaaaacaaaaaacccacagaarttagctgggcatggtggcacatgcctgtaatctcagctactcgggaagctgaggcaggagaattgtgagagccccggagatagagtcttcagtgagccgagatggcgccactgcactccacgccgggcaacagagcgagactgtctcaggaaaaaaaaaaagaaatgcatcttgcacatttggtagagattatgttgcaggctttggtgacaatttgcatctggtggaagtctgagttgctttgctaaaggcctgtgggttgggcatttctgcagggaaggctttgggaggtagagggttgtggggctggggaaacaaatggtctggagcagggcagccgcgtccagggctcactactgcaaaccaaagggtttgtttagaagaggtaatgtgcttccattaggtgagaggttccgttttgttttttttcatgaggcaggatctttattcacatagaaatggatctgctttaacttctggatttttttttttttttttttttgagacagagtttcactcagtcgcccaggctggggtgcagtggcgtgatctcagctcactgcaacctctgcctcctgggttcaagcaattctcctgcctcagcctcccgagtagctgggattacaggcacctgccaccayacccggctaattttttgtatttttagtagagacggggtttcaccatgttggccaggctggtctcgaactcctgaccttgggtgctccgcctgtctcagcctcccaaagtgctgggattataggcatgagccatgacggcccggcctggatgctcttttttttttaaatgcagttttaggaatcacctgcctttcattcattccccaaacttccagtgcccatctccatctagtggtgggcccgctgttcgtcaggagctgcctgttgctgactgatggggaatatcctagtgtcccatcctgggtggaggatgggtgagcgtgttcgcatggcccatagttctggctgacgttctagctcccgtggctaacggctacctggcagctcacccacccattttcctgtgtttgtggctctgttgctcagttgtaccgaggagataagctcatataatatttagacttctgatttgcgagaaacttgggaacacaagtcagtgaaggtcagagaaggaaatcagatgagacgattagatgctggccctgaaagttttcctttcgaatatttgcacatttctcgttgacccttcttttcctgggtattgttaaagaagacagaagtccattttcttgcttagataagagtgctctgagaaaacacagaaaggcagggggaagaattcccacccatttttactgccctggggtcaagacatttgacacaaatgaccatattactgtgtttgtagaatgatgataatttctgaaaaatggtcagttcaaaaaggctttcctgagacctcactggacttgaaattacagcacatccagaatgggctgggacgatcctggcccctatcttgtggcctgctctgtcctccacgaacagtcactcctcactcccgctcttctagagggggcagcggagaaggtgggccatgctgatgggagtgatctggggcctttccactttctcctaatttcctctgggctggatgtgccctcctgacccatgctgtcctggaagggatccactgtcctggggaccaggcagagggatgtgtacatccctgaggcacctcatccttaatcctgccttcatacacatctcaaaggcaggcccacacctgggtccagkactgcacagtctagcctggcccctggctgggcctgtcagrgcacatgcgagcatgaagtgccagacagtgagggcctgtggagcttgtccttgacaagctagaatctctctgtgccttttggggaccccttggctgtgtgacagggctagcattagcccctggagctgggcccacataggatggtctgtaggaccctcttacatttgtctttccaacgttggtctagcatctgttccccaaagggggaacttcaggtggaggctgaggtagcgctgtagacagccaagcttccgctgtttggagggtctcaggggaagccctgtgcactctatgtgtcctcatctttgctttgatccttagagaaaggaactcacacatgcaccgtagagtgactgggtgggaaaagtcttcctccttcaccaaatggcaatggtgtctctctctatatatatttctttttctgtagagtagatagcaaagatgagagcaggtggaggaaatatatagggcaggttgggaagggatccagatgcccttttcagctttgatgggtccatgtttggccctgaagatgggattgcctcaagccaggcaggttgatggagaatcactggagacattggcagaggcctccccctgccaggacaccttccaggatgtgtgatctcagtttggaggtgcattgggccacaagtatggggcctaggctggggcgtgggggagatggtgtgggaattagggtggggacaagctgagggctttgggttgcagggtgatgaaggggagtcctagtccccacccacagatrtgtcagcctgggctgggaagctggcgctgccgaggtcagcactgcctgggtggtggtgagatcatgggcagatggcctcctggttccccattggccctggctggagtcacagcgtgggcttgcccctctgaggacgcagaaagcaatggccttagagttgcccctctgctggtgaggaggatggagtccccattttcactgctgagctccaagactgtcctgcctcaccctcccacctcatcctgcctctgggctgcctactctgccccctggcctccagggactctccaggggtgacactgtttcccagagcctctccacactcaggttcagagaaccctgtgctattgggcagcctccccctggccaggcattccgctggcaccagtctgaggctggtgtggccctgatgccagcaggtagcgtgggacatggcagtgagctgtgagggaggaggggaggctgcagggagcctggaagcaggagygtgggttcctgcgtggttccaccactgactgagtgtggctctgtcaccttccttagttgccccatctgtaaaatgaggccttgacctgaatgacccagctctgacatcttgcagttttaggagcaggaaccgaattttctcgtagaacttgtttttagactggtttgggcaaaggacgtccatgcagttttggggaagggcaccctgcttgcatatgcattccaccttggccaccccaggggaagtgccctcacctcccattcttctcccttcctctgtgtctctccaggggagtgccttgtcacwggtcaatcmcacttcaagagctttgacaacagatacttcaccttcagtgggatctgccagtacctgctggcccgggattgccaggaccactccttctccattgtcattgagactgtccaggtgagctttgccagcccggctgctggtcgggtggtagcccaaggtgctgcatagctgctaggctgaatgggcagtccctggaaggcgtggggcattgctttctgtgcatgagggaggtctcttccagacttcagttagctcctcattcatccagaaacccagcccatcccctctctccctagatgctggcggaaggcatcctgccctgacaataatgcctcctcagggctggctcagctccccacccagtggacgcatcctgcttgggtctagcctgttgcccccataactaaccctctgatgtttggagctggggatggctggggtgggggcaaagagggctggtcttctcttctgaactctgtggtacatgtgtggcttcctttctgtagggatggaagcaaagatgaggacgaagagaatgcacagggctttccttgaggatcaaagtctttgattctctttggaacagtaggtccaaggaacacgatgaagcagaggcccatggttctttataagagactgggccaggctgggagaaggcgtgtgcaaggatgcacttagcaagccttcttgctgcacaactctagggggccccattcacatggagtattctgggagaatggagttgtaggttatgagaaggccagaggctctcgggttgaggcctttctctgattaagagggtcctgggctggggagctggataggcagggggtgcagcaaagtcaccctgtgttccctcttggcagtgtgctgatgaccgcgacgctgtgtgcacccgctccgtcaccgtccggctgcctggcctgcacaacagccttgtgaaactgaagcatggggcaggagttgccatggatggccaggacrtccagctccccctcctgaaaggtatgcttcgtcctgctccatcaggcctggggctggcacagcccatcccttagcaccctccttctcaaccctggccactgtccttaaggacctgcatgcctcttccatgggaatgtgatggagagttatttttggagggcagggtggggtgcttggcatgcatccctccaagaaaggaaggcttcctggaggaggaagactagagaaggaagcctatagatgaagaggttgctctagacctgggacagagtgtagatgggaaaagggaaccgagaggatttttatttggcttgaaccaaaggggcgagttgagtcttgggcaggtggttctggtttgctctggggtgggacaggggcagaggctgatgctgagagatcgggggtggctggtgatgtcacaccagaggatgccacttggggcgaggccaggtgaccctctggcctgtctagaggtagcaaaaaacctacctgtccagtatcttcacctgggttgcactgtgccggtcaaagcaaacctgcttttgcatggtaaagctcccaaacttcacactcaaagtggctctcagactcttccttcttctccacaactgctggccactttgtcgcccattatcctagcattgcacacagcggatgaacttgggctagtgggtacccagcacgtccatgggtgttatgctgtgtgtctccttataagatatgtttgttcccccagggcaaggggtgtgctcctatctgtcgccaccttcccacagaagcaacaattgctgtattcagtgtcgtacacagcatcgctcagacatgaggtggtgtgcagtggcagagtgtcccaggcacattcagatgtcgtggtgtcaatgctaaagagatccccctctgctccagggcacctgcctacagcccaggatgcaggagcctctgcctccctcctgtggcagtagggggaatggcaggtcatagcggggggtgcagaggcttcttcctgggggaccctatttgcgctctgtccaccttgatcrcccttcctcctgacacccccttaaacctcatggccaccccatctkcccctaagtcattgctcttcagtgctaccatccttttgagacaccccatttcctcccaaatacatctgcctgccaccaccctgtcctctccccacctctgcctgagtcctgtcctgcygggttccaggtgacctccgcatccagcrtacagtgacggcctccgtgcgcctcagctacggggaggacctgcagatggactgggatggccgcgggaggctgctggtgaaggtaggtgccctcacggggtactggctccctgcggcccgacccttacaaagtaccccttgtgctctgggtagaatggctttgtgtggtgggagaagaattcctttctcctcatggcctacacccccagagcragaaacaggcctctcttgtttatgaggctggtgtttgttttctggatgccccttcttggccctggggattcttcctgctgggctctgctatcccaagggcctctagactggggtgggctcttgtggggctggggaaggagcaggtttgctgtccaatctcccggctgaaacaaggcccgggagcaggggtgtctccctgggtgcccactgtgggcagtaagggaagagccagattggcactctcagctaagagaaagcctgcccgggaaaggttgctcargaaaccaccagattcttcccctggacactgggactctgcatgtgtgggccacttcctcttgttcttggtggtcctggaatcacactggatagcaatccatacttttcactgtttctctggaaatgaccctggcaggtggacagtgcaaatattactgccattttataaatgaggcaaccagggcacaggaagtggagggatggtgcmgcactccagaacttccagggctaggatagactcctctgatcagaggactgatcccactctgacccccaccaaccgtgtcatggcagagcgaggattagttctctgcctcatgcctttcccatcagaacaaaaagtggttctcgctttttggtcttgaatgcctttacactcttaaaaattattgaggacctcaagatcttgtaggaggattatatttattggtatttatcagattgaaaattaaattagagacatttaaaatatgtatttattaactcattcaaaaattataataataaacccactacacattaatataaacatcactgttttggggaaaagtaactgtttgccagaacaaaaataagcaacaagaataataccactgctgcacatttctgcaaatttctttaatggctggcttaataggagacagctgggttctcatatctactgctgcattcaatcttttgcaatattgcatgtcatgtggcctctggaaaattccactctatacttgtaagagaatgaggagggaaaaggcaaatagcgtcttcatagtattatgaaagtagttttggtctcgcagaccccttgaaagtctcagggacccctatgggtctcaagaccacactttgagaaccactgcgctagattatgcctgggatccctggagagcctcctcctgcctcctggggtcctgtattccacagggtccttgctataatcctgggtggcaggggcagggtggcaggtttcacccaggagatcctggcgtcctccatcctcgtgtggctatgttctttctcctgtcttagagctcctgagggaatttcaaactaactcctttttttttttttttttccttttatgaaaataaacctgcaaccacagaccataaagcaggaaggtctgggagatcctcttgtcaacctcccttttccagtaggaaataaagagccattatttctggagcaggagtaacttgccctaggcctcatggtcgtttagttaccgggcaaggaccagaactcgggtctcctggttcctgaccagtcttgcctcctgcaccccggtcttcaagggggtgcttcacgttagccagttcactttctttttgtttgttttgttttttgagagagggtctcactctgttgcccaggctggagggcagtggcacgatcttggctcaccacaacctccgccttccaggctgaagcgattctcctgcctcaacctcccgagtagctgagattacaggtgcccaccatcatgcccagctaatttttgtatttttaatagagatggggtttcaccatgttggccaggctggtcttgaactcctgacctcaaatgatccaccctcctcagcctcccaaagtgctgggattacgggcatgagccaccacgcccggccagccagtccactttctcagcatcttcccacctcacagagagggtgctctccacccatgcactttctccccttgatcagcagggccgtaacttctcatcctgggcagctgcccttcctcccctcaggtttctttggtctttgtctctcccctgaggagaagagaagccaacttctttctgtgggaggggatgtagggttatctttggggtgggtttgtgtcagtttagctaacaagaagacgtttccttggccaaggttcaggacagggtcagatgaccccatggcctatagaactgtctttttatatatatttttcttttttctttttctttacacagattcctggggctcrtggaaagggactatcttgtgggttttattatgaagcaggaaagggggtgtttgagttggggcaggaggtggggagcctcagaatactgacaccagggcttttggggatggaagtgtggaggcgagagctggagggaggccagctggggcagaggcggtgcaagaggaggtgcagctaggggcccccyggtctccttcccctgggtgtgttrtgtacgctttgtccccgtggggctggcggtccaggcagcaaggctccagccagcagaaatcacatcctctgtgtgctgyttccctgccctgctggctgccctgcagggcccagctctgccttaggcatagcagtgtggaaaagatccttgcacaggcttcatttagtcagaactgtcactgaccagaggtttatttcaaatagtgagtgtcgctaagtgacactaagagagtctctaagtgtcgcccccactctcctaaccctggccgagctgacctccgagacaagccaaggggatgggagragacctggttttagagtgggrcatgggagtgatggctggcttggtgggggtgaatgaaaacgcctttggggagcatcaaactctgagaaaggagagagaaaagatgctgagaggcgggaagggagtggaggtgcaccaccagttatgccgccttgcccagggtgccctgactgcgggcattgcattccagcrcatcaggaggagaacctagtcattcacttacttattcattcatttgttcaacgattcattcattcaacaaacacttactgagtgtctgctggcactgctgtggactgaatgtctgtgtcctccccaaatttatatgttgaaatcctaacccccaaggtgatggtgttacgaggtggggcctttgggagatgakgaagaatgagatttgtgcccttttaaaagacctcagagagcttgctagccccttccaccatgtgaggacacagctagaaggcaccatctatgaaccggaaagcagggtcctcaccagacaccaaatctgctgatgccttcatcttggacttcccagattccagaactgtgggcaatcaatatcagttgtctataagccacgcagtctgtggtattttgttatagcagcctggaagggctaagacaggcaccattctggatgctgagattacagcagtgagacaaaacagacaaaaatccttgcctcatttagcttaagttctaatggagagagacagacaataaacaaagcaaacaagtaaattatattatagatcggaaagtgatagatcctgggggaaataaagcagagaaaggggcaggatgtgccaggattggggggatttaaattttaaataaggaggtgggagaaggcctaatgtgacaacatttggtatttgtcaagcaaacaaggaaacattactctgtcccctttcttaacagtgtttacttgggttcgatttctatgggcctgggaccttctactggattgttaaccctgcattttgttaggttggagctggaagctgaaaaggggctctaagagctgaccctagcccctgagggattcagaacgcagggaggtcatcccaccttggtaatgacatgcggagagggagtcaggactcctgggtcccagcccccgctccaccttcaaatcggggtcctctccgtagaaaccagcagatgcccccagctgtgtgggggaagggcgggctccactctgctggttgttcccgaatgtgcactttgggctcagaactttgttcagttctgagaatggacagtaaaccacatgctcatggcctggagtttgaactgtgccgctgctttgctgctgtcaccctggcaggctgcctcagagcctctgcagactcctactcctatccatcatcaccctcagagtcttctgtggctcgtggccctttctcttcagtgatgcccagggcctgagtggcaggcagcaggttgtggggaggtgtttcttgtcattaaccgtgagctcccggagggcttggaccacacctggcagcctgctgggcccacaccgagtgaccaacgcgaagtctttctatatagaggggccttgagtttgcacgtaactctgggtgggggggtcaggcccactggtgtggatggcacagagggcagagtgcttcgggctgggctcaacctgcctactcaccctagctccgccactacctccctgaccttaggcaagtcactttgcctctttgggcctcccttctccatccttagatgatctgataatttctaaaatctcttgtggcagtacagggctctgatgatttgggaacagggatggagctggtaaatttacactgcagttcactttcccccgcccccccttttgcagcctagggcttagctgccttttattacattcatatttatgtttcacccggggaacttttttttttttattaaaaccatctcattagctaaacaactatgccgctgctttcgcggcagcggctccagagtggcctggtctctcctgcagctgtcccccgtctaygccgggaagacctgcggcctgtgtgggaattacartggcaaccagggcgacgacttccttaccccctctgggctggcrgagccccgggtggaggacttcrggaacgcctggaagctgcacggggactgccaggacctgcagaagcagcacagcgatccctgcgccctcaacccgcgcatgagtatgtgaacccgggggcaaggcagggacctcgcagaatctcgaggtctccacattagtgcagtgcgttccggaggcagtgctcccaccgcggagggcgggggcggggagcgaggaaaggggtcgggctttgtttttaccgtcagcacttgatcatctgaactgggccatttgctcttcaaagtccctttattgggcgcccgccacaggccaacccccgggaaagaaaaaaaaaaaaaaagtctaccgaggcgggaggatcgcttgagggcaggagttcgagaccagtctgggcaacgtagggagcccccatttctattaaaataataataataataataataataataataataataataataataaatttgccgggcgtggtggggcgcgcctgtaatcccaactacttgggagctacgtgggacggttgcatgaacccaggaaggcaaggccgcagtgagccaagatcgcatttctgcactccagcccgggcgacagagcaagaccgtgtctctccaaaaaaaaaaaaaaaaaattccatagtccccgtccttcgaccttcccagtctactgcagcagcagcttacaaactcagcgttagatgattgtaagataaatggacttgggggtgggggtggcatttgcagatttctctgcgtgaccttgcagccctctattagcagcactgggctatttccaggggagtgttgaccgggagggcgtggcccccactcctccccaccacatcccaggctcgctcctctcgccccacagccaggttctccgaggaggcgtgcgcggtcctgacgtcccccacattcgaggcctgccatcgtgcygtcagcccgctgccctacctgcggaactgccgctacgacgtgtgctcctgctcggacggccgckagtgcctgtgsggcgccctggccagytatgccgcggcctgcgcggggagaggcgtgcgcgtcgcgtggcgckagccaggccgctgtggtgcgtgccctcccwgcccgcagycctccgggccgccccccaaatccrtccacgtgtgcttttcgaagccctttctctgcgttgtttcctgtggaaagagggcgtagggcattgtgacaaacacgggtggggaggacggttcatttgcacccacttttcccttccacctcccagcaggacaggcggtggggaccggctgatgattcgggcctgttccaggaagacaggttggctcctcctacctggaggcctagaacgtgggggtccctgcaaagcttgggtttcccgtggccgctgccacctagtgttcgttcagcacagaaggtcaggctgtggagcgaatgggtcccagatcccactgggtctccgcctcccttaagagtccgatgaaggcaagggaaattcacatacaaaccctttgcttgtaactccaggcaaaccaccgatggacaaaacctctggcgttgtataaagttacctaaaggtgaattacatcactgtccccagttggctttagattctcactctgcactgttggattcctggcaccagaggtggtatctattgtgctcacttttttgtttttgttattgctctggggacatttgctgcatgcccagtgtggtcgggcaacagtgatgatgtggaactccaaacttactgttagagtcacagatggaaatggccgccctactagatacctatcctactaagtgaaaggatragtagattcagggcagggaaaaccaaggaaggctttctggaggacgtgtacttggctagggttttaaaaagctgctttcttggcagagaagacttgtttccaatggtagaatcatagtaggcatagaagtgacgagtatattctgttaagaataaggcatagtggatattctgttttttagggtaaagtagatgtgtttagaaattaaaatgtaggtgtagtcccagctacttgggaggttgaggcaagaggattgcttgagtctaggaatttaaggctgcagtgagttatgatcgcaccactgcactctgacctggccaacagagaaagaccctgtgtgtgtgtgtgtgtgtgtgtgtgtgtgtgtgtgtatacatatatatatatataaagtagatggtcctgttggaagaggagttatgagaaacagtgaaaggaattagcatctatatttcaggagcagtgtaggcatggggaccctagaagtgctactattttgggtccaatgagccaactcatgttttgagttgtagaaatgtcatatgaaagaggagcagagacaacagtaaggacgaaagggacgagcacataatgcagccgttgtgccctccccattcctccagctctgggatgtcttggggagccacaggctaggggctgggacaactgggtctgggtccttactggcaactttcccgtgaggtaccagttatgggaccttgaacccttcacgtaacccctttgcacttcagtttcttccttagcatttgctatttagaaattggggaaagtaatgaggagtgaatgagatgctgcttgtgaatattctttgcttgtccaccagtgttagaaatgatgcattatcagtatgtggcagcatccgcaggatttcttaatttaggacattctcctggaatgctaagggcccactgaaatattctttaatctgtcatgaacagccattcttaacctccactgaacagaacaggggaaatgggctgatgcttcagtagtggggataagattcagttaaagaatgtcttgactcctgaggcattacgatagggtagaaagggtggtaggaaggagctttccctggagactgttaaggacaagaggggtctgtctctgtgggtttatgtgacaagagactgggctgaccagatggccttgggctgtccctttgtacccaaggcagttgggtaagtctcctgggttcttgccccaatcttttcttgacttggagaagagctcaggctcagctgtcccctctacccacttccactttctcttccagagaaatgaacagagctccctaaaccagtgaatctattcgtaagaagagttcacatcaattggagacactcagggagcacagacttaccatgtagctactttgtgggatggtgtgaggagattgatgagaagcacacacattttttttcctcttgcaaattggttgtgctccctttrggaagacaggaccacaggctttctgaaggcaaggaccagggctggccatctctgcctccctgggcctagcatagcccctggcatgcagtggatacacaagaagtgtctgctaaactgagawgtgcattgtttctttggggaagaaggctaaaggagaaatttaataaggctccaagccagcyctagagatagcctatcagaacaaagaaagttctcaagtctagctgctttttaatgggtaaaatgtgcccttgtcattgtaggctcaggtggttgaaagacatctccatctttattgtctaacacatcctgtcttaacctacactccctcagtattcatccaataatccaacctttccattcttgcagagaaaaatcaatgtctaataggattaaagaggccctcccttcccagctaccttcaaacaccaagttcagggtggttgtaggagcgggaggctgcagggtctctccagaggctccccactccattgttcaggctcacggccaaggcttacttttataacatctgtgaaatgccctgccagtaggtttctgctggagcaatggatttgaacagagaggggaaggattgtgatggtctcagaagaagcatgcccagggtgaggttctcatttcttgggcagcagctggtctgcacagggaaggcattttgaaagggcagaatgctccccacaccttccctgtcctctaccctgcccataaggaattttgtcaccagaatgccagagcttctgaggcctaggcctttctctggaacactccttccttcttgggaccgctgagctggggctgtttccttagcaataagaataataattattatcagtgaacattattagcagtgaacattctccacatgccagacattcttctaaatgtgttagctcattcaaccttcacaaagactgggtggatactgttattccatccagtgaggatactgcccaagrtcacacagccagctagtggtggacctgggcgtgaacccaggtatttgggatacagagcccgttcccttagctgcgttgccactttgctacacttcctyctggcttgtgtctcttgcagtatttttctgtgggaggctagggagggtgagggctgtgggcagatgggtgcagcccatttcgctgtggtaggyatgagtgtccctcctctttgggaccagcatgtcctcaaagggactgttttctttctagagagtaagggttatgagcatgagctttagggctgcagagagctgagttcaaatccttcctctgcttcttcctgtgaggtatacccctaacaagtcactcagcctaagtttcttgaaagggggtgatgagagctaactcggcatgaggcatagagcccacgtaagagcaaggcattcagtaggtgctccataaatggtactcattgttgtcacggggtatgcccttgcccgtcattcccagtactttttaatattcacagcttcaaaacctgccaggatttctactacatcctaggctttgagaattcagagatgactaatgcacattccctgtggttgaggaaaggagaaaatgtgtgcccccataattataatacatatctgcatgctgaaaaatacacatttgctcatagtgggaaaggaagttgatgaccatacagatataattgggggtcacttggggaaaactgggtaaagggtacatgggatctttctgcattacttcttgtaattgcaagcaagtctacaattatctcaataaaaattttaattaaataattgggggtcacagctacaaggggtggcaagtcctagaaccacagtccttgctgtccaacattcccgctgaggccttacttcttctcctctctcttctagagctgaactgcccgaaaggccaggtgtacctgcagtgcgggaccccctgcaacctgacctgccgctctctctcttacccggatgaggaatgcaatgaggcctgcctggagggctgcttctgccccccagggctctacatggatgagaggggggactgcgtgcccaaggccyagtgcccctgttactatgacggtgagatcttccagccagaagacatcttctcagaccatcacaccatgtggtaagtgcaggcagcagtgtcagggacctctaaaacagcagagctggggaggaaaacgggacccccaagtcctttacttcatggatgggtaaactggggcccaaggaaggaagtgacttgtccagaactgtacagcaagtcagaagcggagctgggatttggtccaggtcttctgacttccttactacacagggaactgggattcctggctggcagtaggagttcttgagttttattgccaactgttatgtgttggcccccatttctgggctttaggtctcagttttccttttctggaacaggaaaagggagatctgcctgtcaccctcctttccagcctgctttcagtattctcaagctgaagcatttgagcaggaagaacatggaccactgcagcgctgcctccatggggcattgctaccctgacctgcttcatgcacttccccaaaatagctccaaatcatgcttgcttcctgcagctctttgcctaggccttctgtgacagtcggtttcaacagggttgccatgagcgtggaagaaatttacaacaggacatttgttgagcaaacacttacctgtcacctgttctgtcttagttctggctaagaattggtggtctaaagatgagccaggctggggcagtggctcacatctgtaatccccagcactttgggaggtggaagtgggaggaatgcttgagcctgrkagtttgagagcagcctgggcaacatagtgaggccctgtccctaaatacaaagaaaaaaaaatagttggccatggtggtgcatacctgtagacccagccacttgaaatactgaggtgggaagattgcttgagcccaggaagccaaggctgcagtgaactgtgatcgcgccactgcattctagcccgggcgacagagggaaatccagtcaccagacacagtacctgatagtctactagggaagaccagttagaaacatcccrattggccaggcacagtggctcacgcctgtaatcccaacacttagggaggcygaggtgggcggatcacgaggtcagtagatcgagaccatcctggctaacacggtgaaaatacaaaaaattagctgggtrtggtagcgggtgcctgtagtcccagctatttgggaggctgaggcaggagaattgcttgaacccaggaggcggaggttgcagtgagctgagatcttgccactgcactccagcctgggtgacagagcgagactctatctcaaaaaaaaaaaaaaaaaaaaaaagaaaaaaagaagtcctgattatggaaaatttcagacagacattaaagtagagagaatagtataaggagccccaacgtatccattcccagcttcaatgattatcagcactttaccattcttattttgtctattgactcctctgctgtgtggctggaatagttttttaaaaaagctgtaaatattacatcatttcacctgcaaacacttcagtatgtatttcaataaataaacgattaaaaaagtaaaggtaccattattaacctgaacatgaacaataattccttaataacgtctaacattcaatccatgttcacttcttttttttttttttgagactgaattttgctcttgttgcccaggctggagtgcagtggcacartctcggctcgctgcaacctccacctctggggttcaagcgattctcttgcctcatcctcccgagtagctgggattacaggcacctgccaccacgccccgctaatttttgtattttagtagagacggggtttcgccatgtcaggctggtctcgaactcctgacctcaaatgatctgcccgcctcggcctcccagagtgctgggattataggcatgagccaccacgcccagcctggaggattgttttgaggtggagcagaagtctagggactaaacgcacaaggtgtactccacaatccccaaggtaagtcctctggcatgaacgcatgctatatgaaggaagactaagactggagggaagttgggatgaggttcaggggtcttcagaagtgagggggtgagcactgatgctggagcagtaggaatggggcccctggaaggttcttagcagggagcaaataggatccaagagtaacttcagggggtgggttttgggagctgcatgaggtatgatggcagggagagcatctgcaggaaaaygttgacgttgaccgataagaaggtagcgaggccttggatcaagcgatagcagtagaaatggagagtggaagccagaagccagagacgctgggaaagcagatggactagtgggatgtttgagaggaggaggggctgttgcagatggccctggagttctgaacttgaatgcctgtgaggacagtgacgcaagaacagcaagagggccctctggaggtagagggcaagtgatggctttggttttggccttaatgactttgagttaccatcttggtgaacaaatggaatcaacagcttgaaatgggtctggaaggtgagtgagaggttggggtggagagaaagacgtacatggaggtgacagtttcagccatgagagtagcgaggatccctaaggggagtgggccagagggcagaaaagaggactgagtcagaacttgggggaatgttcagagggcaagaggaagaaaaagaggattgcatgagagaggccaaagrtcaaaggccagtaaaaagggcagaaccagagcagtgccatatcatggaaatgaagggcagaagggagtaaggacctcctctgcaggactgctgacttggccttagcccagtgctgttttactacagttgtctggctatagtttgccaggagtttctctctgggaccttaaaacaacactgttgggcaggcatgacttgcttttttagtaaagaatttgaggcttagagagactatcactttcctaaatcagccagcaagtgactagagcccagggattcttgaactctccttattacagtgagaatagacggttgaatttggggatcagaaggtcatggtggcctctgtgtttcagtggtaaggatagaggctagactataggaagttggtatgacttgggagggcagcaactgttgctggctatttcactaaaacagagaaggtgggagaaggtgcgccttggcccctgggtgaacagggttggggagtgaccctggctttgggctctttttagggtttgacatcagcgacctctccatgtctgcgtcctccttgtctctcttttaggcaccagggctgaaagctattcagcagcttgtctttccacttcatttagaaaattgggtttcacggagaaggtgtgttggaaggacctcggggcctgtgtgccgctgtttatttttattctttagacaacacactggagaatgagcctcgctggagcaggtgctagtggtggtcgtgaaaaggtggcaggagggtgaaatgctgtggcctggaggttctgcagaccgcgtgcttggtcatcccagcggccatcacaatggagtatttcttcttctgcagaccaggctcagggccaggagttgattttaaacctatctttgaggctttttagaaaattaagcttttgggtcatgtccaaatgacagattgaacatgacatttacgggggcgggtggaattttctcccttaaaactaggtattagttaaaaaccagaagaaggcacgggttctgcaygtgctcagaaagggaagggctgattctcttgttyattcaacagatatttattgaacagcagctgcattaaaaatgttcaaaatcattacagtcagctgggcaaggtggctcacgcctgtaatcccagcactttgggaggccgaggtgggcggatcacttgaggtcaggagtttgagaccagcctggtcaacatggtgaaaccctgtctccactaaacatacaaaaattagctgggcatggtgatgygtgcctgtaatcccagctactctggaggctgaggccggagaattgcttgaacccgggaagtggaggttgcagtgagctgagatcatgccgctgcactccagcctgggcgacagagtaagactctgtctcaaaaaaacaaaaacaggcagggcacgttggctcacgcctgtaatcccagcactgtaggaggctgaggcgggtagatcacaaggtcaggagatcgagatcatcctggccaacatggggaaaccccgtctctactaaaaatacaaaaattagctgggtgtggtggcacatgcctgtaatcccagctactcgggaggctgaggcaggagaatcgcttgaaccagggagtaggaggttgcagtgagccgagatcgarccactgcactccagcctggtgacagagtgagacttggtctccaaacaaaacaaagcaaaacaaaactgaataaaattattacagtctgagaaatgcaaattaaagcaatgagtatgacttcatactagactggaaaaattagacatctggataatgcagagctgaggggcatgggggcctcatctgcttttgtaaggcatagactggttgagtcatctaggagagtacttggcacatcatgtgcaggtcaggtattcacacctgctatccccgcccttctgcctctgtgcagatagactaaaatccttatacacattcattaggacacatgtctgcagatgttcagcacagctttgtttgtggtggtaaggagcaggtgacaacctatgtcaatcactgggacactgagtgggtaaaaggtgtattgtgcaacagaagtcacagacaagtggtccgtgtcttcacagggatgaatcttacaaacacggtgctcgatgggaaaagcaaaacacagcatgctatgtgatatcatttatacaaactaaacatacatacaaagcaaccacagacgttttataaaaatatgcagtcagttaggagacttttacatagtccaggcaagaggtcatagtgtcttgtctcatgacagtggagataaagtggatatgaatttcagtggtatgttggaggccaagtccaagggcttgatgatgaatcagatacagaggatgagggagaagacagtggcagggatgatcytgggtttctggttgcgaagccagatggatggcgtcaccattcagtgaatcagccctggaggagaattggctttggtcgggggatcatgagtttagttttgaatatactgagtttgaggtgtgtttgagactcactacattagtgagaccatgtaggcrtttgagtatatgggtctggggttcaaaggagcggtccgagctgctgatgtagatttatgagtcatgtctgtgattggaactggggatggcagcagagtgtgagaagaggagcgagcctaggacagagcctggggaaggccgatattgaaaggccaggcagtgggggcacatgaaagctgaggctgagaaggaggaaccaaggaagtgggaggaaaacctggagagagaaatattttttttctagaagagtggagtgttcaacagtgatgaataatgttgaatgggatcaattaagcaaataactgaaaaaagtcccatgggatttagtgacgtggggatcatccattggtaacgttagcaagctgtgcttcaggaggggttatgggactgggacctggttggaaggggcagagagtgagtgggaggtgaagatgtggaggcagcgagtatagacgagtctcgtgaagctcggctatgattttcttctctgcagctactgtgaggatggcttcatgcactgtaccatragtggagtccccggaagcttgctgcctgacgctgtcctcagcagtcccctgtctcatcgcagtgagtactgtccccctggaaggcccattgactccatcctgcccagattcctcacgtgtggaatggcgggagagagctgggtgacaccgtcagatgtgcgtgtgcacccaggcatgggtctggcttcgcccaggatcgccttcatttctgggtttgtgtgagtgactttcaggccaaggcatgtctttgcatgtgtcaatcccgaccattgaggcaaggagtatttgatttcgtgtaaggggaaagacctgcagataaattctatgagacccctattttgcccgtggagaccttaacccagtggatagctgtgagttggtggccttgattgtgatgacagtcacccttctttgatggcctcttgtttcctatggacatgctgatgaagacagctcttccttgagaaagcttcttggatgggtttgaaagagagaaagagaagggttgggtccgttgctctccattcgaaggtcctaacggtggctgcactgtcttttttttttgagagtctcactctgtcacccaggttggagtgcagtggtgcaatctcagctcactgcaacctctgcctcctgggttcaagcaattctcgtgcctcagcctcccaagtagctggaattacaggcatgcgccaccacacctggctaattttttgtatttttagtagagayggggttttgccatgttggccaggctggtcttgaactcctgacctcaagtgatctgcctgcctcggcctcccaaagtgctgggattacaggcatgagccaccacgcctggcctgttgtactgtttaaggaccaggcatggaagggagaaggggctgacctggtactgggggtttcacatttacatttatggattgcagcacccttatttgcttccagaaggcttatccttgcttagaaaggactcttccagtgggagagagataaatggctatcttcaatctccagcttgactgcttccctctctgcctctcactttccacaaggctccttctgtccaagggacccagttctgtgccatggtgtttgcttcctggcttgccctgcgtgacaggtctggctcctggcgtgaccgactggagagcgtctctcagcctagagctggggcaagatcccgagggcatgggtggctcaaaggttgagaccagaacttgtgacctcaagatcactccatccttctgtgtcttcttctgtccctctcagagagtttyccccacacccactctctgttgcattctgcctctcagacctaccttccgtgcttctgctcagaatcttctagtctggtcactggaaaatgtaatatttttcaaagtcaggaaactcctgggattctgtgcagattgggaaaagccgtttagccttttggagtttcagttttctaacaagagtttccatataaaaataaggcyagaaattttgactgttttgcccagaggagcgagtatgtgatacaaatgctattaagtgcacctgggctttggaaagaaaggtgctgtatcagtcatctgctgtcagtattacccaattagccattgatacctactaattgccacgaagtaggatatgtcaatgcgcaaagtagatagaaatccctggcttcatggaacatgcgttctagtgggcccagtggcttggggaggacagtaaacaagtaagtgagatgtgtagtatrtcagatggtgagaagaacatatataggatatcagaggggaagcagcagggaggggagattggagtgtccagggatggagtgttgcgggtgttgcaaattcgcatggagtggctgggcaggggctgacgcgagcagagatctcttttaaagccattgtggtcagatggccttctctccccacattagttgtaaccatttaggaatgattctgttgggtccattaaaactcctttttagcwcccaaactcaggtcttttcaagcctgggtctggaaatttctgcaatgcatcctgattcaatgtaacctgctatagcaaggttaagggtgatgacaagtatgggacattagatgagagctggggtcagaagagctgccaccaatgtaagccagaggtcagaagcccaggtgagaagatgccctcccagtcccacacagggaccctggctcaggcagcygctggtccccrygagtgggcaactctgagtctcttgaatttagtcacagactctaggggaccaaaggacagtgtggaaggtaggtccattmtctccttcactaatcatctctttgcttttcctaccttcgaggcaaaaggagcctatcctgtcggccccccatggtcaagctggtgtgtcccgctgacaacctgyrggctgaagrgctcragyrtrccaaaaygtgccagaactaygacctggagtgcatgagcatgggctgtgtctctggctgcctctgccccccgggcatggtgagtcaccaggcacagagctggtgcctgcccttcagttttcttgtaggcagggatgagtgagggggctgtgcagccagagagaggaagaaacaagggctaaacacggatagcaatggaggtggtgctggtaatgggggcatggaggaggggaggctcttctgtctcctccctgccaaagtcagggagggagttgttaggaaaatgcctggggttgatcctcacaggatctgacaaaaatataagaacttagcttacaggagtgccataggaagcaaagaatttccagaaaatacgtactagtaaaaacaagcattcccactagaattttcccaggggccgccttccatgctatgaaaatggagggacacatatatatttgcatatgattgacgtatatgcatataattttctatttcaaaaaaagacattgatggccctgccgtgtcactagcaagccatgggcccaacaagtctcttycccacaatgaaacttgttttcctcatctgtaatgtgagtcgtgaggtcttggccagcccttaacattccatgactccggtgctgtgcctgaaacaggcatggaggccgtgcatccaaggccgtgctggtttgcgactcctggctcctatgtggatgttctgctgctggtggcaatgatctgagcatgcctactcctccttatctccctcccaagtctaatcttagccagcgttgtattaaatagattaygcatacatcctgaaggatgcaacttccagatgtttctctttcaaaatgcatcctgtcttcttgttttccccaactccaattccttatacccaaagtgaatggtgaggagttggggcagaggctgtggaggccagaatgggagagggtggctctcagatggctttggaggggacttagtgttgcccaggactctgcttgaggggaagtgtcctggactgtgggacctgtcaatattctgtagagggaatgtggactcaattaccagtgtctctcaggaaggctgggattgcagtgtgtgaaggacagatgcttacttttctacttccccttcaactctttcttctcccaaacagagagaccaactcttgttaattctctcctcctctgtcttagcctctgagggttttggaactgtcttttctgatgaggagagctagcgattggccaatgagcacctttgaactggaagggttgtttggtgccttagcagaaggtggatatcacgaagggtctctaaggtggggaatctcagacctgggtaggaacaaaaaataggagagggcaggggaatcttccttattgctcttctttatccctggggcctcttaggtagagtgtctcagagctttggtgtggggaaagcatagatcattgtctcttcatcatactcagcaggaaaaggaacatcactcagaggactatgtcagcatcggatatgctttgaaacaaacttttttgtcatgaaggaaaaaatacagatagccttaaatattagtaaccacaataattatattatgaccccaaatccaaaaaagaggacagcgggacctcaaatacaggctgtggctatcctrttaggcgctcatttcattcctgaagcactgggcatgcattctgaggacagcacttggatacctgtcacgtgacgaggtgactcgcacttcagccacaggggattctaacttgcaggttcatattgtaagagattcggttattttcacaactgcttccttacgatgccggcgagtgtgcaaattattgcggccagattcgagasagcagagaagtccgtgtaatttattaagggtgcgcagcgtgccgcctgcagcacgggacacgtgttcttggcyataacacaaagaaaatggagctgggcctggaaacaccctgtttgggcccatctgatggtgcagacatcatccctcggggtgttcctctgtccagtctgtcccttgtgaaggggcagggttgtgggatgtcactaagggcttggggaaggggtcacggattctgcattcttctgaggacttgacaggggaaagggaagtggctttttcccgggggcagatctgcggggggcagaaagagcaggaatggggtgcagagggcagacccgtcaggccaggcttccctgctttcccactccatgctcttgtgcaatccttcagtctttaccggaagcccagtcacctcatgtgttacgtagacaccgaattcctgttctgcctccatgatgcatggctgtgggccccaaggagatgtgtgtgaaagcactttaaagccagagagttctacagaagtgtaggaatagctttcattgttgtttctgtaactatccaaggctgtctcagaggctgcacccatcagttcttcctgctgtccataggagagacctgtaaaggatgctttttcttagatttccagcctgctgtggacccatgcttttgtaaatacaataaaaatgaattctcataaaaataaaacaaaagcaatgacaaaaataatatgatcccacccaactaaaaaatattttcagctgggcgcagtggctcacgcctgtaatcccagcactttgggaggctgaggcgggcggattacgaggtcaggagatcgagaccatcccggtaacacggtgaaacgctgtctctactaaaaatacaaaaaattagctgggcgtggtggcgggcgcctgtagtcccagctacttgggaggctgaggcaggagaatgccgtgaacccaggaggcggaggttgcagtgagctgagattgcaccactgcactccagcctgagcgacagagcgagactccgtctcaaaaaaaaaaatttcttttttttttaaaaatttttttgagacggagttttgctctgtcacccaggctgcagtgcagtggcatggtctcggctcactgcaacccccacctcccaggttctagtgattctcctgcctcagccttctgagtagctgggattacaggcgcacacgaccacacccagctgatttttgtatttttagtagagatggggttttgccgtgttggccaggctggtctcgaactcctgaccttaggtggtctgcctacctctgtctcccaaagtgctgggattacaggtgtgagccaccatgcccggccttaaaaaatgttttctttcctttttttcatgatccctaaatctaaactcttacttcccactttttatgacatataacagacataacatgactctgccaaatttccctaagattttctaaacactttctcttagtttctgtgcttgcgtcctcacaggctggccctggcccagggaatgcactttgagcagccctgttctcagccgaagattgtctctcctcctctaaggtgcctctcagtgtccaccgtatgcccagaagcacctgtttgaaaatattggcgggggcagagaaagaacccctctctttctggtttgtcccaggcctggcacctgcttagagcagaggttttctggttgaccccacaagctgcaggctgtatctgctcctgccatcgtgcaaaggtctcctggcatgggaatgaggaggatgggggtccctttgctaagtggtccgcaccgtgataaatgaagggcagagaaaccgcctggaaacggcatggtatcggaacctcayacttccaggtttgaatcctgcctcctaacatctacttaagtgagtggcaagtcacttaacmtcttggcgtcttaattttcttatctgtaaaaytggcttgcaggctgttgggaagactggagatgagagcagcgagcacatgggaggtgcttagtgagtggtggtttaatgaccactaactattacagtaagttcgtggtgggaaacggtgaatcctgccatgaacagagatgctgcagggaattagcacacacaggagcatctttttagatcccagtgttcactttctgagacctgccggatcgataaaatgagggggttgtgctggaagatctcccaggtatttttctctagttcagaaattcttggagccatgcttgcctgaagcatccatctctttaagttagaatattacctgctaccaccactaggtgacagcaaagcacaactcactgccctgctcacccttcctgagtccggcggcaagggtaactctgggagcatcgtagagggcrgagaagaagaaaccctgaggtcccattatgtcagccccttctatcacacgggaggagactgaggacagaaagggaacagagccgggtcaagccttcatagttgtatagtggaaattctggtctcctgactctgagaccagggctcctgtaatctgaaacacttaggcctctgtctgggagatgctgacttcccgtttgaaacctagcagctacatctcccaaactgctggtattaggagsctcttggtggcgagaagtgtggttatgtccctgatcccaggatgtccagtttcctcactggccccatgtgaagactgaaggagttgggcaccacttcttaaagttcagagcttgggttcaagggcccatccagaggcggcctcacatgtgggcgttgcacattttaaaagatccaaagaagggcctgtttcagaaatatctcctacatggtccatgatttgtcactcagtcgggcttactgaaatataataagcaaaaattcattttggttaacaagcgagaggtttaaaaaaagcggaacctcataagtcttcataggaggagtcatcacgctcagcaggagtgctttaatcagatcactctcctccttgcaagcttctggctgagttcagctgctttggcctgaaagtactgatggggtaggagaatgaacgagaggcagttggaaggtaaaaaagattctggagagtgggtcacgatggtgttcacgtatggagagttggggacaatggggccttttcagagaaaggtaacaagaccagtattttcctactttataattttcttggagtggaccaacacgtaggaccacgttctcagcctgacccctttcggactgaagatgtcatgagttggtgagtgatgggacgagtatttttgccaggctttcttctgaagtcttcaggggacattcatagactttatcttagtagccttytgatgtcccgaagggasaaacactagacggaggtggttctcttcattttaactgtgaggtttaagtgacttgccacaaaatttggccagggactgytgtgctggcctgccccgcctctctgcacagctcccctctgggtccaatccatcccctaaattacccctttatttccaggcctatctacctccatgaatttccacctccctgaatgtctttgccactttgggattctctgggtgtttttagctgggctattgttacctgctcttctctcccaagtcaggaagtctcatgctgtgtcctggaaaccctttcctctcrttgaagattatgttttgtctcctctccagctctcttatgacctaactccacaccactgtggccttcatagcagtcctcacttaatatcaaggtcctattataatattgctgtccatgaattaataacctcctcttgctaacacgagtcggcagagagcagccacgtggtttgcagtgggtgctcagaaggaggaggaggtggcggctgcagtcatggcrttgttatctcacacctgagctgggactggagtgttctgtccgctggaggagggctgggcttccatagacccacacctgggtgacaggagggtctccctgggccrtgaacgcatggtgggttgtcccatgggttgaatatcatggcgagaggtaaaaacatgcagcatgcagaccaagaggcctgggagcccccarcccggcctgcccaagggtgaggggcaacatgtgctgctgaggtaaggggagcctggctctgtttcctggagtccgtccctgcacttctgtcccacatggtatttgccacaaggaggcgtattatctggtttccgttgactgtaaggcatccgtgggatacctcagtcattcttatagcagccactaggtggtgggcctcaggcttaagtcagagctgacactggacggggcgatgtggacatgaaccctaattgtgacagaggctttgaatgctctgctagagagaggtttttcagccctgccagctcctaccaaggtgccatcttccctactgggtgcttaagctcattccctcccaagaacagtggttccgggaggtaagagctaccaagagtggggtcaacctgcatcttatgccctgcactgtcatcctgacccatcagctgggcttccagagatgcgggaacacctcctgaggttgggtgaagatgrcattaagcrgtggaggattcttcctatttccctccccccaaccgccccaacacacacatgctyacatacgattctagcctgggtccttgaaagccctttgttcarcccaasattgccctgttcccagggatttgtccagctccaggcctgggagctcagacttgtctggggagtgactgggtcacgtggagctggaactgttcagaccaggagcttctcgccctgcagggagctctggagccaaggtgccacagtccttcacctgggggtgacccrggcctctttgagaacccccaaggctaggccacaccaggacaggcacccagggctgccccttggagtcgggacagaagcgtgtctgcatgttgagctcagagtgggtttggctgactcttctggggctggtagttcttagttcttttattttctcagccccaacagaccggaggaatacaacatgctcacgaaagtagtttcccgaggggtgasgacggggaagtagagcataccccatggagagtgaaccgggatacgggagactgggcaggagggggcctgtggcttggaccagcccccagactctagttctgatcgatttctacttatgcccartatttggccctcacctccagagtrttaagtacatattaattttattcaatatagtgttcattttctttaattataaacataatacatgctcattgaagaacacttggaaaaaaattttaaaactgaaaaagaaaataaaatcctcccactcgcctatcccagctcaccacctggaggcagattctgtatttccttctagtcttttgtgaaatatatatacatttggaaccatatgtatatacagtttttcttcctgtgttaaaaattaacagcataagtatttctcacttcatttaagattcttccaaaggaccattgtaatagcaccataggatactggcgcctggtgattcctcartggatttagtcattttcctattaagtgtttccaatttttttttgcaatgataaataattctccatcaatctttgtccataattctatttccctcagagaaatcctttccttgggatggctaggtgtaagaatatgtgcatttcaaggcctctggacatgattttttgaagtacctttgcaaaaatgtccaggttacagtgycccagcagggcacgagagggcagagggcagtcagtgtctttagttgacagggaggagccatgtagatgggaacccatgtttgccaagccctggcctgggcataggatccctgtcctggcttggcctgcagtggaagctgtccccctggctcagccctggtcctggtgccagtcccagtgctgggcttacccgtaggctcaagtctcagacaacacttcctggagcgggctggaggagggctttagatcagtcactgtggccctgaggacttttggattcttttctcttaggtcyggcawgagaacagatgtgtggccctggaaaggtgtccctgcttccatcagggcaaggagtatgcccctggagaaacagtgaagattggctgcaacacttggtgaggctcagtgaggggctgcgcyggggacccaggccctgcgggtggagtgagggtgcacgcggccacaggaccttccgcacttgcctccagccccctgtgggaacctggttactctctgcctttcctccgtgcctgtgtttctccatctgtaaaatggggagaatctttttcatcacctgtgtccatcctgcatagacactattcaacaggttagtacagtagcccttatccgaaatgcttgggaccacaactgttttggattttggattattttggactttgaaatatttgcatatacataatgaggtgtcttagggatgggaccyaaatctaaacatgacatttatttatggttcatatataccttatacacgttgcctgagggtaagtttatacaacattttaaatatgtatttaatgtgtatttagtatttttaatgtwtgtgcatgaaacaaagttttgtgtacattgaaccatcagaaagtaaaggtgtcaccctctcagccacccatgtggtgtcatgttggtgctcaaagttttgggtttcagaacattttggacttcagagttttggattaggaatgctcagcttgtatttctgttcagggagatgggccccagggaagacagggacctcgccccaccagtcattrcatttgggccaagctgccagtgggcacggggtctggagggtcctttcgttgcaggccttacactgcccatgagcacttcgtgagtgtgcttgcagtggcgtggtttgaggtgagggtggctggttgccttctcccttttccttggccatcctgcacgtaacccctcaccctgctcattcaccctgcctttgacttggtggctgtgcacagccttggaaagaggcctactggacagaggtagagagggctgtctcttgggcttgaggtctgagcttaccacctctgacgcacaagtgggcttcttgatgtcagctctggttacgggtggtggcagggagggacacgtggcagtgggcagatcactatagattttaacatgtagctacatacatcttaacgtgtagctatgcacacaggactgctcctggcagaagtgcgtacttcatcactcttttctatactctgggctttcccactgttctgtcttgtttttcccattagcctcaggctttcaacatcagtgtgtctgttttacagacaccctgtggccaatctcaggtagatgtggctttcagggtgaggctgagcgaattcataacaggaggcctaaagagcatccgggcctcctccctggctgcctggctcactttggacaaccccttcccttctttgcctcagtttcccccttttagggacagccactaggcttccctgtctcctgctgggcmccatrctgggcctatgaagtccacactccaygctacaggtcctcaacttccttgggcttcctggagggttgggaggcacccagagtattctgtgttccttcattgcctccatggcccagatgggcccctcaaacccaaggtgcccaacttgtcatctctgccatgactgctcctagtgtctgtcrggacyrgaagtggaactkcacagaccatgtktgtgatgccacgtgctccacgatcggcatggcccactacctcaccttcracgggctcaaatacctgttccccggggagtgccagtacgttctggtgcaggtgagaggtggggagatggggagagggtgctgtttctttctaggaggggtgggaggtgtggcctcaggttgggttctgtggatctgtctgcagaaacaactctggggtctggtttctactggagtacttcccagtccttcacagaagtgcctgaagcggtaggggatttgaagctcaaagtggttgtccattttccctctgctcacctggggacttataaaacgagacagaagcttgtttgttgttgaggattggtgtgggagaaaggctactgctagtccacattagcacagatgtggaattagaaaaagtcatctgttccttctggtagacacagcctcagtcagggtgcatagcttagggagtgggttgggctgggaagtcagtcccgctcagcctcccttccagcaccctgggcagtgcacagtctgcaggtgttgtgcagtggccctggacagggggatggttgaaatgacccctggagtttgcttcccacgrtatggctttgtggaattctccgccattttaatgtctaacttggtacaattcagaatgggaggagtgggaggatgggacacaggaaagtcatcctgcccagcagatgagagcgatccaggaatcctcacggtgagtgtgggcagcagcccctctgcctcccactccccactgcgtggattcttgtaagtttctctttctggttgacatcaactgtgtaagcaaggaagtatgagtgcttttctcaccagagctgaggcactgtactctgtgaagctttgaacaaatatggtccctctgtctccattcccaggaggaggaggggcgggagcttggtgtggtctgaatggaagaccacaaacccataggagccccagccccagaggctgagttgcaggagctggtgagtcaggcagcgtgggtgactgtggaccgaccactcgtgtagagcatgctgggcatggggcggagccaacagcagcctcctcagtccccacctcacacccgggctggcccasagaggcaggcagtgtgctggggacacagggcatgcagaccaggcagggaacctatgatccggggggatatgcgcccctttagagctttcccagagattctatatggaagtttcccagcctcagcagcaaaagagagggcgacaccagctttgcagaacaactrcccagcccatttcaaatctgaacatccaggaaaaaattaattcagtgcagcaaggaccagacagctggtcagcatctgctgctcccagcccttccctgcccaggccagctttcccaagtggaccagttttaaagactccccctccaaacggtgccccttgtgtgtggcttgttttcctttcctacagctggttctgttgtcttctgatgcattgtcctggggcccctcccctttctgccatcctcctttggggagtatcatcaagacctaactccctctttcagaaatctcagctgaagataaggacaaataaaacacctacacccttgtttcctcttttaaccttcgccatgcatcgacctaacacaaagccatttaacctgacaattccattaagttgaatggaatcttagaggtcagattgtgtgtgttgtatggacatatgtatgcatgtatgtgtgcatgtgtgtatgcatgagcatgtctgtgtgggtgtatgcatgtgcgtgtgtgtgggtgtatgcatgtgcgtgtgtgtgactgtgtatgagtacatgggtgtatgtgtgtgtatgcgtgagcgcgtgtgtgtgtatggctacgtgtgtgtatgtatgtgtatgctgtgtgtgtgtgtatgagtacatgggtgtatgtgtgtgcatctgtgtatgtgtgagcacgtgtgtgagtgtgtgtatgagtacatagatgtatgtatatgtgtgtttgagtgtatgcatgtgcctgtgtgtatttgggtgtatgtgtgtgtgtgggtgtgtgtgtcagaaaggtaagtggtttgctcagtgttaccaataagtggcagaatcaagattcacaccttgtttttattttttctttttttttttgagacagagtctygctctgtcacccaggctggagtgcagtggtgcgatctcggctcactgcaagctccgcctcctcgattcatgccattctcctgcctcggcctccctagtagctgggactacaggcgcccgccaccacgcccggctaattttttgtattttagtagagacggggtttcaccgtgttaaccaggctggtctcgatctcctgacctcgtgatccgcccgcctcagcctcccaaagtgctgggattacaggcgtgggccaccatgcccggcctcttttttcttttcttttcttttttttttttgagatggagtctcgctctgtcaccaggctggagtgcagtggtgcgatctcggctcactgcagcctccgcctcccgggttcaagcgacacactctgtttttctaagttgaacattttatctttctttttcatcacatcacaataatagccaccatgggggaggcatttgccaggaatgtgtccccttttgcttaattttctatgcaattgaccaacaaggaccagagctccttatcctctctactcatctcgacttggtagctcaggacccatggagctgtgtcaaaccatctttggttccatttctgggccagcagtgcagagggattcaaccagaattcagagccacaaagtgccctgtggtcaaactgtcccagttacctgggtgggactctaggcaaggctccagtgggactctaatgggctctaggcaaggcctttgagcctgatgcatccatcgaagcaggccacatgtcaccttccttccctccccctccttccccacccccaccccactcactgcaggcacctggctcatctgtcgtgggcgaggttgacacacctgagggcattcacctgggcatatcccccgtcccccagacacacacagaggcacatatgcgcagccatggacgtggcaagatcctgtgacacgtactcaaaggcctgtgatgaagagatgccaatcttctggtctggtgagagccagtggggataatggtcttctcctggcactcctctttccccaggattactgcggcagtaaccctgggacctttcggatcctagtggggaataagggmtgcagccacccctcagtgaaatgcaagaaacrggtcaccatcctggtggagggaggagagattgagctgtttgacggggaggtaagtgcagcctcatctccaccctcatgtcccgctttgtgcttctgccacttaataggaacattttccaagcattcatttagagctcgtgtgaatggaataacgcacagccattaaagaggatgaggcagagctattgcaactgaccgtgacgtattattttatgagaagaacaagtggcagaacaatagggatgacacaatcccattttagcgacagtgcagagtgtgtgtgaaggatgtgcacatgtgtctgcacaaacgtgggaagaaccagtgctcacctctagagtagggtggggactggagggtagccgggtttctttgtgtgtgtgtgtgtgtatgaagtgatgatgttatgggatatgtttcatatgtttttctgttcttttcagataaatactttatttttttgagatggagtctygctcttttgccyaggctggagtgtagtggtgtgatctctctgctcactgcaacctccayctctagggttcaarcgattctcctgcatcagcctccttagtagctgggactacaggtgtacaccaccgtgcccggctaatttcttgtatttttagtagagataggatttcgccatgttggccaggctggtctygaactccagaccccaggtgatctacctgccttggcctcccaaagtgctgagattacaggcatgagccaccatgcctggccagaaaggagctcaaaagaggagtaaactaattcagtcccctgtgtactaagaacttaaaaagtagttctcataagtgtacacaagactcccttaggagatcttgtttaaaatgtggctcctrgaactccatgctgagattctgactcagtaggtctgggtggggcccaggaaccygtgtttaaagttgcaggtcatccccaggccacagttttggatcckctgctttgactatgtggagtgctgtggagacccaggctctgggcacaaacttgtcctggtatcttcattttctcccatggcctcagcctgcagctctgccttcttccaaatacccaccattgacagcaggggatgggaggtgaattcttcaccattatggaagaaaactgcttagcaagcataaygtattaactgygagtcagcagtgtcaactscatttcaaagaacagctctatttagggcagagtggcggtgatgatgctgaacaggaggtgtgcagacatgtgagggatagatttgcacatgtgattagctctgcactgcmtgtgatatgttactaatgagaggacctctgcaaagggatgatggcagttctcagcctcagcctcagtctgatgaattggagagtccgccacacatgctgaaatggkcctccagggtacagcactggcagggattgggctaagtcagaggctcaggtcagagcccttcttgaacctgcagtgtgtgattcccagcactagcactgagcacctcagtttccttttycttcagctctgtctcctgatgacagtggctctggggagggggaggtggtgggatacaagaaaggtgagagtctactgcttatttttatagaggaatagatttttaaacaatcaactagagatgcttaaaatcattgccatgttgaaaacctatctaggagaccactatatttaatgactaattgtcaataaaatacctgctcattggtttcatagtactttaatttcataatcatgattttgctgctacctctgttaccgtctcttggtcatggatgcctggagagtggtggtggtgagatggtcacagacatgtcctggcgtggggctggccctgcaggggtgcagtggcaggtggggtcctggaggggtggcagtgcctgcactcgtgggcactgaagacagatgggcaggtgtagagtggagggaggatctggctgtcgagcctgcccttcatcctcctggatttcttgctttgtcttcctccaggtgaatgtgaagaggcccatgaaggatgagactcactttgaggtggtggagtctggccgrtacatcattctgctgctgggcaaagccctctccgtggtctgggaccgccacctgagcatctccgtggtcctgaagcagacataccaggtcagtggctttcttgcttcatcttgttggggacttggcctttggagtgttttctgctccctgatcgtaggtctctaaggacttgctttatgaatccrggtgctcctgtgttgggtgcatatatatttaggatagttagctcttcttgttgaattgatccctttaccattatgtaatggccttcttttgatctttgttggttcaaagactgttttatcagatactaggattgcaacccctgcttttttttttttgccttccatttgcttggtagaccttcctccctccctttattttgagcctatgtrtgtctctgcacgtgagatgggtctcctgaatacagcacactgatgggtcttgactctttatccaattggccagtctgtgccttttaattggggcatttagcccatttacatttaaggttaatattgtcatgtgtgaatttgatcctgtcattatgatgttcgctggttattttgcccattaattgataccgtttcttcgtagcatcgatggtctttacaatttggcatgtttttgcagtggctggtactggttgtttctttccatgtttagtgcttccttcaggagctcttgtaaggcaggyctggtggtgacaaaatctctcagcatttgcttgtctgtaaaggattttatttctctttcacttatgaagcttagtttgggtggatatgaaattctaagttgaaaattcttttctttaagaatgttgaatattggtccccccctctcttctggcttgtagggtttctgccaagagatctgctattagtctgatgggcttccctttgtgagtaactcgacatttctctctggctgcccttaacactttttccttcatttcaacctggtaaatctgacaattatgtgtcttggggttgctcttcttgaggagtatctttgtggtgttctctgtatttcttgaatctgaatgacaatatcaacttttctttaggtttcttaacctacagcagcaaaccaatcatgcacaatattagtataacactgcagactattctagggtgtttccttatcattgagtcatgggccagcatgttttgagagctatttgtaaaattgctaataaccaacttttgagaacggttccactatttagggtccaacagtttgttggaacttgcatgatttctttaagtggcatgtatgtgacaagtggctctggctactctagccactggtttagtcaggcaggaatggcctccacagcatccctgataacaccatccattttcagcttgtacaagccagtgaggcagcactgccctcacttctctgtggcagcccatctcagtcccagaaagcattaacaattcattcattcatttattcaacaaatactgagttcctgtatgtgtcaaacgtggtcctaggcgctgtggatacagcaggggaaaaaagtttttttgtttaggggtgtgtgtgtgtgtgtgtgtgtgtgtgtgtgtgtatgtgtcttccatgtatttgtttttttattgctgctataacaaatcaccaaaaacttgatagcttaaaacaacacatttattatcatatggttctagaggtyggaaagctaaaattggtgggcagggctgcattcatcttagaggctctgagagaggtcccttttcttgccttttttacattccggaggctgcctgcattcttggcttgtggccccatcctccatattcaacgctggcaatgtagcatcttctactttttttctccttttctgcttctgtctgtcacagcaccttttgaactctgaccctcctgcctccctctgatcagaccctgtgatgacattcagcccacacagataatccaggttaaactcttcatcccatgggagccactgttttgccttccataatcctggtgcagattatatcctagcrggaatgttactatagatagtttgggctgatgagccctgtgragaggggatgtaagagcagaatctttggggaagggagggaatgagtcatgccagtatctaggsgagagagtttaggcagacggaacaagcacgtgccgaggccytaaggtggtaggtgtctgcagccgttgtacaaggaggtcagtgtggctrcagaggagggacttgggggtaatggtagttcacgagggcagggaggggcagtagccataccatgggggctactaggccatgggaagatcgttggccttttgcccaacagtgagaacattcttcctctatgtttcctggtgacttacaccccttgtaccaagcygaatgcagcttattgaagcaagatagaatacattttttctctttgtctcaacatcagggctctaagtatrttgtaaaagtatagcaccttttcttctccaggccaaatatttccagttttttctgtagtttttttgttttattattatttttagttgacatttaactgtatgtatttactggtgacagtgtgatatttcagtacatgtatacagtgtgtagtgatcaaatcasggtagttactatatctgttccctcaaacatttaccatttctttgtgttgggaacattcaaagtctgctcttccagctacttgaaaatatacaataaactgttgataattatagtcaccctgtggtgctaccgaacactagaacttatccctcctctttgtgtagttttcacttgtttctcactcattcgtaactactttttcagaacttgttgcatgttgcactccatgatgggtgaacatggagacaggtgagacatatcttcctgattacatttatgagagagcagaattctgcccagcctrctctgaacaggctgcacttctccaggcaaggggactcaccttcccagaggcaggcagttctataactttccctccttggacccctacacctccattggtggagcagtgtacctggctcctctctctgcttctatgcttgttggggacagtgatagttcccaccagtgatctcagggccaaggctgcctgattcccacctctgcccttggctgactatgtgacatgggcatgttgcctctctgtttccatagctttaaataaaatggggccagcaaggaagctcaggaatgggtcttggcaatggcaaggctttgctgctcacctcgggcctcctctgagtctctgtcccgctcctcctcctcttcctcgaatgccctctgcctccattgccgccaggaatgttcccctttcccctgagccggagagcatgctcctgggcttgacggtgctcatccctcaacttgtctctcaaggagaaagtgtgtggcctgtgtgggaattttgatggcatccagaacaatgacctcaccagcagcaacctccaagtggaggaagaccctgtggactttgggaactcctggaaagtgagctcgcagtgtgctgacaccagaaaagtacgtctgggtctctgtgtggacagagccctagagcttgcttcctggaatgtccctctgtccccattgtcatgggggctggaaggggggttgtgggtggtatgacctccaggtggctgcagggtgggaaggagggtctcttggatccttctgggctgaataaccccagtttgaccagctgacggctggcctatctcttgcctggttcccaggtgcctctggactcatcccctgccacctgccataacaacatcatgaagcagacgatggtggattcctcctgtagaatccttaccagtgacgtcttccaggactgcaacaagctggtgaggaccttgagggtagtgggaagcagacggtcccaaggcttggcctggtggtatggacacagagtgtgaccttctaacgtggacactaccctcgtgtcttgacatgatctgcaccaagacaccacttcggctttttttcttggctttcaatctgggaaacaaaaagtaaaatcaacagtttctaggggaagcaatgcctggcaaaacatttccttctgcatgagaagtaactccccttggcatgtgccaatgcttctctttcagccccagtcttaggatttgttctcttattgaagtatcttgttttcaacaccagagccagagatttccttttcctgtcactgctgcatttgtccagaccaaaagaccttcctctcccaccccctaaaaccccttggtgcccatttcttgtctcacagaaattcttttctggccttaattttggtgattttgagtcctcgtattatgacttatttttgtgtcttcatctctaatgacaaggaggaattccgcaaggttaagtgcagttgtctctctcttttttttttttttttgagacagagtctcgctctgtcacccaggctggagtgcaatggcatgatcttggcttagtgcagcctctgcctcctgggctcaagcgattctcctgcctcaacctcccgagtacctgggattacaggcacctgccaccacgcccagctaatttttgtatttttagtagagtcaaggtttcaccatgttggtcaggctggccttgaactcctgactcaggtgatctacccacctcggcctcccaaagtgctgggattacaggtgtgagccaccatgcccgaccatagtgcagttgtctcttatctgctgcatgtatgtgtgtacacacatgtggacatgggcttgtacatggacatatgtgactacagaagtctgtgtacacacacagccatgcacacatacatgctgctgtgtaacaccaccaatgtgggagagactggttgaaaacatggatctcaattctctttctatctatgcagtgattttcggtctctgaggactccaaaggatacttacattccctggtttggtggaaatcctgggcatctgagttggaagagtgaggacaggggaggagttggggacattgagactgttggaacgtcttggaaacaatgacccactcagtgtctgaattcattttctgtcataactgccctgaaaaagtccagtgtgtttagaggcgtgttttggggatgaggaagggttggaactggttgaactggatttggaatcagagtctaggccctattgtcctgcatacctgccccatagcactgcagtgaggcagctgcagggcctgatgtatttccccattctctttgctgaattgaggcaaagaaagacagtgaccagcacatatgtgtgtttgtgtttttgtaaaagcacccacatgctcatgaggctaagagtgggttgtgaggacagatgggtggctgagcagggaggyaggcagagggacagagggaatgttcttctggaaaatcctcaggctcattgtgttctgcagaaggccagcagcactgcattattcaactcttcttgctggaatgcagattagaaactaagaatcttgccttcccactcattccctctttgagaccattgagctrcatttctccttctacctggacccccttatccttaaattgaccatcagaacatttgcacccagactaagagccagagttcctgacacctggccataggcctgggccacctgaggctgcctttgcaggtggaccccgagccatatctggatgtctgcatttacgacacctgctcctgtgagtccattggggactgcgcctgcttctgcgacaccattgctgcctatgcccacgtgtgtgcccagcatggcaaggtggtgacctggaggacggccacattgtgccgtgagtactgacgccctcatgttctcagatgccctcccttcttcccatgtgtctatgcttgaagaccttgtgagtgcagggggatatcttcatgggcgagagaagacagagtgttagtagggactggatggccaagggctaaggagggttaagacattggctgtgtaagaagtttatattacgggtgaggtgggacatggattcaaggcatgaacatgtggagacttttcttctggagagattctggcaggggagaagagggaatactgatgaaaagaaggaagtcgatttatgtctttaattaggcgtgattatatttgccaatatgagtgatcaactcatacattcatgtctatagaatcttgcttctttggacagaagcaacttaatgyttttatgtagaaaactgggccgggcacagtgactcayacctgtaatccctgtgttttgggaggctgaggccagaggattccttgagcccaggagttcaagaccagcctgggcaacatagcaagaccccatctstacaaaaattaaaaaaagaaatgaattcagaaccaatagattctggtttaggtgcttcaacaatccagaagtctctaatattggtgacgcccatagtcccctagttccccaacattatctccagatggcgcaggccatcaccacatgggtctgcagtcctggaggctttgcctgttgtggccacagccttgtctcctgtctacacagcccagagctkcgaggagaggaatctccgggagaacgggtatgagtgtgagtggcgctataacagcygtgcacctgcctgtcaagtcacgtgtcagcaccctgagccactggcctgccctgtgcagtgtgtggagggctgccatgcccactgccctccaggtgaggcctctatccctgggggtcaggctggtgggatgggatagggatggatggaaaggtgcttctaggtcttgcttcatctcagcctccacctgccacgtcctatctctgacctgcaaggctgctgcaggttccgtgggttctttcatcagagtcaggacagtcgtgatttttctcaagtcgagctcctccaaaatgcttttctgtgcctatttatgggattctcacctaaagcagcccctgccgatagaactttctgcagtgggggaatgttgtattgaatgtaactgtgacgagtgtgtctgaggaactgaagttttgaattttattgaattttacttaatttaacgtaaatagccacacgcagtttgtgacgatcctatggtacagcacagctctagagttactgaaggtgttattcagaagagcagaaagagccccggagataagatttcatttgtcctgaggcttggggaggtgaggtagggtgaaggaatccccgctcccagttttgcagagggatcaatcaaggcacaagcaggagagatgctccttgagtgatggggtgacccctgggagtgcaggcaggaggagttggcttctagggcaggaggaggagttggctcctcccttttagttaaaaatgaggcttcctcgtgggaaaggggagcgttttggttcctaatgagagctttcttttgcagggaaaatcctggatgagcttttgcagacctgcgttgaccctgaagactgtccagtgtgtgaggtggctggccggcrttttgcctcaggaaagaaagtcaccttgaatcccagtgaccctgagcactgccagatttggtaaaacagattcctgggttgtttgaagtgatgaatcttattgcttctccaggggccagcttagagactaggttttgggtaaaaagtcctagccacatgagttgagagactgagtttattttatttgtttatttatttaattcattatttaatgtagtttattgttttgtttgttcctagggtttgcttctttttctttagggatggactagactgcttcctccacatatattcctccacagtgtttttgctcttaataggtttttaagtcctaacaggtttttgcttttctcactgaaggtgggggtatggtcacttattgtccttgtaggtcatgactagtctgagcacaggtgtccatatactggaggtggggactcaggagaggaaagtgagatggaacccagggccctcaggtaacatgaacgtcgtgggggccatagtcaaggtggcagggtgtggctgtcataatggggagggaaggtgctcgttgctctcaccctggcttctcactggacttgcctctgggaaactggcctttggggaggtgagaaggagtcctcagggtgagctctgagccctctgaagtcctgctcataagtagggagcatttattaaaatccagatctattcaacaccactccctgacactaatcaagccttctgggagcttaaacttgagaacgtaaattcgctggggaggggctatggtcacagctgctagagtcagatcctgccgccaccatctgtacaaacaagaatgaacactgcctggggtgagttttctagcaaacacaggaaactagaaagtatgtcactcatgcactgttaaccaaggattgaagcaataaatcttgtggatcacgggaaggaggaattaacttcctagtaagactctacctgcgcacactctttatgctgaaacagagactgtagggagcaaaggactgggtgattctgatgctggcttggggttctgtgccaaaagggcatgagagcttcgagccctctccccacctcctttgctggcacacgggcaggggcagctgccacggtgcacgctgaagctgcaagcagtgtgtggacagaagtcccacagcaggctggtggcatcacctggtatcaagccgcagggggacacttcccaggctcagggcgctgccgccttgtcagctttactgggagtgctgaaggccaggtgcctccaaggctgagagtccaaagaggagatggtcctggcccatattggtctccaccacacggtcacttgatttcacctgtgggctggcaggccgtgccactttccgggacactggcaaaaaggtgatgttaccagcagagcctggaaatttggcatggtagtgtaggaatttgtgtgtggggggccactgctctactacagacttgtggtgtgtgcttggggctgggcacagagcctggccagtacctggcacatgagaggtgctcaccctatgtctgctggaggaatgagtgaatgtcttttcctaggcctgacaccgtggagacccctgtctgctactcccaaataatttgttctgctagataaagctggggttttgaatctttattcatctttctacaatgtttttgctccaattttttctctcttcgttagggcccaacatatcaaacatgttttaaaactcatgcaatttacattctgttagaatatgtactgtaaagcatttatcttcaacagaacatgtacaaacacaggttagcgtctacattttagtaacatttgttcttggagacacttgtaagaaggcttggattataaytaagtattcatgttgctaaagatgtaggttgaaaagaaatcagctttgagtggttgtgtggatggcctagaacaacgagtatattttttcatatcctaggatgggctaaagctttggtttctagaatcaaaggaagtcggctatgtgtgtgttttgaaggtggggggcatgctatttggggacagatgttaaacaatgacatctcacttggatgtggaatggtccatgggatctcaagttcaggtggaacagaggagattctgtgggaatatggaagtcrttgtacactgtagggctcagaagtgtccacaggttcttcctgaaccattttaatttcttcgctcttttctgckgccactgtgatgktgtcamcctcacctgtgaagcctgccaggagccgggaggcctggtggtrcctcccacagatgccccggtgagccccaccactctgtatgtggaggacatctcggaaccgcygttgsacgatttctacbgcagcaggctacyggacctgrtcttcctgctggatggctcctccaggctgtccgaggctgagtttgaagtgctgaaggcctttgtggtggacatgatggagydgctgyvcrtctycyagaagtgsbtcygcrtggccgtggtggagtaccacgacrsctcccacgcctacatcgggctcaaggaccggaagcgacyrtsagagctgyggcgcattgccagcyaggtgaagtatgcgggcagccaggtggcctccaccagcgaggccttgaaatacacactgttccaaatcwtcagcaagatcgaccgccctgaagccttccgcatcrccctgctcctgatggccagccaggagccccaacggatgtcccggaactttgtccrctacgtccagggcctgaagaagaagaaggtcatcgtgatcccggttggcattgggccccatgccaacctcaagcagatccgcctcattgagaagcaggcccctgagaacaaggccttcgtgctgagcggtgtggatgagctggagcagcaaagggaagagatcgttagctacctctgtgacsttgyccctgaagcccctcctcctactctgccccccsacatggcacaagtcactgtgggcccggggctcttggggctttcgaccctggggcccaagaggaactccatggttctggatgtggcatttgtccyggaasratyggacaaaattggtgaagccgactkcaacaggagcraggagttcatggaggaggtgattcagcggatggatgtgggccaggacagcatccacgtcacggtgcygcagtastyctacatggtgacygtggagtaccccttcagcgaggcmcrgtccaaaggggacatccygcagcggktgcgagagatccgctaccagggcggcaacaggaccaacactgggcyggccctgcggtrcctctctgaccacagcttcttggtcagccagggtgacbrggagcaggcgcccaacctgktctacatggwcaccrgaaatcctgccyctgatgagatcaagaggctgcctggagacatccaggtggtgcmcaytggagwgggccctaatgccaacgtgcagragcyggagaggattggctggcccaatgccyctatcctcatccaggactttgagacgmtccccygagaggctcctgacctggwgctgcagaggtgctgctccrgagaggggctgcagatccccaccctctcccctgcacctggtatgctggcaccttgtgtgcaggtgggagggctgggcgagggctggcatggccttggtgctacatgcatctgccaagatacgactcgggttctaatcctggcttccctggtctgtgtggccttggttgaaacttgccttcaaagggcctgtgtttcctcacctccctggcagggagacaaactgtgatcctttttcgggggaagatcttttcttattgtgtgtgcttctataaattcaaaggtaatggaagcctattgttaacatttaaacaatgccaataaggagtaaaaaaaaaaaaaaaatgcaagtcttactttatcacacagcctcttccccacccaattccaccctctgccttcaaggtaacctctgttaaaggtggtgatgataagcttcattttgaccacactgggtgggtgaaattattccgagtagctgacattcttcagggcaagaccaggatgtcaggtgtcaggtagcaggtgcagtcttcagacactggagtcagactgccttagtttgaatcttatctctgctacttgctagctgggtaattttgggcaaatacttaacctctttgtatatcgtctatacaaaggatraggcaaatacttaacctctttgtatatcatctatacaaaggatacacatctttgtgtatcctcatctataaaatggggataataatagcacctacttgcttaaaatagtatctggcacatgacaagtgctcaaaaaaaaatgcttgctcccactgctgttactactaccttttactgacactggcgtctaatccattcctagttcctgaacatctttattcggtgtgtttgggaccatcccagaataataagccttcttttagtatcttttgagtcacacacttgtcagtacttttgtttctttgtttttgtttttattcacggccatagatttatttaaattcttgtaatatttctgctgaggaaaacaacaattacatcatttcatcaaatctcagatgtgctcagacactaacaggagcactaggcatttatagctggaagaatcacagtatgttcacctgccctgcaagatctgaggacacagcagctcattgtccagggaggggctgccgctccatttccttttgcagtctccttgtattgccaggccagtattttactcatttctagaagaatggtggccccttcttaccgaggaagcctatgcctgctgcttttatttgtagacatttaaacttcctttgggtagaattggagtcttctcagtgtctctaaatctgaggtagtccggacccaggaactccatctccccatcccctcctccctggcccacattgcccttgtactcacgaaggcaccccccgccccccttggtggtgccacgtggtcagcacgccctgcagatcctattggatgtcaggttgtaggcctggtggccattgtccctgctggcacctgtgtgctcaccttcctggttgtctttgcagactgcagccagcccctggacgtgatccttctcctggatggctcctccagtttcccagcttcttattttgatgaaatgaagagtttcgccaaggctttcatttcaaaagccaatataggtgggtgagcgaggcacctgaagcagcaggtgacgaagaggctctttttgtggctctacttgattcaaaataatccgcattttctcgttccgtttagggcctcgtctcactcaggtgtcagtgctgcagtatggaagcatcaccaccattgacgtgccatggaacgtggtcccggagaaagcccatttgctgagccttgtggacgtcatgcagcgggagggaggccccagccaaatcggtaacgttggtgccacaggctggatgcagaagctgcattctggttcttatttttggcataagtgactgtgtgacctcggccagtcactttgctccttggccttagtttcttctcctggaaagtgaggggctagatgctcttccacgtctctccagatctcaactgggtgttccttggagtttctgaatcattcagcttttaagtgacttaaggatccaccgttaagacagggtgtcgagccgcagtcagtactgacttggcgtgatctgttctccatcctcaggggatgccttgggctttgctgtgcgatacttgacttcagaaatgcatggtgccaggccgggagcctcaaaggcggtggtcatcctggtcacggacgtctctgtggattcagtggatgcagcagctgatgccgccaggtccaacagtaagaatctggtgtacagtcctcaattcaggagagcgagacttcagaaatgatagaggattaaaagtgggctggggttacttttggatgttgtggctgatattaaatatgctcaataccaacctctgtcctggtttcaaacagcaggaaattatccaaccacgatgtgattaggaaaccaaacaataaaaagtgtgtrttgatcctatatctttataactaattataatctttaatttctccacattttccctttgtgtccaggagtgatcatacctctatgccctttctttctaaagtaggattcgtggtctcttactaaaatgtcatgtctgaggccagagtgattcattgtagggccttgagaaccaatgggggctttcatgtatttagagtcctttcctggtaccaggtaatgrgcttggcagggttgatggatgagagacaaaggatcatgctgtaggaaagggaaggatccagatgtccagccttgtgctccataagaacatgtgcttatcatgttcttaatatcaacaggatgtgagctgggacaggtggtagagtctagggaccacctcccagctgaagraggtctgggtgagtggagtgacattgagtcccctcgtggccacctggagaactgttcatctttcagaaccctgcctaggagtgctgtcagaaccctgtcttttctctgctgtcttcctgatgttcttcctgaggaagttatttgctccgttctctatgtcacatatgagctactmaaaatgtgcaaatcgtattgtattgtattgtatttgtaacatatctattccttgcaaaaaactgggagttctttgaaggcaagggaagatcttgcttatttttgtatcatctgtgtatgatgcacaaaataggtgaccatttaacgtttgttgagtgaatgaatgtgacatgtttatgaaatctatgattttagggtaaaggacactaaaagggaaaggatatatatttggatratataacgaacttacaagagctgaaaagctgctaatagaaaatccgttccaacctgaagcacattgcaaattcctagaactttctggagagctgaattgaggaatttcaggatggagattttttcycctttagtatcaagaatccaaagaaagattttcactgggaaaggaagcagttgtggtcttgargaagcagatatgatccagagcacgtcatttaaccatctaaagcctcggtttctcatgtgtaaatgagcatgcacattctctgggctcagccctgtgatattttctcttctcttcttacatataccctgttggtggtctagttcagtgtcatgggtctgaatatatttatacatctctgactttgaaattcgtatctccagcctcacctcaactcagcttgcatgctctaacaggcaaaactaaactcctgattttcacatctgtctttcttatcttagaaaatggcaattccaaccttccagttgttcagttcaaaaagctcagcatccttgattcttcttccttttccctgatacctccatgcaagccacgaacaaactatagctccatcttcaaaatacttcgagagtcacacctccccacaccatgtccactagggtcacctcaatccgagtccccatcatctctcacctggactattgaaatagctgtctaactggaaccccagcttccacctttgtcccctgcagctcattctcagcacagcagctgcagtggccctttaatatcaaaatcagctcctgtccctctgctctgtagtcttggctggctttgtttcattcacagaacatggtgagcccttactgtggccaatggagcattgcctgatccatgccctttccctctcttgcttgtccctctctccccagcccccgggagcatgcagtcacatttctgctctggggcctttgcactcactcttctctctgcttgggatgtccctccctcagacatcctcttggctccttccatccttacatcaggtttctgctcagatgccatcttttcaccaaatgcttctccaactgccatatatgcaacgataacccacacctcagccctgggcattctcatcccccttatctcattttgtttttttcctaagcatttatccacatctgaaattctatatatttactttgtttgtgtgtttgttgtctatctctccatgaggacgggggacagggagggactttatgtgcttggttcactgctgtacccctattgcttacaatagtacctgacacagagtagcagctcattaatatctgttgactgaacatcttcctcatagggctgatgtatgtgaccagcctggaaaacatgaggctgtattcagatgctggatataacgtcaggccagtccattttgagccttcttgcccacagatcctttcttgtctctttgctaactctaggagtgacagtgttccctattggaattggagatcgctacgatgcagcccagctacggatcttggcaggcccagcaggcgactccaacgtggtgaagctccagygaatcgaagacctccctaccatggtcaccttgggcaattccttcctccacaaactgtgctctggtgagtcttataatacctttcttacttccctcaaaaaaaagttccaaaataaacccgccaaagaaacaaaaatagtattcaagagaccccagggtgcccatgcataagatttggccttgaatgaagattattatatagaccaggacctttaagtttctgttcatgggaggtgtataccacaagcccccatggggccagcagaaagctttctgtgtatggtcctatttccactctaattgtccatgtgaacttggcagagagagcctaagcttatttgtgtagagggatcttggacaaaagaatcagaagacataagcaaggaaccccagcgttccgtaggtatagtcttcttccccatgggcctagactaactctcaacatgggtataaagggctttagaaatacgataacacggagactcatatcaaagtaccatagtttaagttgattttaggttagaaacttaaaaaatatgcttttggccaggtgcagtggctcacgtctgtaatcccagcactttgggaggccgaggcgggcggatcaygaggtcaggagatcgagaccatcttggctaacacagtgaaaccctgtctctactaaaaatacaaaaaattagccgggcgtggtggcgggcacctgtagtaccagctacttgggaggctgaggcaggagaatggtgtgaacccgggaggcagagcttgcagtgagccgagatcgcgccactgtactccagcctgggcaacagagtgagactccatctcaaaaaaaaaaaaaatatacacacacacacacacacacgctttttttgtggcgggggcctgggtttgtatattttcccgttactagatgtaagtcaaaacctgcataaagctactgtccttcgggggaataagtcaatgcaagtttgcccttaaagggcaataactctatgcaagttttgacttatagctaataacattagctgtacagagagatggcagctctcctggtaggaatcttcaagtagatctctttcaggtttccaggatcttgcttcatctccccaccttccccatccctggcgtgatctacatgtgaaccaagataatgacagcgtaagctgtagttattgccatattatcgctgttgttggcatcataattattaataactgcagagcatgtctgaagaaccacaggatgaccacctcagcctcatgtccctatgtctccactgttaaccttgttcagattcttttcagagttgagttgacttcaaaaactagaccaggttgcttaagcagacattgtgaatggttcagaatttctgggtgaaagatgggaactaaggtcttatttgtgtctgttgcaggatttgttaggatttgcatggatgaggatgggaatgagaagagggtaagttcctttctgttgactttgaaagaaaggttagagatgtgtttggggctcttgttcccactggttaatttttcctcctttggtcttagtccagtgcttccttttactattatcttgtttttgcgggtccatctgtacatcttgtgttttgcttcctgtctcatgtacaggrggcctccttgctgtgtaggcctgtgttcaattctaggggtcagttgtctggcagatgggcttagagttggagtacctcatcttattccctgcctgaatctgctgttttcttctgcagcccggggacgtctggaccttgccagaccagtgccacaccgtgacttgccagccagatggccagaccttgctgaagagtcatcgggtcaactgtgaccgggggctgaggccttcgygccctaacagccagtcccctgttaaagtggaagagacctgtggctgccgctggacctgcccctgtgagtcctttgcttctccagccagggcagcgtcaaaggggcagtgcttttagcttggctgtgcagaaaagtagagcaggcacccaccagcccagaagtaccctttccctcatcaccacatgcacagtgctaccttcactcaccttcctttcctcctgtgctctttggacatgcatgcagccagtctcagggatcactgccctctttctctgtctttggaaggcacttccccagattatgcataactggaaggaagaattgcttttctgaggtcaatgctcagcttggctgttggcaagtcaacctttaggaatctgtgtattcagggtatagcagtggaagtatagcagtragagagacgcttccagaaaactctccaaccacacctatagcaacagtacatcaccaaggcggcctggattaagaggaggaaatatttaaagtccatctcatgtacacttgtggagagcatgtcatccatgggctgggttagccttctgtctcatgtttgggagcaatgactgcttatggtgaccatgactcagcagtggattgtaacctttatgctgaacaggcataactggtgggatgcaatcaaaactgtatttatagctcattccccctttagaatttatttagtgagataaatttccctcttggtctaggtgaaaactccaccagactttaggtttcttctgtttattcataaagaattctatagttactttgtcagaagacaaagtctcagttgataactagatacccactcttgcgtaataatcaaaactttgaatttgattagagttaaaacacctcccagttccaatttaggctgcctgcctctgggaaggagggtatggtcagctttcctctgtacaaagagctttgccttttgtgattaaaagcatatcctggaaattactcgatgtcatttcaaagagagcttcctaatacttcactgtgtaccataggttacccaactgttcttctatggatgtgcgtttaggctgtttccagtgttttgtaatgacaagcaatgctgcaatgagtaaacctgaacatacgaattgtcatatggttggaggtgtgtcttcagggtagattcctagaagtgagattcttgggtcaaaagataagtgcatatgaagttccccttagacattcccagattctcctctaacaggtgagatgtggttgtgcaaaactggaatgtccatcagtttggttttcgatcagcgaggtatgagagtgcatgcatctccacggccttgctgagtgtgttgttacagtgtttatttttttttttcaaatttcttacttttcaggaaagaaatagtatctcagtgtacttgaaattcatttctctaatgatgagtgaggttaaacattttatcatatgtttaattgccattttttggtctaattttgtgaattttctgctcatgcctttccccattttcccattagaaaagttgtgataagaaacacatgagatctaccctattaataaattttccagtgtacaataccatattgttagctatttgcaagttgttgtacagcagatctctagaagtttttgttttgtgtgactgaaactatgcccactgaacagcaacttcccattttccccttcccctagcccccgcaaccaccattctgctttttgcttctatgaatttgacgattttagatacctcctgtaagtggattcatgcagtagttatccttctgtgactggctcatttcacttagcttaacatcctccaagttcatctatgttgtggcatatgaaaggatttccttctttctaaagactgaatagtattccattgcatgtatataccacattttctttatccatttgtccactgatgtgcatttggattatttctaactcttggctattgtgaataatgttgcagtgaatgtggaagtgtataagtacctttttgagatcctgatttcaatgcttttggatgaatacccagaagtgggattactgggtcatatgctaatactagttttaattttttgaggaaccttcttactgttttctgtagtcgcgacaccactttacattcctaccatcaatgcacaagggtttcaatttcttcacattcttgttaacacgtggtatttcctggtgtgtgtgtgtgtgtgtgtgtgtgtgtgtgtgtgtgtgtttgataatggccattctagcacgtatgaggtgatacctcattatggttttgatttgcatttccctgatgatcagtaatgttggatattttttcatataattgagtttttggatgtctctttggaggaatgtcttttcaagtcctttgctcatttttaaattgggttatttgcattttttttttttttgctattgagttgtatgagttcctaatatattttggatattaaccctttatcaaatgtayggtttgcaaatattttcttccattctgtaggctgcctttttattctgttgattgtttctttggctgcacagaagctttttggtttgmtgtagtcccacttgtctatttttgcttttgttgccttgtttttggcaatgatatccaagaaatcgtcgccaagaccaatgttgcaaagttcttgtgttttcttttaggagttttataatttcaggttttacgtatcagtgtttaagtttgattttgggttaactttgtgtatgatataaggtaagggtccaatttcattctttttcatgtggacaggttcattgttagtgtataaaaacaaatggttttctatgttgattttgtattctgcaactgaatttgttttaactttgctgaatttgctaacaaatttttggtgaaatctttagagttttctatgcatatgatcatgtcatctgcaaatggagataattttacttcttttttgatttgggtgatgttcatatcttcttgattcattgctctagctaagacttctcgtactatgttgaatagaagtggtgagagtgggcatcyttgccgtcttcctgattagaggaaaagcttttagttttgcactattcggtgtgatgttagctgtggtattttcattaatggcctttattttgttgaggtaattttcttctattcttagtttgttgaatgttttaatcatgaaatggtgtttgaattatgacaaatgctttatctgtatctgttgacatgatagtatgatttttatcctttgttctgttaatgctatgtatcacctttattgatttttagacgttgagccattctcctatctgagggataaatcccactccgtcagagtgtattatcctttgattgtgctgtttaattcagtttgctgtcattttgttgagaatttttgcatctgtgttcatcaggaatattgacttgtagtttttttttaatgtaaagtctttgactttggtatcagggtaattctggcttcataaagtaggtttcccacttcagtgttttggaagagtgtgagaaagattggcattaattcttctttaaatctttggtagaattatccagtgaaagcatctgagctcttatttattgagagattatgattaytaatttcatctccttactaatgatggggctgttcagattttctgtttattcatcattcaggcttggtaggttgtatgtttcagggatttattcatttctttaggttatccaatttgttagtgtgtagttgttcatagtagtctcttactaacctttttatttctgcgctatcaattgtaatgtaagctcttctatttctgattttatttatttgagtcttctctttttgtcttggttaatctagctaaagctttgttaattttgttgacctttaaaaaaccaattctaagttttattgatattttgtattctatatttcatttatttttcctcaaatctttattatttccttccttctgctaacttacggcttagtttattcattttctagttcttacattgtaaaattaggttatttgtttgagatctttcttactgtagacatttactgctgtaaactttccttttattgcttttgctgtttcccataagctttgctatgttgtgctttagtttttgtttttctcaaaatattttctgatttttcttttgatttcttctttgacccattggttgttcaagagtgttttttaatttccacatatttgagaactttctgaaattatttctcttagcaatgtctcattctattctgttgtcagaaaagatacttggtatgattttagcctccttaaatttgttaagatttgttttgtgggctagcatgtgaactattctggagactgttctatgtgtgtttgagaagaatgtataatttgctgttgttgggtagaatattctgtatttgtttgataggtccacttgggccatagtgttgtttgagttatctgtttccttattgatcttctgtctggattttttatccattattgaaagtgagatattaaaatctctcactattatgttgttctatatttatcatcacttctgtcaatatttgcttcttatatttgtgtgctttaatgttgggtgcaatgtacttatatcttcctggtgaattgatgcatttatcactatataatgtccgtttttttgtctcttgtgaccatctttgacttaaagtttaatttgtctaagtatggctacctcttttagttaacattggcatgaaatatctttttccatcttctcactttcaacctatgtgcattcttaaatccaaagtgagtctctctcttgtagacagcacatagttggatcttgttttatttatttatttatttatttatttacttaatttatttagatggagtcttgctctgttgcccaggctggagtgcaatggctcgatctcggctcactgcaacctctgcctcccgggttcaagtgattctcctccctcagcctcctaagtagctggaactacaagcacgtgccaccatgcctggctaattttttgtatttttagtagagacggggtttcaccatgttagccaggatggtctcgatctcctgatctctcatgatctgcctacctcagcctcccaaagtgctgggatcacagacatgagccaccgcacctggctgttttattttatttttaaaaattcatttcagccacttcatagcttttgattggagagtttattctacttatacttaaagtaactatggatagggaaggacttactgttgccattttgtaattattttcagtcagtcttgtagcttttttgtccctcttttctactcttactgcccttctttgtgtttcattgatttttttgggtaatgatgagatttgactccttcctcatttccttttgtgtatcttctatagatattttctttgtggttaccatgaagcttacttaaaacagcctatacttataacagtctattctaagcttataacaacttaatttcaattgcacacaaaaactctacttttttactgcctctcccccactttatgttattcatgtcacaaattatattttttaatgttgtgtattcattaactgatttttatagtgagttatttttataactttgtcttttaagtactataccagaattccaagatttacacattgtcattatagtattaaaatatcctatatttgtttatatatttacctttacaaggaattttacctttcatatgttttgatgttgctgcctagcattcttttatttcaacatgatggactccctttagcatttcttataaggcaggtatagtggygatgaactctttcagcttttgtgcacatgagaaagtctttatttcccttccatttttgaaagacagttttgctagagagagtattcttgactgcccattgttttcttttgaatatatcatccatctcccttctggcttgtaaggtttctgctaagaaatttgttaatagtctcatcgtggcccccttttatatgaaaagttgcttttctcttgctgctttcaaaattctgtttttgtctttgacttctgacaaattattataatatatcttgtagtggacttctttaaattaattctagttggagtcttttggacttcttgaagctggatgtctattttcttccctaaatttrttcattatttctactttccattgggttttaatcttattctttattttaaatattggaactattagctcattatccgtgatataggttgcagtactatttattgacatgtcaatrtttgccccagtgatgtgagataacttaataataatcataaatcaaattttcatgtgtgcatgggcttatttctgaatttttttctgattccacttgttgtaagctattcatataccaaagccacattgtcttaattaccacactgtcttaattaagaggaaatacctctaatattttgtcattaaaggctttatggtatgttttattgtctggtagcactagtacctccacatagctttattctaaaktgttttcctggctattcttttatgtttgttttttctgtatagactttagtgtcaacttgtttacctccataaaaagtttgttggtatttttattggaattgcattaaatttatacattaactttgggagaactggcatttttatgatgttaaatcatcctatccaagaacaagtttgtccacttattcaagctgacttgtctgtcttctagaagtgttttcaggtttattcatttgggttttgcatatttcttgctaagtttattccaagtattgaatcttccttgttgcaattgtaaatgagacttttttcttctccattatgttctttaactacttattatttgtgtatataaagggtattgatatcaatatatataacatctatatatctatatatctatatataacctatatatatctgtatatgttaattccatatcctatagctttactgaattcttttattattgagttagttttatcatggattctctagggttttctgggtatgatggtttgtcatttgcaaatagaattgtttttcttttttgtcaatttttgtgcctccaattaatttctcttgtataattccattaataaactttttagtacaatgttgaatagcagtggagtatcttgcacacacacacacgcacacacacacgtgcacacacatatcatgtattttatattatgaaagtatccctcaattctcatttttgagtgtttttttgtcaagagtgattgtggaattttggtgttggtgaaggctttttcagcatctatggagataatctcttgattttttttctttaaatatattgatatggtatattatttgaagraatttcctaatgttgatcccacttggctatgctttgttattttcataatgtggtgttggattctgtttggtaatattttatttagtacgttggttttgacattcataagtatttttggtcagcaattttaacactacttatttaaattttcagtaatatacatataacataaaatttatccttttaactatttttaagtatatatccagtgacattatcatgaatgaggtcaggagattgagaccagcctggctaacacacggtgaaaccccgtctctactaaaaatacaaaaaattagccgggcgtggtggcgggcgcctgtagttccagttactcgggaggctgaggcaggagaatggcgtgaacccgggaggtggagcttgtagtgagccgagatcttgccactgcactccagcctgggcaacagagcgagactccgtctcaaaaaaaaaaaaaaaaaaagagagagaaagaaaatccacattgttgtgcaaccatcaccaccatccattgccagaacttctttcatcttgtgaaactgaaatgctttattcattagacaatgataccccatttcccccttcctccagcccctggcaacaaccattttgctttctgtctctctgaatgagactactctaagcacctcttttgagtggaattatgcatttttcctattgcgactggcttattctgcttagcataatgtcttcaaggttcatccatgttgtcatcctttgtgtttggttgatttttttttttttgtagtgaaacattttaactcccgtttcctttcttttgtgtatattctataactattttctttatggttaccatggggattacatttaacatcctaaagttataatgctgtactttgaatttataccagctcaactttggtaacagacaaaactctgctcttatacagctctatccccacactctttcagttattgatgtcataaacattacatctttatacaytgtgtgttcaaaaacatagacgtatataaattttaatgcattagcctcttaaatcatgtagaaaacaaaaagtgaagtcacaaactaagattacaataatatccagaacttttttggttcctttttatgatttcaatttctttattgaaatttccattcggttcatacatcattttcttgattttgtctacatcttcttttagctctttgataatttttaagacagttgttttaaagtctttctttagtgagtctaccatctggtctttctcagggatagtttctgttgatttactacatgagacagattctgccaatgctattgttgtctaggtggggagacagatatttggtgcttcttactccaccatcttccccgtctcccaccctgtaggttttttgttttttttttgtggtgggggaatactgtcttgatctggtttagatattggtgttaaaactggtttcattaaaagctttaagaagttttctctccttttcagtactctggaacaatttatggagcattcggactatcaggtctttggaagtttaggaaaatttccttgtgaaatcatttggggttggtattttgttttttgtttcttttttttggtggagtaactttctttaattcctactaacttactctaattcttccatgtaaattggtgtgcttaagatttgtcttttatctacaggagttaattttgttaatctccattttcctagaaatttatccatttcatctagattttcacatttattgtatagaggtcttgaaagtagtcttttttttaaactaaaattttgtttattgtttgtatatactctagggtacaagtaaaattttcacagtaatcttttataatattaaaaattctttttaaatagcgattttcttttgtcatttgttaatttatatacatgtytattatcttttttcttgatcaaattaactcatgatttgtctttctggayyttttttaaaaatcaagatttcaatttatttattatgtttactgtttttatattctctactttatkgatttctgcttttatccttgctattttatgacttctttccttgaattttcttttagtttaccttttgtgcttttctatttaattggaactgggaatttcattcattttcattgttttatttttattgacagaaatgtttactgttatgaattttcctaggatcactttatatgtatcccaatgagtctgatatgtagtgtatttattatcattattttctaaagaaattctgtactatctgtttttattgtccctttcacccaggatttatatcataaattaaaaaaatttccaagtgtaaagatctttttaaacaataattaaaaaatttttaattttactatactctgacgagagtatctgtaatagttctactttgtggaagttaccgttattttcttcgtgatctaatacatgatcagtttttgtgaaggtgtattctctattatcagggtgtagagtatgagatccctcgctctcttcctgtcacccctccatgagaactacatattttgattttaatgtttgtcttctatagtcttacttaccttttccccattttatctatctggttctgaaagggatgtctaaaagtatcctgttattagtttgtctaccaatgtctccttgcttctcctatagtttttgctctatgaagatgttgtctggtgcatagatattcacagctgttatggcttcattgtgaattatactgttcagaatgctcttattagtcacatttaatcttttttttggctagaattttactttgtctgatatcaaaatctccatccctgttttcttattgtttgatatcctttgtctgtccctttactttagcctttctgaattttagttatatagcaatagttgggtcttgcctttgagccgaattgaaaacctttttgttttagtagacaagttaagcccattctcatttattgccatcttgtgtttgatcttctttcgtcattatattttataattgtttgttatatatttttcatttataaatgtggtgatacgttaaggtgtctaggaaggtttatgcttttgttcctgtcattacctttgaagttatacctttctaaaatgccttcaggcccatatttttaaatttaagcattcattaatcagtttttcagtttttaatagcattctttaacttctacctgtggctatccaacaatcaatgaggttattctaacttttcttgttccctcccctctcctcccattgtcgagttctattatttctactgtcacagcatataacatttgcacattagtcttccattcttcgttttagttttagatctatgactatataaataaaaatgctcactttagttgttttgttaacatttcctagtcatctcttagttggaggaaatgttctctagtagatttctttttttttttttttttttttttgagacagagtctcgctctgtggctcaggctggagtgcagaggcgcgatctcggctcactgcaagctccgcctcccrggttcacgccattctcctgcctcagcctcccgagtagctgggactacaggcgcccgccaccacgcctggctaatttttcgtatttttttttttgtagagacggggtttcaccgtgttagccgggatggtctccatcacctgacctcgtgatccgcctgcctcggcctcccaaagttctgggattccaggcgtgagccaccgcgcctgggtctctagtagatatcttaagaagggcttatgtgtacagaattccattaattcctatgtatttaaaactgtttttctatagcattgatgctagaagggcaccttggctgaatacagaattcttgattcacattttctttcactaaatttctgaaaaatgctgctccattgttgccttgctttgtatattgcttttgaaaattctgataccaatataattcttttgtccttgtaaattatttgatctttttgcctgaaggcctggaaaattttttctttatgtttgaagtctaatagtgtactgtaatatgtctcagagttgactgttttgggttaatttttccggacatctggcacatgactcccatacatagatttggttcttttttgatttccagaatgttttcatgagttatattctttaagtgttagttctgttccattgttttgttttctcttttaagagtccattttttctcctgtcttacattttcattactgtctctttgacctttatactttcttcattaactcattttcattctcttgattggtttttttttgcttttctctgatgctctttattaaattyttattttgatgtcatcttccttgggtacttataatttagtctttatttcagagttgactttgcacttttattacccacccccaccaagttcactgagttctatttttatttattcttgtctttgttcatttctcttcttagtttttgaaattctgattcaaggtggttttcatttgtgcagatgtttgagtatatttaattcagtttgagtattgtctcatagttttcttctatgtcataacattttgttttttgttttttcctttttgtggaattttcattagatgaggagtgttggttctcattttctgatcttttgaagaagcttttatggacttgcttaatctgttcattttgtgaattttgggttttacaagatttctggttcagtgaccctcctttctattagtatagaaaagtcatttccttagtggtgkgtgtgtgtgtgtgtgtgtgtgtgtgtgtgtatgtgtgtacatgtggatcctgaaggattgtgtggcctctgatttttcaggtttttctggaccctgactttcccgtttgctttatttttatgtctccagtcactttccaagcacctttccatttytttttgctcccagtccccttgaaactatgcttttcaggttgtcaccaaatattgcgtgtgtttttagcacctgctctggtctgttgggatacttcaaaatatttttgcccttaggataggcttttctttctggtggtagtggtggttatagagaaattttaggcttgctgcccactctcttctctcttcttttcagttctccttggattgtccttgctcatgacaaaggctaacagttagaggatgagggatttttgctgggtgggatttggtgttttttctcttttactttatttacggctattttaaagtttggatgtttttggctgggtgcagtggctcacgcctgtaatcccagcactttgggaggtcaaggcagatcacgaggtcaggagttcgagaccagcctggccaacatggtgaaactctgtctccactaaaaatacaaaagttagccaggtgtggtggcgcatgcctgtaatcctagctacttgggaggctgaggcaggagaatcgcctgaacccggggaggcggaggttgcagtgagccaagatcgcgccattgcrctctggccttggtgacaagagtgacacttctcttggaaaaaaaataaaaataaaaataaaaataaataaaatttgggtattttcttgttttctacttatgctgaaagcatgcttttttcatagtaatttaatttgttcttattgttcttcactgtgttcagaggatatatatctccctacatatttatttgccttgtagtttattttattctcatgaccgttggggctggctccttgacttgaccatatatatatatatatatatatatatwtttttttttttttttttttttttgacggagtctcggagtctcggctcactgcaagctctgcctcccgagttcacgccagtctcctgcctcagcctcccgagtagctgggactacaggtgcccgccaccatgcctggctaattttttgtatttttagtagagttggggtttcaccatgttagccaggatggtctcgatctcctgaccttgtgatccgcccgcctcggccttccaaagtgctgagattacaggtatgagccactgtgcccggccaacttgacaatattaatagctgaagtattagggcccactttggctacctggacgtctttttgaacatttgtgttttgctaacaattcactttagtatctgatatcattacattttgacaatcagccaaaagttttaatataatattcaatcacaaatatttgtattgtcacttggaaagataatgagtaagaagatgttgaagaaaaggagagagatgagataaaatgatttcaggagatatttatgagtgatatactttactctgtgataatattttataactgtgcagtaacattttgttatataactctaatgtattaatttttaattggttcggcctaactttctctatgtcctgaacattggaatgtgttaatatatatggctcattaaaactaatcactaaactggagtataatgtgatggtttgttgggaggtaatttggtattctggagatggaaggacctcaagttttactatacctacaatacagcaatttacaaactattgaatttattttgtgtcttattcataaagatttggagatctgtttgttaaacatgcacatgtgagtcatgcactattaggtaggcatttcatctatattgcaactaattctcacaagaatactaaaaggtatcgattataggcctattatgcagaggagataggagaggatcagtaaagttaagtaactgatccaaggtcacagtgcaagcaagtgaaacagaaaccaacccctagtttctctggctgtaaagtacccattacacagtcacagttcatcttagggtgggcagagccattctcactaacttgccttgtgtgagctaagaccatttctttgccttgtgatttattccatccttatggcagttgggctgactccttgacgtgacaatatcaacagctgcgtgttggggatcacttgcagcatggatgttagtaagccagtagtattcagtactgtcacttggaaatgactgactgctcaaggacataggggatttttagtagaacttctggggaggctgcttagctctgatggtgcttccagacccatcatttgtcagtggttgtgctgcttgacagtaacccccatagggagaggttggctcaggcttgrctatgagtgagggatgttagtggggcctccctgctccaccgaatctgtgtctcagctcttgggcatgtattcacctgccattgtagatgtggtcgtggtttgtctggaaagcttatctccaactttacttaggtccaagattagctttcaaatcatttatggtggtggtgccttcaatgtgaggatttttaccaaatcatcttatgtaggtgcaaaatgatcagtattcaccaatartgttttaataggaatcttgagaatttgccaattatgtgaatgactcagggtcaaatgagggagcattgagactcaaccattttttttttttttttttttttggctctggaaatatttctcctgtgcgatctcttaagggattaagtcaacatggtcacttgtaccattaccttagtcacttggcagctgaaaggacacgtgtctttaggtgaattttctttacaatgagatcatgagctcatagcttgcttagcttttcttaatttccacgagtcataacacccctggaacttaactttgttttctgggccaaggcatccctgtagaatggattattcacactgtacatttaaattttttagaagtgtggttctataatttgccacattttatgtaacaggaaaatatttaatggccaagtgttacttacctaaacctctctacctctcagagccccagtttcctaatctgtaaaaaaaggaggaaattgttctatatgacctcaaagggcctgttccrttctctactgtatttatctgtgtgcaacttggtcacacctgcctgtctgcatgtagtaggcatgggggtttggataacgtcgcatccatcctctgcttctctstgtccaggygtgtgcacaggcagctccactcggcacatcgtgacctttgatgggcagaatttcaagctgactggcagctgttcttatgtcctatttcaaaacaaggagcaggacctggaggtgattctccataatggtgcctgcagccctggagcaaggcagggctgcatgaaatccatcgaggtgaagcacagtgccctctccgtcgagctgcacagtgacatggaggtgagaagtactttctgtggatccrtggtaaggcaatagaatgtcaggaaaaccacctggacctggtggcagttgcttttagttgatgctcttgttaggagctctgccttctgcttaagtggaggagaggagtaccactttcttagaggggtttattgccatccccttgtcttggcgtgatttcatgttgttccgggctcagatttgcaagatggaatcacttttagatagcataaaattgtgaatttagtgccagtttctggcactggtggagaattgggattggcatcaggattgttyactcggaaggtattatgagtccaatgcctaaaccctgtaagctttccaaagggaaacatttatggcctaaattaggtcttttgaaaatatttaaggcctacataaaacgtcaggctccaaaatttgaaaagaaaactgcaaaactgatatatatatatataaatgattgattaaatgcttacaaaaggttacactatgccaacttctttacttgttcgtgtagaaatcataaatatttcattgtgtgaaaacaacttgtaagctagattttctcacttcgcaagaattcctgaatttgaacaataattgcagaaaaatcttagtcatatatcaagtgagtaactcatagccaaaaattaaaaaatcaaaatgataaaaaatccttccaaaaattttacagcaaaattatattcattgtggaatgtgagtacattttaatgtgtttgatatgatatatggtggggctgcccaagaaagagcgtctagtggcacacatacacacaaagaagacttaaagtggtcccattaaaacaccagtgtccaaccttttggcttccctgggccacactggaagaggaattgtcttgggccacacatacaatgcattaacactaacgatagctgatgagctaaaaaaaaggtctgggcataattttctgatatccaccaccacagagaagcaaaaatgtccttgcattcaaagggttggacacagctgctagatgctcttggagacactgctctgatgagttggcaataaggcgactttcccagcctgtcttaaaggcattgcccttccctgttgagtcacatagactcaaggttccttttaatctccaggcttttaggttcttggtgcatggccacccgtacagtattacaacagcctgttttctggtcaagctctgtaaagtcaagctctgttttctagtcaagctcttctttatcttagaagagctgccgacaaatatcaaggtttgtggctgatgttgcagttgagtgtgatgaatgtgcaggaactctcggtaacttccctaaaaacctaggattcctcattgctaggactacggatgagctctttcttctttgtgcaggtgacggtgaatgggagactggtctctgttccttacgtgggtgggaacatggaagtcaacgtttatggtgccatcatgcatgaggtcagattcaatcaccttggtcacatcttcacattcactccacaaaacaatgagttccaactgcagctcagccccaagacttttgcttcaaagacgtatggtctgtgtggtaagaacattttctcaactcctcttctccccctgctatacatttataaaccttacttgctctactctgaggctcttggatgcttatatttcagggtctagtagcgagggtcagattctggtgaggatcaagaatggcctgtctctggcatcaatgtttttgtacccagggccactcagtttatcttttttttgtttgtttgtttctctagggatctgtgatgagaacggagccaatgacttcatgctgagggatggcacagtcaccacagactggaaaacacttgttcaggaatggactgtgcagcggccagggcagacgtgccagcccatcctggagkagcagtgtcttgtccccgacagctcccactgccaggtcctcctcttaccactgtttgctgaatgccacaaggtcctggctccagccacattctatgccatctgccagcaggacagttgccaccaggagcaagtgkgtgaggtgatckcctcttatgcccacctctgtcrgaccaacggggtctgcgttgactggaggacacctgatttctgtggtgagtctccaagttacctctgaaaatcctggagaccagctaactgggcttgctcagcctctctgtgccccagattctttatctggctaataaggatgaaaatccctgtatttcgtatgacctggrattccagttaggatcaaataagatggaagatatatatatacatatacatatatgtatatgtgtgtgtgtgtatgtatatatatatayacacacacacacacatatatatgtatatatatacacacatacactctgcaygtagaatttttatgtaaattaatgcatggtcctttccattagtatttctatagttcagacaaatgcgattttaatgtgttagacacatataggcatctgtaaagggctgtgtaaccagtcacattgaatttgaaattccaccaagctttagcacacrcttacagtgtagtccatgcctgagcaggattttgaagtgcaagtagaatcattggttgccaagagtcttctcagttataaacactgcaggattgctagtgcagacagcccctccccaaggtcagcttccctacctggacttggcatttatttaaagtacaggggaaactgaaatgaatcagatatggctcctgtccctcaggggtgctggagtgaaaagaatactgaacttgaaaccctcagtcatcaaatataatcctcgactatttttttgagggaaatcaatatgtacatgcctgttagagcctcagagtttatcatcatggaactgtcagcagctctgagctgggtctggaggacttgggcatcctagtcccagctcagctggtggatggactgttctcttagtctttctggacctcagtttctgcatcctagaatgagatagttggcctagataacctgtaggttccttagggctcygattttctgaggccatgtggatgatactgcctcctcccaatcagcctgcaaatcaaggggcaaatgttagtttctaagttactggaagcactttctctgcatactgatttctttgtgtacctcctggttatttactgtgcacacagagggaaatctttggtgctccaaatccttggaaacttcgtccatcacctgcctgccttggtgccttgaggatgtgaggaagttgttgagcgaatcagaacgagggaaatgaatcaccttgtagcttctctcccaaggcagttctaagctgtgtattcctaatttaaagatgcttttcaagcataaaagacatatgtattcaaaaaaggacaacaaaacctactaaggacacacaggttcacaacatttgttaggactagatttggctgctagtagcagagaattaaaattttctgtcatacaactgatcggaggcggtggctccagctgattctgggcctcaaactggattctagttccttgctctgccctcagttgggtgtggtctttttcttcatggtctaagatggagttctagccatcacattcatgctccaaggaggaagctgagggaaggagggaagagggacaaggagcatgcatagctgtcttttaaaatggactcctggaagctgccatgggatactatactttcttttacagttcattgggcagaactagtcatgtgactacacttagctgcaagaaaggttgggaaatatagtcctcattctggtggtcatatgcccagcctaaagttctgtttctatggaaggtggggaggatgaagattggtggaaaatagccgtctctgccctggcaagtttgtctgatgattaaccatgttgaatcagctgtgcccatttcactctggctggtgtgggcctttgcaagtgacctccttctctgtctacagctatgtcatgcccaccatctctggtctacaaccactgtgagcatggctgtccccggcactgtgatggcaacgtgagctcctgtggggaccatccctccgaaggctgtttctgccctccagataaagtcatgttggaaggyagctgtgtccctgaagaggcctgcactcagtgcattggtgaggatggagtccagcaccaggtaggagcctgggyctttcacttcccatggggctgcttccctcttgggtcaaaagggagatatgttcaccagtgattggcctcttccaactgtggcagcagggttgactcttacggggatcattagggatagggaggcagtattgtgtaatggccttgcattcagatagctcttggttcaaatcctgcrtctgtcatgtattatctgtgggattaaacatcaaagtgttgttaccacattattattatgattgttattactattgtctttatgattatagtcatttaagcagaatgatacagaaatccaggagggaaagggaaaagaatattttgtgtcataatgtctgccattgttaagagagattatgtaccttgattgtgctaaacmcaatatattcattatctyagtgtttttcaaaggtgtattttgcagggtattaacagttacttgtggtcaagtgagtttaaagaacaccagctaaccatagttaaacaggyttctttattgcagaactctttagtctttttaatatactactgtaccttgcagatatttaagagagtttttgtttctcaaacttatttgatcatggagcgtgtgtgtgcatgcgtgtgtgtgtgtgtgtgtgtgtgtgtgtgtgtgtgtgtgagaatcccttgggactgggattccacagaatacattattgtatcctgtgtcactcataaatacaaaaatcctatgaagaaactaagacctaaagagctcagtaagttacccatggaaacaatttataagtaatggagttgatctcagaatttgaagctctatgtgactccaaagatctggctctttccactatatgaaatggcccttttgctgcatcttttttgggctgatttgcttgggagtcactgagtcatcaaatttttttttttttttttttttttttagctctwtgggagttattgagtgtattttgaaagcatatttaccagactcctccgtcttggcctaaaatggctgtcatctctcttcaaagttgaccccgtgtatatttgtaggatctggggcagtgtgtgtctgtgcacatgtgaacgtgtacatgtgaatgtgtgcagtggccctgtccttcatscttgacagtgatactacagaccgtggtagagatagaagcatatttggcttctaggaaaggagaatgtgttttgtgatcatggactgcactcaagacctaatgtcttcatcgccaaggaggaccattcttgctaagtggaccaagtagagtgacttaccactatgttcaaccacgaataggagaactcatggtaaatgtagctaaccagcctgcagaatagtgaaaacaacatttcagtaactacactattctgtccctgatgttataagccaggatagggaccattttatatgattctccccaaagctctrtagggtcataatcgcacatcctattgaatggatgagactgaggctcaatggcatgaggtgataaagctgggatttatattcatarcatcagtcatcctatagtgtcctagccctgccattgacctcactggaactgtgagctgaactctgggctaactcatgttcattggagcatgggtatccattagggctattacttatagtcacttatagtgatctcatctgctctagtttagttgttgggctttgtcctagtggatccaatttgtcctcaccgtggaatagatgagctaaagtcctactctactgccatatttcaacttgccaagttaagtaattgcctgttctgtgatattccctaaatgagttgacaaaaccttatattcctctccttgatttgtatagctcctgagctcctgcagggcttgaatgatgtggaccaatttacatatggggctagaaacctgtggtaatttcagaccggttttactagtagtggcaaaatgcttgctctcagaaggagacagaaatgatcttttccttggcgttctgtgatgagaagtgagctcaagtttgcagcatttctggctcatgagtgtcaaatgtctgcaaggtcctgagagcaggaagactgtgaactttatcttagtgtctccaaacccctatcctttgcttctcctytctggtgctattttcccctttcactgcccgcctcatcttcagtccaacacattagaatatgcattcaagttgtataaagtttccatccaaatattttggatgtagaaaccgtcttataaatatattttaaaatcaggtaaaataaaattagttaattgaaaactttgaaaacaacacagccacttttagtgatttcagaaaatacagtttaaatgaatgaaaacaaacatcatatccagccacgtgcattttyaactttgactttcaaagcagagaaagaataaaaacctaatgtgaagaacatttccattaaagaaacttttttttttaaactgaaaaataaagcccagaaaaccttttattaagggaaataaactagggtataaaactattgtagtaatttcrgaagagcaaaatattcactagttttcatagctcttgtttattttacaaaacagagtctaaagaggtgagtctttggagtaggatcagaagggaccaagagcctgcacaggctgtccctggctcagtggagctgctggtggtggtgggtgctgtagtgacaggcacaagtttagcaggaaccttgtccatggcccagaagctctggcccgtagcctccttccctctcccttagtctctgctgtccctagctgggctcagtgtttgcatttcatttgcatcccccatcacattggctggtggtgggtggtgcatgatgaattgcttgtgtccttctttgaccttgggccttgaaaatgtcagttttcccaccttattctctgcaggccgatctttgtcaccttcattcagactttaactcctgctggctctcataccggttctggcctggtgatagtcacgcctgggccctggaacctggcgattgcractgcctgcstgcagttggcctgggcttgtgcagcagtgccatctgccggccgcgttgctgcatagcctggccaggcctggagagccactacggttgcttttagaagcttggccttagcttgttttttaaatttttwatttttattcttttccctgccttgggcaggccttaagcttcctgggaaatgaaaatccccagcggaggaggttggacacctgcttttggtcatctgttgtgtgttacccattctcaggatagttggaaaattgtgtgatttattcttgagtttaaatatctgaggtctgcrtttaaaaggagagaaaaaagaacactgaaacatatacagaacatgactctctccttccgcatcccctcatgtctgccaattcgaccccctgccccagccctccgaggccagcgccctgggcccctccctccaccttcccagctggagtggcagccgctgtgtcttttctggtttttattcctagtccttcccttttccgtcctgcatgctgtcgccagggttgtctttatttagctcttctctgtgaggcagggcctcctccattgtcttcagccacctgcctcacctgtgatgccgggcactgcgggagtgttccttcgtctgtgcctttgttagctgtttcccacctggaattcctcctcctttcccctttgcccaagtcttcctgtgcttcataggtgcacccttgtgagactctctggagtgcccaatcttagtggactctccttttgcactcttactgctcttttattttttatttttacaaatagctttattgagatataatttacatgccacaaacagcacatatttaaagtgtacaatttgataggttttgacatatgtacacacctataaaaccattgacataaccaagataatgaatttccatcccccaaaggttagcttatgcccttttaaatatatccctcaaccctagacaactactggtctgctttctgtcactatagattcgtttacattttctggaatttcacataaatggaatcatgcctacgcacttcttttctgcctggcttccttcacccagcataacgcttttgggattcatccatgatgctgtctgttttgatagttttctccttctcattgctaggtrgtattccacggtgtgtgtgtatcacaatttatttttctcattcagattttcacgaatgagtcttatttcctcaacctgactgtcagccattcgagggctaggayggtgtgttcagacctgcccaygatgggcactgtgtytgytgatgagaagcagttgtrctgcaagaggctaggcctgtggtgtctggggccagaatgctaagttcgaagcctggatgtgccacttggtcaaatttcttaacttcttggtgtctcagtttcattatttgtaaatatagatactactacttatctggtagtgttattattaggaaaataaagtacataaatgtaaaactcttagaaaaatatcttgaacatatttattattagttacctgtgggaggcagcagagcatggtggtttaaaaccatggatttgggccgggcatrgtggctcacacctgtaatcccagcactttgggaggctgaggcaggtggatcacttgaggtcaggaattcgagacccagcctggccaacrtggtgaaatcctgtctctactaaaatacaaaaattagytgggtatggtggcacatgcctatagtcccaactatttgggaggctgaggcaggagaatcacttaaactcgggaggcagaggttgcaatgagccgagatcatgccactgcactgcagtctaggcgagagagtgcgactctgtctcaaaacaaacaaacaaacaaacaaaaaccaaaacataaaataacaaagaaacaaaccatggatttggattcaaatcctcactctgtcgctgtgcctgtgggaacctagcaggtgccttagctttctcattggaaaagtgagggcagtggtaaaacatatcctcaccgtaggactgcagtgaggattacatgagtgatttaaataaagycctcaacacagtggcacacagcaggtggcatctgaatgttagctgctatcatttattgagtgagtgaaaggtgtcaagggcaggaccagaggrrttaatcctgaaggagggcagggcactttgggggaagggggccttacttgkgggtatttgatcttccttcttagctgactgattgctgactgtggaagtaataagtaagaccttcttgacctgggaacttcttagaggcctttgagctactggataagaatgtgtttcttcaggggcaatttcacttgaatttaattttaagtttaaatttaactttatggctgaatccagagggagactgagtcctggctctgcttcttattagtggagctctttgctgtgtaccctgtgctaatcacagtttctcactccttacaacagtcctgcaaggcaggcttgagtacgctcattttacaggtgaggaaactgaggcacagcggaatgcagcctttgttagagttcaggagttcctgacttcaaagccttgtgctgtggggctgtgtgtaccttcgagaaggctgctctctgccctgggccgtctcccatttgaaaaatcagagaactgcactcaggcctctaaagtcactgcgggcrtcaagaatgtgatgctttcaagagttttgctgtcctccccaccgctcttcctaccctattgtctgaagtcaatttcagaaataaatggatttttttccccaagcaacaacccaatttctcctttggcttgagaaatgactagcagtgcgatccaagaactctcatttttctttctttgcttggttttagcactgccaacagagaaggctgtagtgaaaatttccgcatgttagtttacaaagcaatgtggcaaccacctttctgaaagccattagaacctcacaacctcctttcagcctgcttttgtttgcctgtgaggctctgtcagagggctgggtcagggactggcccttgccggaggcagggagagctgacctctgtgaattctgggcttcgtacctagaatgtcctgtgccctttctgaacctygctttgccctcagttcctggaagcctgggtcccggaccaccagccctgtcagatctgcacrtgcctcagcgggcggaaggtcaactgcacaacgcagccctgccccacggccaaaggtgagagtcctccyctccctggtgccttcatggaggaacaagggcccctgcaaggccccccagccacccatcttcacctctggcagagcagactcaaacactggcacctagagtcctagagtgggtgggcttccttgcccagcctgcatttcccatcactgggcctgggagccccattctgcacctggggtcgacattctcagattaaccctcgcctctggtccccagcaacgstcagacttaagagtcccctggagggtaaatgtgagggtgtcaacaggaacatggggacactcatctgtcagaggtcccgtggcctggatccttgtgggatgacsrtacagaactcctactagttttcagtgagcaagaacatttcaaatccctctgaggctgtcccaccactaatttctctgacttttgtggccgttcctctcctctagctcccacgtgtggcctgtgtgaagtagcccgcctccgccagaatgcagaccagtgctgccccgagtatgagtgtggtatgtgtcccaccagggggatgtctccagggcccaaccctagccccagggggcaccaygttgaaggtgctgaaaggtgtctctgttctcaggcacagggtgtgtgaaaggaggtgggtaaggaccgaytggatactccaaaaaartggaaagggttacctctggagaataggatttgcttcctagaagaatctactgtaaattactaaacacaggtttgacaggattaatacaagaatggggtgattactggggactrtggagatatactgaagaaaaggtcaygccaaagcaacccattttcattttcaataagattttgaggctgctagatatagagaagaccacacactgggcaccttgagttcagcaggttgtttgctagaggttttcatgctagccttgcaggctgctctgtgaatagtgggctgaataatggtataagtccgtgaattcagagctgatggaattacggttagcatggcaggaaatcattagtgcctttgtcccagtcctgtccagtgtgtttattgcttgtacagatgaagacctaaagcacaggcttgtacaatttgcagtgatgcagatattgaagggagagcagatagatcaggggacagtccaaggaactaaaagaaaatcatataatcggagaaacttatttgtactcrtgaaattgatcagaaataaatagaagtcctgtaggggagggagatgtggcttgagaacaattaatgtaaaggaggtcttagaatgttagcagtagagagaactagagggatcatttacttcaagcccctcattttatagacattactagtctcctacaatgtgccgggcactttgcccttattattttgtgaactcctcagactgatcctataaggtagagttcccaccttccagaagaagaaacaggtctagaggatccaagttgacttggctgagatgtgaaagccctagtggatgataagaataatcagtatgtgacttggattgatctatctgtctgtctgtctgtctatctatctatctatctatctatctatctatctatctatctatctatctatccatctatccatccatcctatgtatttatcatctgtcctatctctatctaacctatgtatctatttatcatctatcctgtctctatctatcctwtgtatctatcatctatcctatctctatctaagctatatatctatttatcatctatcctctatcatctatctatctatctatctatctatctatctatctatctctattgtatctagttatctatcctatatctatgtatgtatctatctgtctgtctaatctatctaacctgtgtatctatttataatctatcctatctctatctaacctatgtatctatcatctatcctatctctgtctaacatatgtatctatcatctattctatatctatctgtctatctaccctatgttttatcatctatcctatctctctctaagctgtgtatctatcatctatcctctatctatcatccatctatctatctatctatctaatgtacctagttatctatcctgtatgtatgtatgtatgtatgtatstatctatcaaatctatctcatgtatctagttatcattctatctatctatctatctatctatctatctatctatctatctatctatcctaacycatgtaatctctgtctccatcatcatcacttacctaaaacagtagaagtctgcatgaataggaatgtagcatcccactcacaggtaataaaagagtaacctttctgaactctgcatggaygtctctctttctggccctcagtgtgtgacccagtgagctgtgacctgcccccagtgcctcactgtgaacrtggcctccagcccacactgaccaaccctggcgagtgcagacccaacttcacctgcggtaaggcctctgtggatgaggaggggtggtgtggcctctctctgctggtgtgagggaggccatcctcctcagggacctcttccaagatcacgtcatttcctgttttctacctagctgaatctgggttgggagtacatctggaacagaggggttagggtcacacctgcacggaatccttccggctgcacgctgctgaaggataccaggtgtgggcacagccacaggcacctccgtcttgggtttatgaagaagcagctggggctgagatgaggaggcctccraatctaatctttatttmtgcccatcctcctgtatgtcatcaaggggagggaatgtttccttgacttcccctcatcattggatcttattcccaaacaaatttatagtttttygcctctgaaggtgtatatatgtaatcactatatactgtaacttaaacatagcgatggactaaaataagacacgacaagaaaccaaattctgtatttacctcccgagaatccccactctaactccgttggcgttcttgtcctgctgatgtggacactcacccgacttcctagatgtgagacttcaaggtgggaggagagcacattgtgtttgaagggagctggaaacaggcaaaggacacagggacaggatttggtcttttaaaagtgacattgtggctttgacaagattgctggcaatctttcattccacactgattgctggcggacctaaagtgtagggtattgttctaggtactgaggtggggataggatcacagaagctcctggcatagaacagtgcttagcagggcgtggtgtacccagacctactggacttagagattctacatctgacacctctgagaatgaaggaacccgccccttccagatgtatgtgggaaagtgatagagcagggattgagcagccttcacttctmctccattagagttcctagcttcacatttccctttttgattaatgttcatatttttctgcagatggactgcttttggtaacattgaataactcccagcccgtgagcttggccctcacacatttctgacttaatcttctgagtctaaagctccctggcaccctatagcatagctgaatacttacragccctggctgggcgcagtgctcagtgtggccttgtcctaycctcagcctkcaggaaggaggagtgcaaaagagtgtccccaccctcctgccccccgcaccgtttgcccacccttcggaagacccagtgctgtgatgagtatgagtgtgcctgcaactgtgtcaactccacagtgagctgtccccttgggtacttggcctcaacygccaccaatgactgtggctgtaccacaaccacctgccttcccgacaaggtaaggactgcttggctattaactatcagttaatagtttactcatttatttattgctgtyagtttatccttctatccacccatccattcatccatccacctacccatccaatatttgctaagcaacrtgtgctcctcatggaagatttgcatcctacccagcattcccttcttgcccaaaccaagtgctacaaggcttggttggggggcagtcagcattccagctcagcctgagtggaaatttagttaactcaggaggcatttcttgtgagcctactatgtactaagcatggctaggtgctgaggttacaaataatgtgcaggacatggtctttacctttataagcttattttaggttagctaaggaaataacatgattgcatggattatttagagatcagttaatagttatacatacatgttgagatgaggtcttgctatgttgcctaggctggtcttggactcctgggctcaagtgatcctcccacctctgcctcacgagtaggtgagattacaagtgcacaccaccacacctggctacgagcagttaatagtttactcatttatttattgctgtcagtttatccatctatccacccatccattcatccatccatctgcccatccaatatttactaagcaactactrtgttctaacagaattggcactgtgctaggtgctatgggagaaatgttaagatgaagttcctatgtatgcccttgttagtatatatgacaatagtctataaactgaatataataaagtgtcaacgaatggtacagattttcattacaaacagcagtcttataggtgaaagagccaccaagattagctatcattaaagatttaattgatggagtgggaaagtgaagggcgcgaaagtggcggagtgagaactgaaatgagccagaactgcagcaggaagacctgagcatagttatagctgctgcattgaggggagtcctgacatgaatgacagacaagctgcagtcatctctccttggagcctgttagggctggaacagatctttatttgtctggaatgcttaagacctctcttcccctctggacgctcttccagctcagggattctaagcacgcagttttggagaagcgggaacaagtctaggaggctacagttgctgctgctgctttcttatatctctgttctccttctcgtcttcctgcccacccctcctgccttgctgtttttctattaatgtttcttgtgtgtctttaatctatagtaatgccactccccatttttatgcctttgatttgttggggaagctgggtcatttgtcctgtagaatgtcatgaattctggatttgactagcagccaccttatggtattgcataatgtgttcctctatcccctgtatttccagtagactagaagttagacccaggggattcattacattcaaggtcaatgcagtagggaggcaagaatacctgatcaagggtgccatgtgcatcacacccagaggcacataatgtccagctgtcctcctccctccctccctccctccctccctacgtcacttccttccttccytccctccttccctccytccctccctccctcactccctccctcactcctttcttccttccttccttccttccttccttcctttctttcttttctttctttctttcttttcattcgttcttcttttttttttttgagatggagtctcgctctgtcgcccaggctggagtgcagtggcgcagtctyggctcactgcaagctccacctcccgggttcacaccattctcctrcctcagcctcccgagtagctgggactacaggcgcccgccaccaygcccggctaattttttgtatttttagtagagacacggtttcactgtgttagccaggatggtctcgatctcctgaccttgtgatccacccgcctctgcctcccaaggtgctgggattactggcatgaaccaccgtgcctggcctcgtttttcttttttttttgagtcgctctgtggccaggttggagtgcagtggcacgatcttggctgattgtagcctcgtactccctggttcaagcgattctcttgcctcagcctcctgagtagctgggattgcaggcgcacaccaccacacccagctaatttttgtattattagtagagacgggatttcaccatgttggccaggatggtctcaatctcttgaccttgtgatccacccgcctcgacctcccaaagtgctgggattacaggcgtcagccaccatgcctggcccagctatcccactttgagagataggactgattatgtgttcagatgaagcaacctatttctgcattgtgaagtttaccccatcaacaatttatagttttactatttataagtgtttgttgtctaagatttattatgtcattaggagtttcaaaattgtgacttttctctacttctatcatactgattgcatttattaactggaattctcccgtaagaaagaactttctcccaactgctttcagttaccctgaaataaaattactttagacaaagtagaataagtgcttgattttttcttttccagttttcatagccatgagttgatgctctagcaactgtcaaggacagcgaaagaggttttttgtttttagcttcattatgaactcatggattcttatgtgtttgatgtgtgttgattcattgtaaactttatttttttttgatattcaagttgtcctccctggggtaaatgggggctcttttaagttggctctggagcctgttggcatggcctcatgagtctttcgtagctktcttgctttctgaaacaataaggcgtgctgggctcaccctgggcatttcctgccctagtccttggatctgccattttgacaaaagtccccctaccttttagtgaaagtggtatttaggcggtatgatctgggtgccaagaatatttatggctctgggttgccattgccttcagacctttttggtgaacagagcttagaaatgcatattttaagagaggataaaaactcgtaaatttgtagtggtatttctgattcaaatgaaattacaggactttacttccttgattttttgcttgtatcatttctcttctaagttgaaaattctggtttcctaacataattaactacttatttgctttatcttgcaatatacctgtaatagtttcaaaactaacctgtaatcctagcactttggsaggccaaggtgggcgggttacctgaagttgggagttcaagaccagctggccaacatggtgaaaccccatctctactaaaaaatacaaaaaattagttgggtgtggtggtgtgcacctgtaattccagctactctgtaggctgaagcaggagaatcrcttgaatccgggaggtggaggttgcagtgagccgagattgtgccattgcactctggcctgggctacagagtgagactttgtctcaaaaaataaataaatacataaaatttcctttcagttcttctagtcctaaaaaaaaaacctcattgggggatatttgtgtaaatactaggttttgaagtcatttgaaataactattataattatattatgatgtaatatatcatataattattataaataataattatgtgccactgacgatatctagttaatatttcaatttgttttccatttttagggattgctttttatttcttttaaattttaaaattactatggtgtaaaacacttaaatgattttaaaccccaaattataaaacaagacatattcccaggagtcttactctgtgttttctctaccttattccttcctccaccctataatttatatatgtgaatatatataatatataatatatatatatakagagagagatagggtcttgctctgtcacccaggcacaagtgcagttatgcgacctcaactaacttcagcctccaccccctaggctcagacgatcctccccctcarcctcctgagtagctggaactacagacatatgccaccacatccggctaatttttgtatgtttttgtagagacaaggtttcatcatgttacccatgccggtctggagcttctgaactcaaccaatctgcccgcctcagcctcccaaagtgctgagattacagacatcagccaccgtgcccagcctttataatttttattagtttttctctttttgaaaatataactgaattttatacatgtatatttcttcccatttctcatagaaaggaagcatattatgaattatattttaaattgttctttctcatttaacaatatttgatggagattattctgtatcagtgtgtagagatctgccttattctttcttatagctgcatagtactccattgcatggcagcaccatagttttgtttcaacaagtcccttattggtggacatttgagttgcttcagccttttgctattacaaattgcagtaacaaacagccgtgtgcatctgtcattttgtggtcttgccagtgtgtctttgggatagattcctggaagtgagattctgggtcaaattataaatacacatttacttttgctaagtattgctaaacaattcttctccatagggatggtaacattttcctgcaggccttttaatagaacaaggggtctcattcartaagttcattatacagaagctagaagactgagaagataaatgataatggtttcaaaatgtttgaactgctattatgacattcacagggtggagacccgttttgcataactttggagggcatacttgggattaatttcaaaactgtcattaagtcccgtgatcaaacagcttccttagctcctcattccaacaaaaggatgtccgagcattgtctgtggcgtgcatcccagactttccacgtttccctttcaaccagcctttttcatctgttttcccacatctctaccagagcctattgttcttcccaataggatcccttgtctctcaaacatatcccctgctctgtgtcccagagtctttacttgttatgttcctagtcactcgtgggcaaggggacatgcattcatagcccctgcccaatttgctcgtaagtgggcagagggctcgatgaggatgggctccaagtccaaggacattactgggtctgggcatgtgggtacagcttctcggtgacataggaaggagtgaagtgcagttaaggcaggaagaagggagaccaaggcagccagtgtgttgtattcaagtctgtgggaccatgaaggcctcacgaggggccacccctgagagactggtcatagcttttctaaggctggtgggcagggaaaggaggaggacgaaatctgctttataagcagccctgcatatgggcggagaccacatttggttttatttattgccacattctcagcacytagagcggcttctgtgtagtaggtgctaactcaccgcttgtttcaatgaaacaaatgagttcactyaygaaaacttatgtctacaggtgtgtgtccaccgaagcaccatctaccctgtgggccagttctgggaggagggctgcgatgtgtgcacctgcaccgacatggaggatgccgtgatgggcctccgcgtggcccagtgctcccagaagccctgtgaggacagctgtcggtcggtgagtggggcaggggctgggcatgcctgcagctatcagagcgggaaagtagaggagggcatcttaggaagggtaagaaaggttctttttttttttgaaatggagactcgctctgtcgcccaggctggagtgcagtggcacaatctcggctcactgcaagctctgcctcccgggttcacgaggaagggcaagaaaggttctttagtgacctctggttcaaggctaggggtgaggaagagggagggggttagggctgggtaagaagaaaaagcatgagcaaaggatttctgcgtcatccttctgcagttcagtccttggctaatggtcacgtctgttgtatggccttaagtctaaagtactggtggagtaggtttgagcagagacatggggaggactaaatgcctagaaaagagracttgaagttttcctttttcttccaccctcatgtatcaccttcgcctgtccctagaacaaatgtatgctctgaattttctaggatcgtccttgtttcagtttactctggtgtttccacatagactgttgattttcagaccatgtttataayttgaggtacggaaaacatgatccctgtttcccaaatccagttcgtggtggctgcccctgaggctcctgtgtgtgctggggtgccctattcttgcatgtttaggatggatcagactggagaaaaagggagcaacaatctgcagggaggactgtgggtaaaattctgcttgctggtttaatgcgattattattactacattattatcagcagataatgatgttaagagaagaggtgccagggcaggcgagcacatccatcttgtggttgcttttgcaaatgtcaatggcagtgaaggcagagttcctgaaggtgttttcgaggtgaatggtttgacggaggagggcctgagggcaaatcccgaaacccaggcccttcacctgctattctacctgcatttgggtactgagagtgagcggaggtgctcagtacctttgggagaggatgacgctgtggtatccaggtgttcctgtgggaaacactaagttttggaaaccctttggttttcttctcctctcacaggcsatctgaggccagggaaataacttgctgtcaaataaagagagtgctgcttagaggtcatttttagaaaattgacaaccaatatatttcgtgtttcagtggggagttttgcttgcaaagaatagaacccattcaggctagctacaataaaaggggatttgtagaaaagatacaggaggatctttcagacaggaagtgcaggatttgtaggtgggcaccgtggtcctacagcatgtctctccatttgtcctaagagccggtatttctgtccgtctgctccagctcctcactgcaggccagcttcctctgtgcagaagttttgctttctcacacattttgtttacacacagctttgttaaatctcacttcaactccacacagcttttcagatccgtggttcatccctgtccagtctgacttagttggtctttgtgtttcatggatcaacttctcaagaggaaagttgacaggcccagctcagcccttggatcgggtccgctgtccagttcatgctctggtccagtcaactattgggggagctgcaggtcctggggtataatcctggctgcgtagaaaagctgggggaagtttcaaaaagaagatgagtagggaggtcagggcaggagtggmggaggaaccatgtctagaactcttgaccgtgtgattgctctagggaatcgagtgccctgtcttagaggctgaatgttcacatcttctggggaggagaagggagcctcatggtttaaaatctcaggggacgtgggaggctgggcttcgatctgtactgtgttgagtgaggtgggagcttaagtaagttacagatggtctcagacttcattctgcaaagagggtagtattgttagcattattagctctggtccgacctcagaggcacttgggctcatatatgccggtccatgtgttgtctaggttgtgacagaaaagaaagaacaacactaccatcatcaccctgaagccacagtctgcagaaacacactttccccaagctcctccatagttctctgctcttcgtgtcagaggaatggtggcaggcaagcaggggcattggcggcttctcaggaatgttctaagcgggcctcaggcgatggccttgcttccatgtccatagtgagaggaggcctgcacctctgtacaagcctttgaggggattttccatgaagcctgatggccatctgactcctcaccygtaggctcctgaatgaggctcagtcaaggtgtaggaactgtattctgagaagccaaaggaagtccattagatattatttactctgtgatactcctcaggaagaagaagagggagggctgttcttctcagtatcagacaggaaacagggccaccccagggaatggggttggccagaacctctgtagctcatatgaagcctgtggacactggagggtcctgacccgagcccagagctcgtcctgttaggctggtacaacccgcaactccagtgttgcaagggccagtctgacccaggaagtcagcttttcaaactgtgctcctcagattgcctcagaggggacaagtgaccagagcttggcatctaccacctccatttcagttatagcaattgtgcttaaaggattgtgctgctagatacattcataattwatttttcagtgcatatgttttcaggttgggtggctagtagacctacttagtttcattcttatttgggaaaccaatgaaaacagggtggagaagagagccaggagaagggcctgggatgtgtattttgatacaagatatcaaatgtcgatataagcgagggaatttgttggaggaagggaaaataaagaattgaaaaatataggttggaccctggttgtgcagccagaaaacagggttgctgtggggtatggaggggaatcttagaaagatggaaatttggagggatggctaaaagtgtctgggtttgagaagctagtggggctgtgggaacagacatctggcctgggagccatccgtaatattgacactgtttgcccatggtgagaggcaacaggaaacaaaaataatatgcgaatctcgatcattcagccttctagagaggcgyacgagaatgacagcagatccctaaaggtattaattactgtcttctgtgttctttgagtctttgtttctgaccccctgagaccttgttttttttctttaatggcattttgaatgttctgctgtatcttggagggtgtgtacacagattgaggcatcctaatttgttgtctcctccrtagtacctagtacatcataggtgcacagtaaatgactagaatcttggctgataaaagcctggagacagctcactgcacactgctgggaggtgggcggtgatatcagtaggtctygtggagactgggtggggttgagccaagtctcaggagtgttgagaccgtccagagagaggcacacgtgttgtgcatcttcagattcggccctgctggggagagtgcttggggagcagagcaggctgccatccacacccgtcctgaacagctgtggttactctttctctcttaaggacacagctccaagatggaacgtagtcctgggttcttttctcttggctcctgggacaaacacactgtcattgctttgactattctttctatagacttttcagaggagggtttcagtccatgttcatgatgctttagccagattggaggaccttctagaggcaagatgggctgacaaacttccaggatgctggtctccctggcatgctttctggggaagctttgtctgttgctctctcatctcacttttcttttgtaaagaacaccgtaccctataaattactaggtaaatgtcaagtaacctcttggggaagcccaaatctgcacgttggtgagcagtattgggatcgagtgttcgtcttgtatgggaggctagccctgcgagagtggagactggatcccagtcatcctgagtgtgcctcccggtcagtgagggtccctagagttggccatgataagggccagattagtaagctgctgctaagggaactctgggctgtctttaatgctcctatggactggatcatggtctctctcaaagtgggatctttcagggggcagaattatatctctgcagctgatgtaagacttcgtttagtgacctggtggttgctgcttcttggcatggccctgaggctggttgacaacaaagatgaaaatgcccagaccagtgatcacttggcacaaccccagggctcagtacgcaggaggcgtaggtaagagcccctgtgtctttgctgctggcctgtccttactctgttttttctgcttttccagggcttcacttacgttctgcatgaaggcgagtgctgtggaaggtgcctgccatctgcctgtgaggtggtgactggctcaccgcggggggactcccagtcttcctggaagagtgtaggtccaggcccccgggacggggaggagggcagattggggccactccagggaccagcgttgaccttggtttcatctcattccctgccctttgctttccccactgggcatttyacccagctgttggtgttatccagatgccagctgggatgacctgccccttaggaasyagttaagacggcctcagscttcccattttgtagattttgggagaagcccagggccctcccrgggggattcatgctctctcattcacctgtgaatctgaggtgctgtggctgaggggctggttttgggatggcctcaccacccctccaaagtgccacaggctgcaagtactgttctggaccacatcaacccaggcagggtcctcagaccttttcactgatttctactgaaacctccttggtggttttagggaggtggaaacctttacaacccagaaaaggaacagtatttcccacagtccctctgttatttctgcaggtctggctggggcatcttgccagccccccattgccccactcttgtcctctcctggctggctcacccccgccagtcccttcttctaacacagagcagttcagctgtcccccatgtgctgccaggttctctcttagactctgatgctcatcaagccattttcttaaacacagaggattccgtctttggcrgttttagtccagatgctaggagaatcacagttctttcagtctggtcagaaggataaggtgggtggtgccaagtcctggcagccttgggagctggtgctgggaacaggtgaactgcccatatgggccttgcctctgtcttccccagcaagaccaatgcgcttcccttcgagaggaaggccaaaggtctgctatcttgtcctgagcctttccmatctcctacccaggcccattgcctttctcctccccagtgataacagaatgactcactgggctttttcaggtgagtttccacctccccctctagtccgagttgcctatgggttctcttccctgtgttctcccctccccaccttttagtgcttctgctcccatgtgccctggatggaggcaggttttgtttcttctccccagggtcaaggtccagctcagatcaggggctgccccatcctggtggggctgagagctggtccctttgcgctcagtattcctgcccctttccccatctctcatctcccttcaaggcctaccccaccctgcccctcatcagtgtttgcaaagcataaggtgacctgggcttctctcctctacctcaagtctccatcttacctaaaagacttgggtgttggcaatggctttgctgctgaaccatgtcaggggtcagcggggggtggtggcaatgggtcctcttaatgagccagtggccaaggctcagtgagtgagtaatcagaggagggagaagtctggagggtggaatcaggcctgcagtgggaagatttggccacagggagtcaggagtggggggtgaagagaatggctgcaagtgtttggcattttctacacctcatctggaaggagaagaaataagcaggcaccaggagaagtaggtcagggcctgagatggcggcagagggcacctagttacatatctgggtgctggccgacacagagggcactcggagtgacattttctggggaagatcctcctggtgacttttctgaaccatggtcttgggccctttcagcttcttgcccgtggtgacaacccttggggtcaggctacccatgtgcagtcttcgtggacagattgcagggctgcaggggtcccaggccagccttcccgggcttctgccagctccctgtctccccttaccaygggaagtggcaccagcctgggaaatgggttgagcttcccggctgcaccttcccactgatggcccacagtgctgcttcttggccggagtatctgagctcagctcaaaccaatgctgaggaagggagggtgagtcccctggcttctccaaggtgcttgcctgggtgcctcagtcaggtgattttgacccaaactgtttgagtggtgctcactgagacgagccccactcatcccctccgtgggccctaccctgtggtgggacttacatgttaagccaggcttcacgtctagaaaccaccttcctgagagaagagcacattcccamtgggaccctgggctccagccctgccccagcttgttggactaactctggtgccctgcaggtcggctcccagtgggcctccccggagaacccctgcctcatcaatgagtgtgtcygagtgaaggaggaggtctttatacaacaaaggwacgtctcctgcccccagctggaggtccctgtctgcccctcgggctwtcagctgagctgtaagacctcagcgtgctgcccaagctgtcgctgtggtaaggcatgcaggctggggctgggctggaccgggcaccacctttaagcctctctttccacttttggctcctgaattctttgcctttttagcaacttagggaaatggataggaccgaaatcttcccatctgctcctactgcttttatgagaaagcaaattaaatgggaaaaccataggaatttcctgaagatcactacatggcaagactgggattcggccctaggcttctctgatttggagaccacctttgaaatgctgtgacgtttcacccaggggaaggcgttcaacttgccaccccaacgctgccaacaaacagaaaaatggcaacaacaacaaaaactagttctttctaccatatcctgctctgaattttatttatttgtttgtttgtttgtttgaggcagattctcactctggagtgactggcgctatctctggataggctagagtgcagtggcactattttggytcactgcaaccttggcctcctgggttcaagcacttttcctgcctcagcctccragtagctgggattacaggcgtgcrccaccacactcggctaatttttgtatttctagtagagatgtggttttgctatgttggctgggctggtcttgaactcctgacctcaagtgatctgcccacctcggcctcccagagtgctgggattacaggcatgagccactgtgcctggccactgaattcttgaaactgaaattttcaagagtagcgtttcrttgtttcataaacccaaacatcctcccattcatcccatctcttaaatgtaaattcacataagcaagcgctgtcacttggagaacgtacggggctcttctcattgtgggctgcatggggaagggaggccgctgtgggctccagcagtaggacccccagcgctgggttgtggggtggggggaaagggccgaccgatacaggagggaggcccagacacggaggaggagccccaaagagagcagcctgctcgccggtctcaccagggtgtgttttgcccactctcactctgcacttttctctcccccagagcgcatggaggcctgcatgctcaatggcactgtcattggggtgagccgctgtcctcttctccagagcaagtggtggggacagggaagggggtactgtgggaaggggagcaggcaagycattgtaaagcagaaatgaaggaaaccagagagacccaaccccagctttccactgcctgtgggacgtgcctggcatcatggagcccaggctaggaccatcttcctgactctccgggcctgtctcacactcacttcctggcccccacctcaggcacctgtgcatttcttctgtgtgcagagaagcactctgaagtcattgtgcacgttttagtttgtcccctctgccactacctgggctgcctctttggcatgaaagttctcactcttaccatctygatactggaggtgggaggacgggaaggcagtgggccataggagacaggaggagcagcagagcgatggctcatgggagctatgggtgggtgggcaggagacagggtatgagagtgaggtgagtggggggttgggggatgctggggggcctgaccctggtgcctctgcttccagcccgggaagactgtgatgatcgatgtgtgcacgacctgccgctgcatggtgcaggtgggggtcatctctggattcaagctggagtgcaggaagaccacctgcaacccctgccccctggtaagagaggctcaatggggaccgagggcatggactggacgcgtgtgggacccaggcagtgggacctcactgcggtctttaaataaataaatctctcattattttctgattataaacaataattgacaataataaagaagagactaaaaatcacccacccaaactgcatgcctcagaaataattataattttagttttataagttgcaaacattttcttcctgagttttcagaataaacacagtatttgccaggcttatgatactatgtttacaattctgtatccctttatgtattttaagaaacagcaccaccgttctttgaaaatattaaaaattagtcaacaaatatttatcagacacctcctatgtgcaaggctctacacaacattcctttgaatggatgtgcctcgtgtatacaaccaagctattattgcgggacatttggatggtttcaaatatttcaccctgtttttgccaggccatgctgacgatgcttgttctgaatacttccttgaggtggttctgagaggtggactcctcgttcctagtttgggagatgaaactggcattccgtgggtttcagctgtgacttttagtaacacctcactgggaagttttgagcccatggcggcagggcagggcctgcaagctcaggaggggccttggcttcttcctcaagctcccttctggatgtggggcttctgctgttttagaaaatgccattggtcagaggagtctcttgtgagctagatgcatgaactatggcgatggctttctcagagggtacagggaagtgcttgtctccctcagctcggtgagacagtcggggctgcagcaaggtggagaggagcctcttataagcaggcagcacagtggccagaggggagggggtgggggccaagaggtcgtgcaggtgcgttttacactgttgaggacaagggacaggtagatgttctacatctgtgttcttcatggcaattagaggtatcatgctcaaagtatgggcttaataaaagaagtatggagcggatgggtctgtaggagacacagctgtttctgagagaatgattcagagagagcattccttaattaggaagaaggtaagtatgtggttttccttttgcttattttttaaaaatcccagttgatgttttaggatttggggcccagttgtgtgcacacgtgtgtgtgtgcgtgtgtgtgtgtgtgtattgtgtaacaaccctcctagaacacatctgggcttccatatggaacgaaacaatgctgcctggagtcgtgtggcatccctttttcctgggatgtccactgaagtccaatcagggcagtcaggagacagcaggccgcccacctcaatgccagcctgtggagacggcactgcagcctgctctctggagggcaggcccgctcactccctgcagtgccctctggtgttcagagggagccacagccgcttcctccgtatctggagaaatccacctttagaatccagtctcagatgtaggtttccaaatactcaaaaatccatggccccatttggcctgtgtattcttcttctttttctccagaattctggtatctcccaggggagtgcaagccacctcctctctcttgagatcccttagattcgccctccctctatgcatctctcaagccttgctgaatccggcctctgctgatcccgttctagctcagcgtcctccgctagtcttactacgtcttctgccacgaagggtctctgggacacctcctgggttgggggtagctgtggtgaattaggtctaggtaggtcggcttgaactgcccacgttgggctgaagtgccagtgttgcccgagatgtgagtcttccgttgcctcccagggaagccagtgctcttacctaaagggagagcagcaggaggcagtttgtgctgacaagtggttgagatgaggcttgacagctgactgctcaaagaaagcatgaggaagagaggtcactctgctgtggaaccctggaaaggcgtcccggaggagggcaaccctgagtggaccttgagcaatgaatgggttgaatgtcgaatagaccttccagggaagggcatggtgaatgaataaccggcagccagaagccggggtgagaaaagggaaacacggggagatggatggaagggctgcgagccgtcgatgaaatacatggaaaggggccctgaggggtgtgcaaggcagttttaggaggacaactgtgtgaggaaagcaggactaattggctgctcagacctaaacaagtgaactctggggctggctgggaacttgctcagcaggaggaggaagaggctgctcctgagaaggatgtttcctgcggtgatcaaatgttctggggaaaacccaaagggcagctctgccctccccttgaacggggaaatgtggaacacatacccccagccagcagcagccaggaaatccagcagtgcccaaacaagtcctgtccatcgtgtgcagctgtggtctggccctgccgggtaggagacatgctgcagagcaggctgttccctccattcacttccatgctctctcctccctcccttgcttcttccaagcccctgccacacccttaacactgttgcccccttcggcttattttctgcctcctttccctyttcttccaaatctttcttctcgcataactgccctccacctttccttttcttggcctaactttgccctctgcctcctgctgtggggattttgcctccctgactgccctgtcctcactggcttttccttctgcctgctcctgaagacacgccaagttcatggcttgatttatgagagcaaatggtttaaattaatctctgagcaagcttactgactcctaaccttgaccttgggacaggtcgtctgtctgggtgctccaaattgacttggtgattcataatagaaaagcctcaggaccccaatgaatggatctctgaatggtgatcactaaatgtggcaaaatgagaaaaagaatgacaacagagttggtttctcacaaagctaaattgattctttaaaaaattctgggattatgtgattacgttctttctgttttttgggggtacgaaggtggaaagggtcaaaagaactataatttgtttttcttctgaaagcaamgctaataatttttagggaatgatgagacagtagatggtagcttggtagctttttgtatgtatgtatgcatgtatgtatgcatgtatgtatgtatgtatgtatgcatgtatgtatgtatgtatgtatgtatgtatttttagacagagtctctctctgtcgcccaggctggagtgcagtggtgagatctcggctcactgcaagccccgcctcccaggttcacgccattctcctgcctcagcctcctgagtagctgggactacaggcgcccaccgccatgcccagctaatttttttcttttttttgtatttttagtagagacggggtttcaccgtgttaaccagratggtctcaatctcctgacctygtgatcygcccaccttggcctcccaaagtgctgggattacaggcgtgagccactgcgcctggctgctttttggtttttattttattaaaattgtttaaaacactcttactttgcaaaataaaaagttgccagccctgtttttctcccagtcctgtgtctcgaagctgcttctttgtccgatgcagatataaataaggcgctcttaccttatgccgcttcaacaagtccctagctgcgctgagctatgattgcaccacttgccctccagcctgggtgacagagcgagaccttgtctcaaaaacgaaacaaaacaaacaggaaaacaagttcctagctgaacttacctcctctgtgagtgtaggggtgccaagtaggggccagatgctggggatacaagagaacagcagagacacaatttgcaacttaccatgcttctcagggagaagttttttccagcattctatgggagttccagttacttcctcaccaatgcttggtattgtcatgcttttcaattttagccattgtgaagtgatatcttctagcattttttccttactgcttctctaatttcagaatcttctagtattttaaatttgcatttctctgttggctaatgatgtggagcatcttacatacttattggccatatcatcttttgtgatgtgtttgttcaagcttttggccatttttaaattgggttgtttgccctttaatgattgattatgagtttttttctgtattttggatactagtcctttataaggtatctaatgaaatattttctttcagccagtggctcagcttttatttttcttaattgtgtcttttgaagatcagaagtttaatttcgataaaattcagtttatagatgtttttcttttatggttagtgctttttatgtcctgtttaagaagtttttgtccattctaaggtcatgaagatagtatcctatgttttcttttagaagcattatagtttagttttacttttaggtctatgatccatgaggaataaattttaaatgtggtataaagtaggggtctcccatgtggctatccagtgggtccagcaccatttgttgaaagatgatcctttcctcattaaattatgtcggtgcctttgtaaaaaatgaattgctggccgggcgtgctggctcacgcctgtaatcccagcactttgggaggctgaggcaggtggatcaccaggtcaagagatcaagaccatcgtggctaacatggtgaaaccccttctctactaaaaatacaaaaattagctgggggtggtggcaggtgcctgtaatcccagctactcaggaggctgaggcaggagaatcacttgaacacttgaacccagggggcagaggttgcagtgagccgagattgtaccactgcactccagcctggtgacagagcgagactctgtctcaaaaaaaaaaaaaaaaaaaaaaagaattgcctgtgtatgtatggaccaatcgctaggctcctttttttctgatcctttgtctatccttatggtctcaccactgtcttgattactgtaactttatggttagccttgaaattagataatttaagtttttcaactttgctgtttttcaagattgttttgggtatttaatgtcctttcaatttctatataaatttagagtcatcctgttaatttttattaaaaaaatgtttaaagtgtgccggattatattgaatctataggttaatctggagagaagggatgtctagacaaggttgagtttttcaatttatgaacatagtatatctcttcgattatttaggtcttgctctcagtctgtgctgctgtaacacaatacctgagactgggtaatttgtaaagaacagaaattaattttttcactgttctggaggttcaagattgaggtaccagcagatttgatgtctgatgatggcctgttcctcataggcagtgctttctcatggcatccacatgtggcagaaggtggaaaggcaaaaggcactagggcattccctttgactttttttttttttaaataacagcacaaattcactcaggagagtggagccctcatgacttaaatcacttaggccccatctcttaatatcatcagttgggagtttaaatcccaacataggaattttgtagggacacacacattcacatcttagcagtctcctttaatttttctctgcaatgattttttttgtgtagatgcacaaattttgttacacttattacctagtatttaaagtttttggacgatattgcaaatggaagttttttttaaattttatgttttgtttgttgcttttayaaaatyagtttttatattttgatcttgtattcttcagccttgctaaattcacttattagttgtagtaatagtgttttttttttttttttgagggggcagattcctaaggattttcttcataagcagttatgacaccttcaaataaagacagcttttacttcttcctttgaaatctttatacattctgttttgtttttcttgttatcaaactggctaatataatcagtacaatattgaatagaactgatgggaatattttctttctgatcttagagggaattaattcattaagtatgatatagttgtgtgttcaacagcagcagtgcccaacctttttggcaccagggaccagtttcgtggaagacagtttttccatcgactagggtcagggggattgttttgggatgagtcagatgcattatgtttattatgcaccttatttctattattattgtattgtaatatataatgaaataattatataactcccataaggtagaatcagtgggagccctgagcttgttttcctgcagctagatagtcccatctaggggcgatgggagacagtgacagatcatcaggcattagattcccataaggagcacgcaacctggatccctcacatgtgcagttcacggtagggtttgggctcctgtgagaatctaatgctggctgctgatctgacaggaggcagagctcagttggtaatgtgagtgatggggagtggctgtagatacagatgaagcttcactcattggcccactgctcacctcctgctgtgcagcccagttcctaacaggccactgaccggactggtactggggccccctgtcctatagcatattgaagaagttctcatctatttttttagtgctgagagtttctacaatgaattggtttaaattttgtcagacagttttgctgtatattttaagatgaccatatggttcccccttaattctgttaacatgaggaattgcatggattgatttcaaatggtgagccaacctttcattcgtttgatgaatcccctttcttcatgacgtgttatcctgtttcacatccagtgctagatctatttgctcatattttgttaaagattttaatgtttatgttaagagtgttaggtttctaattttcttctctttaatgcttttgttagattttgatgtcagggttatgctagatccaacaaaatatggtggtgttttctaaagagcttatataaaattggtattatttcttcctaaaatgtttggcagatttcatcagtgaagcttactagacttgaagcttttcatgtggaaaagatttatatataaaattcaacttttaaaataaaaaaacggattttctatttcttcttgaattagtttggtaaatcagtttttcatggaacttatccgtgtatttaagttggtcaaatttagttacacaaagttgtttataacatttccttattatacttttaatatctgtggaatctgtagttgtaaaccttctattatttctaatattgataatttgtttctttttattttcttgattaatctagctagagattttcttattttgactaatttgtctattatatattaattattattatattatatattattatattattaatctttcaaagatccaacttttgcctttgttgttttactttttatatttttcttttctattttattgatttctgcccttatttttattatgtcttgtcatttaatgactgggtctaatttgctcttcttttactagcatcttaatatggaagcttagctcatgattttctaatacaaaatttaaaatataaattttccttcaagaactgtttttgctgtactcctcagattttgatatattgttttttattaccgctagttaaaaatatttattttttgatccatgggttatttaaaagtattttatttaatttccaaatatggtggtgtgtttttcaatactttattgttgctaatttcaatataatttcattatattgaaattggtcatagaatataatctctaagatttcaaaatcttgacatttatttacttttttatccagtctctgtttatccatgtttacatttttatggcccacaatttggtctgtctttgtgaatattctgtgtgcatttgagaagaatgtatgctctgcagttctggaatgtaatagtttattatttccaactaggtcatattggttcttacagttttccaaatcctctatatcttcatttgtctttttcctacttgtttttatcaattactgagagaacataaaaatcactgactaagattgtggattagcctatttctccctttagttctatccatttttgcttcatatattatgaagttctgtagatgcatccctcttaagcattcttatgtcttgatgaatctattcttttgtcattatcaaataacctcctttattttttatttatttattttttgagataggatctcactgtgtcgcccaggcctggagtgaagtggcacaatcatggctcactacagccttggcctcctaggctcaggtgattctcccacctcagtctcccacctagctgagactagaggtgtgtgccaccatgtccaactaatttttgtggagatggagttttgctatgttgcccaggctggtcatgaattcctgggctcaagcgatcctcccacctcagcctcccaaaatgctgggattacaggtgtgagccaccgcacccagccacctcctttatttttggtaacattcctcatcttaggctgtctctagtcctatctaagcttggcaacaatggaccaagataacaaactaagaattacagtcagttattcactcattcaacatatatggtatctactatcatttatccaagcagagggatcaaattagtgaaagaaaacaggtaaaaatcctttccctgcttcccctaagtgaagagtaatcttttatgtttatttatttattttttgagacagggtctcactctgtcttccaggctggagtgcagcggtatgatcatggctcattgcagccttgacttcctgggctcaggtgatcctcccatctcagccttccaggtagctgagactacagttgtgcaccaccatgcctaactgattttttgtattttttgtagagatggggttttgccatgtttcacaggctggtcacaaactcttgggctcaagygatcttcctatctgggcttcccaaagtgctgatattacgggcatgaagccacctcactggccttgtttggtattaatacacctatatcaactttcttattttgactaatttgtctattagatctttcttctcaacctatctatctaaattaaaagtgcgtctcttgaaaacaacatactaattgaattttgctttttaaaatctaaaggtgacaatctccatttaatgtaattattgatatggttggggttaaagctattcttctgttattcattttatctgctgtcttctttgttacttgttctgttgttaattcttttttgtcttttggttcaactgagtttttcttttttttcttttttttagtactatatctctttattggccttttcaytgtatttcttcatattactattttagtggttgctctagacttatcacagtacactttgattgaataatataacatttcatgtacaacrtactttttccataatttgtacatttgttgtcatacagtttacttctacataagaagagagaaattccacaaggtattgctattatttttgctttaaacagtcatttgtcttatatggaatttaaaaagtgaactgaaagtggtgatttatatttacctacatatttataattttcagtgctcttccttcttatatatctgaatttccatattatatcatttcccttcagcctaaagaacttcttttagtgcagggctggatgacaacacatttctaagatttcatttatctgaaaatgtctctattctgccttcatttactgaatatagaattctaggttgacgggtttgtttttaaatttcatcactttaagtatgtttcttagtctttggcttgtgttatttctgatgaccagtcagccgccatttttattgttgttttcctgtatgcatttccccccttctawtggatgctttaacagtttttctttagttttcagaagcttgagtatatgcttttgtgtaattttcttcctaccttttctattttggattcatagtttcctggatttgtgggttgattttctgatcaaattgagaaaaatttcagttattatttccttaatttttttctgtttcattttgttttactgtctttctgaaactctaattacacgtacattcacgtgttgcttaacaatggggatatgttctaagaaatgcatcgttaggtgatttttgttgtgcaaagatcgtggagtgcacatacgcaaatccagatggtatggtctactayacaactaggttatgtggtataacctgttactcccaggtgacaaacctgtatggcatgttactgtgctgaatactgtaggcaactgtaacacaatgattagcatttgtatatctaaacacatgtaaacatagaaaaggtacagtaaaaaatatataaaggataaaaatgacatactgtatagggcacttaccaagaatggagcttataggactggaagttgctcttggtgagtcagagagtgagtggtgggtcaatgcgaagacctaggacattgctatagtctataaacattgtacacttaggctaccctaaatttactacaaaatatttttctttcttcaataataaattaactttagctcactgtaacttttttacttataaagttttaaaattttaaaagctttttgattcttgtaataacacttagcttaaaacacaaacacattgtacagctgtacaaaaatattttttctttatatcctcattctaaaagctttttcctatttttgaaatttttaatttgtttaacttcttttttttttttttcgagacagggtctcattcgtcacccaggctggagtgcagaggcattatcatagctcrttgcagcttaaactcctgggatcaactgatcctcctgcctcagcctcccaaacaggtggaactataggcatttttttatctttaaacttttttgttaaaaatgaaaactcagcacgcacagtagtctaggcctacgcagggctggaataatcaatatcagtcttctgcctccacatcttgttccactggaaagtcttcaggggaaataacactcatggagatgtcgtcttctgtgataacaatgccttcttctggaatactcctgcaggacctacccgaggctgttttacagttaactttttatatttttaataagtagaaggagtatctctaaagtattcataaaccagtaacatacattatcatcaagtacataattgcatgtgctatacttttacatgactggcagcacagtaggtttgtttayacctgcatcaccacaaacatgggagtaatgtgttgtgctatgaagtcaccaggtgataggaatttttctgttccattataattttatgggactgttgtcatacatgcagtctgttgttgactgaaacattgttttttggcccatgactgtttattattaaaccattgatactgttccactggtccctggggctccctatttatattttttacatctttattcctctctatgcttcagtttgggtaatttctatygatctgtcttaaaattcaaggatcttttcttttcttgtgtcctgtctgcagttaatccaatccagtgagtttttgatttagagtattgtgttttctagttctaagatttccatttgatttttttcctaaagtttccagattgttcctaaaattccctgtctatttttccattatatctgtcatttcctctagactctttaacatatttatcatagttattttaaagttcctgcctgctacactagtcacaatagcaaagacttggaaccaacccatatgtccaacaatgatagactggattaagaaaatgtggcacatatacaccatggaatactatgcagccataaaaaatgatgagttcttgtcctttgtagggayatggatgaaactggaaatcatcattctcagtaaactatcgcaaggacaaaaaaccaaacaccgcatrttctcactcatagatgggaattgaacaatgagaacacatggacacaggaaggggaacatcacactctggggactggtgtggggtggggggagtggggagggatagcattaggagatatacgtaatgctaaatgacgagttaatgggtgcagcacaccagcatggcacatgtatacataygtaacwaacctgcacattgtgcacatgtaccctaaaacttaaagtataataaaaaaaaagttcctgcctgctaattgcaatactggggccatttctgtgtctgtttatattaagtgataattctcttggtatagatcaaatttttctatttctttgcatgaaatttttttttactgtgtattagacattggtggaagatatgttgaagagactcttaattctgttgtttctttataataaaggttaagtttggttctagaatgtggttagattattggtggttcattttgaactatagaagtcttgatttttaaactacattagggaaggtctatttcagcatttttcttagccctaggctgaatattttagtcctgagacacagtgtttactgtgaaggcttgtcccttatgaagttccagtagaaacccaggtgtttacccagcccctccaactcgttagaattcagacrgcaaactctctcccrtgtggtgtgtggtaactgaaatttctgctcaggtgtttgagctttccagctgtygttttgtctctgggctccttgtaggctctcctatagatgtataattaagggatcaaccaaagagttcagaggagtttatttgcagatttaggggcttcttgtttctgacttcctcttttctgacattttccctttagtttccagctattctagcagttccaaactgtctgctgagtcctcaggcagatacaactacagttttctgcttgagttctggctgtccagtgccatacagacggccctcatgggaaaagccatttaaacatgaatcttgtccattatggttccttttttcaaggatcaaataatctagactttattcttgattttggtcttcttccagtgcttttgaacagttggctttaaatatttcgttaattgtttataatcatcatctgcaggaaggttagtccaatacaagccactgtgccgtaactacagccagaacctcatcaaaagtttctaagctgaggagkcacaagagtagacgtaggctttaagaaggtcattctggcagatgtgtggtaacctgtagcaggggagcaagaatgaaggtaggaagacaaaataagactattaccagagtccctggtagatgatggttatttagactcaatgatgaaagaggagactggtcatgacaagcaatggatgagtttgagatacatttttggcaagatttggtgataagcaggggatgagaaaaaaggggaagtcaaggataactctcagatttcttktttgaaagactgggtgattaacrccacttaccaaaatagggaataccagagaaagatgagatttgggacaaaaatcaaatttccttttggatgcaagtctcaagatgacaatagaataattgtccagtaaacaattgaatttgtaagtctgaagctcagggaaaaggtctcatttaataggtctggctgctacaacttgagtgagatgtgcacatgcagagtgaaggaatgctacctaggggactgagaactgacaaaagctggttggagytggaygttgactttcygaattctaggtgaaactactggatragagagatgagaggccagcaaaatcagcctacttacaattgggatgttttaaggaggttaactatggctgcttttyccccctctggatgcagggttacaaggaagaaaataacacaggtgaatgttgtgggagatgtttgcctacggcttgcaccattcagctaagaggaggacagatcatgacactgaaggtaggagcaagctgaatgcagggctccctcacatatcaccatcttgcttccttttttggaaatttttcttcaaggaagaggggctaagtttggttcagtattggcttctttttctatttctttctgattatataaagaaaagatagatgacttattgcaggcacagaattttctcttttatttagttattttgttgctcttcttgacaagagtgtacttggtgtagggcctcacaatttggagttgattgatcttttttttttctttcttgagatggagtctcgctctgttgccaggctggagtgcaatgtcacgatctcggctcactgcaacctccgcctcctgggttcaagcgatttccctgtctcagcctcccgagtagctgggactgcaggcacgtgccaccacacccagctaatttttgtagttttagtagagatgggatttcatcatgttggccaggatggtctcgatctcttgacctcgtgatccgcccacctcggcctcccaaagtgctgggattacaggtgtgagccaccgtgcctggcctggaggtggttgatctttaagattttctctacccttgggcgtctgtaagactggacaggccatcagcgtgaaacaaactctggtctatgaagtccggactagctggtggggctgggaggtagttcccttcgttcatctctagttcagttatcagctagccagtttrctgttgctatatctcaatccttcaagcatttaactggtcggaagagtctacatagcagccctgttcataggatacaagctgtaaaactgggactccacttctggtctgtgttctgggtgtgggggctttattatacactgtcttcttgtttcatggttctgcagattgtttcgtcatctccatggagtcaagctcatggtttgaagtggctttgtgaaccaaacactgtctctgactttacccactcctctttccttccagcgtgatgagacgctccaggatggctrtgatactcacttctgcaaggtcaatgagagaggagagtacttctgggagaagagggtcacaggctgcccaccctttgatgaacacaagtgtctggctgagrgagtgagtactcattctgctttcctctttactgtctcaatctctaagaacaagattcttctgaatagygtgcatcccagctccggcataatttctcagtgtctgaggcacatctctggcctagttgaagaatcagtgagattacgaaatcaaagcctacggagagataaaattctctgcaatataggatgttttaaaaaaatattttccttaagggaggctgagtgtgtgattcttgaataaaatgtgagatcaaactgatttttagtctccctgggaatgaagatcctgatgactcaactggaagagaattcagaatcatcaaaattgtttcagcctggtcaggtagggtggtcaagctgctcacatttatgataggaaagcatagtttacatctgggcacttaagcacagggctgtgagttcggagctaaaaattggcccggagtgacctgaaagctgtctactctgtactgtttgtgcctaacctgmaattttgctgttttcttagggtaaaattatgaaaattccaggcacctgctgtgacacatgtgagtgcgttactaatatcttgtcccttgaaacccatcagagcaagtcyaggggctctttgcagcttgctccttgaaacccattagcaagccgcatgactgttctttggagtaagctttatttcagaaagatatttcgtgaccactggtcagtcattatgttcagtcttgcagggagcagcctcccctccttggatgtcatcagactgccctcttgaactcccttttagatcccatggagcaatctctttccccttttcctgcaaactccctcctgtctccagcttcttatgtgccttttccctcataggatctttgattgctcatagtcctatcctgggacgatatgttccctctctaaccaaagcttcttgaagacaggcaccttggatctatgatcctgacagagtagactctcaacacatatctattcatgagtgtgctaaagctatctcaaagagaaagcgaagccaccagctggctgacaacagcccacatgtgctgtgggggctggtctaagtttatcaccccctcttcttcactctgagctcctctttacctcgtagttatgtcctactgattggttctcattgctcacagcagcagctttggagacgagacacaaatctgcacatcagacagtgttcttcccatacatgcttgtgtttgtgagcacaaataactttcaggatcccaatgctaatgccataatttctgaatatagaattacttgcctggactaagattttttgttttagattagggtatttcttttctgccctgggttcacaggtccatgcttgtttacagatagagaaaggaagagtgaaaacatgaatactttcagtgttcaatcattcattcttgacagcccctgcaattgctgtaaccaaatctcagatcgaggaagcactctgaaagcatgtctttctatgattcccatttgaatggtttaagaatgtgaagtcaggaaaccatcagagaagaagaattctctctaggcacactgcacgtggaatttgattaggagactgttacctacaaaaccaccacaaagggtctttgttggtcaactcattcaagaggcttcgagatctttaataaggacaataagccaggctcagggccttaaatccacagcaacatagtatagtatgctggtctaaatgttttttttttttaattcatcctcttaatgtaattggcaggctttccctttacaatgaaattatctagaaattaggaggcagactaatatgtagttagggttgatttagatttcgagccatctaaggacagaaaactcccagtgttcagactggaatggtgagctgggattaaatttttgaattcccagtgggccaagtagagattcagatctgaatgccactaacccctgtgtgaaaggaaacccccatgtcagcaacctggagtcagcagtacccgaagagaggccttcacaaaggtgcctagggatcttctcggtccccagagaggcagggtatgcccttacatcaccatkacttcgcctttcctcttaccccaaggcaggaatgaagagatagtaattatacttattgactacttcattgcccattagcttctgaatgtagttacaagcacaagagggttgctttagccatgtggtttttagagtctacaatgatacaaaggcaagtcttcctcattttacatcaccatagcacagtgaatttaggctcttcctgcaattaaaattgtaccattaagtgagttaagtccagcaataactatatctctgcatatttcgggccaggaacagctgaggtgaaccaggataactgaattccctccctgtggctggctttatttggttactgtgaaagggacctatttccagcccagtgagggcactggggctgaagagtgttctctagaaccccagccagtcctcaagtttcatctctcacctgtcctgtaggtgaggagcctgagtgcaacgacatcactgccaggctgcagtatgtcaaggtgggaagctrtaagtctgaagtagaggtggatatccactactgccaggtaagggctctgcttcaataagggctgggtgyggagggytgagcctccgtgttcggatacctatccttagttacattctagaaggatctggaaaattcgcagggaagagaagggaaataaactggaagcatttttttttaagcaaatgttttattgaagtaactggaaatttttgactccaggaaaaaaacaaaaatggaggaaagactcagcaamtcctttacagaaaatggagagttatttatgcaagatgggggccacaattcttgaagatcagtcaaacatatataaaattttcctgcataaaacatgcataatcaggcataaaacattttatgcattaacatgcataaaaattgcagctagaggggtgtgggtatgatattattaccatagagaagaggacatgtcagacctatgatcttcctttacaaattgcctagctgtcctgggtgcttctgggtgagatcagacctgccttgcttggagggggtcagggagaaagcaggctgccccagagccctgcctaagccaggacttcccaccatygtgaagctcccatcttcctctgctttcttgcagggcaaatgkgccagcaaagccatgtactccattgacatcaacgatgtgcaggaccagtgctccygctgctctccgacacggacggagcccatgcaggtggccctgcactgcaccaatggctctgttgtktaccatgaggttctcaatgccatggagtrcaaatgctcccccaggaagtgcagcaagtgaggctgctgcagctgcatgggtgcctgctgctgcctgccttggcctgatggccaggccagagtgctgccagtcctctgcatgttctgctcttgtgcccttctgagcccacaataaaggctgagctcttatcttgcaaaaggctgctggtgcactgtgtcgtagggctgagatggcaacggtgggcaggggctgagttctgagaccggttctgaggaaggaagcacaggccccatctgcaagcctcagtgtcagtgtgagatactgccaacctctggggaagagtgatgtctttgcctccaggggtgggaaaggcatagcatggggtaggcctcttctgaaactcagcacaaagtaaaagggattttcccagcaacactggattctccagtctctgaatggaggggcttctgaacatagcagaggggtgggtcctggagccaggctcctgctgagatagatactattgttgtcacatggctggcagtgtggagaaggtgtctgaccaggtgtgcaaggatttctctgagcccgtggctcacagggttcctgtgtacccatagtggcccctgtgggagggagaggtgctgacgactgatggggacctggaaacagggtgctggcaggtgcagtagtgtggtcacccaactcagcctgaggccatgagccccagatttggaggcagacctgggctccacacatggccctcgctcagctgtgtggcctcaaacaagccccttggtggttctcagactcagtttcctcatctggaaaacaggagtgttgttctcactcataaggtggtaaggataaacaacctcagcctaaaatagggcctgcaagtccttaggtaactgtaaattgctctgtaatcatgtaagaagtggcgagaataacaatggggagatcaaggctttcggtagggaataagagactctaatgttaacagcagagcattagagatttcctttgtggtgagggctggaccggctgggtttctatcaggctttatgcttgatgccaaggtcctacatactccagacatccttcagtggaagaggaagtggtgtagataacaccaaacatcatccagtccccaaatcactaactggtactgtcacttgcagttagagatggtccttccttaaaatgtatggaagaattttcatgtacatgctggcaagatggtggggactcttgctggggagaatacccatgagaaagaaggggatgtcctggattacaagaatttgatgaagaattgattttcattccaaatacttttgacacaggagagactcagctcattgaaagtactggataatggaatcaaaagggacttagacatcatctagtccactgtccctcctccactcctttacaagtgatgaaagcagctcagagaattcaagtgacttgccaaaggtcataactgctgggtggcagggccaggttcagaacccaggtgacttgacacctgcataagaactcccaggccaccccatcagagccacaccatccctgttgcttacactcctcccgtgctgacatggggaccagtgactgctgcacccttaagttcccaccacttctgttactgcctgagcttaaccttaagagaagccacattacaggaaaatggcatagattatgctgagtaggcttggtggggagtttagtggggcagaagggaggaagaatggatagaagttttatgtaactactcagtaattaaaaggttactgtctctccatccatcaccccactcccaactttgggtagcctctaaggtctctcttggtaggaaaccagatccagggacagggaattaactgtcactcttctgactgatcgcctaacactctagctggggacaaggtgttattggaggcatcagctctggagaaattcagcaggaaggctaggctaccactgcagcataggtggttgattttccaactgcctgtgtcttgctagcttgaacttctcatgtttactgatatgtcattttaccgtcaagaaaaaagctgaatcggaaaactgcatgttttgattattttaaaaaaacccaaaacgatggaagagagctgggtaaaaaggatgcaagaagagaaacttgtggggctagtgtgtgcggagcggtgtctcggcagtcttcttttatttacaggtattccaaaggcactatctgtacctggtttcagggaccctcttttttactcaccctcagaccaggcaagacagagtgccccaaagtggatgttttaaggggagtctcaaggaaggagtatatagacactaagaaactgctggagggaaagaagaaagggaatgaatgaaagagcaatggtgaccatttttcaatcgtttggggattgaaaagacatgataacggtccctggaagtagacagggagaaaggggttgttagggacagaaaggagcagaatagcagagtgttatgccacagactccagggcaggctgcctgctttggaatcctaggatcctcttagaggcaagttacttgccatttaacactgcagttctctcatctgtaaaatgggcacactgcagtgattgcctcatatacttattgttaggattaaaataactaccatagggaaagcactgagaagggtgttgggtggagaggaagtcctgtagaagcattagctggtagtacttgcagtggatggaataaaggcctgggttgggacatcacatcttgtggttttccttctgctctgccctcgactgtggtgtcacttactcccctttgcttccccaggctccttctctataaagtgggatctatcatgaccagcctaccttatcaatataggagagaaaatcttcatgcctgaaggtcagtgatcacaaatggcatacttgaccttaacatagtacttcttcattttgggggtccatggtattaatgaacttgttttacttctgtgcatcttggagttgcagattccatcgtgcagaagggccctttggaggtcttccctcccatccccctgcccaggtccgtgaactgtcccggggagctggcactcctcttcccctctggggatggagcttccatcatctactccctcaaccttccttaaccctcctagcgtctcatgggagagctcttataaaatggacccctcctcctgcctctggcagcccctcctgttttgcggtcccttgtgcacttactacctgcctcttctcccttttgttctgcttaacctaggggaaggtgaggacagctggtctccacctagtatggagacaggtgtgggagatccgccgtccaggggctcgcccccactcccgccccagggctaactcttgggcagtggatgaccctttggggcggcgggaagaaggttttgctggcaggattggaaactaatcagccagacagttcatgagataatccggctgaatttttacactcgaagcaggttgtggggcgttgccccggctctgggggagcagggagcgtttactgtctcgcccctcagccccacggacccgagtgtgtcctggactcaacccggccgcgggaccgcgctccattctcgacgccccgctcccagcacccgggcgcccagggcgcagcggggagagctgggctgtggctgcgcggcgccggcggccgggagggatgggggaggaggaggcggcagccggcgaggggcgggcgcgccgggacggagctgagccgcgatggaattagccccgcggcggcataagcctgcccagaagcgcgcggccgcgggccggcggggtccgcgtccacatcatggcgactcccgggccgcgcggtgagttttccggctggacctggtcctggtctcctacaggtggtaggagggagggagtgaaggaggcggcatccgaactcccactcttcgggattggggacccccaagggagcctgggcagggtggtgcgggaagttgaccccgtttttccagggtagggactctgagggacgtctatgtaatttccgagacgttttttgttttttgttttgttttgttttttttttaactcaaggagagggaaggtaggacaacagaggtttgggcggccgcttctctgtgattggttaccaatccccacctctgtgatgttgcctctccttgttacaagtcctggggacgtttagcctacagcatctgaaggtaagtaaacaataagtaaacaaccagccggactgggtttaactcagcaacggtccgctgaggacagagcaaatttgactttggcatccctggagtggcctctcagtttcagaagttttttccagtgtcttacccaaaaccgcattcaggaagggttccaagatcaggcatttacaccccaggctgcagggaaacacagctataccttcccgagggacttttcttagaagaaaagcaaattgaggtggagtatggagaagaaagacgttattttattgcttttgggcaggactgactttgcctgggacagggactttgtcggctgttgtgtttctggtaattcttgagacaggcatgaagagggaggtgcccgctcctttggcatgaacaatgagctgagtgcactgggaggtggtgtcagtcacagtcctgatactttgtgagcagatgtggagaaataccaccccgggaccatgtggaacctcgtctgggacagaaggtcccactgagcaaggtcgggtctcagcccaaaggcaggtggcaggtggagggaggatcttagacaaggtgaaggtgcttccagaggactgtggtcctcttggccctccacctgccgagcctttgtccttggaacctggcatcagagcccctgcccagtctctctgtcaccctggctcagctgctgggcatccagggctcatttgctcctctcagtgtgtcttaacgtgcacccgtcatttccggagccaagcacctgattcgatcctttccagcaactgcttctgctgtctgagttgcctctatgtgggtaccagagccactctgctggttgactgtagagactgtgtgaggggtaagggtgggatccaaacacacacctcaagttctagtccagtttccaggtgtgccatctcttcatcttccattgtggggcaaggctgcagggtgagaggcatttgggcctactggggagtgtgtctataattttctgtaacaaagacctaattttctggaaagctacccattctgtgggctgagagaagcccatcccaccctatgtatgacgttgctagagcacatgcatagcaggtatttggctgctagggacggtgttattgtctctagtacacggtataatccatctgtattgtttaaaaattgttttaaaaatgtcagtagtttttagggtacggggttttgcttttggttacatgggtaagttctttggtggtgaattctgagattttagtgcctcctcacccgagcagtgtacattgtacccagtatgtaatcttttatcccttatccctcctcccacccttacccgctgagtccccaaagtccatgatatcattcttatgtctttgcatcctcatagcataactcccacttatgaatgagaacatatgatatttagttacccattcctgagttacttcacttacaataatggcctctagctccatccaatttgctgcaaaagacttattttgtttcttttcatggccgagtagtattacacacacacacacacacacacacacacacacaaacacacactcaaacacagacatcccacattttctttattcactttttagttaatgggcatttaagttggttccctatctttgcaattgtgaattgagctgctataaacatacatgtgcatgtgtcttttttatataatgacttcattttctttaggtagatgcccagtagtgggattgctggatctaatggtgttctacttttagttctttaaagactctccatactgtttttctatagtggttgtactagtttacattctcagcagcagtgttaaagtgttcccttttcatcacatccatgccgacatctagtaaaatttttgactttttagttatagccattcttgcagcagtaaggtgggttatctcattgtggttttaatttgcatttccctgatgattagtgh

SEQ ID NO: 13475 - DNA, 29959 bp, Homo sapiens
cagaacccagggagggagcgcagggctgcccttgctaggctccagcaggtattagaaactgtcacaattgtccggcaggtaacagcataatcacattttgaatcaaaagtgttgttcaagctgaaatcctagtattcaccctcaattcctctgtttccctcacccgtacaacaatctctcaactcagtccatcagccctatctccaagcctccctcaagcctggcgcctcctcaccaactctgtggccatgccacagtacaagctatcatatccctcgcctacactgctgccatggtcttccacacctgcccccagaagccaggctcattcagccatcaaaattagctctttgacttcactgaaatgaaaaacgcttgtgctccaaagggcaccatcaagaaagtaaaaatacatctaatccacaccaccgacaaaaataaaaaaaaaaaacccacaaaatggaagaaaatatctcctggttatatatctgataaagagattttacccagaatatataaagagctcttataactcaataataaaaagacaattttaaaagctgggtgcagtggcacgtggctatagtctcagctacttgggaggctggggtgggaagatcgmttgaacccaggaatttgagaccagcctgatcaacacagcaagacttcatctcaaaacaacaacaaaagacaattttacaatgggcaaagtctaagaaacatttctccaaagaagacacacaaatgcccagtaaggccaggcacggtggctcacatctgtaatcccagcactttgggaggccaacgcaggtggmtcacctgaggttgggagttcaagaccagcctggccaacatggtgaaaccctgtctctaccaaaaacacaaaaattaggtgggcatagtggcgcacatctgtaatcccagctactcaggaggccgaaggaacaagaatcacctgaacccgagaggtggaggttgtagtgagccaagatcgcaccactgcactccagcctgggcaacagagcgagactttatttccaaaaaaaaaaaaaaaaaaaaaaaaaaaaaaggccaataagcacataaaaagatgttcagcaccattactcatcagggaaatgcaaatcgaaaccacaaggagataccacttcatacccactagggtatgaacaagtgttagcaaggatgtggaaaaaactgtatacattgctggtgaaaaataaaatggtgcagccaccagtgggcagttcttcaaaaggttacagagttaccatgtgacccagaagttctattcctaggtttatgcccaatagaaatgataacatatctacaaagaatttgtagataaatgttcataatatcaccactcataatagccaaaatgtcaaaacaacctaactgtccatcaactgatgaatggacaaacaaaatgtgatctatccacacaatggaagcctgttcagcaataaaaaggaatgaagtactgattcatgctacaacacggaggaatcctgagaatattatgctaagtgaaagcaaccaggcacaaaacaccatatattatatgattccatgtatacaaaatgtctagaataggcaagctgtaggcagagtaggtcagtggttgcccagggctgggagaagaaggggttagggtgtattgctgaagggtacggagtttccttttagggtgatgagaaagttctaaaattgacgtagtgacggttgcatagctgtgaatacagtaaaaaccattgaattgtatataaatgggtgaactgtgtggcatgtaaattatatctcaataaagctgttaccccccaaaaaacaaaggaaaatatcagctccttcaaagagaaatcagaccatactacccattctactcaaaactcctcactggttgcccagtgctctaagaataaaaaccaaatgccccgtgtggtctaagccctttgcagctcccctgtcacctctctacccgtctccacttgtcctccaagttctagctccactgacccactctgtcccactcaggtgtcataattatttcctctatgcagaataaatgatctcactccatttatctggcttcttctcaactgtggggtctcagcttaaatatcaccaccacagaaaggccttctctgaccagatcactcaagagtacccaactgtcccttctttcctctatcatatgtgcttcataatcctcattacaacctctaattgctttatttgctaaaccatttaaaaatcatctctcctacaagaatgtaagcaacatgaattctctcttgcttaccaaggtaaatcctagtatctaataatagctttggcacagagtagatgctcagtaaagatttgttaacttcaggtcttactgcaaaacaatagtctcaatccaatttttaaaattgggctgggcatgatggctcacgcctgtaatcccagcactttgggaggccgaggtgggaggattgcttgaggccaggagttcgagaccagtctggccaacatggcgaaacccatctctactaaaaaatacaaaaattagccaggtgtggtggcgcacacctgtaatcccagctacttgggaggctgaggcaggagaatcacttgaacctgggaggtggaggctgcagtgaaccaagatcgtgccactgcactccagcctgggtgacagagtgatatttcatctcaaaaataaataaataaataaaaatataatgaataatgcttccttagtcatgactatttcagttaaaaaaatacaaaacaccaccctatggcatccttcaagttacgatgcttcctttccccactagccctgtcaatctcataaccctggaaggtggcagctagccttcactgctgactactaacacccaactgccacccagatggatgatttctcaaactggagctaggactaatatagagtctaagtcatccacttcgctgtacaataaccatgttatcagagtgctctgggtacactaatggtttcaggattctctccaaaatccctaggaagcaacaatttgtatccctattgtagaatctatgtttgaaatctggctacgacatctattaattatttgagtattaaattattaaggaggaacgtaatgagactgaggcagtcatttatcttccagacaaaattttgtcacttccttgctcccatccccattggctacccaatggtcacaagctaaagcctaacacaagcatggaaattagacactatgacaaaacagtctatatctaacttcatctcaggccactcttccatccacacactgtgcactccctaccctttagcaatcacccctctacacgcttcttctctcagccctgggcaaccactgatctcctctctgtctacagttcgcctattctggagatttcatyaaaattgaatcatataatatgtggtattttgtgtctggttgctttcacytagcctaatgttctcaaggttcctccatgttgtagcacaaatcagtacttygttcctttttattgctgaacagccttccattgtgtagacaggycacgttttgtttgtgcatccatcagcyttccatcacagtccctgcacacaccataacctgtatgtctctgcagaacaaagtccctttccactcttccctattcccccacatgtgccctgtaagaactagtcctccgccaccaggaagccttcataaattccctcagatacttggttggtctttctctgctttcacagaactccatgatggcagttatcgcacagcaccatcattatctgttttctctccccttcaatggactctttctcatcttcacctatgttcttctagtctgtatactttgtggtgctttaaaagaccaataaagagtatggtacaatcaatgctcaatacacgtttgttgaatgaatctctctctcaaagcactgtgctagattcacccaagtatgacagccctaaatataaaatagtggcaaaaagtcaatagaactcttatgtccaggtccaaagaatacattcattttaaattgaacaygcatcttgagtaacagctcccttctaccttagcaattcgcaaagccatcaactactcccttctaattttactgatctctctgtgcattactgaatctagaaatctcttcgtgcttgacaccaaagcttttcattataaccctttcctgatctattcctcatcttcccaagttcaatcaactgcctctgcctgatgcctgtttccttccttttcttcccactaagttccagtagccatttttttcaactcctacagcggctaatatgaaatgaaattctccccaaacttaagtgtaacttctttaagaaaaaattggaaaaaaaaatccagtagatgccagtcttctattgaaaaagacacgtgggtataatatagctgatgcctaacmaaagctacttcctagtcactccttcagaagagggttatcctcattccatcttccccaccactggttttccaaggcagtcctgaaaattcaatttgtgtgtcccctacacctgcacttagttctcccttttaaagttcatgggccagaccatgatctttctgaggcagtgacctcaggaagggtctgtctggttcaccacagcatccctagagccagcctggcacagtgctggcacacgatggccaaataaccaccaatatgggacgtaagtcaggttaacaacaacaacaacaaaaataaggtcagaggtttatcaaggtacattatagctgggtgtgagaaaacacaaagtcctgcagcctaaaagaccaggaatcgctggtgatcacaaggagctacagtggcttcattcccagattctacctatgcctgggatttgcgttttgagatttcccagaactctgtctacaagaccttggctgcaaggaggcagtccacaagtgcaactggtcactccaatagatgagaaaaggatgcacccaggctggtatcccacattctgccaacacatggaacataagtcacagaacagaataaaattcctgaatcccaataagagaggaagaaaaaagtgcagggaagagaaatggaggtagagaaggagaaactaaagtcatgagaagtcagagacatatcagaaggractagagggcgagaacgcaggctagcacagatgacagcaggggctcccctttactgaaatgtacagcggcaggcaccgtgcytaactttacatgcactgacccatttaatcctcttaccaagccagaggtagaaactattctcatctccattccactggtgatgaaactggagcggagtgagrtagggcacttgccccagcacagagctaggaaggggccgctgggacctgcccggctctgactccaggacaccccatcctttaacacttactacctattctgcctcccatgccttcaaataggattgggaaaggagtcattcacttatccactcatcgaacactgaacaccaactggatgagtgtcaaggcctggggccaggcgccggtgggcggatgtaagggacgcgggctgcgagtgggggacagaacacgacgtcaatcttaaggcgaaggagcagagcccgcggccagaccggcagccgggatgcagggtggggccgggggccgagggcgcgggacgcgcagcggaggcctgaggaggggcgggcggcccctgttccccgctgcggaccgccggattctgcgggcggcgagccaggcgctccgtgtgttgtggcatttagtgtccgccactccgcgcgggcgagaccgcgggcgagggagacggggcggacgggcatggagaccctgcggggctgaggcaagggaagagtggcccgggggaggccgaggaggggctcggggccaggcgtcgggggcgtcgggggcgtcggggccgcttgcggcgtcgccggactcacctcccgcggcagcccctccggactcgtcggccccgccgggccggaggaggcgggatggactccgggccgcgggggctgccgggagcctgttccctgggcaacggggccggcaccggggccagcaccgaagagcagcagctggctccgccgggggctagagcggcagagccacaagtggcagcgggcggggcggacgtgacgcaaatgcgtttccggtggggtgggcggggcttcgcgtctccttctacggatatctgtggaccttatggaaggtgcgtgagatcggttcctttcccggggtggggtggctgtgaatgttactgcttaggccgcaggttggaccagaagctcaggagctccccggattacatgaggttaaatggaggtcctctgtcttaccccagcctagcccgcaggcccctcgcagcctctgcgagctgctcgggagacagttttgccgagcctccgttttttcacatgtgcagtgacagatgaacgggacgatatacgcaaatgagtgtcagcagatccgacatccaaattgtaattattgtcactataaattagtactaacagagttcactgggtaccaagccttgcatgctcatctcgtccagaaactcctctctgaactgccctcagtcagaacattctgcttgtaatgaaagctggctttcgcctagtgctcagtttgctgagtactgctccaagcactttaagtggatcatctcatttgaacctcacagtggtcccatgaagtaatgtcaaccccattttgcagatggggaatcgaggctcagaggggataagtaacttagccactgtgccctcaccctaccctgtcctgtgacgctgatgactggtctgtctttaccagcccttgagtttcttgaagtcagttatgtttttggttcctaaatatgtgccccgtatgagtcaggctgaccrtgaatcagatgtgatcctgccctcagaatctcctgttggggggaaaacccttagacaattatagaacaggtggtaagagctattcctccatttacctcattttatgcaaagcctcctatgtgtggaaggtttgaaagagaacgagacatagttcctaccctagtcgaatttccagtttagcagggaatatagacattaaacaagcaaatacactccactggtgaatatcatgatagcagaattatagggtgtaccacatatctagtggtgagtcgtaacccaacctgggggatccaggaatacttctctgtggaaatgactttctaaaaacctaaatcagataatttcactgccctatccagagctcattgctcactccccattgtattaggttggtgcaaaagtaatggcaattttggctgttaaaagtaatggcaaaatctgttacttttgcaccaagctaatacttagaagtccaaacttcatttttttattttgttttgttttgttttgttttgttttgtttttgagacggagtctcgctctgtcacccaggctggagtgcagtggcgcgatctgggctcactgcaagttccgcctcccgggttcacgccattctcctgcctcagcctcctgagtagctgggactacaggcgcccgccaccacgcccggctgattttttgtatttttttagtagagatgaggtttcactgtgttagccaggatggtctcgatctcctgacctcgtgatccgcccgccttggcctcctgaagtgctgggattacaggcgtgagccactgccctcggtccaacttcttatcttggcctattaggttctagttgtctgatcacctactcacrcactagtccttttctgtctatttcattccagcacactggtttttttgtttgcttgtttgttttgttttgttttctgttttttgaactcaccaacctcattatcataattagggcacatactactgacctaccctatttctggcttttcatcattcaaatctcagcctaaacgacaccttctcaggggatcacactaacacaagaccctgttttattttccacacacacttaatcatgatctgaactgatcgtggtcatttgtttattatctgcctcccctttggaaagtaagttccatgaaaacggtcctggtccgtctcattcaatcacttcattcccccatgcctggcgtattgtaggcagtaagcaaatatttgttgtttaagtaaagaatgaatgataaatcaagatgatattttaaagtgaggatactaagtatgaggcaggggagtggggacacacacagataggaaaaatattccaggtcaaagtcagaacttgtacagagccagctctgatgcacagagggcaagtgggaaagggtagaagctgaagtggtgggcagagcttggatagtagaggcccttgagctaacaggtgagatactgggtttttgccttgtgcgaggcctcacagcttcacatatattatctaatctcagcaatcctatgaaatagatactatttttattcccattttacagatgaaaatgttgaggctctgaaaggtacattaagttgcccaagatctcacagctggcgagctggggttcagacgcaggcagtgtggtcttctgacttgaggcatcaaaccatccagctgttgtgtgtcctggattcctcaagaggactttatcctgtgggcagtgagaagcctttgtggggttcaaagtagagaaggcaagagggcacaggagggttcggggagaacaaacaacctgagttggctcttggtggtctgggggttgcttcctacaggcagtgggatccgggtgcatcttggaggatgggcatygtgagcctgaggaaggaaggagctttcctgcagagagaacacgtgtaaaggcctgcaggcacctcagcttttcaagagctgccagtagttcattttcgctggatattgacggggggccaaggtgtgggttgatgtacgtgatgatgtggaggggtagctaggtctggaaggattttggacttcctcctgattaccaagaagggcagtggcagcatcgtgatcaactctgcatctctgttgtctcagtgtcttgaaatgattagcactcatgggccacgctactctgagcaaatttaaagtatcagagtgcctgagactagatagtggaagtactcgggagtcagggctagattatcctgtagggaagggaacgtgagccattgaagagttttagcagacagtcacaactttaccttatttccaatctttggaaaacaaagggcttaaggtaaaaactttgtggagccattaagctggaagaggattcagctmtatctggtgaattttaaaatgttaaaaatattctatattgtcttcttccaggaactttcacattcattcagactttgtagtttccacatttatttgtccagttgatacagcatttcagatagttttactgttgaaaattataaggacatttgccctccaactatgattgtatattccatgataataattttgtttcttttataccctatcagcaaagactcttggaactgtaacgcccagaaaacctgtcttatctgtcagtgcaagaaaaattaaggacaatgcggctgattggcacaatttaatcctgaagtgggaaaccctcaatgatgcaggttttaccactgcaaataatattgccaacttgaaaatcagtttattgtaagtacatattggtttttcatgctctaagtttttcacccttaataactggggaaataatgtgaataaattttaaaataaaatattaagcaaaaaaagcaagtggtaagatgatacgtgtaagtataaattgtattgtacattttaaatacaaaattatattccatatatatatatatatatatatatatttagttatttatttatttatttttttggagatgaagtctcactctgttgcctaggctggagtgtgatggcgcgatctcagctcactgcaacctctaccgcctgggttcaagcaattctcctacctcagcctccggagtagctgggattacaggcgcccgtcaccacacccagataatttttgtatttttagtagagacgggctttcaccatgttaggctggtctcgaactcctgaccttacgtgatccacctgcctcagcctcccaaagtgctgtgtgagccaccgtgcctggctattctgatttttaaaaccacagattctttgattcttttgtagttcataggcataatgattgggttttcatgctcatgtatgacctgtgccttcctcaaactttgctatgatgttggcacattacctagctgatatggaaaaaactaccatgaattcttttcatccatttttggattttacgtaaacaaaaaacatatgttattgtttcctttatatctcactttctttttctattttttattttttatttttggagacgagtctcactctatcccccaggctggagtgcaatggcgtgatcttggctcactctaacttctgcctgtcaggttcaagtggttctcctgtctcagcctcctgagtagctagaattacagatacctgccaccatgcccggctaatttttgtatgtttagtagagacagagtttcaccatgttggccaggctagtctcaaactcctgacctcaagtgatctgcccaccttggcctccctaaatgccggtattacaggcatgagccactgcgcccagccatgtctcactgtctttcaacatggaagccatgcgtgtaatgtagagccactattctggttctgttctttctcattgctgtttaatagtgtttacccacattagacctctcacactggtttatcaactaagttatataatattctcaatcttttgttgtcatttcaacagtgtgcacagtgtctttcccaggaatagattccatctcaagaaaccaccttctttgctcatccataagaaacaattccttatctgttcaagttttctcatgagattgcagcaattcagttccatcttcagaccccacttccagttctggttctcttgctttttccactggcagagtagatttaacatcattcttaagggccctaggaatttgagaatggtaaatgagcattggattcaacttaaagtcactaactgcaatatcccctaataagagggtgagcctgtctcttgaagctttgaagcctgtcattgacttctctgtagttgtgaatgtcttggatggcatgttcttctaatagaaggctgtttcatctacactgaaaatctgttgtatcatgtagccaccttcatcactgatcttaagtagatcttctggataacttgctccagcttctacattagcgcttgcagcttcaccttgcacttttatgttatggagatggcttttgtccttaaacctcatgaaccaaatcctgctatctcaaacttttcttctgtaacttcctcatatctctcagccttcacagaattgaagagagttagggtcctgctgtggattaggctttgacttaagggaatgctgtgtctggtttgatcttctatccagaccactcaaactttctccatatccacactaaggctgtttcactcatcattcacatgttcactggagtagcacctttaattttcttcagtaacttttcctttgccttcacaacttggccaactgtttggcacaagaggcctggttttcagcttatcttagctttttttttttttttttttgtagagatggagtctcgctctgtcgctcaggctggagtgcaatggtgcaatcttggctcactgcaacctctgcctcccgggttcaagcaattctcctgcctttgcctcccaagtagctgggactacaggtgcacaccgccacgcccagctaatttcttttgtattttagtagagacggagtttcacatgttgcccaggctggtcttgaattcctgagctcaggcaatctgcccgccttggcctcccaaagtgctaggattacaggcgtgagccaccgcacctggccccttatctgagcttttgacatgccttcctcactaagcttaatcatttctagcttttaatttttttgtttcttaaattggccaaagtatagcttttgatttaaaatgagagatatgcaactcttcctttcacttgtacacttagaggccaatgtagggctattaattgggttgatttcagtatcctcctatttcagggaacagggaggcccaaggagatggggagaaaggggagcagccggtcagtggagcagtcagaacacacaacatccattcattaagcttgccgttatatatgcacatggttcatggcacctcaaaacaattaaactagcaatatcaaagattaccaatcacagatcatagacataataatgaaaaagtttgaaatattgtaagaattaccaaaatatgatagagagacatgaagtaagcacatgctgttggcaaaatggtgctgattgacttgctctacatacagagggttgccacaaaccttcaatttgtaaaaaatgcattatctatgaaactgaataaggtgaagcacaataaaatgaggcgtgcctatattcctggattgtgaactctttgaggaaatgatccatgtcttattcatctttgtacatccagcaccatgccctatgccaaggatgccacaccgctgaatggtgttttttttttttttgagacagtcttgctcttttgtgcaggctgagtgcagtggtgctataatggctcactgcagccttgacttcctgggcttaagtgatcctcccacctgagcctcctaagtagctgggaccacatacgtgtcccaccatgcccagctaatttttacttttaatttttgtggagatgaggtctcacygtgttgcccaggctggactcagactcctggactcaagcagtcctcccgcgtccatccctcaaagtgttgggattacaggcatgagccaccaaaaccggctgtcacatggctgaatttaactgacttattttggtgcaaaattgagtgaccaatggacatattcattgcacatataaataataactgcatttgtatcataatgatatgaaagaacaatgcttatgcaaaatgtcccacgtaactatgtggatatagaggtttgtagaatttattataaggaaataaggcaagcttaaagagtatattttgtacacattattttctattttgtttaggaataaagacaagatagaactagacagcagcagcccagcctcgaaggaaaatgaagaaaaggtgtgtctggaatataacgaggaactggagaagctgtgtgaggaactgcaggccaccttggatgggttggtaagacataaagacgcaggccacttgtggtcactgtcactgaatccgatggacgtatttggggtttgcttgaccattggccatcacttactccttctcagtctcctctgatgttctcttcctctgcctgctgcgtaaaccttaatgttccccaagatgctgtcttagacactcactcctcctgtgcgtcatccggggaaatgtcacccactttcagggctcatcacatagtaaattttttttttttttccatgatatggagtcttgctttgtcgcccaggctggagtgcaatggcgtgatcttggctcaccgcaaactccgcctcctgggctcaagcgattctcctgtctcagcctccagagtagctgggactacaggcgtccgccaccatgcctggctaatttttgcatttttagttgagacagggtttcaccatattggtcaggctgatctcaaactcctgacctcaggtgatccacctgctggcctcccaaagggctgggattacaggcatgagctaccacgcccagccacagagtaaatattttaggcttccagggccagccagtctctatctcagctactcatctctgccacataggactaaacagccatagataatatatgcgtaaatggatgtggctgcattccatgaaaactttatctttgttttttggattttctttttttttttttttgagatggagtctcattctgatacccagggtggagtacagtagcatgatcttggctcactgcaaactccgcctcccaggtacaagtgattctgctgccttagcctcccaggtagctgggattacaggctcgtgccaccacatgagctaatttttgtatttttagtagagacagcatttcaccatgttgaccaggctggtctcgaactcctgacctcaagtgatcagcctgccttggcctcccaaactgctgggattacaggcgtgagtcaccgcacctggccttttttgtttttgtttttgttttttttgagacagggcctcactctgccactgaggctggatggagtgcagtggcgagatcttggctcactgcaacctccgcctcctgggttcaagcaattcttgtgcctcaaccttccacatagctgggatcgcaggtgtgcgccaccatgcccagctaattgttgtatttttagtagagatggggtttcaccatgttggccaggctggtctcgaagtcctggcctcaagtgatccacccacctcagcctcccaaagtgttgggattacaggcgtgagccaccatgttcgtccaggaaatctttatctttggacaccraaattagaattttgtataatttttatgagtcacaatcactattgtccttttggttattttcaaccatttaaaaatgtaaaaaccatcttagcttatgggccatacagaaataggctatgggccagaattgacctgtgttccagggatagtttgcccatccctgatacagcacgtaagagactaaagtgtttgtttaatgaactaataactaaatttcaatacctaccatactggccaccagatgtgaagataacaccaccttatttctttgctaggcacaggaaatcaggttttacacatatttgaacttggataactgaagcttacccataaacatttaagatctttatattttcacctttttgtttgtttggagacaaggtctcgctgtggaatgcagtagtatgatcacagctcactgcagcctttacttcctgggcttaagtgatcttcttgcctcagcctcccgagtagctgggactacaagcatgaaccatcatgcccggctaatttttaaaattcgtttgtacagacggggttctcatgttggccaggctggtctcgaactcctgacatgaagtgatcttcccaccttggcctcccaaagtgctgggatcacaggtktgagccctggcgccctgcyttagcttttccgtcatgtcttgttttggcttcaggatcctgtatgacatcgagtccccttgtttcctcaggctccttttggccgtgacagtttctcagacttccctgtttttgatgactttgacaatgttgagggatactggtcaggtattttgtasaacatcatgagatttatctgatgtttttctcctaattagactgaggttacgggttttgttcagaggaggaccacagaagtaaagtgccatttctatcatgtcatatcaagggcacgtactggatatactgtcatcaggacttttctttgggtcccacctattgcccgggctggtctcaaactcctgggctcaagcagtgctcccacctcagcctcccaaagtgctgggattccaggcgtgagccactgtgcacagccaggactttccactgctgaagttgaccttgatcacctggctgggcagtgtttccaggttcctctgctgtgacgttgctctttctcctcctcccacgctgtgctctttggcaggaagtcactatgcatagcccacacctgggggtagggacgtattcaccacctgcttgagggtgcagtatctacataaattatttggaattattctgcgtgggagatttgttccctccctcccatttgttaattttttttttttttgagatggagtttcactcttgttgcccaggctggagtgcagtggggtgatctctgcccactgcaacctctgcctcctgggttcaagtgattctcctgtctcagcytcccaagtagctgggattacaggtgcctgccaccacacccagctaattgttgtatttttatttgtttttttttaatttttgttttggccaggcgcagtggctcatgcctgtaatcccagcactctaggaggccgaggcaggtggatcacctgaggtcaagagtttgagaccagcatggccaacatagtgaaaccccatctctactaaaaatacaaaaaattagctgggggtggtggcaggtgcctgcaatcccagctacttgggaggctgaggcgggagaatcactttcggaggttgcagttagccgagatcaagccactgcactccagtctgggccacagagtgagactccgtgtcaaaaaaaagaaaaaaagaaaaagaaaagtggtttgggaataagttctcattctatgttcaaaaccaaaagttgattttatagggtattattatttttcctattttcctctatccgttatagagaatggtttccagacctggtctgtgtctttcataactttgaccttctgggggtttcatgcaccgttcttcctaagctgggctaacatttcactgtggtctgtgtttgctgtgggaagaagccaccgatgttgaaatgtaagggcctgctgtttatgcactgttcattcagggctgcacgtgcctatgtgacttgaattctttattgatggctgagctgcaggattgagcatgacttcttgcctggggtcaaggctccagaattttccttagtctcctgttatcagcttttcttagaatcaggtggcaccagggagctgctgcaggactcacaggaaagagcagaggattgggtgttaaaacttggtgtcggctgggcgcggtggctcacgcctggaatcccaacactttgggaggctgaggtgggcggatcacaaggtcaggagatcgagaccatcctggctaacacagtgaaaccccagctctgctaaaagtaccaaaaaaattagccaggcacagtggcgggcgcctgtagtcccagctacttgggaggctgaggcaggagaatggcatgaacccgggaggcggaggttgcagtgagcggagatcgcgccactgcactccagcctgggtgacaaagcgagactctgtctcaaaaaaaacaaaaacaaaaacaaaaacaaaaaaacttggtgtcagaaggcatggtatcgagttctggcctcatccttcctcagctcaaccttaagcaatttcccagctgtgaaacggaaatgacaagtcctgcctcttggggttgggccaaataaaatatcaaaccttaaaagatttgggaaactacttaagtaaagtcctttaaaaattaacgttagctgaatttagtgcttgccacttccaatgtaattggagggtggttggaaggaccaagtaaaggaattaagatatttgacaatttatatatcttttcttatttcccctttttcatatttatgtatgtaaagtcaactatacttaggagttcaaaatttggtctttatagacctatgctacttaaatctgaaatcctagttacttcacccattaattttctttatccaacccttatatatctccaagtaggtgcttcacaaatactaactcacttaatcctcttcaccaagctgtgaaagtaagcccgccattgcccctattctgtgctgcctggtgtgtgcagtggggttggtttagtgtctcccacaagtagccatacacatcatgcagttacagggcttaggacagagcctggtccacrctgagggaccgtcaatggcagcttgccacgtttccttcctttctgcgtgaagtgtgtagggctccctttctgtgttgccattttataaacaaggaagtcaaggaggtttccgtaaataaaggcagttaataagagagagtcaggcctggtgcggtgtctcatgcctagaatcccagcactttgggcggccgaggtgggcggatcacgagttcaggagatcaagaccagcctggccaacatggtgaaaccccgtctctactaaaaatacacaaattagctgggcgtggtggcacatgcctgcaatcccagctacttgggaggctgaggcaggagaatcgcttgaaccagggaatcagaggttgtagtgaaccgagatctcgccactgcactccagcctggcactgcactccagcttggcaacagagcaagactccgtctcaaaaaaaaaaaaaaaaaagagagagagasagaacatcagaaacgagctcatttgatagagagacagagagcctcagaaacgagctcatttgataaaagagagagagagagagcatcagaaacgagctcatttgatgcctttctctctcacttcttaaaagcagcaagagccagccaggcgcggtggcgcatgcctgtataatcccagcactttgggaggctgaggcgggaggattgctggagcccaggagttagagaccagcctgggcaacataacgagaccctgtctccacaaattaaaaaaaattagctgggtgtggtggtgcacacctgtgatcccagctacttgggaggctgaggtgccagcggttgaggctgcataaggcatgatcatgccacacagaatgagaccctgtcgcaaaaaaaaaaagaaaaaaaaaaaaaggcagcaagagcctgccttgggattcctccaggtctttgggtctaagacattaatgctgtttggaaatcctagtgaaatggcactcggaaacctttcttgctctaggactggaaatctggggtttattaccaaagtcattcaaattaatgaaatcatagcaactgtccaccttcatctccctgggaatttgctgtaygtagagttaacagtgtttagttattggaatttttatcataatagacttacacttcttagctttgaaatcttagagttattaaatctgagactggagatttcaaatawtatyatcatattccaaatggatatctttcagaccaaaatacaggtgaaaatggaaaagctgtcttcaactaccaagggaatttgtgaactagaaaactaccattatggggaggagagtaaacgaccccctctgttccacacgtggcctacaacccatttctgtaagtagttccttctcagttgattttcaggagggtaaaggttattaagggcatttagtatcgtttacatctggtactttaagaagctgacaaggctttcaaattcaatgcaaaagtatcgggaggaaaggagacagaggcatcttaaacatttcttcttggctttaattacctggttatcagcagagtatatgaaacatagagacccgtgaagcaagctgctgttattaggcctctaaaaccaatgggcagagtgaattccacctcctctgtggaagcagatatctctcattttgagggggggaaaggaagaaaggagtttttttggtttgttgaggtttttcttttgttttttgttttaattaaaaaacaaattgagggtcactgcagccaacctcatggaagatgactgggaaaaatgaaacccatggcttcagtaaactctatgaggcgcttcttaaagggttacttttagcttttattagttcaagacaagggtaagctatttgatgttgacctgagactttttaaataaggcaggaaagggtaaaatcacctagtggaatgtgtttagtgaaatattgtcagtttgaggggaatctcctactgataatcactgtaggtcacctaagagtcaagtagaaaaggttatatatactttttttgagacagagtctcgctctgtcacgcctgctggagtgtagtggtgcaatcttggctcactacagcctccgcctcccaggcacaagcgattctcgtgcctcagcctcccaagtagctgagattacaggtgcgtgccaccacacctggctagtttttgtattttttagtagagacaggttttcgccacgatggctaggctgttctcaaactcctgaactcaggtgatccacccacttgggcctcccaaagtgctgggattacaggtgtgggccaccacgcccggcttgtatacactttttatttcactctgctgaccatgttatcaaattgtactaatctgcaccagctagagtagtaaactccatcgggcccttcttcccctcagtgctgttgctgattctggtttttaatcaagagctgttaaaatgtagttcttcccaagtcgacactatgttcttgaatcactgccattaagggagattcacgtttctttcagatgaggtttcgcataagctcttggagatgtacaggaaggagctgctcctgaagcrcacggtggccaaggagcttgcccacaccggggatcccgacctcaccctgagctacctgtccatgtggctgcaccagccctatgtggagagcgacagyaggctgcatctggagagcatgctgctggagacaggccaccgagctctctgacgtcctgagacggctgcggacactggctccttccacgtctcaccaggcagacagtctgcctaggacccagtgccgcaggcctggatcagaccccaggatcagacctyggggtcttytggccagagcttgtcaccagccccayggcctctccaggsgtgctcatgcccacaacccgcggccagccccacgtggtgcygctcagccttytytgcccctcctgggaatctgtcattcgtgggtgcttcagagtaaaatcaatgagtttytgagmagaatgagtgagtgatctagtttctataaattaggcatgctttatacattatgtttgtgtagaaaatccctggtttaatatttttactttatgcctatctgattgttgaagtttttatgagactatattagtttttgggccaggtgcggtggctcatgcctgtaatcccagcactttgggaggccgaggtgggcggatcactttaggttcggaattcaagtccagcctgaccaacatgatgaaaccctgtctctactaaaaatacaaaaatcagctggcgtggtggcgcgtgcctgcaatctcagctacttgagaggctgaggcaggagaatggcttgaaccgggaggcagaggctgctgtgagccattgcactccagcctgggcgacagagtgagacttcgtcttaaataataagatcccatggagttaaaatgaagtttgacatcatgaaaatgaaaataacctacaaaaaaattgccgctgtttgcatactggggacatggcaagcgatgtaaactgccttccctggcattcttctgacacaaatcctcgagtttcacaatgtttgcagccatttccagagttaacatactaggttagaatgagggaaaggtgacagttttgaaacagaccgaagagactggccaaaagctagggcatggggagaatgtgaaggtatgcaaaagcctacttttttttttttttttaatggagtctcgctctgtcaccaggctggtgtgcagtggcacgatgtaagctcactgcaacctccgcctcctgggttcaggcgattctcatgcctcagcctccagagtagttgggactacaggcacgcgccgccacacccagctaatgtttgtatttttagtagagacggggtttcaccacattggccaagatggtctccatctcctgacctcgtgatccacccaccgcgccctcccaaaatgctaggattacaggcgtgagccaccgcgccgagcctgcaaaagcctaaactcttttttgtggcattacttgttacatggtttctacatctgcgtttgcctttttgtaagttctctgatcccaaactgtttatattctgtgggactgtgtatagagtgatacttaataaacagcagttttagttttttggtttttatgagataggctcttaccatgtggcccaagtagtgtcaaactcctgaggtcaagtgatcctccctacttagtctcctcagagactacagtcatgcactgcccagcccagcaataatgttgttggtgtttttagatacagggtcttgctctgttgtccaggctagaatgcagtggcatgattgtagctcactgtaatctcaacctcaaactcctgtgctcaggtgatcctcctgcctcagcctccagagtagctgggactgtaggtgtgcataaccacgtccggctaatttttttatttttactttttagagatgggggtcttactatgttgccctggcttgccttgaactcctggcctcaagtgatcctcctgcctcggcttcccaaagtgctgggattataggtgcgagccactgcacctggccaagtatagtttttaattgtgtcattttagtatttaactataaatactatttatctaagtttattaagactattgtaactttatttattttttgagacagagtctcgctcttgttgcccaggctggagtgcagtggtgcaatctcggctcatcacaacctccgcctcccgggttcaagcgattctccccgctcagcctcccaagtagctgggattacaggcacctgccaccatgcctggctgatttttacaggcatgcgccaccacactcagctaataccgtattttcagtgagatggggtttcaccatgttggtcaggctggtcttgaactactgacctcaggtgacccacccgccttggcctccccaagtgctgggattacaggtgtgagccaccgtgcctggccaaaagcatttaaaggcaacatttcttaggatttctctttcctctgcctttgctatatttattaagatctgactatcggctggatgcagtggctcatgcctgtaatcccagcactttgggaggctgaggtgggtggatcacctgaggtcaggagtttgagaccagcctggccaacatggtgaaatctcatctctactaaaaatacaaaaattaggctgggcgcactagctcaatgcctgtaatcccagcactttgggaagccaaggtgggtggatgacctgaggtcaggagttcaagaccatcctggccaacatggtgaaactccatctctactaaaaatacaaaaattagccgggcatggtgctgcatgcctgtaatcctaactactcaggagcctgaggcaggagaatcccttgaacccggaaggcagaggctgcagtgagccgggatcgtgccactgcacttcagcctggtgacagcgagactctacctcaaaaaawaataataatgataataatatgacctggctaggcatgagtcattacgggctcacacctgtaattccagcactttggtggctgaggcaagcagattgcttgagcctaccaggaggttgagaccagcctgggcaacatctacaaaaaatacaaaaaactaaccaggtgtcatggtgcatgcctgtggtcccaactactcaggaggctgaggtagratcacctgagcctgggacattgaggctgcagtgagccacgactgcaccactgcactgcagcctgggtgacagagcaaagccctgtggaaaaaaaaaaaaagtgcctcagagggcattaaagatccactctgccctggctcctttctttcctgctggttcagctctccccactcctgtgaccatttgggaggtgccagggctgcagtgccgtgggtgcctgaccaggggtacccaaccagggttgcagccacaggaatcctcatggtttccagggaacacaagggaattttctttctttgcctttagtaataataactgaacatggaccaggtgccagggatcatgacaaatgctgaaaccacgtgtcctcattgaagccccagccagccacccctgggagtcatttgggtgtccttgtcccccggtctgtactctaatgtctcttcacacttgctcttaatctgagtatttgaaattaaaagtactatgtatacaaaacaaagttcttcatgagaaaaggaaatttccatttatcattctttcataaataaggttatgtctgtctttttttctttctttttctctacaggtgtgcactaccatgctgggctaattttttttttttaatttttagtagagatggggtctcacggagttgtccaggctggtcttgaacacctgggctcaagcgatcctcccgcctcagcctcctaggttacgtctattagaagggggttgtaatgtggaagctgtgcatacatctgtctctatgctgtattggggaactctgcaaaggccaagctggaagagaggataaggcacagggctcccaaagagtagggcccatgagtccccctcactgccgtcagtcctgtgcctggcacacagcagcactcgacaggcacgtggccgattcatgaggacactgctctcagagcctcctgtgtcttcaattctgtctggtggaacaaaggtttatttgttgtaggttttttttacatcagttacattgaccatccattcatagtagcacatacacagtggtgaaactaagatgtgttgggatattcactagtgtcctatagatagaaaataaatgtatatttaccagggcctcatccagaccatggtcatactcgagtcagcatgttgtgtcagttacctgacagtggttatgaatgatcctcagggctcttgtctccatctccaggatcccaggagggcactcatggtggtttatgggactctggactcctgagaagcggccttgagtctacaggatacatctacagcctgacctgaccacccracactcccaggcagccgcggcttgctcccctgctggccatttccagcctgctagaaaacccacctttttgttcctaccgaccgtggctttgagatcaagtgagggtaggaaatgcccctggtcactaaaagggctgtaggaaaggctggctctctgagaatacagctgccctccagggcaggacctggaaggagcacagcgccagggcgacacatggtcacaagcccagctctgtccctgagcagcgtgctctctgcttggggtctctcctgaccgtctctgcaaggcgtggggagagacctgctgctccctttgaatgctttcttccacatgtggacaaatggcccttcccttccttccccgtaacacagcccacggaaatattgaagacatgccactaagtgactttccaagtgggacatcaaagaactgggcttctaccctgagcagcatcttgctgtggacctcaagtaagtcaccccatcatttatgcctcaccttcctcatctgtaaaatgtgaggagagccaggcaccgtggcgcacgcctgtagtcccagctactcaggaggccgaggcaggaggatcgcttaagcctgggagttaaaggctgcaatgagctatgattgcaccactgcactccagcctgggcaacagagtgaaaactcatctctaaaaaaaaaaatcaggccggggccgggcacagtggctcacgcctgtaatcccagcactttgggaggccgaggcaggcagatcacgaggtcaagagatcgagaccatcctggccaacatggtgaaacctcatctctactaaaaatacaaaaattagccgggtgtggtggcggacacctgtagtcccagctactcggcaggctgaggcaggagaatcacttgaacccaggaagcggagggtgcagtgagccgagattgcaccattgcacttcagcctggcgacagcaagactccatctcaaaaaaaaacaatcaggcccagtgcagtggctcacacctataatcccagcactttgggatgctgaggcgcgtagatcacctgaggtcaggagttcaagaycagcctgaccaccatggagataccccgtctctactaaaaatacaaaatgatccaggtgtgatggcacatgcctgtaatcccagctacttgggaggctgaggcaggagaattgcttgaaccctgtggtggaggttgcggtgagccaagatcgagccattgcactccagcttgggcaacaagaccaaaactccatctcaaaaaaaaaaaaaaaaatcattggccaggtgcagtggctcatgcctgtactgtaatcccagcactttgggaagctgaggtgggcggattgcctgagctcaagagtttgagaccaccctgggcaacatggtgaaaccccgtatctactaaaatacaaaaaaaaaaaattagctgggcatggtggcatgctcctgtagtcacagctactcaggaggctgaggcacgagaatcgcttgagcccaggcggcagaggttgcagtgagccaagatcgcgccactgcactccagcttgggctacagagtaagacttggtctcaaaaataattaaattaawttaatttaatttaatttaaaaaatcatgcaagtagaaatgactttttcccccttctatcaataaaatgctgcccagaatgactagcttattttctttttaattgaacccaaaagaagcttctagtatggagcaagtctggtggaaaagcagcatatctcccaggagagaagggaaacggagcagggccaatcatcaggtgacagtgcagtgctactcatcaccatcatgaaaaactcatgagcgtcagacgcgccacagggattcctgatcaggtaatatctgctattattatgacaagctccatagaaaaatgtagacagcagggcagaaagacattattctttataaataaaaggttcatctgtgcaatattsacattagaaaaatatacattgcttgccatagaccttctctggataaaatcagacgaatctaggatctgactccacttcactgtgagggctctsgctccrcggtgacgaccgactccacagcttctagaggaactccttctagcgggcccatccgcaggcacgcccctctgcatcagtcactgtgacaatgtcctcctcctgagacactattgtacctggaggggacaagataagcccatcggaagtctgaataaaaatctgcttctgtccctgagacagtaactcatggctcccattggaaatttcaaaagccatggcttcgccracagcaaccacgctctccagttctctctggccagagtgcacctccatcccacagggkaaccggttcaagtcccccgaaaggcttctgagacacccttcagtcaatagtgatccatgtgggccaggctgaggccctggcttgggcacagtcctgtaggcacagtccactgccaygctatccacagacaaaattttctcaagcggaggggctgccacctctgtaggcaggacgctggtggggctgggctgctggtggttcaggtggaagtcacaaaccttgccgaggtgtcctgcctctgcatgtccaggccccccaggcggcagggactctgctccaccaccagatgacaaagggctgcagaaacccgggctcctcaggctgtcccaggtgtcctggtctgaagagtgttccaaagcattctctccaggaaacgctgccacctgtgcctgggtcagcctcctaggctctcctgactgagcataaacaggcagcccactgacatcccrggatgagagagcagcacctatagaccccctcctggcttctaagttagccagtgcctgaagctgcgggcccgcctggaacacgctcccattgccaccagaaaccgtcgttgtatggctttcttcagaacggggagagacagtcacatttactgraggggaaaaacctaaacattttgggaaacaggtgaacatggcgtgtactgtgtcatggcccactcactgcactcaccacccaaaaccagctaggccaagtcacctgccctgcagaaaagtcaaagcatcgatgctccttgctccttgggattggtagcaattttaaaaaatacgtccctattctctattcacaaagacagattttgtattaaaaatatgctctaagagccaatcgacagtgtgcttttttttttttttttttttgagatggagtctcgctctgtcacccaggctggagtgcagtggcacgatttcagctcactgcagcctccacctcctgggttcaagcaattctcctgccttagcctcctgatagctgggattacaggcatgcgccaccatgcccagctaatttttgtatttttagtagagacaaggtttcaccatgtaggtcaggctggtctcaaactcctcaccttgtgagccacccgactcagcctcccaaagtgctgggattacaggcatgagccaccacacccagcaacagtgattttatgccaatactgaatgaatgattggtgrttcttcatcagagtgagctggagaatcacccaaagaggcctttccaaatactcacatccacaccctcccaacaaccctacctgcagacctggaattcccasaggtccaggcccctgtatttcacaataacctccccaggtggttccaacacatgccccaattaagaatcaccatcaggctgggcacggtggctgctcacgcctgtaatcctagcactatgggaggctgaggcgggcagatcatttgaggtcaggagttcaagaccagcctggccaacatggggaaaccctatctctactaaaaatacaaaaattagccagatgtggtggtgggcgcctgtaatcccagctactcaggaggctgaggcaggagaattgcttgagcctgggaggcagaggttgcagtgagcagagatcatgccattgcactccagcctgggtgacagagcaagactccatctcaaaaaaaaaaaaaaaggctggcgtagtggctcatgcctgtaatcccagcactttgggaggccgaggtgggcagatcacctgcagtcaggagtttcagaccagcctgaccaaaatggtaaaaccccatctctacaaaaatacaaaaaaaaattagccgggcatgatggcgggtgcctgtaatcccagctactggggaggctgagtcagtagaattgcttgaacccaggaggcagaggttgcagtgagccgagattgtgccactgcactccagcctgggtgacaaagtgcgactcccgtctcaaaaaaaaaatttatatatataattttttaagtgcytagttgataggttctggctagagccagaataaaagccaggacctgtcttgttttcaaatgttaaatctcagctggcatgtacagcgaagtctcatgaaagccaagccatagatggatgtgtcctgggacccgtctcagcctaacctcttgggaccctcctggtatagcctgtttactaccatttggtggctctccttttttttttgagatggagtctcactctgttacccaggctggagtgcagtggtgcaatctcggctcactgcaacctcctgcctcccaggttcaagcaattctcctgcctcagcctccgaagtagctgggattacaggcacacgccaccacacccagctagttttttttgtatttttagtagagacggggttttgccatgttggccaggctggtctcgaattcccgacgtcaggtgatccgcccacctcggcctcccaaagtgctgggattataggcgtgagccactgcacctggcctgtggctctccattttaacaaggcactctagaaaaccctgaagacctcaagactcgcagggaatgaatctggaatgacagaacactgggaggctggaatgaaacttgagaaaccagagggtccccttaaatccagcacaggtcacccaacctgaaaaatggcaatcctgggtacatctgtgcatgtcagcagggctgccaggccatggatacaccccacaaacagcattttaccctcaccagcggccaaagcatgcaagggcctgggcttctcccggcctctgctgttggcagcaagagattcagtggtatcgttggacagggcttctcttctgggccttttcactgaggccagtccc

SEQ ID NO: 13476 - DNA, 53331 bp, Homo sapiens
  misc_feature (1)...(53331): n = A,T,C or G, or insertion/deletion polymorphism (see Tables 1-2)
atccccgccaccaggatgatccagccactcacctgccacacagatgtcaaagtagtcaccaaactcacttcggatgtgcttcaccaggtccactgcgtagttgaagcctccctcctcctcttcccactggtcacctattgggtctgcagggttggtggaggtcatagtcactgggtctcacccaacctccagagaccctttctgttccctctacctagyccygacaccsaggacygcgagtccctggaaggcagaaacttcatattatttaggtttggttcgtctctttctagcacttggtaagacagcaggagggaaaaaagcagcccaccagttcaatattcactgcatgctgaccctgtgctggcggtggagaataggagaccaccgctgcttctcaccgtgcctggaggattggagagcccttccctacttctacctgggcaygcctgccaccctctcccatcccacggccttggggctcctgcctcctgggagaattttctactcatctcaagtgaaggggtcttgtggtagggagcacgaggccataggatcccacccatcaggctccctcttcccactcttaggtggcctgacaacagcgggcaccagaggcctgaccggctattctcactcctggatactctgttactctgtgattgggccaagtgctgggtgcagccagcaatcgatgcagtggtgtaggcaaggcagagggttatcaggccgcgactgcattcctgacggaactcctatgtcgaggtcaagaggtggaagaggtggctgcctgtgtgtggtgcccaggatgactcactacccacaatgcctactgacactactggcggggatgggatcctgcggatcctcagcgtggggcccaggargaagtaaaggaccatttcaggaaccaagttcaggctaccaagtggcctccgggaaagccagaacccagagtgtaggggagtgctggctccacacctcccygcagcgccatsatgttcttcaggcccagctgcttagctttgtgcagatggccygtgatctcctccaggcgctgacggcagcaggtcatgtgcaggatggtctccaggccacagtagttcacggykgtgctggcgatcatcatggaggaggtctccttgtctgagccagggtcacctgctgggtgccaggtcacgtctatgtagagggggccacctgctgccatccggtcaaacctgtagggggtttgtttctgaagagaggttccaggagaaataccatccgtcactgccttcccatggggcccgggagttagagaagcatcaatgaaggttggagacagaccaatcagcgttcatatcctggctttgctacttatagctgtgtgatcttgggtacattacttaatctctgtgagttctgtttccttatttataagacacggcagatagtagtacccacttcataataacactaggatgctgggcgtggtggctcacgcctgtaatcccagcacttcaggaggctgaagtgagtggatcacttgaggtcaggagttccagaccgcctggccaacatagtgaaacctcatctctactaaaaatacaaaaattagctgggtgtggtggtgggcacctgtaatcccagctacttgagaggctgaggcaggagaattgcttgagccaggaggcagaggttgcaatgagccaagatcacaccactgcactccagcctgggccacagaatgagactctgtctcaaaaaaaaaaagcaacaacaacaacaaaaaaccataacactaggagaatatgacggcagctggttccacagaacttagaacagtgcctggtgtacaaaccgaatactcagtatatgtgaggtgccgttataatcactattacagaggtaagacacaacaacagcgctatcattttgtgtgagagcagcacttcagacttttcacagcgcttgcctgtttaytatctcaggtgagttaagacatcatgattgagagttaggggaatcctaactgtggcaagcacagcctcgctgtaggaacagttagaaagagggtcagcagactcactttctttcatrycaccccccaagccctgtgcagcagcttacagttatgcagaccaaggccaagttccgaaacgagactcaaaaaaaagcctggatgtgcacgagtacttgtgttacaagctatcaacggtgtatttaaacatccttgtgcatttaaacttcaaaaacttgggagtgacacgtgagacgtgcatacagtaaaaggcataaacttaaaaaaaaaactgcaattcatgaagtgctaatgtaattcagttggcatttctagagttcaagaagcataatccaaatttctaacttgctgaaaacaatctcactgctttgtgacttcctaaactgcactcgtgatccagcccccaagttccctcaaagaatacagtgtgagaatcaacatttttaacccattgaagagtgtgtctaaaataccttgacactgtggagggacttttacaggcaacagagaagttgcagatcagatgacccactctgccttctccttcctgccccctccggctgcttttttctgccgggttaaagggcagcccagcctcagggctgacagtttgctccccaggcaccaccactcccgcctcccaccttaaccttgcatgagttyaccttgagatgagattgacagctccctcagcagttygaggagggaagaattccagggagaaccacttgtcaccagattccaatygcsgcctcatcttctcccggagtctctcatgccgctcrgggtccaggcccggggtggaacatctcgaactatctttggagctctcactgccactgctggcactgccctccaagcaggggttgaggctgctgtttcctcwggcttcgttcaccatggctgggttcctactgcacagggtggggcagggagcatcagggggcaggcagccacacccccgacacatcaagacacctgagtggcaggttcaagccggaggcrctgtatttccacacaggaagaaggccaaaaaaggtgacactgccccctcccagtggctccatgctcctcagctatggctgtccgggccgcctcactcaaagccttgccctccgctgctgccaggctccttgcatgcaaggcagcccccacccggcactgcaacatgctcctcggtgacagctacctgatggaaggtggcacagaggacctcacgctgccgacctgcgaggcccrtattcctagcgaggggcagtagtgcccagctgggaggaccctggcttttcgatgktccatctctgtcagctcaggcccagagtgcgtggggagggaacagaggcaccttccccagcgggtgtgttcaactgggcggagctgcgacaaaggaagaggcttgagctccagccagcacaagggggcgggggcaaggcttccaggcgaggagggagggctgaggctctagtaaggggaggcggatggaaggagggggactcaggggcagagactgcaggggttggtggagatgaggccaacaggcgttcagggataccagatcaccctccagagaaggaacagctcactctggctggctctgcctggaacatctgttacttgaaacagttcgtgcayaggatggaaggggtgagggcttgactatgcagccagatttctcctgaattcatgctactccaaaaagacmgtgttgtgggttagaacttgatgctggccatgttccaaaaatagccagacccaagttcagtaagggcacgaatttctcagaacaaaagctgccccatctgtgcttgccttgcaggctgctcttcttacacatcacagaattcaattcaaatcatcacagtgacccagctactggraaggctgaggcagaaggawtgcctgagcccaggagttcaaggccagcctgggcaacatagcgagactccatctcttaaaaaaacaaaaaacacacctgtaatcccagcacttygggaggccgaggtgggtggatcacctgaggccaggagtttgagaccagcctggccarcatggtgaaatcccgactctactaaaaatataaaaattagccaggtttggtggcgggcrcctgtaatcccagctactctggaggctgaggcaggagaatcgcttgaacccggaaggcagaggttgcagtgaaccaagattgtgccatagcactccagcctgggcgacaaaagcaaaactccrtctcaaaaaaaaaaamcaaaaacmaaaaacagaaacaagtaatcagagccaccagggcacagacaggccaacagagggcatagggycatctggcagtctggttaagaaaataagacaaacacttaaaaacaaacaaaacacttgcacagcaatgggcaaacacacagtagtgaatgggtgtgtggtgacatggcacaacagaggaaagcccaggtgaggttcatttctttcagactgtccaccactaaccctgtgtacctaaccatttggggtcttagactcttttgacaatctgattaaatgcactgctcccttcccctgaaatacacacacaggtgcacagactacacggggatacatccaaagacaaggagttgattccagactaagaaccctgggccaaagctttctccctctagggctgctctctttcattctgacctcaaactccagattctcagtggggatggctgtggggagtgaggaacgggggcgggggggaggagtaacagcaagagcagccagttggctttcctccagcgtttaagggcgcacctcgttaattgcttgctggaacagaacctagagtaggaggaagctgaaccacctgtaaaccctctgattttcaaagacttattgcattcctagtatatgccacgcatgtgccatatttgtaagccaactcccacgatttatccgttatcagctggactcccatagcaccctgggttgtaactgtgggtgaaaagrcctgtctcctttctctttccccagttccctgagacaggaccggtgtcctgcctggggtatccccagagtttggcacacggtgatagccaacattcactgagcgccaaagggccaggtgctgccactctctcaaaataagcctctgccacttactgaacaactagtctgcgccaagcactgggatactaagcctacgactcccagaaaggtcccggcggacccccgtgcgcagcgggacgcagtgggcgccagggaccgcagtgccccgggcccagcgctcttctccaggtgmtcgccggggaggcaggtttaaaaggcaggagccggaagccgtctcggcgcccaggtggccgagaatccagtcaccaggtcactgagtcaccgatgggggcgaggacacgggcctgggccggtcagaggggcgggatcgtcacccctggctcaggggcccctccgtccaggcagggagccaaagtcagtcttcgcttgagggttggcggtcgctggaagtggtagccattgggagttacactaatcccgcgaagggtgcgcargggaggcggcagccccccccaagaagagaggcaggccggcctccagcgctccccgcccacaagcacgtccttgcccccgggaggttgtttgccggctccaggatctccctcccggcgaccccggcctcgccgtcactcaccctccagtcccgggtgactcagaacgctcggccgccggccgcaccactgtggccgctgcaggggcggggaacgcagtgaaggggcgcggcgcaggtgtcaggttgctggagaggcgggcctacagggcggaaaccaccggcgcgggtgaccggaagccccgcccccaacatggccgtgcccacaggtctcgttggaggccgtgcctttatcgtcatgtgacgcgagtcctcgccccacycgtctgcagccactcctggtctcagtcccagagctcgagagggccacgtgaccgtcccggggccagtcacgtgaggcgcagatcctggctgggagggggttggtagaggggtccagagtggcagtaaaggaggaagatggcggggtgcagggggtctctgtgctgctgctgcaggtggtgctgctgctgcggtgagcgtgagacccgcacccccgaggagctggtaagaagccggcggagtcggcctggggagggggcggttgctaarggactgagagaggcgttgccgggggtggggccgggccaatctgggcccgcaggtggcagcgggtggggcctggggaccgcagccagggctctcgaagcgtctaccctgcttcacgtgcctaagtctggggtcttttctcataacccctcctggaatctgagggagaatccaggccagctccagtaaatcccacccatgtttccttttatttccatctgaaaagagtttggaatgaaacaagcgttttcagaatgagcttcctcacaggactttgtgcttatcatgctgctgttttagcttctccagtcctttctcactctatccctcaccctttctgggtcactgacagtccagcttccccctgcaaagcatcctgggaaaacttgagttgtgttcccagagttgacaagtcctttctgatttcagatacgtcacactgtcaaatggaacctgcatttttaccccccttttcagctggcgttggacatctttgaggtgtcctgaagaggagggtggttatttggagactatcagtggaaatgaagagctcagctgatggctgtagatcctcacccacatggtccctcaccccygaaaggttttttttgagggctggttcctatttgataatggctccagatgatttagaagctagccactgatttcagtaaatacttctgcctccttccactcctaaccactaaaaaaggctccctctgcggatctgtktttctagaccatccttggagaaacacaggaggaggaggatgagattcttccaaggaaagactatgaggtgagctcctttgatactgcttgggcaactaaagtagtgagtggcctggtcacttcaggccgaagcattatgattccaaccagagatgctctttgaccttctgtcccagggagtgagtgggtaagagaacttccttctaggaaagagactgtttagcaagcccttttctcaccttaaccccaaaacaaggtctggtgtttttacacgtttataaatctgtggcaccttaacctggatagagtatgtatttgccattaaactgtttgcttttacagcttacagagagacttagagtgaaaggcactggcaggcagtatgtgcccctaacaggtgtgtgcytataaactgttaaggaggccttgcttctcttctaggagagcttgcttttcagatattttcttgctcaagcagcttctctctgacatgttcttgattaagttccacctttcatgtatgggattcttagagtatgtgtttttagtaaagccaacactgctggggtgaaacaacatgcgtgactttttatcattaaattcttaaacgtaataaagaaggtagagaaaagcctataactccattcattaaaagatgactgttaacaccttactaagtatctttctacatccttacccatgcttttatatacatgatacatgctttttttaagtaacaaaaatgagattccactaaatcatctattttaacctgtcccactcaccccctttattatactttttgtatcattaggtaattttccacaaccttttcttttttttgacagagtctcactcttccataaattcttcatgctgtagaatttagtgtcagcgttaggatttgtagcacttttttgtttaacttttattatgaaggatttcaactatatgcaaaaacagaataatctgttgaaaccccttgtcctcatcacacagcttccacagtgatttagctcaagcccagtcttcttttgtctgtgctttcgttatccacttctcctttctcatattattattttttattgtatgtgtgtgtgtgtktgtktgtgtgtgtgtgtgtgtgtgtgtgtgtgtgtgtgtgtgttttaaagtaaagacagtctccctatgttgcccaggctgttctcgaactccttgacaccagcgatcctcccatgtcagcctcccaaagttctgggattacagtcatgatctaccatacctggccgcccttcccatgttattttgaaagaaattctgtacatcatattatttcacccataattctatatgcatctctaatggataaggacttttaaaaagcataacccaatactattaccacatctaaaaaattaggaatttcttgatatcaaatatctactgtccagattttccagttttcttgtaaatgtcatatgtattttaactttatttgaattaggttccaaaagtccttttttatttgtttgataaatctgttaaatctcttttaatctgtagcttcttccttcatcttttttttttttttgtaagttatttgacaacataattaggacctgggattttctactgtctagattttgccatttggagccgtttgtatagtttaatatgctactctgatgggactgctttgaatgaaccaaaaagcactgtatccactgctgtgttttgttctatttctttttttttyytttttttaaatttgagatggagtctcactcttagtgcccaggttggagtgcaatggctcgatctcagctcactgcaacctccaccccaccctaggttcaagcrgttcttctgccccagcctcccgagtagatgggattacaggcgcccaccaccatgcccggctaatttttgtatttttagyagagatagrgtttcaccatgttggccaggctggtctcgaactcctgacctcaggtgatactgcttcggtctcccagagtgctgggattacaggtatgagccactatacctggccattttcttctgtttygtaagtatttgttttcttgtacatagttgagaagtttgcaggaattagtataagatactccatattgttctgtcaccttgcactccctcactgaaccctgttacatcatcctgactgtatcaccaggactgagactgtctcacagccttcatcctacttctaggagctcaccaaggcttccccattgacacccaggctccctcaccccttctactaaattgtacttacatttgtaatgtgcttgccttcagctgatatgcatattcatgtaaatttttgttgttsttgtcattgtttgagacagagtctcactctgtcgcccaggctggaatgcagtggtacggtctyggatcactgcgacctccacccccgcctctgagttcaagctgttctcctacctcagcctcccaagtagctgggactacatgcatacaccaccatgcctggctaagttttgtatttttagtagagatggggtttcaccatgttggtcaggctggtcttgaactcctgacctcaggtgatccacccacctcagcctcccaaagtactgggattacaagcgtgagccaccacgcgtggccatattcatgtacatttcatgggttaatgttcttttgatattggtcattgatatttctcaaccatcttcaagaatgagcttcttgagagcacttgctttgtgtaagaacaaattcaggcacttaaacagaaaagtctggattttatttattcaataaataaatcaacttgacacaaaaagtataataaagaggggagtgagtgggacaggttaaaatagttgatttagtggaatctcatttttgttatttaaaacacgtgttaaaagcatgtgtataaaaacgtgggtaaggatgtagaaggatatttagtaaggtattaatagtcatattttaatgaatggagttatagggttttctctaccttgatagtcagtcaactagaaaacccttctgttgaatatctttctaaaaagtgccccttcttccygtctcaggaagagttcattgcacatatttgactctttrtttgataaatttagggtcttacaaaatgttagaatcccattttgacatccattctcattataggtggtttgaaaaatggtaactttctgtgagatgtgccattgcaaacaggaatgttttcatgcaggtcacacagtctatttatattgtacctttgaattagaaagaggcacactcagaacgtaagacttagaattaaaggcctcccccactggccatagcagcacccctagctcacaaccagttgaaggtggttttggtgtgaacactaagatgccccttcctggttgaattggggctggttcagcccccacctccctcccggccaggtgccattttgctcgtaaccccctgtaacagccctgcaagacacagataacattttatttttttaaaaagttgttagtcccctaaaccaaagagcaacatatactgcagaaataaaaagttartcatagcaaaggagaagtaacagtatctggttttaataatagctcatatattccattggtacatatttacaaagggccaaactcaactaatttatttaaaaaaaaaagaagcgtggcacagtggctcaygcctatatgctcagcactttgggaggccaaggcaggaggatcgcttaaagccaggagttcaagaccatcctgggcaataaagtgagactttgttcctacaaaaaaatttgttcaaaattagcagggggccgggtgcagtggcccacacctgttacccccacactttaggaggctgaggcaggtggatcacttgagcccaggacttcataccagcctgggcaacatggcgagactccatctcaacaacaaatacgaaaaaattaacgaggtgtggtggctaacctgtggtcccccctactcaggagatcgaagcaggtgaattgcttgagcccaggagacggaggttgcagagagctgtgatcacgccactgcactccagcctgggtgacagagcgagaccctgacaaaaaaaaaagggattctggtgttctagcgttgcggttgtttctaaatgcccttcttagcagttttattgcactataattggcatactattcagttcacccatgtagagtgtacaattcaatggggttttaaaaattagtatattcacagagttgtacaaccattcctacagtcaatttttttttttttttgagacggagtttcgctcttgttgcccaggcaagagtgcaatgttgtgatctcagctcactgcaacctctgcctcccgggttcaagtgattctcctgcctcagcctcccaagtagctgggattacaggcgtctgccaccacacccggctaattttgtatttttagtagagacgaggcttctccatgttggtcaggctggtcttgaactcctggcctcgggtgatccgcccgccttggcctcccaaagtgctgrgattacagacgtgagccactgcgcccagctaattcctacagtcaattttagaatattttcatcacctgagaggaaaccctgcactsattagcagccactgcctgttctccttgcccctgactccaggcaaccagtgatctcctttctgtctatttgcctattctagatatctaaaaaccttctaaatgtttacggaaccatatcattattagatggaaccatcaatgaagtacttgaccagtaatttccatacatattttggatgaaggcaagggtattgtttctcctctgctctcaggcaccactcgcggaacactgctaacaccgatatgtggaggttgtttccccactactcaggaggctgaggtgggaggatggcttaagcccaggagttggaggttgcagtgaaccgagattatgccactgcactccatgctgggtgacagagaaagaccccatctcaaaaaaaaaaagtagtaggttgtcacctgcatttctcagcagctggcagtgaattgaaggttcacaggactccctccttgagtttggttaacttgctagagcgggtcagaaaacacagaaatgctacttacatttgctagtttattaatraaggatatcataaaggatacagaagaacagccagatggagagattcaaggaacgtgggagggggcacggagcttycatgccctctccaggcacgctaccctccaggaacctccaaacggttcagctgtctggaagctctctgaaccttgtcattttggagttttatggaagcttttttatgcagtcatgattgattacatcaccagcccttggtgatcagcttaaccttcagcttcggtctcctccctggagggatgggtgtcccaccccgctaatcctgccttggtctttctggtgaccagccccttttctgaagccatctaagggcccccagcygccactcatctcattagcaaacaaaagataccacggctcaaaaaaaaaaaaagacaamgtatgtttgtgtgtgtgtgtgtgtgtgtgtgtgtgtgtgtgtgtgtgtgtgtgtgtattgttggggctcagaaaatgatacctggaaatatggtgctttgatatgctgaactctccaccctcacactttgtctctcccaaagcacaggatgaggctcttctctgccgttcccttatctacctagaaactggacctaccagagaggaacacagttgtctttgatccctttcctgaaatgtcattaaccagggaacattaaaactcatcttacagaggagactgaagaccaaacaacatacctagagcctggacaaactgtcccaaccgttgtttgttcactgtcccatacaatttccaaagagaatcattcacaagatgatatctgcttcccagatccattcattccccactaagaattatttcctcccacatccctatctccccttcccctgtgaagaagagtatagaagcgtctgtacctcgctggcattattgggtaatcattctgcagttcccctgtgcaatgcatgttaaataagtggatgcctttgctcccattaatctgccttttgtcggttcactttcagcagacctttagagagtgaaaggggaagcttttcctcttggccgctacaatacatatgtaggtgcatatatgtttaatcacttatggatgagtctagtttctaaaagtacttttttcatcactgtgtttcttttctgatcagtaaaaaagattttttttttttttttgagaccgagtctcactctgtcgcctaggctggagtgcagtagcacaatctcggctcactgcagcctctgcctcctgggttcaagcgattctcctgcctcagccaccctagtagctgggattacaagtgtgtgccaccacacccacctaatttgtgtatttttggtagagacggggtttcgccatgttggccgggctggtctcaaactcttggcctcaagtgatccacctatctcggcctcccaaactgctggaattacagacgtgagccatcacgcccagccgatcattttttaaaatataaaaaagcacaccatttgtgctatgagaatttcagacaacacccagaaacaaatatctccttaagcactacctcacggatgttttyccattatgaatgctgacktacaaataatcctaattttgtttaatcaaaaagggatattatacttttaattctccatcctgctttatttttattttttaattgcatcttgctcttttgctgaataatttttggagattttccatatctttctatatagacttaactataatcattttattggtgtatagtttactatatttggatgtataattgatttactcagtcacttgttggtactccaggactcataaaaaaagaatttggactaactctaggtagtcatatagatagaataaattgtcactcatcacatgtgtttggctgacttgaaactattgtctgggagtgtggctgccacccagccaatgtccagctgatgtgggtaggaacaggttgtgggaaggagagctgatggccgaccattatttttctttgttgccaaactgctgcgtcttttttttttttttttttgagagtgtctcactttgttgcccaggctggagtgcagtggcatgatcttggctggctcactgcaacctccgcctcctaggttcaagcagctctcctgccctagcctcccgagtagctgggattacaggcgtgctccaccactcccagctaacttgtatttttagtagagatggggtttcaccatcttgcctaggctggtctcgaacttctggcctcaagtgatcctcctgcctcagcctcccaaagtgctgggattacaggtgtgagccactgcacccagcccagactgctgcttctctaacaagacaactaaaatgatttcctttgaattgtttctctaaatgtctgtggcatacctgcaagttgcttgcaggatttctgtgttttgtgatgcatgttgtaaaggatgctgcttcagatgtagaagttttaggagccgagagccaagctgaatctgtgcctcttcctaacataaagtggaagttggccaggcgcagtggctcatgcctgtaatcccagcactttgggaggctgaggagggcggatcacgaggtcaggagatcgagaccatcctggctaacacggtgaaatcccgtctctactaaaaatacaaaaaaattagccgggcgtgttggcaggcgcctgtagtcccagctactcaggaggctgaggcaggagaatggtgtgaacccgggaggcggagcttgcagtgagctgagattgcgccactgcactccagcctgggcgacagagcgagactccgtctcaaaaaaaaaaaaaaaaagtggaagttgcttttaaaaatactttccatgttagtttgtcttgtgactaacctcatttccatagacactaactacaaaagataattataactaattgacattctaaattaatttggttctggctaactgaaacttttgttcatatctaatggagtaagtttcataaggctgatgatagctgaaggtctttaaatattttgccaaaacaggaagtttaaaaataggtaatttaaaacttctcctaaagcatgaagtatgaacctaaagcaacaccactcaaattttaatgtgcatctgagtcatctggggctgcagggctgcaggagtctaagattctgcattttgtttttgtgtttgtttttgaaacggagtctcgctgtgtcacccaggctggagtgcagtggtgcgatctcggctcaccacaacctccacctcccaggttccagtgattctcctgcctcagcctccaaagtagctgggactacaggtgcgcgccaccatgccyggctaattttgtatttttagtagagacagggtttcaccatgttggctagactggtcttgaactcctgacctcaggtgatccacctgccttgacctcccaaagtgctgggattataggcatgagccaccgcacccagccagattctgcattttgaaccagctcctcctgggtgctgcaggtaccactgctctgcccatccacacgttgagtagcaggaacccagaggtttgtccctttgcaggtcttctcacctgacatgaccttttgactcaactttgcctcttttcagagtttggattatgatcgctgtatcaatgacccttacctggaagttttggagaccatggataataaggtgggtcttacaattcttcatctctggggatcaaatcagtcttaacatggcattttttttctcttctaaaggccycagtaaacatctttacaccttgttttttgaaccttttcatgcgatacaggcagacctcactttatgcgctttgctttatttcacctcgcaggtactgcaggttttacaaactggaggttggtggcaaccctgtgttgagcaaggtgccatttttccaatagcatgcattttgtttgcattttttagccataaagtattttttaattaaggtaggtacatttttgtaggcataatgctattacacactttatagacctcagtatagtgtaaacatcacttttatatgcactgggtaaccaaaacactcgtgtgactcactttattgtgatatttgctttattgtggtggtctagaaccaaacccatgctatctgyaaggtaggcctatgttggcatttattccctaggcctttatcctgccaaccagagttccccctgtcagtgcaccttgcccagcctcttaagagtccatcatttttgcactgtaaagcacctgaaatcccaacatcatctttactgtgcctgctctccacgtggaatttagcttaaaactggttggccaagatgtatttcttcccctctgccaccataaccctgtaaactgaatcattcttttcctrtgtgaacagaaaggtcgaagatatgaggcrgtgaagtggatggtggtgtttgccattggagtctgcactggcctggtgaggaggcagggcctggagggatggtgggccatagggctggaggggcttacagggaaagccctggcctggtgaataacattgtcatttgtcattataacatttataacattataatgcaataacacttgtcattataatcaagagtgccttttcttttttcccttttttttttttaaatgaataatcctggcacagtttttcacacttcccctgcttttgctttgtgaaatgaaagcgagacacatgacaatggtgctcttgaagcgctcaaaggtttgggcaggactttatcttttatgatatgattatggatcataatctctaatctacctagtaaactagatgtctccctaatgggtagataatgcattgggtagagtaaataatggaagttaaagttacttttttttttcttttaatttaaatagagacagggtctcgctttgtcaccctggctggagcacagtggcgtaatcacagttcactgcagcctcgaccttctgggcttgggtgatcctcctacctcagcctcccgagtggttaggactctaggcaggcatgagatcgctctttagggaaaaagcgaagtcgtgggtacggaactgtgaacatcgtgcccttcatttagcacagcgtgccagtgaacagggtggcacaccatagctattgatctcatgcagggagtttatggtgctatcctgggctcctccccgtacgtcgttaatgttatctagaagatagagccagcagctgtgagtgaagggatatgcccgtatgaacagagttggtggaggcagcaacttcacaggtgaatcaaagacaaggcaagattggaaacatggccaaagatgaggatagcaaaaagtctggaaccaaaactgccgacttcacattgttaaatatgaggaagagaagctggaaaaatcagcatcagtcaaaaagatccatgtcaaatctgattccggtcagtacagtgttgggatagggtatctgtcctcagtaacagcctgttgaccacctttatcttgaactggccacaagcctcctacttaatttgacatgatatgcctagaaaatgtacacatgtgttcggtataatatagccacaggggccaaccacaatttttattttcatggcatgcatcaaatttttactatagtaaatccacaagtaaaggaacatcttactaggtaagactgatggcattcagaagccctcttcagtgatattctgatggataccattttggggaaacttgggttgatttattgttttatttaaatctcagggtgttgggccagggacggtggctcacacctgtaatcccagcattttgagaggccgagacaggaggactgcttgagcccaggagtttgagaccagcctgggcaacgtagggagaccctgtctccttaaaaataaaaaaaaaattaaaaaaaagaaatctcagggtatttattttgctatatatgtttctggttgcagatttctctataataagcatagtccttaggcctctagttgttagtgtttgtgctacttttatatcaaactctttggagctgccacttgtcagtactacaggttgagtgttccttatcagaaaatccaaaatgctccaaaatccaaaactttttgaatgctgacacgattctcaggaaatactcattggcgcattcagattttggatttcaaatttttggatttgggatgtttaatcagtataatgtagatattcgaaaaaaaaatctgaaatccaaaacacttctggtcccaagcatttcagataagtgttactcaagctgaagcaactttacctcctacctttgtattttaggaaggcacacctgcctttatgacatagcactcccaactctygtccattgatgtgtggccactttatggcttcagtatcaaaaagcctccaggcattggcttgagggaaggccagagttaaaggcaagaagctttgatcctgaatccataaaattagaagtctttctagttctcctttaagccctgagcactttggagagtggaatactggaatttggttgttttctctacccagagtaactatggactataagatggttataagtcaagcctggcacagtggggtgtgcctgtaatcccagctacctgggaggctgaggcaggaggatctcttaaaccctggagttcaaggccagcctaggcaatatagcaagaccccatctcaaaaaaagatgatttcaagtcaaaataatgacttacaaaatagaacctgctaataaggaacatgcaaaaagcacatacacctaaatgaatgttgtgttttaaagcaagcttgtccaacccatggcccaacacagattcatataccttttaaaaacatttatgagatttttctgagtttttcttttcttagctcatcagctrtcattagtgtattttatgtgtggccaaagacaattcttcttccagtgtggtccagggaagccaaaagagtagacacccctgtgtcagtagtctttcttggtctcrcatctttttctgcacctgcttccctctttgttttccgttgcttcactcaacttagctgtactctctgcctttgttctttggaggggcagtggractgggctggagaagggatctcctccttctgcgcttttctgctgtgcattcacgtactgctggctggtgagcagcctccgtatgtgcagtgggggaggagatgccttyaagaggagcacacctgtactatacttgtgctacacttggaaataaggctgtgtgacagatctcttgctcttcacaggtgggtctctttgtggacttttttgtgcgactcttcacccaactcaagttcrgagtggtacagacatgtatccttttcacggttcctggtgttcgtggacttcagtggtcaccaagattctttcttacatagaaatgggtytaacagtaagcatrgtattagaagggccgcttattagctattcagctttaatatttctaatgatcactgaaggacacaaaagaaggactttaataagcaaagacatatacctatgtttgtggttgataagattacagatgccgcaaagatgcctgtactccctaatctgtaaatttaatgtagttccaatcaaaattccaatagaatttgttgtggaactcagaaattctttgtaaatttgtgtagaagagtaaagggccaaaagcagtcagtatagttctaaatgacaagaaggtggacttgaccctgtcagatatcaagtcttataaaattaacaagtttggggagttagggaaaaaaaagtcataaaatttaagatacagtcattgaaattggtcatattggtgcaggaatacctagacagtggaaaatgatagagaagcagaagctggtcctcacatacatggaactttggtgaatgacagttaatattacaaatcagtgagggagtgatgaatgatttaataaaagacgctgtgttatttaataaataaaagatacacatctctgtagtcccagctacttaggaggtgagcccaggagtttgaggctgtaatgcaccatgactgtgcctgggcagcatagcaagaccctgtcttaaaaaaaatgatgctgggacatgggtgatccatatggaaaaatagttatattcctatttcatactataaataagataaattccagatgaagatgtaaatatgcagaacaaaacttcgggagactatatgttgtcaagagtggggaataatttcttaaaactccagaaggcacagactataagaaaaaacatcaatggggccggacacagtggctcacgcctgtaatcccagcattttgggaggcagaggcaggcggatcacaaggtcaggagattgagaccatcctggctaacacggtgaaaccccgtctctactaaaaatacaaaaaaattagctgggcgtggcggtgtgcgcctgtagtcccagatgctggggaggctgaggcaggagaatggcatgaacctgggaggcggagcttgcagtaagccaagatcacgccactgcactccagcctgggtgacagagcaagactccrtctcaaaaacaaacaaacaaaaacatcaatggctgggtgcagtggctcatgcctgtaatctcaggactttgggaggccgaggcaggcagatcacctgaggtcaggagttcaaggccagcctggctaacatgacaaaaccccatctctactaaaagtacaaaaaattagctgggcatggtggcgggtgcctgtaatcccagctacttggaaggctgaggtgggagaatcgcttgaacccgggagacagaggctgcagtgagccgagatcgcgccattgcactccagcctgggcaatgagagcaaaactgtctcaaaaaamaacaacaaaaaaaaaaaacaaacaaaatcaataaatttgaccacatcaaagtacatattgtatttataaagacaaaaactccaaataacaacaataaaacaccataaataaagtgaaaacaagtccacagcctgagagaggttatttactatgcatttaagaggcagataattagtatccasaatacaggaagaggctgggcgcggtggctgacgcctgtaatcccagcactttgggaggccgaggcaggcggatcacttgaggtcaggagttcaagaccagcctggccaacatggtgaaacsctgtctctactaaaaatacaaattgagctgagtgtggtggtgtgcacctttagtccagatacttgggaggcagaggcaggagaatcacttgaacccaggaggcggaggttgcagtgagccgagattgcaacactgtactccagcctgggtgacagaatgagactctgattcagaacaaataatacaggaagaactcctgcaactcaatcagaaaaacaacagatggtccaatggaaggaaaacgagcaaaggatgtgaactggaattctcaaaagagaaaaactggccagtaaacctctagaaaaaggaaggtgcacattcctgtgactcatacattcctcttagaaatttgaaccgtagacatgtacaaaggtggtaattatagctttatgatagcaaaaagctggagtcaccaaatgggagaayggaaaaattatggtacattcatatggtatcattttagacatcatgtcatttctgtagattgtaaaataaaaattttagacaagtgaaagtgaaygaaccacagagttgtgtgtatcaacatggctaattctcaaagacttaatgttgagaaaaaaagagcaagttacagaatatacaagtgccgtgtacaacagtgtggacacttttgaaatacacasaataatttcaggttagtggtttctcccaggggagagaggaaggaaaactgttttttkttttkttttgttttgtttcttaaaatggtactgaatgttttcttttttaaaaatacctggagcatatatggcatgttgttgagatttgttaaagctacagttgtgagggtatgggtattcgttactttttgtaatgtttgaagtatttcctaatgtcaaaggcatctcaaacaattttttcttttttttaagagatgaggcctcacactgttgcctaggctggaatgcagtggtgcaatgacagctcactgcagcctcagcctcccaggctcaagcgatcctcccacctcagcttcttgagtagctgggaccataggcatataccttttgtactttttgtagcracatggtctcactacattgcccaggctggcctccaactcttaggctcaagtgatcctcctgcctcagcctcccaaagtgttgggattacaggcatgagccattgcacccagtcatctcaggcagtttttaaaaaatttttatatakagagaaaaagtgcactcagcagccagcatgatccaaaggagaagcagctgcaccctctcaagtgatgacggggacacccctcggctgatgaacaagtttccttaacccagtttccgcagcggtggaggagtgcagccagaaaggctgcctcgctctgtctctccttgaactcctgggttttaacctcacctttgtcttcctggcaagcctccttgttctcattgaggtgaggtggtttggattcacctgctcgcttaggaggttttagagtcccgcaytccttttccccacctccttcmagaatgtcaggaaactgagaatgcagattcctgcagaaagtggcctcttgttcactaaaggtaaaggtttcacctctggtgagattaaagaagaaaggcctcccaggtgatgctcattcacagggaacttgtacagattctggggggaggaaaaaagggggaaagggctgaaaacaaaactgttgggtgccatgcgcactacctgggtgacaggatcattcatgtcccaaacctcagcatcatgcaatataccctcgtaacatacctgtacatgcaatccctgaacctaaaataaaagtggaaattatttttctttaaaaagtgcaagtctggccactttgggaggccaaggcgggcagatcacctaagatcgggagtttgagaccattctgaccagtgtrgagaaacccygtctctagtaaaaatacaaaattagccggtaaaaatacaaaattagccgggcgtggtggcgcatgcctgtaatcccagctactcgggcgactgaggcaggggaattgctggaacccagaaggcggaggttgcaatgagtggagattgtgccattgcactccagcctgggcaacaagagtgaaactctayctcaaaaaaaaaaaagaaaaaaaagtgcaagtcctcccattgcccctcagacctcctgagtcagatcctctggagtggggcccagcagctgtggttcwgcaagccctccaggtgacgctcacgctgctaatgaaggtggccagctctccctcttccgccgcccagattgttgagggtaagccagagaaccaatggatttygagttatgggtgtgcctgctctcctccatcagccggtggcagcaggttccgggatacccgaggtcaaatgctatctgaatggcgtaaaggtgccaggaatcgtccgtctccggaccctgctctgcaaggtccttggagtgctgttcagtgtggctggaggtaagaagggtccaacttgtatccttcaaatactcaaagggcagagacgacaagaagcatgatgtatttcagttattagatttggactgcagggcccagcctcaaacagctgatgtctgcactttttgttgatgggctgtttttaaatgcagacactgttcgtatgttaccattcagatacctgacaaacacactcttcagttttgggatttggaatttagcttgtggaattagcttttgtcaaaattagcaagctytttgtgtcaacagccagatagtaaatatttaaggctttgtgggccaagaatcagaatggaagctcttatgtagatgtttatgtaactatttacatgtgtgcatttaagaacgtaaaagccagtcttagttctcaggccgtgtaaaaccaggagggagctggtggtctgggctcacaggctctcatttgctgacacacaatttagaatgtagagtgttttctcttctagcaagacttgaaatggagcttatttggtgggaatttggctctttctcttataaagtcttaggatcatctctgttcagttgtcacgaggaaggtttttgtagccaaggtctcctgacccaggggcgtttctgcactgactgttggtctttcctttttcaccctgcccagggctcttcgtggrgaaggaaggccccatgatccacagtggttcggtggtgggagctggcctccctcaggtaagatgrgctgagagrgtgtgggcctctgggcaggcctagtgggaggtctggttacactgggccaaatccattgggacaccctgacatcacattggaacctggtgccattctggcttcacgtgtaaaccatgtgtctatctctcaggaaagggcataacttatacttggaagttttaatgatgccctaccgagccctaggagcaaaaatgagacatagagaaaaactgtgacgtggcggatgaaagtcactgggtgcttccatagccatcaccaggcgcctctatatagggtggctgggtggatcatctcagtgctgccagatccaagaggctcgaagcatcgactgacatggttttaggcacagttccgtgctgattctagttggcgtggtacagtcataataactgctgctaattatggtctgtgtgccagacgccatgtatactaactgctttctccttatagccaccttcaatgattcgttgttattattacccccatcctcagatggggaaactgaggcttagagaggttgaggtactagctcgagacctcaaagctcccattcttgggggctactccagatccctggctgctgttggagaagtctcagttccctgtgaactgtcactcttagtcatttccctctccagtcctgagaagagggagttattgtggttgggagtctctgaggtgaaggagggaagattctttcgtccagagctcgtcttttggtctctctcctgctactgccttgagcaccagatctggcagaagtgagccaaggggtggaaggccaggcgtggagtgggcatcagtgtgcacctttgtggggcagacagaggacaggctctgggcccttctcttcctggcgctgctgagcagagcagactcggtcttctgcaacagcttccgcgtccccttccctcagctcagccatttgcctttattctttcagacttgttgactctgcacaaaatgggatttcagaaggtcctagaaacacgagggcaggaaaaataagctcctcccaagggtggggggtaatctccttttttcccaagtttttttattttcattttttgagacggagtctcactctgttgcccaggctggagtgcgatggtgccatctctgctcactacagcctccgcctcctgggttcaagcgattctcctggctcagcctcctgagtagctgggattacaggcatatgtcaccacgcctggctaaattttgtatttttagtagagacagggttttgccacgttggccaggttggtctccaactcctgaccttaggtaatcagccgtccgcctcggcctcccaaagtggtgggattacaggcgtgagccatgagctaccacgcccagcctccttttttcccaagttgctgttctggactttccttcctgcagcacacttacccaggtgtgctcaagcagaggggcctcccctgatgccgtggattcccatagtttcagtcctaggctgcccctgacctgtgttcttttttttttttccataattactggggtacaggtagtatttggttatatgagtaggctctttagtggctctcttttctcttgctttagtttcagagcatctccttacggaagatccagtttaacttcccctatttccgaagcgacaggtatggaaaggttagaaattggtttyttttttggaaacaacatgttcatgcgctgcgggtcagactcgayacttgctctagcctggcagtatcccctgcggggaaacccgactgggagaagggggcgggctttgaacttttcttctggaaataagaagccaaagcaccaggctggcatcgtgacttttattttgtcatgccrtaaggcctagaakcatctcaggcaaatgaagatggtcccagattaaaaacccaaccaagaaaggccacagacaggcatattcttaggaaggcgttttgtattccccagtgattcasttggtcagccaccctcctgggtcagaaggtactcttagtagacttcttagccctgtrtcagatgtgtgtgttactgacctgccsgcctcgtaaggctctttcaatcagagactcagtttagagtcacggaccaccttctttttgtattcctgcaagttcggcacatacccagaaggcaccttgatgtttttactgatgccggggttttctggaaggaagatccrgtgggaacatggtgcagcagtgatcgtgccgatctttgatctgccccctgagctgggggctgagattctgagatcacagaaaacacagaggtcaggggctcctgttcccaggcagagtagccgccatgctgaaagggactctggtgctaaggtgtgtggctctcgggtggacacactcgcggcaaaggctgcctcaccagtgacctgcccttccaggatccctgcctattcattcacaggtgtgagaaaatgttcatgataaggaagtcagaaaccaccttttgggggctgggggctctttattggataacycgtctctctcctctcctcagagacaagagagactttgtatcagcaggagcggctgctggagttgctgcagctttcggggcgccaatcgggggtaccttgttcagtctagaggagggttcgtccttctggaaccaagggctcacgtggaaagtggtgaggaggaccttcagtgaaagcrttaaccacacccmccgaattacactgggtgtcccttactcggtacatggaatggtagttttgatgagactgrgggggtcractggatcagaaacagctttcctcttgtgcccataacctccacactggactttctgtacttctcatatcaataccctccctaaccccaaatcaaaccgctgttactttttttttttttttttttttttgagatggagtcttgctctgttgcccaggctggagggcagtgacgcgatctcggcttactgcagcctctgcctcctggattcaagcgattctcctgcctcagccttatgagtagctgggattataggcacgtgccaccgcatccagctaatttttgtatttttagtaragatggggcttctgacatcaggtgatccacccgccttggcttcccaaagtgttgggattacaggcgtgagccaccacgcctggccttgttatcctttcttgatgaaccacctgacatgaaaatgtgaaactggctgttgtcataaagcaggaagtgatggggcttggactggagccggtcttctccctcagagcaggctgtccttccctttgcattgatccttccttttggtgcaaggtctggtctgtaaaggctgtaaataggctctcatagtagagtaggctgctggaacggaaacttcttaaagcccaatctagagttggtcatacctggggtgtatctactgtaagggtgactagatctctgtacccggatgtagattcyggaggtctctgygtagagcagtgggtaccaggaggaagggttgggagagagtaggacatgccactcctgaaccttcttgtcttttgtcacctctcccctagctcttttgttccatgtctgccaccttcaccctcaacttcttccgttctgggattcagtttggaagctggggttccttccagctccctggattgctgaactttggcgagtttaaggtatgttttgtcctttccccaaggatttttaatttgacccatgaaaatttcctctcaagtgaaggaccagagagaaatgagcagagggctaggtacaacttccagggrcacatctcacccattagcctctgccgtgcgggaaagcagccccactcttgcttctgtcttctcttctgtctcttccggttctcatggctgctatggtttttctctccctctccctttccccttctctcagtgctctgactctgataaaaaatgtcatctctggacagctatggatttgggtttcttcgtcgtgatgggggtcattgggggcctcctgggagccacattcaactgtctgaacaagaggcttgcaaagtaccgtatgcgaaacgtgcacccgaaacctaagctcgtcaggtatctgcacagtcgcctcccccccgagcctgctgcggctccctgagcttggtgtgggccgcgccatctctcccgaggagcggaccctgcctccacggctttgatttctcatctaagactgagaatctaaacacggccatgcatcttccctacttgacaggccaaagggctgagccagcttaattgatgtcagagttgctggttgactccctgcctgtcctgacttggccactcggacacatgacaaggttagaagggtcaccgtggccctgccgagcagcttgctctcaggaggcttctcgccccaggacttattataatggaaagccattcattccttggagagagatgatgtggacgtagcagcccactttaactgtccactttttacaaacaaattgctggaatacagcaaatcacggatcaattctgcacacatgttgactgaccaggggctgctgtgaatgctgttyggagaaatcggggctgggggtaggcagggttatgttttgaatttctgagaccagagctkctttctgtggcrttgtaacagctgtgctttgcctcctagagtcttagagagcctccttgtgtctctggtaaccaccgtggtggtgtttgtggcctcgatggtgttaggagaatgccgacagatgtcctcttcgagtcaaatcggtaatgactcattccagctccaggtaaccccagtgcacctgctacctttatcccataccacgaggaagaatccagaaatgtatgaccttcctctgttgagaactaatagatrtgttgggttcatccttccacacccattacctgagcgttgagagatatgggaatctgtagtcgtctttttacctcagagaaagtgcacaccacatgccctgtgtctttgccacttctgtgaacaaccctggcgtcacagaggggaacctgggaacaaccctggcgtcacagaggggaacctgggaacaaccctggcgtcacagaggggaacctgggaacaaccctggcgtcacagaggggaacctgggaacaaccctggcgtcacagaggggaacctgggaacaaccctggcatcacagaggggaacctgggaacgaccctggcgtcacagaggggaacctgggaacgacactggcgtcacagaggggaacctgggaacaaccctggcatcacagagggcaactcctctctgttgaacaacactcatgggaaacagacacttggaaagctgacagcaaggtgctttctgagccccagttactcttccacctccccttgcctgaaggggccacagcccagaggctcagcacccacctcatggcctctgtgactatgacagtcactcttgagaggaagaaatatctgtgtcagggcaaggaggcttctctcttcccagcatcctctgcctcttcccggcgttgggtcctttgtgggtgcgccaccctcctgcactcctccttttcccttcttggggggcgcgatattttccagaggctttccctgaggagtggtcccatgaggtagtccgtggagcctactccacgctgtgttctttcggtccaacccggaggctctgagagctacacctgtggttcagtgagtcagccagatgtgtgattccagcccttggctgcaracaggtgagcattctctaagtgcggtcggccatccacatttgtgggtcctgcatccatggaattacgtagggtcaaccaactgtggagcaaatatattcaggatgcaaaacataaaaaagaacaagacaacagtaaaaaataatgcaaataaaaaacagtacagtgtaacaattatttacatagcatttacattgtattagggtattataaataatctagagatgatttaaaagtatataggaggacctacataggttatatgcaaatatacaccattttatatctgggacttgagcatccctggattttggtatccatygggatcctggaccctatccctggtgaatackgaggaacaactgtactctttycttgttgcttctctgtaaccacttgaatctctcagatccccaytggggcccttgtcttggaggacagcctcttcagtgtccccagttatatgtatatattwtwtatatatatatatatatatatatacacacacacactatatatayacacayacacacacacacacacacamacaaacacacattatatatttctgtttgttttgtttttttaagacggagtcttactctgttacccaggccggagtgcagtggcgcgatcttggcccactgcaacttccgcctcccaagttcaagtgattctcctgcctcagcctcccgagtaactgggattacaggcacccaccaccatgcccagctaattttgtatttttagtagagatggtgtttcaccatgttggccaggctggtctcgaactcctgacctcaagtgatccacccatctcggcctcccaaattgctaggattacaggtgtgtcaccacgcccagcctggtttatatatatatgtttttgtttttgtttttgytttttttttggcaaagtctcactctgttgcccaagctggagtggagtggcaagatctcggctcactgcaaactccacctcctgggttcaagcgattctcctgcctcagcctcccaagtagctgggacttcaggcacgcaccaccattcccagataatttttgtatttctagtagagacggagtttcactattttggctgggcttgttttgaactcctgaccttgtgatccgcccacctcggcctcccaaagtgctaggattgcaggcgtgagccaccgtgtccagctggtttatatatttttaaagggttgagagaaaaaaaagaatatgccgcagagactgtacatcactggcaacttctaaaatatttactgtctggctctttatgaaaaagtttgccgacccctgttactagttattcccaagcctagctcattaccagacagataccttgatgcgtgtgatttaaagcatacaaaaaacgattctgtggtcaaatgggctaggaattaaatatgcttctttatctttttagagacaggatctcactctgtcacccaggctggagtacggtggtgtgatcatagcttattgtaacctcaaactcctgggctcaagcgatcctcccatctcagcctcccaagtagctgggactacaggtgcatgccaccacatccagcttatttttatagagacaggatctcactatgttgcccaggctggtctcgaacttctggcctaaaatgatctcctgttttaggagtgctaggattatagacacaagccatagcacccaacctaaatacgttcctttagtacagaacttctagggccttattcccataagtgttataaatgtttggtgtctttattgtgtaccagatattccactgagtactttatatgatttcatttaatccttatcagcactgtgcttgctggccagtagctgtgcccccattttacagctaaggaagctgaggcacagtatggtcttgaccaaaaaccttcagctagtcatatatagtgagagggtaggtgttgttaccattttataggtgaggaaactcacaaaatgaaatatccttctcaacgtcactagagagtggcagagtttagagacaaagccatctgattttggagcctgtgctcagcttttagcagacacactgatttccaagaattgctaggatgtttctcagtgcagttgaccacaggactctctggaaagccttcaggactgaacttcctccagacagtttgggaaacactgcatgtgtctattatgaagccatcagctgagctcatcccccgtgcactccacaacgctgaggctctgcacatggctcaccagtgccaggtgctgccagtcagcagtgccgtgctgtttscacagcagcctgcatacgtctatattgcccagccygtttcacctggcggggtcacacaaaccaccccctggtattgttagcacgtccacataatggcatctccacagctgtgtcatccagaagaaacccatagccttgattaacctttgtaataagactccctatttgcatgcacagtgataggtgtgaagtacaaccttgtaccgttgtacactgtcaactagaaaataaaacagcacacttgaaacacccttgccttctagcaaagatcccatcttcccacacagaatgatggcaagaaaatgaggtctaaaatgtgtagaagtagtagaagaaataatctctttttctgtttgggttttgttccccagatggggtctagaaggagaggcagcctggaggactgggtctgctctccaggcattatggaggtgggttttcttttgcagcaaattcaggtgctttttttttttttgtagcaaattgcagcaaaatcaaaggctttttctatttggaaccagagttggggctttcggtcaagtggtgccctggattttcctccccagatacctgtcaactcccagtcacttgctctcacctgcctcatattcccccagtcctagggctctcaggccaggcttctagcagcatcacttagaaagttagcaccgggagaggaagcagaaccaaattcacggtgaatcacggccatagtgacattttcatcatgagtgtggatgaacaaaaggccmtcatcccgattctttcatctgtgcattcagaatgtgaagaatacacttgcccgtgtggctgccgttggtagaggtcagtttttggcctgtttgattgatggggaaagctgtgcagccacctgttttggacccggctggagacatcccacttgaagactcaaagtcaggtgtccttgtactgattttctgattccttcttctcaggtcacagaagatgtgaattcaagtatcaagacatttttttgtcccaatgatacctacaatgacatggccacactcttcttcaacccgcaggagtctgccatcctccagctcttccaccaggatggtgagtgtctgcactgcagcccaatcrtgggtgattggtgtcatctcggacacagccaggcttgcccttcattccaagcaagaccaggacttctttgtaacgcccacccagacaaaagattggtttctgcctccwgtgttggaaggggaactggtatggggtgtggtcgggccyggtaggtctactgggccttggcaggcatccggtagtgggactcaggttggctcttcccttgcaggtactttcagccccgtcactctggccttgttcttcgttctctatttcttgcttgcatgttggacttacggcatttctgttccaagtggcctttttgtgccttctctgctgtgtggagctgcttttggacgtttagttgccaatgtcctaaaaaggtactctgtgtgtgtgcgtgtgtgtgcgcatgtgcatgtgtgtgcrcgtgtgcrtgtgtatgcatgtgtgtgcgtgtgcgtgcgttgatgtgtctgtgcccatgcatgcacatatgtgcataggcacaagagtatgagctgtaggtcctccccacagcctatcartgtggttcaaagccatgttctcggtgttttccttcactagctacattggattgggccacatctattcggggacctttgccctgattggtgcagcggctttcttgggcggggtggtccgcatgaccatcagcctcacggtcatcctgatcgagtccaccaatgagatcacctacgggctccccatcatggtcacactgatggtgagcacactccctccaggcccctgtcaggctcagggccacgtccgccccacaggacctatttttaggtctttgctttgtgtttcaggtggccaaatggacaggggactttttcaataagggcatttatgatatccacgtgggcctgcgaggcgtgccgcttctggaatgggagacagaggtggaaatggacaagtaaggccatgattttgctcatgtcctagtttcagaatgtataagctctgaggcctaaggaatgttgttattagggtaggaaacagtaactyacttttcttgggctgaaagaagcaacacacccattcctgagcatgtgtgagaatgtggagcagcccatgggctgggggctgcgggggcagggcaggggacacgggcactgtgggactgcagtgggcagggcctcttcgtggtggtttgactcccatggcattctggttagatatgaggtgaggtctctggatcaagttcgtgatgtgattgaatgtttaagggtatgccaagccccaggagtgagaatagcctgtttcacatgtgcccaccagaatgccctactgccagccgggattgttctgggcataatcacctcataacccacctgctaatccacaggtacctgggcttcctgtgtctagatagcaggcaaggcccttacgggctaacacgggggccagcaagccgtttctgtggagggccagacaggagtttattttcaactttccgggctgtatggtctctgtcacgactactcgactctgtcattgcagcaggaaagcagtaagcgtgacggacttgatcagtgggctacagtttgctgtgccctgatctaaagggggacccaagtgctgtgtttattttattattattgtttttcttttttgggacaggatctcactctgtcgcytaggctggagtagggtggcatgatyatagctcactgcaacctatgcctcccaggctcaagcgatcctccacctcagcctcctgagtagctgggatcacaggcgcgtgccaccacacctggctaatttttaacattttttttatagaaatggggttttgctgtgttgcccaggctggttttgaactcctgggctcaagcaatctgctggcctcggcctcccaaagtgctgggaytacatgcgtgagccgctgcacccagcccacccatttacccagttgtggtaaatgctgtagcagaattagcagttcaggggtagtatgtggagcgtgctgcagggcaccgaggagggcgtggccagcccctggaccagcagccagggcttcctggtgaggggatgttgctgttgagctgagggatgagcccgagcccatcagcctggtacagcagggtacgacattccaggtgcgggaacagcatgtgtcgggggatagaagtacaaaggaatgcatcgggtttgagggagagctggggcagttcagaagagccccccaccccgcccgtggtctgagcagrgctggagagccagcacagcttsctcccaggggcctgcgggcactgtcatgaggctggatgayttgccctcctcccccaggctgagagccagcgacatcatggagcccaacctgacctacgtctacccgcacacccgcatccagtctctggtgagcatcmtgcgcaccacggtccaccatgccttcccggtggtcacrgagaaccgcggtaacgagaaggagttcatgaagggcaaccagctcatcagcaacaacatcaagttcaaggtaaagaaaacggcatgagaggaaaggcaggtgagagacaagcggtcccgtctcacacggcttagtgctttgcccacccctggctggggtggacttaccggctctcaggggaagttggcactgttctcatcacaygcgacagggagagtagatttgacagcaggggcagctttatcaggccgtgaagatgtgtgtgcgttcttgccgcaatgagcatgtggacagatctgtttttcaagtcagcagctttcatggtttgtttaccatgtgagagtatcagggagagttctagagatgccagcaacagaaatggacttcgacctccttaagaaagagaaagaaatccacaggaaagctcaggacagctgggaaagctgaaggaccagaaccaygtgctgtggggagcagtgcagggtctagcagacatcccttgggtaccaggargaaggagcactggccctgggttcctcctgattccgattcagaatccagggagagggggtatcctgttgcctcacttgggtcatgtgccactccttggctttgggggcaggcacgttgattgaaaattctatcaagacaggatgtaggagatggcttgttcccctctggagaawcaagctgctcttcccagattaaaggaaaccacagaagctgcagccaggtcctagggttcaggctcatttgaaccaccagcctgagccactcttttgaacctcagccccattaagttcctgcgtccggatgtgcttctgaccctccctgtcacccaaatccttaagctccatcagtactgctgtgttcgtttgcccatgcgcagtagcctgtggcctccccacccacagaaatccagcatcctcacccgggctggygagcagcgcaaacggagccagtccatgaagtcctacccatccagcgagctacggaacatgtgtgatgagcacatcgcctctgaggagccagccgagaaggaggacctcctgcagcagatgctggaaaggaggtgagarcctggcggggcccccactgcccgcagggctacacagcggtggggtgagccyttggctcagatgttktgaggtggctcctgagtttcctgggaaagttggatggggagcgggctgggaacatggatcagaagcgctcccgctgagggtatcccaggcagcatctggtttttgtgtaacagatacactccctaccccaacctataccctgaccagtccccaagtgaagactggaccatggaggagcggttccgccctctgaccttccacggcctgatccttcggtcgcagcttgtcaccctgcttgtccgaggagtttgttactctgaaagccagtcggtaagtctctccgaggcagaaatcagccaggccagrcctgacgaagctcgaggggttgggcgctgccggcgggccgtgaacagtgccatagggaaagctgaatgcaaggcgagaagtgcagagtggacttaggggaggagtcgccacagccgggtggtgagaagcaacagcggtttattccttcatagttcaaggccagaartacaaaatccgggtgtcaccagggcagcgctccctggctctggtgctgtccttgccccttcctagctcatgggagttgcctgcagaccttggtgctcctgactgtgaacacagcccccatcctcgccactgtcatcacacggcgttctcctgtgtatcttctctcctttccctaaggacgcttgtcaccggatttggggcccrccctaatccagcatgggttcatctgaactcggtcacatctgtagagaccttgtttccagaaaggtcgcattcataggtactagggcttaggacttggccatatcttttggtggggggacacattcaccccccagccactttacttagtgctttctcacttaaacttccwaataagccatttgcatctcatgaatcaggaagaaagggagtgcagacagatcaggggacttgcccagggtgccacagctaggacttggccaaggactyggtttgactrgagagctctcactctggagcgcttgctgctgctgcaccacctgcctcagcagcctggagctgggcatattcaggcatcaaggggaggggctctaaggtgaccctgctggccactgctgcctgagcacggacagtgtctgggttggaattgcagagcgccagccagccgcgcctctcctatgccgagatggccgaggactacccgcggtaccccgacatccacgacctggacctgacgctgctcaacccgcgcatgatcgtggtgagaagggctgccccggcctgtcccatgcggagctgcctcttcatgccgttggcgtctcaggcagtcagtgacacgtggtctctttgcaggatgtcaccccatacatgaacccttcgcctttyaccgtctcgcccaacacccacgtctcccaagtcttcaacctgttcagaacgatgggcctgcgccacctgcccgtggtgaacgctgtgggagaggtgagcgaggccccggccctgcccccacctttgagagaggatcccctagccaggtgctgtttgtgcacccakgcttctcaccagaaacgtaggcatcccaccaggaggggagagtgtggcccaacactagckttgaaccctgctcggcttccgtgcactcgggaccctttcccctgcctgccagcagatggcaccagcgtcccactggccgtcctttccagccagagccgcgcctctaccaggctgtgtcttcctcctgaaatgttgctcttcactccgtaccactggtgttccttggttctccacctgcgtaggkatttgcgcattagatgagagaatttcaagcaaaatactttgagttttacaaagatataaaacacctagtaattattgctgcagactttccttttttcttctttttagaacttcattattttcttattacacaaatattttcttattacacaaatatgatttcattgtaggaaaatacaaaaacacatatgagcaaaaaacaagcaaaaaccaaaccctcgtccctaccctgtcgcggtagccctggtaacttttcaaggccaccctctcagtcttttgttgttgttgctgttgttgttgttttgagacagggtctcactctgtcacccaggctggagtgcagtggcaagatctcggctcactgcagcctcgaccttccaggctcaagcagtcctcccacctcagcctcctgagtagctgggaccacaggcatgcgccactatgcccagctagtttttgtatttatggtagagacacggtttcgccatgttgcccaggctggtcttgaactcctgaactcaagtgattcacctgcctcggcctcccaaagtgctgggattacatgcgtcagccactgcacccggcctcagtcttttcttctayrcggcacaaccctggcatgcatagtgcgtacttacacaggttttgttgcagtaggttaacttatgtcccttgaaatgtaattgccaactacactgacagagtcctaacatagtttatgacgtggctttggagttcccaacaacagtgacacgtgggaaccactgtaacgacctgtaacaaatgactcccataggtcactttgcaaggtggtgagtatgaggcatggcaggggtcataatctcaggagacttcaagggccccmccgcttgcacatctgtgaagcaggctggtcatgatgggagctgagcgctgagcatgtgccctgtggaaggacattttagttcagatgccagctggcccaagccctttttggagctaaccttgtccccttggcctccartgtgtgagccctcgttagctgtttatcccaatcaagctgtgtctggctgtgcactatccaggcctccacattctgtgacaaactaacagggccggctcctgtcactyctgttctcgccagcgggttttaccctkaaggtgactcaggccttctctttgccctagatcgtggggatcatcacacggcacaacctcacctatgaatttctgcaggcccggctgaggcagcactaccagaccatctgacagcccagcccaccctctcctggtgctgcctggggaggcaaatcatgctcactccggcgggcacagctggctggggctgttccggggcatggaagattcccagtyacccactcactcagaaagccgggagtcatcggacaccttgctggtcagaggycctgggggtggttttgaaccatcagagcttggacttttctgacttccccagcaaggatcttcccacttcctgctccctgtgttcccaccctccagtgttggcacaggcccacccctggctccaccagagccagaagcagaggtagaatcaggcgggccccgggctgcactccgagcagtgttcctggccatctttgctactttcctagagaacccggctgttgccttaaatgtgtgagagggacttggccaaggcaaaagctggggagatgccagtgacaacatacagttcatgactaggtttaggaattgggcactgagaaaattctcaatatttcagagagtccttcccttatttgggactcytaacacggtatcctcgctagttkgttttaagggaaacactctgctcctgggtgtgagcagaggctctggtcttgccctgtggtttgactctccttagaaccaccgcccaccagaaacataaaggattaaaatcacactaataacccctggatggtcaatctgataataggatcagatttacgtctaccctaattcttaacattgcagctttctctccatctgcagattattcccagtctcccagtaacacgtttctacccagatcctttttcatttccttaagttttgatctccgtcttcctgatgaagcaggcagagctcagaggatcttggcatcacccaccaaagttagctgaaagcagggcactcctggataaagcagcttcactcaactctggggaatgctaccattttttttccaaagtagaaaggaagcacttctgagccagtgaccactgaaaggtatgtgctatgataaagcagatggcctatttgaggaagagggtgtctgcccttcacaaacacctctctctcccctgcactagctgtcccaagcttacatacagaggcccttcaggagggcctcctgtgccgcagggagggtgcgtggggaagatgcttcctgccagcacgtgcctgaaggtttcacatgaagcatgggaagcgcaccctgtcgttcagtgacgtcattcttctccaggctggcccgccccctctgactaggcacccaaagtgagcatctgggcattgggcattcatgcttatcttcccccaccttctacatggtatyagtcccagcaggcatccctggggcagacgtgctttggctcaagatggccttcatttacgtttagttttttttaaaaccgtggaggttgcccacgggcctcggcacctggccctggcagcacagctctcaggcccagccctgggcgacctccttggccaagtctgcctttcaccctggggtgagcatcagtcctggctctgctggtccagatcttgcgctcagcacactctagggaataattccactccagagatggggctgcttcaaggtcttttctagctgattgtggcccctccattttccccattttcttatctccctgaccaaaattgctttgacttctaaatgtttctgcttcccagaatgcacctgacttatgaaatggggataatactcccaggaaatagcgcaggacatcacaaggaccaaaaaggcaattcttatttaaatgttactatttggccagctgctgctgtgttttatggcagtgttcagagcttgatcacgttatttcttccttttattaagaaggaagccaattgtccaagtcaggagaatggtgtgatcacctgtcacagacactttgtcccctctccccgccccttcctggagctggcagagctaacgccctgcaggaggaccccggcctctcgagggctggatcagcagccgcctgccctgaggctgccccggtgaatgttattggaattcatccctcgtgcacatcctgttgtgtttaagtcaccagatattttgttcccatcagtttagcccagagatagacagtagaatgcaaatacctccctcccctaaactgactggacggctgccaaggaggccccaaacccaggccccatgcaaaggcacgtggtttccttttctcctctctctgcatctgcgctttccagataagcccaaagacagcaacttctccactcatgacaaatcaactgtgaccctcgctccttccatttctgtccattagaaaccagccttttcagcatctcacccattagcagccccatcacccagtgatcagtcgcctcagtaaagcagatctgtggatggggagcctacgggtggtaagaagtggtgttttgtgtttcatctccagcttggtgttccatggcccctaggcgaggtgatcagggagtggggccaatgggcccccggccctggctttgggaccttgtgctgagggatgatttgctcctgaccttgattaacttaacagttcccagctggaagggacactttcaggacccagtccactgtatggcatttgtgatgcagaattatgcactgacatgaccctgggtgacaggaaagcctttcgagaggcccaaggtggcctcgccagccctgcagtattgatgtgcagtattgcaccacagctctgcggaccttggccattgccrcagtcgcagcttccttttttctgtttgcactgtttgtttgtatgatgttagctaattccactgtgtatataaattgtattttttttaatttgtaaaatgctatttttatttgaacctttggaacttgggagttctcattgtaaccctaacatgtgagaataaaatgtcttctgtctcctctgtctcctttagccttttgtctccatgctgctttctttctttctttctttytttgagacagagtctcgctgtcacccaggctggagtgcagtggtgccatctcagctcactgcaagctccgcctcccaggttcacgccattctcctgcctcagcctcccgagtggctgggactacaggcgcccaccaccatgcctggctaattttttgtatttttggtagagatggggtttcaccatgttagccaggatggtctcaatctcctgacctggtgatcctacccgcctcggcctcccaaagtgctgggattacaggcgtgagccaccacgcccggccctgctgctctttctttcaagggatacttgctttttattttactccccctctttctgatgtgtggaaattacactaggacgtagttttagagtctcagagctctccctatgcagctgggcagtggggctcttcattcttgcgggtccacttctctgtattagacagtgaccttaataagaacagatttcatcctgtggatcttagcagaggtcaccgttgtctgtttctcccttcagatgaacactcttcctgatcctctcctctagaattcatctcctcctgctagcagccgcgtcctggaggagcagcggatggggaatccattctgtttcttcctggtgtttaggaagttgccccacamacagattgccccgatgtccaaccagaagaagtgaaactgctgctgggtctggagaggtgaagacccgtggccagcttctgttgttgccatcggccattgctttttgttcgcttgcttttggttttgcaagaagagcggcctctgtctctgatctgcttcaaatcatcattccatcagtgacagaagtggcygttccatcagtggtcrcagccagttcagctcctgcatccatccccaagtgttctgtaagtcccaggggcattttctgccttgtgtttttgtcatttttcaatcagttycattcaatgagaactccctgtgttacctgtgttacggtgacaccttgagaatgggctacttcccctcctagcaacccgcaacaccatcccagacctcaggagccaggtttgggccagtgctgtctcctgtcgctcttactttcatccttgtcattctctaccccctggttttcctggtatttaaagtccaggtagagaagattttgactggaggtggttaggtgaggctctccccccacctcaaccccctgccattagttcactgggagcctccccctttcctccgcaaggagcaagttactacttcatttcctcttttcccaatttctggacaagaccaaggcaatttgaccaacatttatggggcatcaactctgagagtgcygaaggggcatttgccctcaaagagcttgcagtctagggacgtagacacaagcaattgcacataggcaactcgtgttgtgtgctattataacagttacatgtgcaacactgcctacgaagggactcattgttactaggcatgaggtaccaggaaagaagtagtgttcatatgagccttaagaaatcagtacaatgtcctcgggaggaccagaggaaggacaccccaggtggaaggaacagcagaaataaaggcacagtggcatgtgtgggtgtggggtgttggagtgtcatagaatctgatgaggttgggatccatgggggtaacaggtgggaaaacagtttactctgtttaaggtgaacttattgcctggtgttttgtgytcagagcaaataccctcttcaggagcagatacaaaaagccggcatcttctccagcagctcttagtaaaatacaagcccaggcccttcagacccggattaggcaaagactatgtctgktttccaaatacttgttagtacacaaaaggcacatgaacttgtagtttgtctgcatggcaaacctttcttcactttgctcagtttttatttttttgagacaagtctcattctgtcacccaggctggaatgcagtggcacaataccagctcactgcagcctccacctcccaggctcaagccatcctcccacttcggcctcctgaatagctggaactacaggtgcacatcatcatgcctggctaatttttaaattttttgtagagatggggtctcactctattgctcaggctggtcttgaactcctgggctcaagtgatttgcccaccttggcctcccaaaatgctgggattacaggagtgagccaccacacccggcctgctcagcttttaaattcaacactctgcctactcttttcaaaactaaaagtaccattaccttagctgtagaacctaactctctcgaaatgtaccagagaaaatctaattaatactctcattttctgaatgttcccccctaaaaacaacaaaaaccccactaggagtggaatttgaggcctccccaaccaccnaccaaaaaaggagggtgaaatgaaaggaagaagaaaaactcagcattctttcctctgacaaagagtaaaacgacaaggaatatcggcctgaattctcttcccaagaagaaagaaagcacaccaacgcaggcatttgtcttctgtccatggkgctgaagtttattcactttcaaaccactttcagtaacaggtgaggttctaccttaaaatttaatgcatggggtgggagaggcgaggaagtcaccatcaaaccactttatctacagttagcataagatgtgagaagtgttgacaggaagctgcagcttaratgggatgatcacaactccatggcaacaagrtgacacraatgcagcagagamcccaggggacaggagcctcttgcagtctgtccctaggcccagccctgcttgtcctccctggctgttatcttcrgtactgcaaagagaacacagacatatctggcttggtgacctggctgtcctggaaaagtcagcttcatgtatgagtgtgcccatcctctgaacttgattactgaccacctgcttcccaccggcccccaccccagcctgatgaccctctgagcttcatgaattgataagcaagttactcatcagagtaaatttcacttaagcccttcaggatcttgcaattctggggaggaatatgaactgctaatcagccatgcaaagataacttggctctatgaatattttaatttcccagtgctagtggcagttgcttttttttttttttttttttgagacggagtcttgctctgtcgcccaggctggagtgcagtggygccatctctgctcactgcaagctccgcctcccgggttcacgccattctcctgcctcagcctccggagtagctaggacttacaggcgcctgccaccacgcctggctaattttttgtatttttagtagagacggggtttcaccgtgttagccaggatggtctccatctcctgayctcgtgatccacccgccttggcctcccaaagygctgggattacaggcgtgagccaccgygcctggcctttttttttttttttttttttttttgagacagtctcgctctatcacctaggctggactgcagtggcgygatctctgctcactgcaacctctgcctcctgggttcaagtgattctcctgcctcagcctcccaagtagctgaragtacaggtgccygccaccacacccagctaatttttgtatttttagtagagctggggtttcaccatgttggccaggatagtcttgatctcttgacctcatgatcsgcctgcctcggcctcccaaagtgctgggattacaggcgtgagccacygtgcccagcccccccccttytttttttaagcattttctcagcagactagctaaggacaatagatggcatgtcctgacacccatggggcactctgggtgttggggcagaaacttgagagggaatgagcttctgcattggtccctttcctgctgaaggtgtctcccagtagtgtccatcccatcccatttccatccccagttcctcttacccggaagctgttacagcccagtccgctctgggctccaatcctgtccatcctgcccccgaagcagctggatctcygcaggctccgaggggcagtgagcagcgccctcagcttgctttttaggagggcagatcgatcagaggagtcccaggggccccgcccgagggcacctccatctctctgggctgggctgacttccccggtccagggaggcacctcagggarggggctgagagcagcccccrcttcttcattcggctcactgagcacttgtgggggcacgacctcatcttctaaaggcatcttttcttccaaatggtccagcaaattctttagaaaaggaaaatacagggaaagggataaacctcactgacttggaggaaatcaagaggagtgagcacagcatcagaaagccccctggccccagactgcacccrctttcctggccctaccttgaaatccatcaggtctgcgttggacayggcattgtacatgggattagctctggtctgacctaggagctggaatgccagtaaaaggaggaagctcacggtggtggtggagaaggagctcatgctggcgtcgtcaaggagcaatccactgcttgctgctctgtctctcccctctggttcctctctggttcccctctcttggcctacgtctgtccctgtctcccagctgcccagtgccgcctctttttatagccccccagctctccaagcacgcaggagagacagaaccctccccattctgtcacttgcagtgataaagctgccaagtgagaagccagcaggagatgcccttttaaagttatcatcccgcagggcttgtcacagcccctctctgccttgggcagccccaacagccccccagaccctcagctgcaagagccgcattcttactgatttgactcaagaggctcccacttcaaaggtgtgagaagagtaaaaaagartccttggttatctcaccgccgtgcctcaggattctttctcctcgaygctggtacccgtgcggggaaacagagggtgacgcttggctggkgcccagctcccctggtttgtttgtggctcagctgtcagggcctccaaataagggtggagaggaggaaatggcaggcagccarcagcccgagacaaatggatccagatgctcaagctggcctcacacctgcctcatccgccacgtgggcagacctctggcctcagacagggctgccttcacccctggcagtccctctccatggtcaggcgaaaggaagttattttttagtatataaagtcagctgagaaccaaatgtgatgaagctcccaggaatccaacccccaaatagaaatascaagaaaaggcgggggagcacaagcatcctctctccaaagctcctcctcttccatgtcccccgcgaccctcctccagcatgctgcggggacaggcttagaggacgcagccaatttcatttcttccgttgctgtttatagatgctcagactcttcgtgtctgaagtttgttaacatccccctgcccttcctgggcttgtgcccgtggcaacttgaccgatggaggaagggaggtgggggtgaaggaggtatagtcagtttccctcaatgccttctacatccttccctgaggacgtggcaagtggcaagtgaccgagccaccaaggtcacaatttccctggcccccaaaagggaaataacaggcagcaagtctgtctatgtttaatgaatggcctgtttgctaagcactgaactcagtgttagccattaccattcaatgcaacgtatactgggggaaaactctaaatttgaagggctgagagaccagtactgtagcccaaaacaaaccagttgcatacctcttcgcagccttactttccttgtgtgtaaaatgagaaagaatgttaaaaaccggccgggtgcagtggctcacacgtataatcccagcactttgggaggctaaggtgggtggatcacctgaggccaggagtttgagaccagccctaccaacatggcaaaactctgtctctactaaaaatataaaaattagctgggtgtggtggcatgtgcctgtaatccccgctactagggaggctgaggtaaaagaattgcttgaccttgggaggcggaggttgtagtgaaccaagatcgcaccactgcactctagcctgggcaacagagtgggactcggtctcaaaaaataaataaataaatgaatgaataaagtagaaatcttccctgcctacyttgcaggattgttgtggagcccaagtgagctgagaacgtgtcaacacataacaagtgtgcagtgctgagtccctgcaagatggccatcatagttgtctttattgrttgcttgtagcatgcctagcrctgtgctgagaactttatggaaatgattttattttgatcaccatccccaggtggtagatagcattgtccttgcttacaagggaacagaactgagcccgagaggctatgccacttgcccaaggccactaggtgcctaagtggcggaaccaggactggatccccaggtctgacgctgatgtctgtatcctagcctatttcacgtagagagctgccaccttacctcttagctgcattccccaattaaacccccattccccatctttcagatgccccaagggagctccttcaccttccccatgcccctggggctgtagcttttttgtgcacttaccaagtctgtgtgtgttggctgctctcctgatctatttctacaccgaatgtgttttaatccactccttagaagctcagaaaatgtgtgttgagtgaccagctctgtcctggctggccagatctgtccccaggtgtgctgacctcatgactgaccaggtgaacaggaygttgtgcagccataaggttggaaatcagggcagcaagtgactagaggtcacaagaggtatccagggtgatattattctaagataagataaaagggaccctctttggcaagccttggggtttgtctgtaggtggggatctaatatttcatggggtggttagaagcagcctgtaggagtgagagagaagaaaagtaacaggcacagaaagccaggcccacctccatccccacctcttccacggctgaaaaatcaaaagccttttatttccttatcactggaaagaagtcatcttagtcatacaacgggyggagcactgcaaacgggtgggagaatccagaatccgggtgttgccagattccagcccagagtttggcttcacgattctctgggggtatgccttgggctgctgcagggagccccagagtgtgcagtgtcacccgcgtgcagagctggcacgaaatccccaacacattcgtggcatgattctgcgggacccagatggtctaaagcagaagccccagttgggaaaaattggttcatacttagggatgatcgttgctgactttgaaaatgatgttttgtttctttggtttaatatggaggtcactaagggctgaagactggggacagtttccctagaaaacraagcccaaggcaaaaggtcactcgctaaagttttgtgggggttcctattcaaaggaagcaagagtgaggcggagtgagaggctgttttagttaactactgccgggtaacaagtcaccccagactgggcgtggtgactcacgcctgtcattccaacactttgggaggatcatttgaacccaggagttcaagaccaccctgggcaacatggcaaaaacccatttgtactaaaaatacaaaaaattagctgggtgcagtggtgcgtgcctgtcatcccagctaccctggacactgaggtggragaatcaccacagcccaagaagttgaggctgccgtgagccatgaccaagccactgcactccagcctgggtgacagagtgagaacctgtctcaaaaagaacaaaagccaggcatggtggctcrcgcctgtaatactagccctttgggaggctgaggcaggaagatctcttgagctcaggagttccagacaagactgagcaacataaggaamcctgtttttaataaataaacaaacaaaaamcaaaacaaaaaccaagtcaccccaaaccttagcaacttcacacaatgcacatctattatctcatcacctctgtgctctgtggatcagggatctggccctgcttggcctggggcccctgggcaatgaaggcgttggctgcggctgcagtcatctcaaggcttggctgggggaggataggctttcaggctcactcctgcagctgttggcagaagccacaggttctcgctggctggtggctggtggaaacatcagtttcttgccacgtgggtctctccatggagacgcaactgtcttctattaggtcaggcgagaaagagaagttacggaagaagccacagtctctttgttacctaatctcagaagtgacatcccattcttcatgttgtactgttctgtgtcccttagaagtgagtctctgggtctcactcacactctaagggagggggttacagagggtatgaagaccaggaggttggggatctctgggggccttctgaaagcactgcccacacaaatagagaaggaaggaaagcaaatgtaaggtgacattggctgagtgcagtggctcatgcctgtartcccagcactttgggaggctgaggtgggtggatcacttgaggtcaggagytcgagaccagcctgaccaacatggtgaaaccccgtctctactaaaaatacaaaaattagccaggcatggtggtgtgcacctgtagtcccagctactcgggaggctgaggcaggagaatcatgaagggcagggctctgcaggaaggttgacttatttgggagtgtcttagtttaagttctcttgaaccggagacagrkattccagtattagtggctgatcttggagacaaacccaggaaatgtcagtggagagtggggaagtgatacagaaaaagtagaagtcagtgaccacctctggcagtaggtgcttaatcctcctcccacagagaactccaaacaggttctctgtttggagaacagagacacatgccacctatgactcaagggagctgggtgtttgttttattttattttattttattttatttttgaaacagagtcttgctctgtcacccaggctggagtgaagtggtaatttcagccttgacttcccggctcagtgatcctcccatttcagcctcccgagtagctggactacagatgttcaccaccatacccggctaattttttttcttttatttttagtagagacgaggtctctctttgttrcccaggccggtctcgaacatctgaactcaatttatcctcccacctcagcctcccaaagtgctgggattacaagtgtaagctgctgcaccaggcgtgagctgggtctttaaatgccaactcctggccaggtgcagtggctcacacctgtaatcccagcactttgggaggctaaggtaggaggattgcttgaggccgtgagttcaaaatcagccttgcaaacatagtgagactctccatctctacagaaaaaaaaaattattttaattagccagacatggcagcatactcctgtaatcccagctacttgggaggctgacgtgggaggatcgcttgagcccaagagtttgaggttatagtgagctatgatcatgccmctgcactccagccttggtgacagagcaagactctgtctctatttaaaaaaaaaaaaaaaaaaaaaaagccagctcctgtcagatgttggttgagcactgctcaggtcaatgtcaattccccagcacttcctgccggccccaaggagctgagtgggctgcggctgccagagaaagttcttaggcagaaaagtgcagtgctgctggatgaaaggattgatgtgtgctgaagatcaggggctacgggcctctgccgtgcccgaaacgggacagctagaggcaggagagtgggagccagtgtccaagggcagatactgagtttggttctagaaacgcttaaggcagctgtatggggcaggctccagaccccargggaaaaatggatcacttggtggaataagactgattatttaagctaaggcagtggatgaaaaatcctagagagaggctgagatctacaacatgaacaaagacaaatggccaagttcatgtcatggtttagacccagctctgcaggaagagaaatgcattttttttccttgccacaaatcattctcagaaaggccaaagcaggtggggcacggtggctcatgcctgtaatcccagcactttgggaggccgaggagggcggatcacgaggtcaggagatggagaccattctggctaacacactgaaaccccgtctctactaaaaatacaaaaaaattagccgggcgtggtggcgcacacctgtagtctcagctact

SEQ ID NO: 13477 - DNA, 28553 bp, Homo sapiens
gaggtggaggttgctgtgagccgagattgcgccacctcactctagcctgggcaacagagtgagactccatctcaaaaaaaaaaaaaaaaaatcttcatcccttttcaggctctaatcaatcgtggggttaacctggatcccctgggcaagtggtcaaagactggactagtggtgtatgattcttctgtgcccattggtaagtctcccccacccaagagcccttctacctctgtccctgtccctaccgcatgtcacagggtggtccttctccacaggtgctacccccgagtacctggctgggcactacatgctgcagggagcctccagcatgttgcccgtcatggccttggcaccccaggaacatgagcggatcctggacatgtgttgtgcccctggaggaaagaccagctacatgggtatgagaggggcaggcaggtgggattcatcgggctgtcttgcttttgaaagtagatggggttgctggggttgctgactcactagtgctcatggaacacaatgtgcaggtagctagcagggtggtgaggaccagtttctggagtcggcctgggttccagtgtgccacttactacccatctgactatggattctcttttgtcatccataaaatgggatggtaattgtgcttgggttggcccttgtattacgcttggattgtgagggttaaaatgatgcgtttagaagtcctyggcagtgttcagcacatagtcagcagccataacttttattaagctgctgtcacttaaaagaagtaatttagtatgtaggaccacataggtgtttggtaaaaatgggaaaaccacatcggtagacttgccgatcaccagggsctagtgcagagtggatcagcctatacagtaggcaggcttgttgggagcgaagttgccttgaggtgatgacacttctcatgtggattcctggacaggagggtgggagcaagtgtggagacagtggaactggctgatcagcactgttactgccctctctttagcccagctgatgaagaacacgggtgtgatccttgccaatgacgccaatgctgagcggctcaagagtgttgtgggcaacttgcatcggctgggagtcaccaacaccattatcagccactatgatgggcgccagttccccaaggtgagactcrrrctgtgtgtcttctgaggcttcttccggttgaccttctcccttcctgacctcaatgtttagactcgaccctagtaaatattgccctgctggttgcagaagagacatatgattcatctgtatcttttctccaggtggtggggggctttgaccgagtactgctggatgctccctgcagtggcactggggtcatctccaaggatccagccgtgaagactaacaaggtgaggagtcaggtggtgggcccctgagaggccttggctgggtctcgtagagctggaaactgagatggggacaccctctgggctcccctctcctcctgaggctgcctttgggtctctttttgggacaggatgagaaggacatcctgcgctgtgctcacctccagaaggagttgctcctgagtgctattgactctgtcaatgcgacctccaagacaggaggctacctggtttactgcacctgttctatcacagtgagacctctgccatggcagagcaggggaggctgggctggggggctctttgccccttagagctcccttcagctccagctctgctttttcctccgttctttgtcttccccccacatccaggtagaagagaatgagtgggtggtagactatgctctgaaaaagaggaatgtgcgactggtgcccacgggcctagactttggccaggaaggttttacccgctttcgagaaaggcgcttccaccccagtctgcgttctacccgacgcttctaccctcatacccacaatatggatgggttcttcattgccaagttcaagaaattttccaattctatccctcagtcccagacaggtaagtratctttttcttcccttcgtcaccacctttgctctttccacctttcaggaggctttatggtgtgacaagaggaagggaaaggaargattcatgcatcccttactccagcctttgcatgcttggctgagagaaccctctcattccagctagaattgcttttgagtgctggaccccatgtgaacaggctaaagtgttcatatggatggaggcctgttcctttattctgccaagtggctgcagttgttcagcactaaatgcattccaaatgcaggttgtggtttcttttccttcttggcacagggtggacttactggtactggacctctgctggtccagcaatctcagcactgggttggaacagagctccacagagctttgtcagcagttctctgagcccttcacactcattgcagattgttttctcagccatcttgaggagtctggcctggatctcaagggaagggtggggttttctgaaacagccttgagagcactgcttactgggatataaccctgggtttagttggaagaggsagagaagtgctactttagaaatagtagaatttgtctgggcgtggtggctcatgcctgtaatcccagcactcacctgaggtcaggaattcgacacggtgaaaccctgtctctactaaaaatataagaattagctgggtgtggccaggcacggtggctcacgcctgtaatcccagcactttgggaggccaagacgggtggatcacgaggtcaggagatcgagaccatcctggctaacacagtgaaacccccatctctactaaaaatataaaaaattagctgagcttggtggtgggcgcctgtagtcccagctactcgggaggctgaggcaggagaatggcatgaacccgggaggcggagcttgcagtgagctgagattgtgccactgcactccagcctgggcgacagagtgagactccgtctccaaaaaaaaaaattagctaggtgtggtggtacgtgcctgtagtcccaactactcaggaggctgaggcaggagaatcacttgaacctgggaggtggaggttgcagtaagccgagatcacgctattgcatttcagcctgggcaacgagcaaaactccatctcaaaaaaaaggaatagtaaaatttgctataacttaaaaagtacatattttaattatcccgcacttcatcacaattcacatggaaagaaacttctctgatttaaaaaataaataggccaggtgtggtgatggctcatgcctataaatcccagtactttgggaggctgaggtgggaagattgcttaagaccacgagtttgagacctgtctgggcaacaaagggagacagtagttccagctactctggaggctgaggtaggaggatcccttgagccccaggagtttgaggttgcagtgagctatgatggcaccactgtactccagcctgggcaacacagtgagactctacctcaaaaaaaaaaaaaaaaagataaataaagcctagtgcttcaaattcatttagaagaccctgcgaggccgggcgtggtggctcgcgcctgtaaccccagcactttgggtggctgaggcaggtggatcacctgaggtcaggagttcaagaccagctggtcaacatggtgaaacctcatctctactaaaaatacaaaaattagccggacatggtggcgcacggttgtgattgtycggaggctgaggcaggagaattgcttgaacccaggaggcagaggttgcagtgagccgagatcacaccactgcactccagcctgggtgacagagtgagattccatctcaaaaaaagaaaaaaaaaaccccaaaaccctgagaatcacctcttccttacagcatcttgttacttcctgtcctcaagagggcgcagcttcctgtagaaaccttttggcccaaggataggcagtgatttttttttttttttttttttttttgagacggtgtcttgctttgtcgctcaggctggactgcagtggtgsaatctcagctcattgsaacctccaccttccaggttcaagcgattcttgtgcctcagactcccaagtagctaggattacaggtgtgtaccaccatccctggctaatttttgtatttttagtagagatggtttcaccatgtgggctaggctggtcttgaactcctggcctcaarcaatccacttgccttggcctcccaaagtgctggaattacaggtgtgagccaccacgcctggcctataggcagtgatcttttaatacaaggttcaactaggacttgagtaaaggccaagttatattaagtaatgggaatttaggtaatctgctcttaggcactgacctaattgtgtggagctcctgcccaggaaatggcaattctcatattttaatatgagaatattaaaatatrrtgataaggcccattttctgacaccatctgtttaattttaaccccaggaaattctgaaacagccacacctacaaatgtagacttgcctcaggtcatccccaagtctgagaacagcagccagccagccaagaaagccaagggggctgcaaagacaaagcagcagctgcagaaacagcaacatcccaagaaggcctccttccagaagctgaatggcatctccaaaggggcagactcagaattgtccactgtaccttctgtcacaaagacccaagcttcctccagcttccaggatagcagtcagccagctggaaaagccgaagggatcagggagccaaaggtgactgggaagctaaagcaacratcacctaaattacagtcctccaagaaagttgctttcctcaggcagaatgcccctcccaagggcacagacacacaaacaccggctgtgttatccccatccaagactcaggccaccctgaaacctaaggaccatcatcagccccttggaagggccaagggggttgagaagcagcagttsscagagcagccttttgagaaagctgccttccagaaacagaatgatacccccaaggggcctcagcctcccactgtgtctcccatccgttccagccgccccccaccagcaaagaggaagaaatctcagtccaggggcaacagccagctgctgctatcttagatggttgaaaactagacgggtggctcactgccattgtcaccaggttggaactcttgcctctgtgaggatgccttctctactgtgcatacccatgaaatttaatacacattttaaaacctctggccactgagtatttttgagggaactgggtgctgcctttgccgctttaagggtaaagatgggaggtgggactgggatcttctgaggagagggaatggttgggtgctactgagaaataaggtcagttttaggctcctgcatccttgggttttcccaggaagggaaagccctggagtcagagctaggggtgattgaactccggggagaggagggcaatagaagtgtaggggaaggcggggcacactagctcatgcctgtaatccyagcactttctgggaggccaaggcgggtggatcacctgaggtcaggtgttcgagaccagcctggctaacatggcgaaacctcgtctctactaaaaatacaaaaaatcagccgggtgtggtggcgggtgcctgtaatcccagctactcgggagactgaagcaggagaatcgcttgaacctgggaggctgaggttgcagtgagccaagatcgcgccactgcactccagcccgggcgacagtgagactcggtctcaaaaaaaaaaaaagtcgtgtaggggagatgggcttgccaccagaacccatggggtactggaggtcctgggctttacgccaccccggctggagtccaggcggtggctcccctcatcacagggctcggcctcagacccggaaaggtccagggtccggcctccaattggagcctgtcattggcttcccctcggcccgccccctgacckctgccccgctgccgagccgcctgattggtcggctctgtcccgccggcgccgcattggctcttctggctcrccttccatccctgctcctgcaccggtctgcatctcccagcagaaggcgcagccatgaatccgttattcggccccaacctcttcctcctgcagcaggagcagcagggcctggccgggccactgggggactcactgggaggcgaccacttcgccgggggaggagacttgcccccggcgcctctctcgccggccggccctgctgcctactcgccgcccgggccgggcccggccccgcctgccgccatggccctccgcaatgacctgggctccaacatcaacgtgctcaagaccctgaacctccggttccgctgcttcctggccaaggtgcatgagctggagcgccggaaccggctgttggagaagcaactgcagcaagcgctggaggagggtaagcagggccggcggggcctgggtcgtcgcgaccaggcagtgcagaccggcttcgtcagccccatccggcccctggggctgcagctgggcgcccggccggccgctgtctgcagcccttcggcgcgcgtgctgggctcgcccgcgcgctccccggccggccccctcgcgccctccgcggccagcctctcgtcgtcctccacctccacctccaccacctattcctcgtcggcccgcttcatgcccggcaccatctggtcgttctcgcacgcccgccggctcgggccsggactggagcccactctggtgcaagggcctggcttgtcgtgggtgcacccggatggggtgggcgtccagatcgacaccatcacgcccgagatccgcgctctctacaacgtgctggccaaagtgaagcgggagcgggacgagtacaagcggaggtagggattgggaaagggggacaggtctctctgtgtcataccactcacaacgggccgcgagttggtgtgggttccgaagaatcaggggtgaaaagaatgagagtaaagtttgtgctgtgtaatgaggagcttggaagcaattggatgcagggagactagaatccgcagagaatgcagaagccctgctcgtgacaggaagaaggacgctgggagcggaacacggggggattcctacttttccggcttgtctctgccatccaggcttaactgcgggttttgtgcggtgtgaaagggactggggctctgccctaccggtctcagccctggggcaggttagggatataaacttcaaaagtaggaggcaaggatatagcgtaaatttgggagactaaattgagtgaaactggaaggggctggtgagggaggggctgtaccttgcaacgagtgattctttcacascccaaggtttcccaaagaatattgatggaaaccaggtacctgctgtggtttcataggaaaagctccgggacctcaagccattgcttgagtaggtcaacaaactgggaaaagaaagagtgaagggaattcactagggtgagggtggagagcagggctgacaggggaatcttggcagtataaagcgccagtggggagggagagtggagagccagcaggggactgagcagggagaagctgggatatgggccctccctaggaccgcgaggccgcggggcgggcccggtgcattctgtggatgaagatttggctgtctgagaggagcccggccccaaggggcaagggraagggatgtgatgccaggagtgctggctgtataccaagtggattcctyagatggctgataaccaagccgataggacaggagtgagagcagaggtagtgtcttgcagactccaacccaagccttgaggagggagcgggtgactgacaggctttggtttggcggcctcccctctcatctcagctattatgaccccttgtgggcgggcctgggaactacctatgcagcccagtgtrgcggagattcagcactgggtgaggattggccgaatgttctaggaaatgaccgctgggtctaggggcgaccttcagggatctccaccctgctggagtttaccagatcacagatcagcaggctttctttttttttttttcccataaatgataatattttattatagaaaaagcatcccaaatacaggatttcgtaaacactggtaggtgaacaagtgcaattttagaagtaaatgcaaagtaaagaggcaaaacctacaagcattttgccttcagaagaagatgtagtgttctcctgcactartgatcccacccagaacacaaatgtggctctgtctcccgtgaaagcatcagatttgctttctgagctcagtatgcccatttcaataattgcaaagtgatggcaagaagtggcgttgaacacatgactacagacccttgacttaaaatattgagacagggacttgctctgtcatccgggctggagtgcagtagcgtcatcacagctcactgcagcctcatcctcctgggctcaagcaatcatcctgcctcagcctcttgagtagctgggactacaggtgtgcactaccatgtccatgcctggctattttttttttttctttttgcgttgtccaggccagtctcaractcctgacctgatcagcaggctttctgagcttgagtcctgtcctcgtgctggcttccttagttgtggtccatgttatgtgtycttgggagtttcagttgtcctgaaatcatcgttctgccacccagaaccagcctgctctgcccctgcaggagttaactacgcgctcagcagtggcacaggcacagttctggaatacatccataaccacaggaacaactgctgttctcaggagcattttttttttaaactgaaggagygtttgtccttggtccagctgtccaggacaggaaggagttattccttggggactgattagctcatcgctctgcagcacgctgctgtgtagagagccttagctggattcggatggtrcgtgatactggcagtgactcttcttcctccctagatycccygccctcattctggtctctttatagcaacactgtaactcctgtcttctgcctggaaggcctgggatggcttgagcgctacactgggaggtagctaaaggcctcctgcgttctattttcagctcccctgccttgtgygtgacctttttttgagcccccattttcccaacataggaatggtccctgctttctctcttcaacccagggatacagttttttggaagagagatatttggtccatgcagaacacatggatatcgctctcaaattctgcccatgttaagggaaccttataagtgagaccagatggaaatggaggtgaaaatgaacctgtctgtgtgaagtctggccaaagaacaaatagaactgtagtgggcttccagatgattcatttgtagattttttttaccctgtaagatttccttaggcttaacctttagctataactgccttacttaagtttcttccaggctctgttgagctcactgtcagatagcccctcctgccctctttcacacatcttgtccagggttagcgtgcccttgacaggcttactgtctccctccagggactcgtgggctcccggcgcatgagggcaccacagttcatgccttcacatcrtagatgaagaaaccaagacccagaaaagataagggtcttagctaagaaaacataatctgatgcgactggttcccttagtggcctgactgtatgcatgagaatgccagggaggaggggagaagcacctacgggacacacagggaagggggctgggagccaggaaggctgggagctgggctgtgtggggagccagcagggtggtggctgggctggctgcctcctcctgctctgcccagcagggaggggcagtcgaggtgatgtggaggagttattattaggaatactgcagtgcggctgtgaatgaggagatgggacccagaggctgacacaggaaggaagatggagggaaggggaagaaagggcttcacccaaggcttcagaagctgcccactcagattttaattttcttgctgtcttcttggccccttcctaaccacctttcttgtgttgaagtttctctcttggtgcagttcccctcccttctcgggttgacagaagtgatgagctcacargaacaggatttgagatgtgctgctacgccagctagactgcagggccctggaatgccgggcgggtcctaagcagcacgttgccctggcttccatctctgtgatggaatagaatatgcactgcctgccatggctgatgagacatgacaaagctggctctgggaagcatgccctacctaggaccctgccctgtggcccagggtgycgtccggcccacttgcagtcttaatctctgaattctgggccctggaacaggctgtgtctagttctcayttgcygtactcaccgggcccctttacrtactctactttctctttccctctgggtttgagtgctagtaaccccaggctcgtgtgtccactgctgtcatgctgctgtgggacttccggcctctgagccagtctggtcacctctctgtgactcccttagaggaggctctgggtgggtagtttctggagctagtggggaaggactttgagtgtctcctaccaggctcttgacccactctgttgatacactatgtgtcctgcagatgcttttacagggttaaatgataccacaagaggcagggcagcgggctcgacgagctctgttctgrtgcgggcaggaggcgggagcccggatctgtgcgactgaaggtgggagactgggccgggtggacctggtggtctggtgtgggcaggaggtgggcaatgaggccagccggacagctggctgagctggggcctgagcagggatgggcatcacggaggaccggagcctcagcacttgcccaaacagagctcctggtgcacagcccggaggttccgggaaggcagctggcgagctcgacgcccatcaggaagcacagagccgcgtgacagctgcagttggtcaccagctggctggccaggcattcctgtgccctgctcctccccatccagggaaccagaactggggtctgaggcctgagccagagaggtggggacagggagccrtggggrcagggaaggactctgtacctaagctctctccgcccttcccatgtctgtcaggtgggaagaggagtacacggtgcggatccagctgcaagaccgtgtaaatgagctccaggaggtgagggtggcgccccacttgctgctggtgcttccctgggtacccctgtctgcccatgaccctgctgccgtctccctgtccctccttggcatctttatcttcctcccacctcggcagtgccaccaacatcagggtttctcccaactgcaggaagcccaggaggctgatgcctgccaggaggagctggcactgaaggtggaacagttgaaggctgagctggtggtcttcaaggggctcatgagtaacgtgagtgcagccccaggcttcccgagggtcgaagtgaggcttctgaggccagaagagtaggcccttctagtgttggcctgttggcctcccgtccacggctcctccccttctctttgctttccttccctttttcccctagccacccctaactccagagaaagacaagsaacaaaagtctcggtgttgcgtcacagaggtggcgcagcttctgagggcctggggttgcagagcagttagtgagcagcttctggggtggaggctctgcagctggcgccggggcgctgggccgattcctcagcctctgaggcctcacctttggcgtggggaaataaacgcgtgcgctctgcaggagtattgtgagggtggtcatgtactcgggacagtgcccagcatgcagtgttagctggaagagtgttagctgttgcgattattatagtcctttctccactcttataattcccaggagtctctttctctctgggaatgtaagttctaggaggatgaggaccgctagtcgttccagtgagccccctgcatgtcccaggcactggccatgccctccagggcttccgtttggccagggagcagtggcccgagccgccccatgcccagcatattcacacagtgctgtggggaggccaccrctacccaggaagaggggtgcagtcagctcagggagactccacagaagaggcaccggtgcaatgtggtgggaaggatgaggaccttgccaggcctaattcgtccttgtctggagaactgggcgcctcctcactgttccctgggctccctggacagaacctgtcggagctggacaccaagatccaggagaaagccatgaargtggatatggacatctgccgccgcatcgacatcaccgccaagctctgcgatgtggctcagcagcgcaactgcgaggacatgatccagatgttccaggtgaggacggagctgccctctgctctcaggggtgggtggggcaggtggatgcttccgtggcrgctggcctggaacgcaggccctgcctcctgcttggggagccttacctggcaactggggccctcacggggctagactggggggtaaggagcagcatcaggaggggcatcgtggaagctgtctctaacgccgtctctcccttccccctctctctcctctgtctgcttcctctcctctcttcctctcatcttctctcttgcttcctccacagaagaagctggttagtttgatctcacgcaagcttattaatgtcccagtcccagtttctaagctgcctaggcctcctggccctcagtttgggcccgctgggctcttgagcacggatttttttctgccctttcccttttccttgctcttccccctttttctctctatctcttgttctcttgactgcatttctttctctcccttctcccccggctttccagatctggatgtgattcaggttctcttttgtacacattgcacactcatcctccttgcgtcctaaagcttttttttttttagttgagtcatttaatcaaaaagactttttttagaaaaaaatttcctcttgagccatcatgcacatctgactgcagccccagcgagcccttccttccttgtctgactgctcttcttctcgatttcttcttgttctgccttctcggtttgcagccctgacccccgctgtgtgtctggcccttggtgactgtccgtgtttctgttcctgtcattgtaactgtgacttttctctctgtctgcccccmcttcctactggttcatgcttctcccccattcccaccctctctgcccggcctcccgctcccgccctttctcctcatgcacccggcctcgtctctgtagtctctgcacttgtctcccattaaggtcccatccatgggggggcggaagcgggagcgcaaggctgccgtcgaggaggacacctccctgtcggagagtgaggggccccgccagcccgatggggatgaggaggagagcacagccctcagcatcaacgaggagatgcagcgcatgctcaaccagctgtgagtccgcaggccgtgctcccgcagcaccgacgccacagcagcccaggaggccggagctccccagtcccccgccaggacgaggccccgcccgccctgacacccgggttccctgtctctaggagggagtatgattttgaggacgactgtgacagcctgacttgggaggagactgaggagaccctgctgctttgggaggatttctcaggctatgccatggcagctgcagaggcccagggagaggtaacctctgctcccggcctcagggccctctggctctgcctctccagcctgamgcccactcccccgctcctctccttgctctgtccccccatgtggctgtcatcctctacctgcgtctcccctcttcctttatccttttgcttttctttctccagtttctttaaccagacttcctctctctctctctccctgacttggccctttggaatgcgtcccatcccatccctccttggctggcctcccccgcttccctttctactccagcagcaggaagatagcctggagaaggtgattaaagatacggagtccctgttcaaaacccgggagaaggagtatcaggagaccattgaccagatagaggtaagggcaggagcggaagccaggggcgtggtgtcccagagggttttgagtggggctgcaggcgcagtggcctcatccctgctgcaggaccctagagaccaaggtcttgggaggaggagtgatctctcagctatagtcctcctggtgggctctgaagacctcaggctctggaaacagacagatatcggttcaaatctcagctctgttacttacaaccaccctgaacttgtaataagttacttgttccctctgagcccctcctttcctttcctttcctttcctttctttccttccttccttccttcctttctctctctctctctcttcccctccccctctatccctccctccctctctcccttgtctttctgtcctttcttttttgagacaaggtctcactctgtttcactctgttgcctaggctggagtgatcctcccaccccagccttctgagtagctgggcccacaggtgtgtgccaccatacccagctaatttttatttgtatttttttgtagagatggkgtctccctgtgtttcccaggcaggtcttaaactcttgggcttaagtgatcctcctgcctcggcctcccaaagtactagaattagagacatgagccatgtgtccagccctacacctgtttctttttctttctttctttctttctttctttttttgagacagggtcttgctctgtcactccaggcccactgcagccgtgatcttctggatccaagcaatcctcctacctcagcctcccaagtagctgggaccacaggcgtgtgctaccacgcccggctaattttttgattttttttacagagaacagggtgtcactatgttttccaggctgccctcaaacttctggattcaagcagtcctcctaactcggccccacaaagtgttgggattacaggcatgagccactgtgccgggcctttttatttgtaaaatgaggaatttaataatacctcacctatagggttgtttagaagatcagatgaaataatgcatatatagagcttagggcagtgtctggctcatagcgagtgtagcatagtggggactgttttattattattaacactatcagtgccatggcactcagagatggactgggactttcctgtttcttccactcagcctttgagataacagagaaatctccatgctttttcccaagccttgaagtaccttctagaggtacctagaggcaagtggagctggtgctttagctcaaactctaggctttaggagctgcaagaaggatttgtggaggccgggcgcggtggctcacgcctgtaatcccagcactttgggaggccgaggcgggaagatcacgaggtcaggagatcgagaccatcctggctaacacggtgaaaccccgtctctacgaaaaatacaaaaaaaaaaaattagctggscgtggtggcaggcacctgtastcccagctactcgggaggctgaggcaggagaatggcgtgaacccgggaggcggagcttgcagtgagccgagatcgcaccactgcactccagcctgggcgacagagcaagactccgtctcaaaaatacaaacaaaggaagaaggatttgtggaaccacagaatggaggttgctgttgctgtgggaggagggatggacgggacccccgtgagctctcctggcctggtgaggtggtcctttcccgacgctctgactttgggagaggcatggagccttctctgcgtctcagcctctcttcaggcccacatgggagattcatacgtagtccccccttatctkcagggcatgtgttccaagacccacagtggatgcctgaaaccaaagatagcactgacctcctgatagcttgggtccagttgctgtcaactggaacgtgtttctgttcatgtctcccacccacacattcaatgccttttctatcttaactaagcacttagcgtgcgctgtggcggtaccttttgcagttcgaggtgtgacagcaaaactggcacaaatttctttttccttctttacaatttcacggatagaagattcattcttactgtagagcttaccaacctcagcatcggattctttttcwtattaagttgaaaacttttaccttttcacttaaagggagcatattttggcttctctttcacatatccaaattgccagcatcactactcttgtgctttggggccattatgaagtaaaaataagggttccttgaacacgggcactgccataccacgacagtcaatctcatcactgagatggctcctaagtaactaatgggcaggcagtatagacagtgtggatccttgggacagagggagggttcatgtcctggtctggatagagtgaggtttttttttttttttccgagacggagtctcgctgtgtcacccaggctggagtgcagtggcttgaactcggctcactgcaagctccacctcctgggttcacgccattctcctgcctcagcctcctgagtagctgggactacaggcgcccgccatcacgcccggctaatttcttttgtattttttagtagagatggggtttcaccgtgttagccaggatgatctcgatctcctgacctcatgatccgcccacctcggcctcccaaagtgctgggattayaggcgtgagccaccgcgcccggcagagagagtgagattttatcaggccactcagaacagcgtgcaatttaaaacttaggaattgtttatttctggaatatttcatttaatattttcagatcaaggttcaccttgggtacctgaagccgtggaaagtgaaaccagtggataaggagagagtgactttattcttttcatttatttatttatttatttatttttttgagacgtagtctcgctgtgtcgcccaggctggagtgcagtggcgygatctcagctcactgcaagctccacctcccaggttcacgccattctcctgcctcagcctccagagtagctgggactacaggcgcctgccactacgcccggctaattttttgtattttttagtagagacggggtttcaccatgttagccaggatggtctcgatctcctgacctcgtgatccacccgcctcggccttccaaagtgctgggattacaggcgtgagccaccgcgcccggccttgactttattcttattgctgtcacattggaggtgtttgagaaggaagycgagaaattattttcctatatactcattctcccaacacacatcaaactgtcctgctcctgcatcaaacctggttttcttggccaggtagatgaggtttcctggatttgtgctgctagctaaagacatggcaagggaaaccagtactccccaccctcccgtctaccgcggctcactgtttcctcctcctgcctgacctgattcttgtctccctcttttggatggtggatttaaggtttgtgttttcactgtgccttcaaccaactaggggcctttgtgcggccatcttygtgagaagagatctcgggctgccatctctccctagtcttccctggacctcaagtgcccagtgtaaaacatgatctgaaagaacgaaaataatatcttaaatggaatcatgccttttaagctatttttggctgggcgtggtggctctcgcctgtaatcccagcactttgggaggccaaygcgggcagatcacttgaggtcaggagtgtgagaccagcctggccaccaacatgtgaaaccccgtctctactaaaaatacaaaaagtagccaggcattgtggtgggcacctgtaatcccagctacttgggaggctgaggcaggagaattgctggaatctgggaggtggaggctgcagtgagctgagattgtgccactgcaccacagcctgggtgacagagcaagattccmtctcaggaaaaaaaaaaaaaaaagtattttcaaatcatctgactcctcctctctcccagtgcaatgactttaggcagcagtccccaacctttttggtaccagggactggtttgtggaagacagtttttccactgacccgggggaaatgattttgagatgattcaaacattacatttattgtgtactttattactatttttaaaaattattattattatttttagagacagagttttrctcttgttgcccaggctggagtgcaatggcgcaatcttggctcactgcagcctccgcctcccgggctcaagcaattctcctgcctcagcctcccaagtagctgggattacgggcatgtgccaccacgcctggctaattttgtatttttagtagagatggggtttctccatgttggtcaagctggtctcgaactcccgacctcaggtgatccaccacctcggcctcccaaagtgctgggattacaggcatgagccaccgcacccggcctgtgcactttatttctattattattacattataatatataatgaaataattwtacatctcaccataatgtagaatcagtgggagccatgaacttgttttccgcaactagacggtcccatctgggggtgatgggagatagtgacagatcatcaggcattagattctcataaggagcacacagcctagatccctcgcatgcacagttcacgtaaggtagggttcaggatcctgtgagaatctaatgccgccgcggatctgacaggaggtggagctcaggcygtaatgccagtgatggggagcagctgtaaatacagatgaagcttcactcacttgcccactgctcacctcctgctattyggcctggttcctaacaggccacagacaggtactggtccgtggcctggggtttggggacttctgcattaggggaaccgttaggaggacttgctgacctcaggagtacccaaggtgcctttatctttgtgacctttgatctctcagggtcactaagatggagcaaggtaaagccaaggcccagagtggtgggcgggaggcagttcttccccaccgctcctcacctctctctgtctcctcccgtcccacccccaagtctgttcacacagygagcctgcagttttcaaggtggcttgtcaaggacatctcctgacatgcacgttcacctcctgaccttgttcctgctgtaaatttgtgaattaagtggggacatagacatatgcagagactactggtggcagtactagccttgtatttcagtagaatatatttggttcatttccttcttcccagtctccctgagtgatggttccagaacccagctccctgcactccggttcttccaaggtggagaaattggggtgtaggcagctgatctgaacaagggctggtggcactgtattttccccctgggttgaacagtcaccgtgtcctgctcctcccactactgtggggccccagctgtggatccaagcctgccagggaagctgtccccactagggcttctcacccagccagccgccatctcaccccaaatgtcactgtcctgaccatctctgctgtctggccctgtaacctgtttccttctttctctaagttcccaccctctctgtccaatccacattatggcagctggtatcctccccgttctcttcwctcaggcagtcacgaacgtcatctccaggaagtttcattttgcttccccttgcggcccctgccctttgtacccaaaacaaagagaggcagtcgactgtccctggcactgagtttgtgctgcctgggccctgcctctccgcctgcctcagagtgtgggctgcagaatgggcccggggagggagacyggatttctttgattctgagccccgtgttttccacgtgtgacatttctgaaatcargacasgtctcagaatcaatggcacctccaatatgggagtcttccytttagtgtctgaaaatggcttttaggtgagaaaataaagtgataaggagagaatggtaagaggattgggcccctttcagcagttagccaggcttgtatgccacgggtcacagagagagttaattcccttcgaggtctgggtctgccaggatgaggaaaacctgtcgctaacccttacgggagctcacagtgcagtgaggggacagcccaggaccagcgcagtacaggggatgaggggtgagccgggccccataggaacctgtgtggccctgggagcctgtggatctgcwccatcccgcccacactgactttcctcaccactcttatcagtcttaaaagaacacagcctgcagcagtacctttgcattcctccataggcaaagatttccaggaaaagcagaggaaacaatggtgtattcgctgccttctgccttggtctggtttattttaaaatctgagccttcagtaatggctgcctgggcccccggcccagccactgctcttggcrtgttggcctcctggcgggggcaacagaggcgctgtgaacgccacctgttaaccccgatggccctgcctgccccaccacagctggagttggccacggccaagaacgacatgaaccggcacctgcacgagtacatggagatgtgcagcatgaagcgcggcctggacgtgcagatggagacctgccgccggctcatcacccagtctggagaccggtaggcgcctcccctgggcatggggccttccagggggacacagcggggagaaaggttggaacacagccccagagaccctcaggcaatgactgggtcacatcttgctgtggggctgccctttgggagttacctggtggggctggcccagacccacagctctctcccttggcagttggatgagctatgtccattcatgacgggagggctgaaacctcccaaggccaccagctctggtggttcccctggttagaggcagtttaaaaactggcaaggaacagaagggttgtgggggcagatttttatctaaagtcagggccatgatttgtgcatttgaccctgtgtaagttacacygcaacaagaaagtgaatttttaaaaatcacaaaaatactgcagatagacataaagccaaggccctagagtcagggtgctggaggctcagcagcttctctcctactgtgacttcagctatttctttttttttttttttttggctcactacaacctccgcctcccaggttcaagtgattatcttgcctcagcctccaaggcgcccgccaccacacctggctaatttttgcatttttagtagagatggggtttcaccatgttggccaggcttgccttgaactcctgacgtcgtgatccacccgcctctgcctcccaaagtgctggaattacaggcgtgagccatcatgcctgacctcagcctctgagttcccaagacacaggcggggcccatttccctgtcagggtgggtttggagagagttcagtccctgccgctccctsgccatcccgcggccccgccctcgcttccggtacttctcacgggctgccagagggtgaggcagcaggaggaggagtgccgtccgtcttcaggattcctgmctgccccaaggttgacaactggtgtttttttctagaaagtctcctgctttcactgcggtcccgcttagcgacccgccgccgccgccaagcgaggctgaggactccgatcgcgatgtctcatctgacagctccatgagatagagacctgcctcccccttgcacccgaggccctcgcagcagggagctcagcgaggcagagggtggggctgcacagaggggaacatcagctgcagctctgcaccaggccggyccctggggactggggcgctcctccctcaggctttctccctcagtcttggcttctccagggctctggggtgtctggagctaggcttggccctaccattctggggccatttccaccacagttggggctctcctgccttcacgcgtgggtgtctgctacttccccatctttaaaatgctgccagagcgattgcggcccctcaccttgtccacgtatcaggaatgtgaatgtgggacctttcctccatccctgttgtccggagccagctcactgtcttccacactggtgctaactggcccaggcactggagtggaatagaatgcagctggaggctacgcatggcctctgcagcacacgcagctggagagggcttctgtccctgtcagcggcagagggcgttggggctggccggggcaccttgtccctgctatggtccacrtgctmacgctgtccacctgccaggtggagtgtatgtggctgtggccctccctcgtggaggtgccgtgctttaaagaggccttagtgcccgggatgggcacagtgttttgaagggaggtgggagctcttgctctcctggtcactgcagaatgacagagaaggtgaagctccatgcatgtgtgcgcgggtgtatgtgcgctcagggtctctgtttaagtatcagctaaagatgtgcttcctccgtgtctgtcatacactgagaccaacaggctacagtgtccctgattcttggaaaagcctggagaagctggggagatgcggttcmcaatgcctcggtataggaggctgtgttgagctgacattcaaatggattctttaataataatgaaactggcgagtatttattgtgcactttggtgtcactgtctcaagcacttcctaatattcactagtttgaactctgaggtaggtactttttttttttttgagatggagtctcatactctgttgcctaggctggagtgcagtggtgtggtctcagctcactgcagcctctgcctccggggtgcaagcgattctcctgcttcagcaygcctgtagctgggactataggcatgtgccatgaagcctggctgatttttgtaattttagtagagacggagtttcaccatgttggccaggctggtctcaaactcctgacctcargtgatacacccaccttggcctcccaaagtgctggggttacaggcgtgcgcgctctaccgaggtatgtacttttgtctccactaggtaagcacacgtgcaaagtgaggccsgggagtaactgcccaaagcamctgagccgttcagtggcagagccaggggtctggacctaggtcccagctacacgccttgcccctacccaagytcccctaaggacgatgatggaaataagtcaccctgacacatctcagttcatcttcctcaaaactatgcgaggtgggcatttttaccgatttttaaacattatatagtccttaccgccttgggcatggttttaggtacttggtttacctagatgaatcctgcttgaagaccttaggggctggccacgatgtcctcagataagacacgagggcacagaaagcaatagagcacgtgctcaagacctyacagctgcggaggccaagctggaattgcccgctgcagctcagctccaggctgagctccactaaccagtcagcgtcagagcccagtgcgagccctgacttcctccacctgtcagcctccctggggcygcccacagaatagcttcttccatgtttggccaacagcagatagcctaggactggagcgaggagaggaaaaggccttgttctctgaagtagtggtgccagcttcctgtagcactcaagacgtctgagcgggaagcaaatggttctcgaagcaagcaaggctgtttggaggccctaccctcagtctgaggagaacataccaggtccctccccagcaagaatgtctcaccttgacacaagcccagcttccctcccctctgccccagaccctagaataagacaggacaagtaactggttgagcacagggtactttattgatggtacatgacaaggkgcggctccctaggcccctcccctyttcaaggggtctacatggmaactgtgaggaggggagattcagtgtggtgggggactgagtgtggcagggactccccagcagtgagggtctctctcttcctcttgtgctcttgctggggctggtggtccargggtcttactccttggaggccatgtgggcmatgaggtccaycaccctgttgctgtagccaaattcgttgtcatacctagaagatgaaaagagttgtcagggccctttttctgagccagccaccagagggcgccagaccctgcactttttaagagccagtctctggccccagccacataccaggaaatgagcttgacaaagtggtcgttgagggcaatgccagccccagcgtcraagrtggaggagtgggtgtcgctgttgaagtmagaggagaccacctggtgctcagtgtagcccargaygcccttgarggggccctccgacgcctgcttcaccaccttcttgatgtcatcatatttggcaggkttttctagacggcaggtcaggtccaccactgacacgttggcagtggggacacggaaggccatgccagtgagcttcccgttcagctcagggatgaccttgcccacagccttggcagcgccagtagaggcagggatgatgttctggagagccccgcggccatcacgccacagtttcccggaggggccatccacagtcttctgggtggcagtgatggcatggactgtggtctgcaaaaggagtgaggccctgcagcgtactccccacatcacccctctacctccctccccaccttgaaaggaaattatgggaaagccagtccccagaacccccaaccccagggttgcacgcagccccggcagggaggagccagtcttggatgagaaaggtgggagcctcagtcccattccccagctctcataccatgagtccttccacgataccaaagttgtcatggatgaccttggccaggggtgctaagcagttggtggtgcaggaggcattgctgcaaagaaagagggagcggggcgcaagtcaggggagcgtgtccatagggtgccaggctggccgcttctccacgggccctgccttcctcacctgatgatcttgaggctgttgtcatacttctcatggttcacacccatgacgaacatgggggcrtcagcagagggggcagagatgatgacccttttggctcccccctgcaaatgagcctacagcagagaagcagacagttatgaacccggstcctgcctttgcagggctgagtcagcttcccctcccgcgggccctcctgcactcaccccagccttctccatggtggtgaagacgccagtggactccacgacgtactcagcgccagcatcgccccacttgattttggagggatctcgcctatgggggtgggggggagatggggacaggaccatattgagggacacaaggttaccatatacccaagggagccacaccatcctagttgcctccccaaagcacatttcttccattctgtcttccactcactcctggaagatggtgatgggatttccattgatgacaagcttcccgttctcagccttgacggtgccatggaatttgccatgggtggaatcatattggaacatgtaaacctgggggaatacgtgagggtatgaaggggctgcccatcagccaggtggctcctcccacaccagctttggggctcaccatgtagcactcaccatgtagttgaggtcaatgaaggggtcattgatggcaacaatatccactttaccagagttaaaagcagccctggtgaccaggcgcccaatacgaccaaatctaagagacaagaggcaagaaggcatgaggaggggaggctcctccagaatatgtgagcagccctaggccacctccccattaagagggcgaatgcrgcatctccttacccccaggagggcccaagaggttgaattttatctcccttgagcttccctgccaggctggcctggcttaaggcatggctgcaactgaaggctccagggctgcccaacacccccagtcatacgaagcccttccaggagaagcggccatgtggggcactgccacccacagtctgggcacaagctttgtacatggtattcaccaccccactatgccaccccaggaatgcttgctgctgcytagctcagctgcaccctttagggagaaaacgcttgtacactcagcatcatcaaactcaaagggcaggagtaaaggtcagaaattaactggacagggcaagcccaccccttctctaagtccctcctacaaaagggacagagactggggcgggtgggaagaggggaagctgtattttaaccccctagtcccagggctttgatttgccaagttgcctgtccttcctagctcttttccagaaatcaggagtgggagcacaggtaagtgcatgtgtgtggggagaagggatgggagagagccccagcccaggcccccagctacagaaaggtcagcagctatatttaacctcagaccagggtgcggtgggagatctggtttccggaagacggaatggggagaagggcaggttccccgaggcgcccagacacccaatcctcccggtgacatttacagcctggcctttggggtcgggtcaacgctaggctggcaggggaagggcggggccgtgaggtgagccggcgctgcaggaaggggccaccrccagaggggccattttgcggtggaaatgtccttttccaactacccatgactcagcttcycccggcttggcaccatgccacagccmccacacctctgcggggaggggacacaagaggacctccataaacccacttctttgatttaccagagaataatctaggaaaagcatcacccggaggagaaatcgggccagctagcctcgctccacctgacttccccgccacacgcgactccacccatcgaggcaggagcgcagggttagtcaccggcaggctttcctaacggctgcccattcatttccttcccggttgcaacatggcggccgctctaccgcaggcgcagcatccggacagggatgcacccgctgcgcactagcatcccggggcctgcggtgccggaggccgtgggggaggggctcctctgcgacacgtgaccccgcagagcgcgraaggaaagamagcgtcccccacctaggggtccgggtcgggatctcgggcgggagtagggacctcctgtttctggggwctaggggaaggaggctccgggcagatggcgccgcaagggcggagctgcacagggcgccacagcctgggtgcggggctccgccaggtccgagcgctgaccttgagctctccttgcggrgaacagctaccctgcccccatacgactgcaaagacccggagcccgcaaggctcgtagacgcggttcgggggcggtcgcagcccagggccccccagccacccgcgaactcacccgttgactccgaccttcaccttccccatggtgtctsagcgatgtggctcggctgcgcggagggagagaacagtgagcgcctagtggccccggccgacacmcacgcctcccctcccctcccccaccaggcctccatgcccagcccgcgccgcatcacgtcctccgcccgcccctgcaatgcggaggccgcccgggcccaccccgcagcggcgcgaacacatccggcctgcgcccgcccctgccgccttcaggccgtccctagcctcccgggtttctctccgcccgtcttcacctggcgacgcaaaagaagatgcggctgactgtcgaacaggaggagcagagagcgaagcgggaggctgcgggctcaatttatagaaaccgggggcgcggcggcaggcggtgactcggaccccgcctcccgccasgctcagccagtcccagcccaaggtcttgaggcctgagctacgtgcgcccgtaaaaccgctagtagccgggccctactttctccccgcttttttttttccgcagccgcctggttcaactgggcacgcaccgagcgtgtgggccccgacgtaggggggaagggactgagattggyccgatgggaggtgatcggtgctggttcccaggactggactgtgggcagcaggacactagggagtcaaggacggggacccttacacgcttggatgaaacagraggactttgggarcgactgagatggggaattggagccggagcccagcaccgctcgcggctgcacgcggcctgccccctcccctttctttctttcaaaggctgagaggcgggaaagttggggaacttctcctcgaggctctgcggtagtgacaccggactgctcaggcaaaggcctaggaggggcccatgggcctcgggcgggggcccgtggttccttcccagcccccacttccccctccccatctcctggctcctggcatctctgggaccgaggcctgggctgggcactgggcactgggcactgggggcctggagaggaaggaggctcgggaggcggcttgagggggagggggaggtttctgcacggaaggtcacgatgtccygcagccctgtagcctggacctgataattagggcagacaatcccggccctgtgtgcaccagcggctctctccgggctggggccccaggcggaggacaggatggctggtgggggcccagaggcctcccacaaaggcactcctggaaacctgtgggctgtgctgcctagggagagagacagtgtgcctttcattccatccagcctggggcgaagagcgggacgtgagggcggaagtccctccccgccctgggacg

SEQ ID NO: 13478 - DNA, 24064 bp, Homo sapiens
ctattgtgtgctttgggtcaccccatcaagacaagattcccactgccctggtggctctgcccaaaggggaaagcccctgccctgcctcctggaccctgctctgggcacaggtgtttcacaagtaacatcatggaccccgacaggaaactgaacacgagtggagcccagtggtctcttgggaagcaggggcccaggccagccctcactgtcctctcccaagggagcccttagagggtcagggaccctgggcaatgatctcccagcctttcaggagcggcagcgctggaaggacccaggctatgggatacccagacagcgtcggctgcatccagcccccagcgtggccccaggcactggtcagtgtgcctctggcctagaccacaaagaaccaggtcacaaagtgggccttgccctcctgttgcccctgaccactagcccacctgcctctggyccccatcagccattagtcaagttgccaatggccctactgggaagggggctcgcaccggagaaggtcacagacatgggcctgtgggcaatggggacaggcctttatcataaggaaatccatggccttaggaggtagcctgagccagtacctatcttgtttcccacagaaggaataaatatttacatccacggtcagaaaccacaagagctcctgaaaatcagccagctcagcagaggccatggggcaggaggggccagccaatcggtgaccgttcccttgtgatatttaacagaagctagggtgagaaccctggcctggctggaacacccagaccagcttatatcaacttggcaggaagtaacagagttaattaacagggttgacagcagcttctctgaccttctccttccagatccaccaaaaatcccagaccactgactcagtggtgagataccccttgaaagtcctgagaaactccccccgggagagaagacaccaggacaagtaccttttaagggagcaccagggctcaagtaagaagacacggcctgtggctccaaagcctgaagacaactctgcaagacaaaaagagatggatggggccgggcatagtggctctggcctgtaatcctaacacttggggagaccgaggtgggaggatcacttgagtccaggagtttgagaccagctggggcaacataacaagaccccatgtcttaaaaaaaaaaaaaaaaaaaaaaagagagagagagaaagaaaaaagaacaaaaagagatggatgaagagggagacaggaggcaggaggtgggtgaggccaaccaagaaggagagggggaaatcagagacagggagaggaagggagaggcagagaagagcaacctacacagtttgggacaaactagtatctgtctgttcagcttcaccgaatgagcaggtcgtactgagacaccaactccctcttcagtgagcacacttcatcccccaaagccccaagtacagactcccctgcccagcgcaaaccccaaagctgatgtagtcagctatttggcactcccctcgccccaggtagctcagaataccccacccagaggctcccagaatacccccgctcctgcaaatgagcccacctgctggaaatgggagggtccccagcagcccaggagaaagccacaggcaaggattccggccacacagaggggagggcatcttgcccrggggtgacgctggtgcatcctcaggagagccagcccgaggagtggagcggagtgagagggggccttggtgactgggaatctggtcagtatggaatgggacaggcctgctcactactgggcgggacgattaggcagtgtttactcttggaagcttcctgccagggcaggggccgtggctagggtgggcggcctgcagctcctcctgctgcaagctgggccttgctctaagatggttgcagttcagggtaacctgcagcccagtcctgcacaccagacagctctccggatgtgcacgcccacccccttagaggaggcctaagccatctaatctggagaagggacactggaccagaaacccacagacgggggttcacraggaatgccaggacctcggctgactccctctccggggtccccgctcccatctgacagatgagaggctgtgccaaagacatcgtggttctggctcaactctccacctactctgtgcctgcgcctgatgaggagagtcgcagaagcaggctgcacggcaccagatctcagcatcatcacaaacggcctggcaatccccttcatctcctggaagactcacttcacatgctccaaaccactcttttacacccacagagccgcacaagctgatgaccagcagggggattcaccttgtctttccacccctcaaagtgcagcctctctcctcytctgcgatcagggaggacacacctacacttcctgccaggccctggctctggatcccttcccagctctctcctcctgcatcgttagtttctgcccctctgctagagccattcattcattccttcagccaacaaatgtttcactgagcccctgaaacaggccaggctctgtgctagacaccaggaaagcagccccaagccaggcagacagcagcctcggcctctcacagcttaaattctagggaagagagccagacagcaaagttgctagacagacacatgttgtatatgtagtatgttcaaaggtggtaagtgttatggagaaaaatacagcagaataaaggaatgggggactggagggaagggtgtgctttcatgcaggaaggtaaggaggctgttggagaagggggcatgcttagatatcgagatcctggtacctggctcactccatcagcatgaatgactctcctgtctctttttggtttttgtttgttttttgagacagagtcttgctgtgtcacccaggctggagtgcagtggcacgatctcggctcactgcaacctccgccacccaggttcaagtgattctcctgcctcagcctcccttgtggctgggattacaggcacccgccatcacgcctggctagtttttgtatttttagtagaggtggggtttcgccatgttggccaagctggtctcaaactcctgacctcaggtgagctgactgcctcggcctcccaaagtgctgggatyacaggcatgagccaccaagcccagacactctggtgtctcttgattacaatcaacaaccttcccttgacccacactgtcctcctgccatagccctgtttctggctgtctttaagaacttagaaacattattttcagtggctatctccacttccttgccttcaattcccacataccattgaaattgatctttaaaaggtcaccaataactttgtgaaccctgaaagagccaatccttcttgatggatcccaagttactaactgggcctaaattcaaagtaggacctagcagccatttgctgactagggtcacacacacattctgcgttcctggaaagcccccactctcacttaactctgggatggtttcacagctatctgttcctgtttatgycgccagaatcaacccatcgactgtgacctgcatcgaccaatctgaactcagcaagtattaaccaatcagaactaagcaagtgtgccttcctcatttgcataagtggaccaaagtgggaacctgggcaggaagttctctacaaaagacgacctctttctttgttctctttgttccctggaatgcacctttgtacagaaggctgcattgccctggtttacaaactgctggaacaaagtttttttccttttttaaaaagaaaacctgggccaggtgtggtggctcacgcctttaatcccagcactttgggaggccgaggcaggtggatcacgaggcacgcggatcatgaggtcaggagttcgagatcagcctggccagcatagtgaaaccccgtctcttttcaaaaatacaaaaattaggctaggtgcggtggctcacgcctgtaatcccaacactttgggaggctgaggcgagaggatcacctgatgtctggagatccataccagcctggccaacatggagaaaccccatctctactaaaagtacaaaattagccgggcgtggtggcacatgcctgtaatcccagctactcgggaggctgaggcagaagaatcacttgaacccgggaggtggaggttgcggtgagccgagattgcgccattgcactccagcytgggcgacaagagcataacttcgtctcaaaaaaaaaaaaaaaattagctgggcatggtggcgtgcacctgtagttccagctacccaggaggctgaggcaggagaatcgcttgaacccgggaggtggagattgtggtgagccgatatcacgccactgcactccagcctgggcagcagagcaagactccgtctcaaaacaaacaaaaaaaaagaaaacccttttcggtggacttgctgacaatctcagtgccatatctggttcccatctctctgtcctcgtccttctcagcctctcagcagcatctgatgtggtttattctccccctggattctctratgccactcacatccgcttctcctcccactgcactgactgctccccctcagcctcctctgctgcttcgcccctggagagcccccagcacctgctatctggtcttaacccttcactccctatattggtactctctctttggatgaactaacccaggttcatgtttcaacactaattatgtgctgacgatttccaaattacatctccagcactgacccttccctaagcttaggaatcttatatcctgctgctgattagacgtctctccttggtgactgacggcccrttcaaactcagcaagtgtgaaaaggagctcatggctccacccccatacttcaccctgctccccgcagacatttattgagatgataaatggccacacccaattgctcagaccaaaatcctaggagcctcacttccctgttactccatcaacctctgcctgttacacacgcacatcaaatctacccactcccggccgggcacggtggctcacacctgtaatcccagcgctttgggaggccgaggcggatggatcactggaggtcaggagttcaagacagcctggccaacgtggcgaaaccccaggtctactaaaaatacaaaaattggcagagagtggtggcgtgcacctatartcccagctactcaggaggctgaggcaggagaatcgcttgaacccaggmggcagaagtaagggaggagaccacccctcatattgtcttatgcccaatttctgcttccaaataaagaagtaaaaactaaaaggcagaaataaaatccacaggcagacagcccggcgccgcgccctgggcctggttaaagatcaatccttgacctaaccggttatgttatctatagatttcagacattgtatggaaaagcattgtgaaaatccctgtcctgttctgttgcgttctgattaccggtgcatgcagcccccagtcacgtaccccctgcttgctcaatcgatcacgaccctctcacacagacccccttagggttgtaagcccttaaaagggacaggaattgctcactcagagagctcggtttttggagacgtgagtctgccgatgctccccactaaataaagccctttccttctacaattcggtgtctgaggggttcttgtctgcggctcgtcctgctacagagtgaactggcaggaactcctcccggtgcctgggcctcagtttccccactgtacgtggaagatgagccgctgtgaggctgagcaaggagcagcccaaggcgggaaaggctcgagagtccaggacgcaggcgagcgacctagcccggctctcactagccccaccgcccagtgcccccagctcagctgccctaccrggtgctacacacacagcggccccccagttcccttccggcgttcgcatctcycatccccatcccggatcttggggaggtcctcggcttgccccagtcaaactcgaggtcgatgaccccggatgccgctggctaaggcggcggcccaagtcccgtgcgggtgaaccgcccaggctgcgcggaaccagaggcagggatccggtttccagccggttgtggagagacgagcgcttccggggactggagcgtgcgtgctgaggtatgcgcaacgcgtgcggggtctcttccggagtcttttmctggacggggtccctgcggtgggtgtgtttcggcctggcctgggcaggcgcttgtgctgccagggcgccgggcccggggaggccggggtctcgggtggccgccggcccakgcgctggacggcagcaggatggggaaggcgaaggtccccgcctccaagcgcgccccgagcagccccgtggctaagccgggtcctgtcaagacgctcactcggaagaaaaacaagaagaaaaaaaggttttggaaaagcaaggcgcgggaagtaagcaagaagccagcaagcggccccggtgctgtggtgcgacctccaaaggcaccagaagacttttctcaaaactggaaggcgctgcaagaggtgaggcttgagggggcccgggcggagcgctgcgcagctcattcccgcagaacgcgacggagggaaagacttgggtagccccaaaagacctgtaaaggcagatttgaatcgaaatcttgtaaacagcttttcacaagaaaggtggcctgttgagggaggtctcgaacttgtttgcttgaaagaaattgatgaaagaattatttcaagtacaaaaaagcaaagataaacccttgtaccttttgcataatgaactaactagaatggattttacaaagagaaatttagcttaaaatcccgaaaccaggccgggcgcggggcctcacgcctgtgatcccagcactttgggaggccgaggcgggcagatcccctgaggtcaagagttcaagaccagcccggccaacatggtgaaaccccgtgtctactaaaaaagtacaaaaaatattagccgggcgtgatggcgcgcgccggtagtcgcagctactcggggagcctgaggcagaagaatcgcttgaacccgggaggcagaggcagtagtaagccgaaatcgcgccactgcactccagcctgggcgacagagcgagactccatctcaaacaacaacaacgaaagaacacactggtctgtgtagcaagacagggagaaaraagattcctgtgtagaagtgaaaagcagatagcagacatgtgatggggttctagcgacacttacggtcttgaagtaaatactaattgagctcctaaaaatgtgcactctgccatgtgctctatgccatgygtgttgcaatccccacaataagactgtgaggtggacacttycatcatckctattgtacagatgaggaaataggctggaaragtttaaatagatcatctaagattgcggctgggaaccaggtggctgactctggagtccatgcttttaaggctgtgttgtacctgctgtctccctagtgacctgcacttctgtagaggttgcctgctctctccyagacactcttccacgtgcgtcactcatacattcttaccacatcccttggagctcccttggagctacctcctgttaggatcatagctcactgctgcctgggctccagtgattctcctgcctcagcctcccgagtagcccacacgtgtaatcccagcactttgggaggcccaggcaggaggatcacttgagctcaggagttcaagtccagcctgggcaacatggtgagattccatctctaaataaaagtaaaaagtagtttttttaaaaaagaaatgtgatccccagtggtggagatggggcccataggaggtattgggtcatgggggtagatccctcwtgaatgacttggtgccctcccctcagtaacgagtaagttctcactctgctggttcatttgagagctggttgtttaaaaagagcctagcaccttttttgcttgctctctcaccacgcaacacacctgctcccccttcaccttacaccatgatgggaagcttccttcggcctcaccagaagcagatgctggcaccatgcttcttgtacaacctgcaaaaccatgagctacataaaygttttttctttataaattaccaaacacaggtattcctttatagcagtgcacaatgaactaatacagatggggtttcactttgttgcccaggctggtcttcaactcctgacctcaagcaatcctcccacctcagcctccccgagygcttcttgaacctcctaatactctgcacagtatctcagtgcagacattcctgtcttaacacacaggaccagtcaaattcccgtgggcagccccagggttctgtgggatttcttgaacaccaactcttcttccttctcccaagaaagaaaagcaaaataagtgaatggaagggatgtgtgctatagggaaactttggagtgttttctaattcatccaagaaagtcagcccttcagttctttacctatcacagaacaggtaagtagcacccgcctcatcatcgcactgtggtggcgcccactcccactggggatttgaacacagggaggaagctgggctctaagactacaggagcctctgcttgggtgacagccaaggtgtgtggctgctagcagttcttcagccactccagtttgacagaagcttttcttttcatttatgacaccccccaccttcctgagatcttcacagcagtagcaaaccagggaatcttgtaaaaaaaaaaaaagcgatttctgtgtagcaggatgttggcccaagctgtgagggaagttaactccaaaattctttctagataagctgaaaagggaagtggtctgtggtgtccagccactcaacaggtacccaaggtgtagaatgagtttgacattttgtatgcatgaaggagcaggtgcaaaatgcattataataagataagcaaagaaacagcatttcaccacaagtgacccatgagaatgaaaaagagctttttccaaaccgtttgaaaatgaatttcagtgatgcggatgggaattgtatagatgtgtttggtgtatatgtgtgtatatacatacacacgtaagttttttcaatctgctgtgtgtaatttccaaattcaaatgcagcatgtattttattttgggtcccagtggctgctgaaacaaaaatctcaggccccagaaaagcctcttgtcatctctcagatgggttccaaaaagaagcccaaaattatccagcaaaacaaaaaagagacctcgcctcaagtgaagggagaggagatgccggcaggaaaagaccaggaggccagcaggggctctgttccttcaggttccaagatggacaggarggcgccagtacctcgcaccaaggccagtggaacagagcacaataagaaaggaaccaaggaaaggacaaatggtgatattgttccagaacgaggggacatcgagcataagaagcggaaagctaaggaggcagccccagccccacccaccgagtaagtatgggccacctcaccactgagaaccgaggcacagcgacttcaccaaggcctgtctccttatggaggctggtggcctcaccgcagtctctccatcactttaccctgatgtcgtctgttcctttgtttactcgctgttacttgttttcccctagagtgtgcgcatgataaggcagggcctgcttcttccgagcgttgagcagagctcagcatttagtgggtgccagtacacgtgtgtggaaggaaagcgtgctgaagccagaaagacccaagtatgaggcctgtccctgcttctcgccagttgggtggtttggggcaagtttctgacgtcctctgtgccttgtggtagkcatggtggcatcataaggagattgtgaggttggcactcttggctcagtgcctggtgattacttcaaccctgtgatggagccaggtgtggtggytgttgcctgtgatcccagctccttgggaggccaaggtgggaggatcacttgatcccaggaggttgaggctgcagtgagctgtgattgcactactgcctccagccygggtgacggagcaagactctcaaaaaaacaagtgaaaasaataaaccctgtgctggccacccacgtggggtggaccgggagtcagtggccttctctgaatggttcagctggaggtgaygtgttcataagttacagctggcttcatgttgcctgggtgttcaggacacagtcgctgatggctgaggaatgagccatttgggggcctccctgtgttgtgctaggcaggctgtctgggatagagttcagtgaggtgggcctgctcctccctcttgaggcttattgtcaagtgcagtagacagactgtaaactgcagctgttgattaagtgtggtcaggataaatctagtgaggagaaggtattgggygcctggaacaagagggacgtgtccattcagtggggccrggaatggcttttctaaggamatgacatttaaccttagcccaagagacagattccccaggcaggtgttaygtgcctgtgtgagcttcctagtacggagggcaaggggttctgtgtttccatcwtacaggcattctgtctgtctgtttcctaagtgttcaataatgaacgtgttaccttcataattaaaatgttagcactcattacacttgggtggtgggttatgtgtttctgttttatattctttgtgtttgtctgtgttcctaaatcttgaataatgagtgtattttctaattaaaaagaaaagagatgaggccaggtgctgtgactcacacctgtaatcccagctctttgggaggccgaggcaggtggatcacttgaggtcaggagttcaagaccagcctggccaacatgacgaaaccccgtatctactgaaaatacaaaaaattagccaggcgtggcagtgggcgcctgtaaaatcccagctactagggaggctgagacaagagaatcacttgaacctgggaggcaaaggttgcagtgagccaagatcatgccactgcactccaggttgggtgacccagtgagactccatctcaaaaaaaaaaggaaaatgccaagatgatcaaaatagcagaagcagcagggccagcagtcggggtgtctggggccagcctgtgggagaggcaggctgtgccatcgctccactcacctgcacagtcagccccacagccccaccccaccagttgcactagggtcttctggtgatcagcctgttatctttgccttttagggaagacatctggtttgacgacgtggacccagcggatatcgaagctgccataggtccagaggcggccaagatagcgaggaaacagttgggtcagagcgagggcagcgtcagcctcagcctcgtgaaagagcaggccttcggcgggtacgctggtctcagggagtgggrtctgctggggatgcttagcygtggagggcggggcttcttcaaggaagaggatgctttcctctccctgaggtgaatgargcaagcacctcccagggtcctgctaagaaccaggaccacacagagcttgtcacgtgggtgcaaatgagtgaggggcagagagcttttctctgctgacacttagtccatggatccctggggctctgacctggwgccctgtggcctgccgtgtttattaaactacagcctttggttacccttcagcctgacaagagccttagccttggactgtgagatggtgggcgtgggccctaagggggaggagagcatggccgcccgtgtgtccatcgtgaaccagtatgggaagtgcgtttatgacaagtacgtcaaaccarcygagcccgtgacggactataggacagcggtcagtgggattcggcctgagaacctcaagcagggtatgtcatccacagctcaggaacttagaagggaaagyagtaactggattcgttttctcccttttgttcccttttctgtctgagaccactcactgcagctggttttgatgcgtcttgtctccttttggggcgatgggttttaaaatacaaaaggcatccttagacggctttacacccatttatgccttgcacttcattgcctcctgtccgctgacttcaagaccaggccagtagctgggcacggtggctcatgcctgtagtcccagctactcaggaggctgaggagggaggattgcttgaacccaggagttcaagtccagcctggacaacatagcgagacctcatttctaaaaaaaattattatttttttttgagatggagttttgctcttgttgcccaggctgaagtgcaatggcacaatctgggctcactgcaacctccgcctcctgggttcaagcgattctcctgcctcagcctcccgagtagctgggattacaggcatatgccaccacacccgactaattttktattttaagtagagacagggtttctccacattggtcaggctggtcttgaactcccgaactcaggtgatccgcctgcctccgcctcccaaagtgctggaattacaggcatgacccactgcacctggccttctaaaaaatatttttaaaaaattagctggtcccacttggctcgggccacccttggtctaatcasccctgttcggggggtacaagtggggttggtggtggggtggtccccagaagcaggcaaggctgcctctggagcccagggcctagggcaacacatctctrcccatttttgtgggggcagttttgtttttatttccatttgggaaattgtcaagtaaatcatgaggttgaataggcagaaccrcgctgccaggcggctctaaaagtttctcagtgcctacactcaacatatgctctcctccagccatgagccgactttgcagactgtgtggagcactttattcctctcctcagaggtggttctcgcagccacccctgccaggggcccacaaggcacttctcccaggggggtgggtggatgtggtggcttcgagtcaccctccgtagtggcattgcaggcctgaccatttgtcttaggtctgaccaggggtaggagcggggctgcctcctcacagaatgatggtgatgtgtgtgttgcaaaaaaccgcttctttgtgttgattttccaggagaagagcttgaagttgttcagaaggaagtggcagagatgctgaagggcagaattctagtggggcacgctctgcataatgacctaaaggtactgggctctctcctggggactcagcctgcccctgctccgtgggtgttacactcacgcccttgctgtgttggggagttttaacaatgtgtgggtttgtgctctatgttgggaatactttggtaataatatcagataccgcgtgctgagttcttactgtgttttaggagccatgccaggctcttgttttgagagcccccagcgaaactggggtacccataccagagcagctggcaaccccgccctaatgagaaatgaaggtgctgataccccttttacctggaggaaggcctaatgtccagttgtcccatccgtgaccagggtccctccacaggaaacaagtttatcctggcagatgccctgtggcccatgttcaggttacgcttgcctaaccatcaccctggccctgggagcttgcctttgccttcttyctggcgtcccgaggaaaatcccgcctggggcagcccctggttcttcagatggaaagtgcaaattcagacaccaccaccgtgggaaacaagttcaaagacatatacagaccctgggcagggaaggcgtcatgggtggggagggcagcctgccatctcctggtcacccgaggcaggaatgaagagtcaggcagagcgagtacgtgtgtatttacaggagaacagggtgggggtcactttgagtttatgggcaaatgcctggatgttggtttaaaggacacagtgggaacagyggggaggccagtctgctagatgggagagacacttaagttgtcacctctgcccaccggcttgaagcacttgrgtgtggtgaggaacttgaagccgttcagaaggaagtgacagagatgctaatgttcaggcagcagcctttgctatggtgctcccgtgacggcactgtagagatcccttgaatccattgaagatgcyggaggtgttcatgcttgtttacagagggtgaaactgaggtgagaacycccygggcagtgtcctcacagaaaggtcttctgtgtgctcctgctgtaccccctcagagactgctgccgtggggactcgtccttccctcctgactctgactccatccctggcaccttgcgcagcacatgttcaagtctttcttgaagatgatgctaaggaccagacacagtggcttatgcctgtaatcgcagctttttgggaggctgaggctggaggattgcttgaggccgggagttagagaccagcctgagtaacayaggggagaccccatctctataaaaaattttaaaattagccaggtgtggtggcgtgtgcctgttgtcccagctactcaggagactggggtaggaggatcagttgagcccaggaggttaaggctgcagtgagccatgattaccctatagcactgcagcccaggtgacagagtgagatcctatcaaaaaacaaaacaaaacaaaaaattgcatgctaagattgcaagatgagctgttaaaatgtgttatttgcaacttcctgatgtgtagaaccaactcaaaatacaagtataatataggaataagttggttgctggttaactgttgactgtttttctcctacttccttgatttcaagattttgtttttattgtctctgactgttgggcatcagcttaagtcagtgcrataaatttccttctggagttgaaattcatatcagtgccttgtttccatgtgtgtgtgacacacttggattccctacaagatgttacttgcagggcagccgcgttggctcacacctgtaatcccagcactttgggaggccgaggcgggtggatcacctgaggtcaggagttcgagaccagcctggccaacatggcaaaaccctgtctctactaaaaaatacaaaaattagccaggcatggtggcgggcacttgtaatcccagctactcgggaggctgaggcaggagaatcacttgaaacctggggtcggaggttgcagtcagcaaagattgagccactgcattccagcctgsgtgacagagcaagactctgtcacacacacacacacacacacacacacacacacacacacacacacacamacaaagatgttacttgcaaaaggtggcggggggagggggttctgctactacaaaccaaaaatgaaaatgattatcattatattttatttttctaggtactatttcttgatcatccaaaaaagaagattcgggacacacagaaatataaacctttcaagartcaagtaaaggtacttagaatgagtgtgactcaagatactgtatttctgttttgctggtcacttcattgtttctggtcactggtggctgacttgttggttaaagggtttttgttttttcttttaacctttaaaactagaaggaatgtttaaaaatagagttctgctaattgctgaccttaaaaatgattgcaacggagggcaagttatttccactctaacctctgaaacagggtcactgactaagggcctggtaccactgtcgtatctgctctagagggtgccaagggcagagccgttcttcatccttttttttttttttagacagggtcttgctctgtcacccaggctggagtgcaatggcataatcttggctsactgtaactgccacctcccaggctcaggcaatccttccaccttagcctctgaagtagctgggaytgcaggcatatgccaccacccctggctaatttttttatttttatttttttagagatagggtcttgctgtgttgccctggctattctcaaactcctgggttcaagtgatctgccctcgttggcctcctaagtgctgagattacaggtgtgaaccaccatgcctggccagagctgtccctcttgaaataagcagggaggcctcaagatgggagatggggatgctgactcctcccctggccctctccttttattggctgataggggtgtatcaccagcccatcatgctataaatggcagctggtggctaccaccctaagtgccatgagcacctctccactgagaggcaaactgtaggtcrcttgggtgaggttcagtagccaaccgctccctgcttggtggggtgaccctctttgggccgagcctgcagaggcccccacccgcctcttccccctttgcagagtggaaggccgtctctgagactactttcagagaagatccttgggctccaggtccagcaggcggagcactgttcagtaagtgtgtcctgtggggtagttcatggggtttggggcggtttcccacctggaaccagacatgagtcacctgacacagacatgggggaggtggggcttgggcacctacttatcctacgaggctattggtcaaaaaaaaaaaatggtagagcggagttacggaattttggttaaattctaaatatgcacatttaacgaatttaacacttaacacaaaagtactgcattctcgttatttggagaaaaagttgccaaataattacaaagggtccccccacccccgcagccctccagccctgccctgcccggcccyrctgagcagctggctctgcctctgtggagcagtcaccccctgccaacgtggcctcagtgctttgggccctttttgcccatctgcttggtccttgtgcccctgtgcccagcrcccaacctgccatcaccctgcactcagagacctaaaaaggcagcgtgtttgttgcttctcctctttgggtttccctttcttctcctgggaggggtgtctgagtcacagaagtgtggggaccatcaggtcgttgctccctctgcttctcttgtgtcctccctccccgtcctggtgacatctcgtggccaggtccatgtctcactcagtacatctgtagcagagtggctagtgggagggctcagtcattgtggggttgactgtgggctgcggctatgcctcgtcacctgctgggatgtttcatgtcgtctagattcaggatgcccaggcagcaatgaggctgtacrtcatggtgaagaaggagtgggagagcatggcccgagacaggcgccccctgctgactgctccagaccactgcagtgacgacgcctagcagtcctgccctgctgctgctgccgccccgctacagaggcaatgtgaccagtcacagggacagatcacatctccccagagtggcaactctggtgaaaccttttcagaatcatggcagaggggcgtggcgtggtgctactgagaaggtcctccttcctcttgactttgtggtctgaaacctggtcttactgtccatgtgtgtttgggcccggatggtcagggtggggagcagggackgcyatgggcacgcctggccacgctttaccgactgctgaccccctgggcmaggtgaggttggggcctgtgggccgccagtccatacggtgctgtcacygcccatcttcggtgacaccctggggtgaggtgctcagcaccttcctctcgaggagccacattttcctcctttgtgttaggggacataacaagctctgctgggcttgagggacccagaccaggtgtctgcagtcagctcctgagacacagctggccggcacaacaggtgttacatcaggggtttcctgtggccgtttgractttgagcatttatctaaattaaattggcccagggttggctggtgggtcacccagcagaggcttctccccatagcacgaggatgtgttgcctgggcacggtgactgcggttattcctggaggtcrgcagacatgccaaccttgggctatttgagctggagaagctatgtgatgctagccggtggctttctgggctaggccccagtttgaggctcccctgggaactagagccaggaacagccagtggcactgacaaggggacggagtccaaggcgttattgggccacctgacagctggacagaaraggggcagacacaccraggatgcgatttaaaataaatgcagatgtttacttggaatggagcctgtggaggctcagtgttgactctcatctagaatggtctggaaggactgctctgtccaggggcgaggtctatagagackgcagaattaagtatcccactggccagtcacagcctcttgccagaaatgattaaggcagaaactggccttgggcctctttattagtcacctaagaggagtgtgagrtgcgcattctggtgctggatgacccttccccccaccccaagggaaacagtggcccatggaaaggaaggacagggagagggcacacgtggagggaggggcctgtggggtatctgtcttctcccccrcatcagggctgagctgcttccccacccagkgggctgggagaggtggctgcctccagcctcaagagcactttttccrcgcaagaaaccagttcctggaaggaggaagcaggcaagtcagttttcgtggacagtccccgggtccaggagcagttactcatgtgactcaatccagcagtcatggacaggaaactctttggagaggtctgattacccctcccgtttaagattgattttggcccagtcatagagatgggataataggcaggcaggagagcagtcttgaaaactatacacgtggagatcaaggtcagttccatacaaacatctattccagtcccccagacgtggtgcaccccagctgggggcttccacctggagggaggcctggtttgctgaaggcgctgctgtcactcaccaggctggaggtgaagcgctccttgatctcytggagcagggccttcatactactggacaccagctccggcaggatctcctctgcaggtggagcaggaaggtcctgaggccagaryccttcctgtgccccttgccagragccccagaaggatgagagtgggtcrcattcccccttgggcttggcatgcacagagccaccttgcagttccggagccccaagcgtcaccctcagccaggacaacccctggtgctcagaagatgccaaatgagtgggaagtttaagtgggccgagaagtggggttgagcccaccttccatgtgctccttccctgtcagttatagggggagcggggcacccctgaccgctgggctctagggagtgtgaggygagaaggggttctcaccataggaagccaggtggaccagcagcatgcccacgttctccaccacctccgggtcgtccctgtggagctggtaggtctccttgatgaggctgaggccactgccgccctcctcctgcaccaccaccttgaaggccgccagctctgggggatgggtgggagtgggttcattccctgctttcccctgaaagggaagagccttctgcccaggacgggatgggaccccagagctcacacaggggcctgggacaggacaagagacgggacccaggaggccccatcagcttgggcggaccagtaggctggcatgacctgaacaggaccatgcaagaacagaggaggcagcccccccagagccaaaggggtcgttgtcactctggggaagatyaggtagtacagaggtcaagaccatgagcccggagttgccaggcaccagctagtgtcttggccaggcccaggatgctctctgaaggactgtgctktgggccgagcgtcggttgtgctgtgctcagcgctgggcccagcctgtctagctgagtaacaggcagggtttgtgttgtggggaattggagacactgtttgcagagctgttttgatcagtcacggtgtgcctgcatgttaggaaacctgtgcagatgtgatgtgtttatggacagagagagggtcacagggtagcataacgcagagacaagagtttatcaagtgtgcgtgaaagtcttgatggtgatttctggatgactggacttcagatcgtttttaatttcttttcctttttgatttgttgcttctgttttttggtttgtggcacctggcagatgtaactgatgggggctgattcttgcccccacctctaggtggcagcctcgtcctgtccccaggctcacctgacaccttcaccaggctggccagtcccyggtaggcattgttcaccagcagggctctgtcctggcacagccggatgctttgcaggagcagcgccaccacttgttcaaactgctgctccttgatgcagcctgcagaaaggggccgggctgccttgtgcctgctgtgccatgaggcccacccctcccagccccaggggcccagggcgcccayccagctcacmcagcagggacagcagccagaagactccgcagctggcttcygccatttccccatcygcagggtaggtggccaacacctggctgatgaggtccgggaccttctccaagggggccttgttcacaatgatacctggaacgaggacagggatggaaggggacacccaggccttgggtgtgtgcaggggggccttcccatcccccatctgctgccttcctccagctaacgacaacagcagaaatggggtgggaaaggtcaactgtcctcagagacgggtgcaggggttagcccaggagaggcttggagaatcccacactttgggtgctggcagggttcttgggtttcccgggctttccgtggtttggagctctctttttcctggggcgctggagtgccaagatggggtctagaggagaggaagcagcacaggccagggggccccctactgtgaatcaaaaatcaaaacaaacagggcatccagcaccaccgctgccctctggaaccaggactgcccggaaaatcccaggacatttccctgggcaggaggcacttaaaactgaggggtctgcccactgggcaagaagtcctgaaacccggcctctgccagaaggcctttctcccctgccttttctctctctgctccttgattttcttctgttggagttggaagctctcagaagagcctttcccggactatggctgttgtgttttagggacaggacatggaggtcctcgaaggctctcaggggcagttagggaggggctgggggagggctgccagccccggtgggacagcaggaggagggcccctcaccgtccagcaggagggcccagagcaggcccaggccgctggcgcagacgtccctgctttygagggagctgttgaggtgctccaggatgtgctccagcagcccagcrttctgcagctcctctgacagtgactctgactctgtgggtgagccagaatgagggccccagggcccctccctccaggaagccttcctgcctctgttgtccttgggcactgcagtcccatttgacctgcaatcctaggtgcctgctctgggccaagtcgtgtgcactcaayggagccctgaacaggaggatgtgggactggccccagaggagtctgtccatctcgtggrccaccagtcccaatagctgccatcccactaccaggctgggtctgacctctgtagcttcccatccagggggcctgaccctgcctcctgggctcacagagccagcctgtgccttccaggatggaaccatgacggggccctatcccggtaggatgaactgacatccattttgcctgagggttccagttgacatctattcctagtgcctcctttcactccccaaagtgagatcagccatgtatcatcagttatccagtctgtgcagtaaagagggtgctggggcccagaccccagccctgaaccctgctgcatggactcctggcaactgtccttaggctctctygaggcccagcttcctgttggggagaacagtgcccacccgatttgtgggtgaaggtgtgagcgctctgtatggccctctccttcccacagtcctggctgghggcttcggaagcccactgggccctatggaatggagacacacagggcayttgasccccagcctcccagaaggggcaggaagtgtgggaaagagatgtcattggtgtgaagcccacagctgcgcctagcatgtctgtagagggaaccagtgacttcaagagtggaagcttgtcatcaagatggaaaaggatgcgaccagyatttggggtggccaaatgaagacggccaaatgccaccatgtatctcaggaggaggcccagcactgtcctgtccaacccacctataccccaaaccaacccttccaagacccctgggaagggctgtcctggagcgtgggtggggcaggaggtggctggcagacacaccctgggttgtggtgatggctagcaggctgtagaccatgacaagaagtggctcctcctcggggtggctctgaagagcactcagcagggtggaggtgatggcttggttgcagggagccttggcttccgggtggtgcaccagcgctgctcaagccagaggaagacgcctggggttagccccacagctcaggcatggggccagacacacaaggctcacaggctgggggatagcatctccactttgcatgaaggaaaccgaggtctgccttgttctgacccagagcaggcctccatgaatccctgtggcctaatggagtgaaggaccggaagggagccctgcccggccaggccacgcatcctggtccctgggagccrgtcaggcagcactgaacacaatttcaacattgcatggaactccaaacttccaacagtgaaactagaaaggtggccgcgcgcggtggctcatgcctataatcccagcactttgggaggctgaggcgggtggatcacgatgtcaggagttcaagaccagcctgactaacatggtgaaacccgtctctactaaaaatacaaaaattagccaggcgtggtggtgggtgcctgtagtcccagctaytcaggaggctgaggcaggagaatcgcttgaacctgggaggtggaggttgcattgagccgagagtgcgccactgcactcgcctgggtgacgagcaaaactccatctcaaaaaaaaaaaaaaaagtaactaaatactttttgtttcaaaaaaaatcatcaaagctaattcaactcttttaacaacccatgtctctcataggaggctcratctctcagctccaacctcttccatcaggacagtgaaatgaactcagcactgccctcctaccagccctcttcagaggacacaacccatcctccctgagggtsactccagaggacctcgtgtccagctcctcgcttcatagctgggaaaactggcaggatcatcaggaacttgtccagggccacggagcaggcaaaaggcaggcctgggtgggatccgcgtctccaagctcctggcctgtgccctctctgccatccaggatggggtctgatgggcacaggatrgcatggactctccagtggttagatgccaaccaggtggtgggggcagagctaggccaccaggagtgtctcctggcctggccctggcatccaccttggcctagaagatggcctagaaggtgcagcagcagggagcagggcatggcttcccctaacccacccggcccggtgcccaccttggcccaggaggcacagctgcaggaagcagcgcacagcctccccgaccccatctggcctggtttggcacccaccttggcccaggaggtgcagcagcagggagcaggcacacagctggacatcgaggaccctgtcatgtagctccatggtcgtgaccaccacctccaccagctccgggggccacggcagacctggcagggcgggcggcacaggggagactcattttgggccagatcgggggcatatagacccgaccagggcccccagaggctggtaggagcctgcagggccctakgtgggtgaatagaagggggaaggacaatgaggattagcgctaggtccatggagtgcatgccatgtctgccacgggtgtcctgctctgtgctgcccacagccctgtgaagtggcccctcccaaggctgccctccatatgcagatgaggaacctggggtcagcaggatgaaagcacctgctcttcagcagtttgaacctagccagtctattccagagcccttggctgcaactgccctgagggtggacatgggt

SEQ ID NO: 13479 - DNA, 54946 bp, Homo sapiens
gttatttttcccttcccttcatacatttatgtccagtacctgtggaccctccttgtgaactcttctctaatttctcacagaccaggaagggtttggaatataactggggctcagctatcaagggcctaagcataataaagtaaatgttcagttttacattttaaactcattttactaagaagaggaattcacatgcctatagatgtaaaggtatgaacaacaggtgactttggtttaccctggaatatctgggaatgctaatagcctcaataacggctcargagacttgtgaaagatacaatttaggagaatctaatgcatttcttctctcaaggctctcttcttcccccattttcccactggccacccatgcaggtagaagtaatgagtaatgctctcaaacactcttttcatattacaaatgtactcaagaacctgcagggactcctgttgtttgtgagctcaacaatgtgccacatctggccacaagctcttcacctcttctttytcagtcyatccacmtaagttctagttacacttctcctcagccaaacccagatgctagctctctcacactcaagcttgtgctgccttcaatgtgtgacaacatactaatctggaatggttttctacttccytctgtcaatgcatgtcctctgacctttcctcaaccaaaataaatgaaacccaacaacaccaaacttcactcttcacttaggaaagttcatgactgactaaggtactgtctatagtctcatgcaacttaycttgcatttgccccatcaaaatcctctctkcaccaccaytccatccagtggccctgggtggctgatcatcatggaatccattgcacccttgtcctctgctccaggctgggtttggccaatgggaggcactggcaggaggtcagagggtggtcatgtacctgcctctccacgtggggcttctggagcagctgtgcttctccytctgggagcacctcttctcagctggcctgcctcatgcatctgcaatccctcagacacccgtctgtgagaatatcttggattgttttattcacggttgtgctttctcctgttgcagtgaggactgggtatttcatgttctttctgagtccacccagagctaattggaatcaccatggygtctacgctgtataaayrccaaatgggaaaggggatctattgtcccttgagatttttctagtttggatcaaatcagtttctacaacagagattaatgggggtgaagtaaagtcaggacttactttcctagagactttggacaattttgaggggcaaagcttcctgagtttgtgmtttttaatatgtgagttaaaattttaagccattgaaaaacatataagcaaatattctaagaagataatatgtattctaagaagaatgaaccagaattctaagtctctaatgcaacaatagactaaatatctttacattcccatttacttggaaggactctgttttagttaagactaagctacctgggaaataaaaagaggacattggggctgatattctcacaaatgaaaggaacacaaagaacaaaacgggttctmtatccacacatayytccacttctctgagtaagtgacttgatgtcagagaatctcacaccagattataacaataagacttttaartgttcaggatgtttatgtttaaagcattagactgataagaaatctgatctatttcttgtatgactagatgtagtcactrcagtggaaaccaacatacgaaagagcaggcggcacattttcatcctgacccctcagatcactcacaayaaggagtttgcctacgarcaggaggttgccctgcactgtgccctcatccagaacgacgccaaggtgatacttattgagatggaggctctgagcgagctggacatgctgcaggctgaggcgcttcaggactccctcmrgcatcttatgaaagtacaggggaccatcaagtggagggaggaccacattgccawtaaaaggtccctgaattcyaaattctggaagcacgtgaggtaccaaatgcctgtgccaagcaaaattcccagaaaggcctctagtttgaytccctyggctgcccagaagcaatagtgcctgctgtgatgtgcaaaggcatctgagtttgaagctttcctgacttctcctagctggcttatgcccctgcactgaagtgtgaggagcaggaatattaaagggattcaggcctcaggtttcatctggtaactttccttccatttccctgcttctgggtggatgcaaaatggccagaaatttttctcctcaatcctccaccatcctccagccaccattttcttcccttttcccttttgcttgcctgtcttcactgtggtgtgggatgttttcactactcttttttcctctctctctgtcttgctttgtttctcctcattcttgtcaataatctgaatagcaaactaatcattcgagagtagattttcacgtcacttgaagaacattctgattccctcaggcagaatgtcagttgtaaatcttgttcccaacatgccagattttctttattttctatatatatataatattwtatatataatattatatataatattwtatatataattttatatawaaaatattatatataatattatatataatattttctatataaaatgtgtatataattatatataattatataaaatataatatagaatatctaataatgtataatatataacatataaaataatattatttaatatataatattttatatataatatttttatatataatataatatatattttatatataattattaattatataattaatatataatatatattttatacataattattaattatatataattaatatataatatatcttatacataattatcaattatatataattaatatataatatatattttatacataattattaattatatataattaatatataatatatcttatacataatatatataaatatattatatataatatatattatatataatattatatataatatatattatatatataaaatttatatataatattatatataatattatatattttatatacaatatgatatataatataatttatatattatatatatttatatataattattatataaattatataaatataaattatatatttatatataattattatataaatcattatataattattataattataatatataatataatataatattatatatamtatatagtattctatataaataatataacatatattttatatagaatattatatataatataatatatattttatatagaatattatatataatataatatayattttatatagaatattttatatatataatattatatatatgtatttgagacagagtctcctatgaacatacttgtggacttatgattttattttgacacttaagagtggtcatagggtaggtgcatatttaactttcagagaaacttatacattgtttcgcaaactaattgtactactttacattcccaccagttgtgtatgagagctctgctgcttcattgcctcaccaataattggtgttgtcaagtttctttatattttaayaattttcacaggtgttagatgaagatcaccatggtyttaacttgaagttccccgactmatgatgatgagcmcttttcatgttttcattggccattcgtatatattttttagtgaaggcaaaatattttgccttatttaaattgtatttctttttatattgttgatgtgtaggaattatttatgtattgtggrtgcaagttctttgccagatagatgtaaagtgagaatatttccagggttatctattcatttttaagtgatgtctttgtttagtagacatttttaattttggtgatgtccaattaatcaatgtgtcccaaatggctattkttttttgtgtcctagctaagaatttttttttttgcctgtccaagrgcatgatttatttatttattttttgcctgttcaagggtcttctctgtatttttatgaaatatttacggttctagcttttatgtttaggtccatggtctattgtgaattgatacttgtatatagaacaaggcaaggacaaagttcttttttctgctgctgcttcttctgtagaggtacccagctgttccagcaatgtttgtgaaagactgttttttccccactgaattgacatggtgctttgttaaaaaaatcaattgactagatatgtgtggatctattagtctactttctattttgtatgtttgtatgtttctgtgaatatcacattgccataattactattgccttattataaatcctcaagtcagtataagtctctcaactttgttcatctttgtcaagattgcccagacaggccgggcaggtggctcacccctgtaatttcaacamtttkggaggcygaaatgggyggatcacctgaggtcgagagttcaaaaccagcctgaccaacacggagaaacccygtstctactaaaaatacaaaagtagccaggcgtgatagtgcatgcctgtaatcccagctactcgggcggctgaggcaggagaatcgcttgaacccgggaggcggaggttgcagtgagccgagatcgcgtcattgcactcactccagcctgggcaagaagagsaaaactccgtctctgtccggacaatcctagattatttgcattttcatatgaattttagaaacagcttcttaatttctttgaaaaattttcctgggatttggattgaattgtattaaatatatagattctgtaatatatagagtctaaaaatatacagtgtggagaatagatgtcttaagtcttccaatccgtaaacgtggtatatccctttattacttagatgtytcatctctgttagcaatattttgtagttttcacaggagatatctcatatattatccaatgaatttatactttggtattttgatttttaaatgctatggtaaatggmatttttaacaaacttcacttttcaagtttccatctctaatatatagaattgctattkatttttatattccatgatcttgataaacttaatatttccagtagtttttttttttgtagatttcaaaagttggtctacatataattatgctctctgttaaaaccagtagttttaattmtttcttctcaatctttatgctttctaattttatttttatttcttcacttgttgcaaagcagttgtcccaggtgggagccaaaatccttatctcattactaatcttaggaaaaagtaaaatgtttcactattatgaggtcacctgtaggtttcttatagatgttctttatcagattaagaaagrtcatttctactctcggttttctgatcgttattaattcagaaagggtgttgaattttgccagatgcttttatttgcatttattgagataattacatatttttatttattatgtggtgaattatctaaattgggtaaaaagaattaaaatcattgtccaattgaacattttgcctgtcggctatgggtttcccttttcctttkgttaaataacagttctgccacaaaataaaaatctagaaacacacattcccctttggcctccttaaaaaaaattaaaacttcaacaattgcacccctctctattacttccctatagtgaactcccatccttctgggaaagcaaaaagcctggggcgcatttgtgtacttgagacgcggagcccctctcaccttcggcatcccccggggacccctcttccaccctcagccctcccctcytcttcctctgaagagccgggcggccgctgcggccagcggtcctccctcctggcatcctctgctgtgaaccgcggcctgcagggtgcttgcgagcggcccgggcgcgcccccttccggccccgcaggtcacccggctacagcccgggttttcccgggacccgcgccgcgcggctgggcaggaagcgccagacgcctggggcccacgccgtccgcgggaaaagggcaaggcgctgggttttccagcagcaacctttggaccccgcgatccagtagctccggtaactccacgcggggcgtctgggtggaggagccggtcctggagcacggctgcgaggagcacccggaccggagggtccccagaccgggacctccgagtcagggaggattctacgccagggagcgccccagactgagagcgccccagaccgctayactcccggacccggagcttcgcccgaccgcgggcagtgcccacctgcagcctccaccggccggggttagcagccaggagctgccagacgcctgacattcttctttctgttcctactttttttccttcttcttctttttttttttttttgtagccctctctgggtgccttatctctttaatcacacctctctttcactttccacggtagtcaggaggcggagatcgctgcttctcacctactttctgaacttggcctccgcagtcscgacctgrcgtgaaggaggagctgccgcccccgccccagcctcggggacgcctctctgaaggtaagggtgggctccgctgccacccgcatcccctccccaccccccagaggaagggaagaccaccatccggggagggattctcaaaacaagatcaattaagagagagagagagatagtgtgtgtgtgaatacgtgtgaataattgatgagacagcatcctgtctttctctgaaagtatagttttagaaattaagacatccccaattattttctggagaggtgagaacgactgaaataaatgataacaatagttgtcattttttaagtgcttactgtgtgcctgacactgtagaaaatttttagatatcttattttcacttaatcctcctaagggccacatgaaataggaactattattatgctttaataaaagggaggaggaattccgtcatttacccaagagtatccagctactaagtagtagatcccagatccacacctacagtttttctgattccagagcctttgtcttttttctgcccagccttgggaagttaaaatgcccagcaccttgcatcgcagttatcagacaaattaatgaggtgtcaattgcagccagatacagagatccaagattattgtattcatttcactgacttcccttgcttcattctcaagaccctttgcaaatactgattttgtgtcatacacagtgctgctattgggagcacacctctcaacctcagggccttggatgggctaggaggggtaaatttggggaattgggtttgtgcaggttctggggacagtgttttccctctccctgcacaaatatacatccaaaggctgagaactaaggctaaggcctaggaatgtggattgaaaaggcagggtctaaatcccagcacttgggaggctgaggtgggcggatcatgaggtcaggagatcgagaccatcctggctaacatggtgaaaccccgtctctactaaaaatacagaaaattagccaggcatggtggcatgcatctgtaatcccagctactcgggaggctgaggcaggagaatcccttgaacctgggaggcagaggttgcagtgagcrgagattgtgccactgcactccagcctgggcgacagagtgagactctatctcaaaaaaaaaaaagaaaaaaaagaaaaggcagggtccctgccttcagggacctcaccagagagtgggagctagtccaggagtgatggaaacacctgcagagtgatggagacgggcttggacataggcatgtgccatttggggctgttgcagttggagagcttccttgagaaggcaaataytgagccaagttgaaaggactctagggacctggcatctgggataagtggggagggtggcccaggtagcacaggcataggcagatttggggggawgcataaggctaacaacagacacttgtgtgacaaggactatgaggtggcattgattttcttggccttacagatgagaagccagattccacacaaattattttgtttgttagagtttaagcgtgtgtgtgtgtgtgtatgttatgccccamgatcattttctcctctttgcatttggttgttttatcatctcacagkctgagtaaaacgactatgcatggaacactgtagaagaaaaattatattaaaaaaaaactggtgttatgattttcatccaggcattttgtctcaggagttgctcgattgtatgtgttgctaatgagtgatttatattgaggcatctacattgattcatgtgtgtccttgtgaatagctgtaatctgaggctggccatttcacttcctcaaatctcaggttcctcattagaaagagctttgaaatggctctttccctgtacattatgtgtttctgtgaattacttttagagaaaggtcagtttctcagggtgggacccataaacaagggcaactgggcagagccagggrttcaggtgactgtttggaccctctggaagggctttttactgtgctgccttgggagacagagtggtcagcttggaactgaccttaagcctaggtcacccaatttttgaaggaaacttttttttttcatttagagaaaacttcatgcctttgggtgattaggtaagtttgtgactattcgttatgtgtgtgtacacacacgtacgtacatatgtacatgcacaaatatttaatatgtcttagacacaccaaatatatgcatttaagatgtattaaatgtactttcctragaatacaaataagtgccctacgtcggcggctctcttcctgactgtatgttagagtcacctgcggagttctgaggactcaagatgcccagtctgtcctccagaccactgggtggagcccgggcatcattatttttttccaaacttgggtgagagctggtggcctagacttcacattagttgctaaaacatactttccaagatatcatgcgttaaaaagcatttcaaaagtagattgtgcagatgtgccaatggatcagatgatcacctagattcaaaattatgtakattttatggatgtaattcattcaataattcagcaaataacaaagaaacaagcagacataaagtgaaaatatgacagttagtgataagtgctatgaatagaaaaactaaacatgggagggtagaggaacattggtgtgtgtgagcatgtgtgtgtgtgtgcgtgtgtgtgcatgtgcatgtttgcatttggaaaagcatgctgtgctagacttgcagtagagtgctcagggaggacctgtacattataagctagtgtcagcaaaccgtaggggaaatacaggattatttaattaacaatagagaagtaattagtaggtatttgaggaaagtaagtttagttactccctatcttcatgtcaatcaagaaaattaattgttggtggatgaaaaaagttaaatataaaaacaaaacaaaacaatactgagccataaaaatgaagaaactatgtaagcatctatttgaccaccaacaggaaaggatattctacacttaaaagcaatgaaaacatctcaaagcaaaagaatgatcggtttgactacatcaatataaaatttgtcatatattagcataacaaaagagagaaagtaaacaacaagttagacaaacatctgagaactggacaaaagacataaagagatggttcataaacatgaaaataaaatggctgataataagtgattaatatttgcctcatttatacccaaagaaatgcaaattcagaaaacaatgagataccatttttccattttggctgtctaattacattttaaaagtaaagctgctcagtgtgcttctgggtgtggtcgatagatgctgtcttgtgctattgagtgaragaatatgaatattgcaacacttctggaatgcagtttgtcagcatgcatctgtcaggtttcaatgtagtcttcaactcaatcactgtactgccatcgagtaacatccaggaaataataagaaatgtagacaaataataatagctaacatttaagcggtattaccattcaccagacacttgcaatagtaactcatttaactttcacatcagttccaggagatggtattattatccccttctatagataagaaaattgaggcacagaacaggcaagtcagttgcccacagtcggttagctggttgaaggtagaatggagattcaaatccacccaggctgccacctgagcccatcctgcaaaaaaactgagccatcctggcttacctgtgaagatggtcatgtgattatctcataatacatctggtaaatgataatatatccacatgaagtaatattaggtggcaattagaatggttttaacaaagagttttgtgacacaggaaaaatgctcattatgtaatattaggtggaaatgcaggatatgcaatcttttaaacatcttttattttttgagaaggagtcttgctctgtcacctaggctggagtgcagtgatgagatctcggctcactgcaagctccgcctcccggattcacaccattctcctgcctcatcctccttagtagctgggactacaggtgcctgccaacgtgcctggctaattttttgtatttttagtagagacggggtttcaccatgttagtcaggatggtctcagtctcctgacctcatgatccgcccatctcggcctcccaaagtgctgggattacaggcatgagccactgtkcccggccaaacatcttaattatgtgacaacatttataaaaagtacaagaaaacatgttaaaatattatacatgttgagattattttcttctttcagtcttcattttgtaaatctcctacattgagtgtaaattgctttggaaatcagaaaaactttaaaaagaaagaaacttaagagttayggaaaagcaaaaatattgatgttaaacataacaattaaaracccttaaaattcttacatgtgagacatttaatatttatattcttctatgcctattttattaatacttgctagagtatctgttacatttatcagaatatctctttttctggaaatgaattcattatttaatataamcttaatctgttaaattcacacataaaacttmartacattaaaaattttacatacacacatccacatttgcagaatggtgtgcaaataccagctaatttttgtatactgagatcttaatatgtttcatattgaaactcaragttaacttgtcagtttgctgagccrtctcctgataactttgtctcttggtagatattgaatattttttttaaagtggtgctttttataaggttacatcagtcttaatcagagtgacataaaggaaataacattttttattctatccaagataaaagaataggcagagttaataataaaatgtgtgtggaggtagtgggggaggtttcaaaccatagamccagtctaatttgattatgcacagttggtactttccattcatacttgtttctttggcctttacattattgattattatctcttggaaattccaccaaatatttggtgatttttccataaggatgtatgtgaatggtttggcagcttagccattaagctttatcctggattcaggcattgacaactctgtttttaggatggaagatgagtagttgttggtgagaggggcattattctgagctgagaagctgccatgcactcaggaagtctccataagccttagatggtttaatcactcaataattccagaaacaggccttcttatcatctccattttggtaatgaccaaataggctctaagacttgctcaagttttgcacagcttgtcaggactcaaactggagtggcagcccaggtttgtgtgtttctgaaaccagactctgccatcaggctgtgctccctgcactcaggatggtaaacaagggatatggtgttgtttatgcagtatttagactctgaatggtctccactgtgggggatccttcctccactgggctcaaagttgtaatcagaactccgaatgctaggttgcagtaggatcaaagttcaatgcagatcttagttccactgggacacagtcaatgtaaaggaggggtctggagtgtaggagrctgtcacttcatctctccatttccctaaagtaaactcatatgggcagccacagacacaygcgaacacatgcatacacacctatgcctcagtgacacatgttagtgagtgctggccatgtgctaggcatcgtgctggattttagtgatacagtgaagagcaaaatagacttagtgcctagaattatgaaagaattatgaaacctacgttctgaaggaggaagatggagttttaaaaattcaaccctaaatgaagatctcattacaattcaggaatgttttgatgtgaaaacacacacacacactctgttacatgggcagaactgccatacatagctcagcatgtcacagattgtttattcatagaatggtaatatttgtagcagtactattgttctgaactttggccttggaagcaggatttagtagaccaggcctgaaattcttcagactctgttgtatcagagaaataaattattagggatttcttccagaagaaaaacttcattgccttgaaattttattaattttatatggctgaaagttctragaattggttactatattaaggattataaaaatcttctaggttgtttttttaaaaatctgtgtgccagaagatttttaaacyttcataagataggmacacttttgtttgaaagctttggctgaatctgttttattctgttttccagagaagccatttgaagcagaatccaaaccatgaattgtagagaattaccsttgaccctttgggtgcttatatctgtaagcactgcaggtaagtgattatacatactctcaaacatatttcatgagtaattgaggaagaatgtcaaagtttttttttttatgtggtggctactgaagatgctgaatttattcagaaaagaaaagattctgcagtctgagttcatgtagtgagagcagagtgaaaaacttgcatcttgaaataaattacatttgtctgaggtgaaaatttatttcatgttatttgaaactgaggaggtggcagccatctttattattgggttttaggaagtttgaaacacactttctccttcctgagagggaggcaaagattcatctcattatttaggtaataatgagaaaagtaaacgacaaatatattagacagcttaaaaaaattagagtgagacagaatatacaaaaaagagactggctagaccaaggagctcaagtaggcttcatagtagatgtcaaatrccaattttaatttattagcagtgattgcctagagttttttttttttatttgagaaggattctgagacttcattctttagcgttccatgattgaatagcaaggcattccttaggctttgggggagaaagtgggagcacaaatattaatttgccttgatctattatctaggagagggaaacacatgggctcatttccctactttgataattactgctgaagagatagctgaattaagcttttggtactttcaaataacacaggtccaatctcagggtatatttacttacgtgaatccatttattattgagatccctgcaatggaaccctacccagatgataaaagaatgaggtagatcttcatttttttatatgtaatgatctgtcaaacaagtgagtggaaaagcaaggtacaggaaaatgtgtcatgagttccatgtcctgtggacatacactaatagccttactcctcattataatgagagcatgtttcaggcacagaaacagccatgcagccagttgtgcaaagttgccaagctcccagctgcctgccctgaagagcacttttcatgaatgtttcactctagggagacatgacaatkttctacaygtaggattcactgaacctagttgagtttaaatgacaaaatgctatgattgtccaaactcaagacagtttcaaacacagactttattccaaagggcattggttgttggcactgctgggttcttatactgtgtttatggaacaataggagtgcctattttggcacttggaactccacaaaccttgaattccacttatttatcccatcaaggaccatttccaacaagcattatggtaatcaacaaagcctctaatggtaaaccatgattagatatccaaagcttctagctgcctgaggaggggggtggtgtggastttcaattatcaacctcccacctctggagagtgtgtaattcacattaagtttcttcaaatggtaatacttccagagagcacatgtccatccaaacacagtcatatgtgtttatagaagctttttaagacaagcgaaaacctgaaaacctagaaataagccaatatccaacagacatttgtttaataaaccaawtccccaacatgcatccttttataaaatggataaattgcgaaatggtaacacgattagatactacattacaatgagaaaagaacacatcactgctacagcatgaatgcatttataacaatcatgtcaaaataacccagacataaaggagcacatattgtatagcctatgcattttattatattaactctaaaacaggaaaataaatgaactgttaatgactcaccagggttttgcatgtcrrttgaagctgacacccacatatacacatgtatcacaccttckatgttgaagtattagtataaaatagagattgtattgcaaccagaaaacatgaagttggtgctccttaactcttgtgttttgtggtagattcgacatccatgttttcaaagaatgtgtattagtccattctcatgctgctaataaaggcatacttgagactgggtaatttataaaggaaagagactttattgattcacagttctgtatggctggggaggcctcaggaagcttacaatcatagtrgaaggggaagaaaacatatccttcttcacatggtggcatcaaggrgaaggctgagcaaaaaggggaaaagccccttataaaaayatcagatcttatgagaactcactcactatcaggagcacagcatragggtaatcacccccatgattaaattaccttccaccaggtccctcctatgacacatggggcttatgggaactacaattcaagatgatttgggttggggtatagccaaatcatatcattccacccctggcctctcccaaatctcatgctctcacatttcaaaacacaatcatgcccttctaacagtcccccaaagtcttcactcattccagcattaactctaaaatccaagtccaaagtctcatctgagacaaggmaggtcccttcctatgagtcagtaaattcaagagcaatttagttacttcctagatacaatgggagtacaggcattgagtaaatacaccccttccaaatgggagaaattgactaaaacaaaggggctactggccccatgcaagttctaaatttaatagggcagtcattaaaccttaaagttccaaaatagtctccttcaactccatgtctcatatccaggtcacgctgctgcaagaggtaggatcccayggccttgggcagctrtgctcctgtggctttgcmgggtacatctttcttcctggtttctttcatgggctggtgttgagtttctgggctttttcaagtgcatggtgcaagctgtcagtgaatctatcatcctggggcctggaggatggtggctttcttctcttaactccactagctgtactccagtggggactctgtatgggagmcccaacaccacatttcccttccacactaccctagcaaagattctacatgagggttccacccctgcagcaaacttttgcctggacatccagcatttccatacatcctctgaaacctaggcgtaggttccyaaacctcaattcttgacttttgtgcacctgcagcctcaacaccatgtggaagstgccaaggtttggggcttgcaccctctgaagccacagcctgacctggtatcttggcctgttttagcaatggctggaggggtaggatgcagggcaccaaatccctaggctgcacacagaaagggaccctgggcccatcccaggaaatcattttttcctcttaggcctctgggcctgtkatgggagggtctstcatgaagatctctgacataccctagaggcatttttccccttgtcttggcaattaacatttgagtcctcatttcttatgcaaatttctgcaaccagctttaattccatgccccccattcccacgaacatggatttttctctcctaccacattctcaagctgtraattttccaaactcttatgctctgtcacctcttgaatgatttgctctttagaaatttcttcttccagataatcrtctctsaagttcaaagttccatagatctctaggacaagggcaaaatgcaactaatctctttgctaaacataacaagattcacttttgctccagctccccaaaagttcctcatctccatctgagaccacctcagcctggactttattgtccataacattatcagcattttggtyaaagccatttaacaagtctttaggaagttccaaacttttccatattttcttatcttcttcaaactgttccaactgttccaaackgccctccaaactgttccaacctctgcctgtatgcagttccaaagtcacttccacattttgtgtatctttacagtagcaccccacttctggtaccaatttactttattagtccattctcacactgctaataaaggcatacctgagaccaggtaatatataaaggagaaagatttaatggactcagttctgcagggctggggaggcctcaggaaacttacaaaagggggaaaagccccttacaaaaccatcagatctcatgagaactcactcactatcatgagaacagmatgagggtgactgcccccatgattaaattcaagatgaggtttggatggggacacagmcaaaccatatcagaatacttctatcacatcacttcctctttatgttgtggttaacaattttgagttaaaaccagactgctgctttgagaaacaaaccctgactatagagaaggcattcygtccatgtcctaagggaaatgtttcgttcagtttaaatactctcattctcaaaatgtggtaaaagtgcacccgagagtcactggagggtagattatgagaaagacccattaatgctgaacttgaagtaccacaagtgccgaaagaggggaacgagcacctaycctgggtagatgatggtcagatatatttccaaagccagagaatctgggtcaattgagaaagagggaaagtgacagatatgcaaatttggattgatattatattaatgaattcttgattatccacatggtgacctacagtaataataaatgtacacacactgtaagttacataggcacacttttaaccatccccacacttaccagggaatgttagataggcagggtgaatgcaaggtgagtgagatttctgatggtgcagagsaagaacgccaaggttgctagatttcttgttttcttttctactgagactcctcagcagggtatattttgaggtaggtatggcagcacyrtgacttctgtggctttccctatgaagaagttgtaatgtgtaatattttcttctaagaggtgacacaattatcagtcttctagctatggttggttaagttctgataccttcctgttggggagaaactgtcagaagttgtgttttcatctatgttctgaaagtgccttatcctttctagtgttggaaagattgacgcaaaaataaagaacccacaggaaattgacaccgagatttctcaggactttcttgctaaccttgcttcttcacctaatgcattaggagaccaaaaaaagttaccttgtcattttggtttttgtttttatttattttactttactaatcttytgaagaatcttgtacttcacgtccccacattactgtggttgaaggggaacctttctatctgaaacattgctcgtgttcacttgcacatgagattgaaacaaccaccaaaagctggtacaaaagcagtggatcacaggaacatgtggagctgaacccaaggagttcctcgagaattgctttgcatgattgtgttttggagttttggccagttgagttgaatgacacaggatcttactttttccaaatgaagtgagtaaccctttcttttcaaaatgtatttcacagccctcttgtcctttgttcagcaactcaaatatgcagtaatctgaaaggtcagataatcascacatccttttctttcctactcttcctatgacatgaaatacattctwtgttatggaacaraataagtttatctctctctgcttattttcttagtgaccttaatgaaaggagattactttgataggatttccttttaggggatccttaccaatgacaagtgacgattgcatgaaagtcagttttaaaattcagctgctcctgttgtctacatgcccccagtcaaatgaaatcagcagctcggacttcacgataatattaatgtgttgcgaatggggcagtgtcagcttcctgggtggcatccctggtggggagcagggatggggttgatgcagaaacaccctagtccagtctgcaggggctcactgggagccaggtggcagtgctagtggaggaagtgtgtgtctggcagccaatcgcaacccacagctggcggcagtgagagagggcaacacggaagggctttgcattttactcatgaggtggccctagattgtgccagaatactcraaattgggttgcataacttccatgaaatgagcacagccaactgaaagcatcacccacacttaccgaacatgtttctttttagatgtacctacctacatatgtaggtagttttatagagacttgagactgacctgtaagaaatagctcagggccagctgaaggtgatggtgtgtagatttcatatgtagcagatttcttttagaagcacttctagagtgagtcctgatcattatcaaccatgctgttgagagcagagtgagctaccactgtgaaaccttggtagcacttctgtrgttttgcaccaaatcaggtcatttttgtttgtttttatacataggaactcccaggcatcagaaaaaaattaaataactcttttgataaaaatcagtacatctttagatgaccttttaagagtgataattacagaaatgggtcacaactgggatttttcataacaagctaaggaagaatgaatactcacaaatggggtaaaggaaaaagaacaacaaacaccgccccccccaccacaaacttccaactcctgattgaatgaaggcacaatttaaaggaataaagtattctggacaggsctgagagagcacgttgagaggaacagccaggcatctatgatcatcacttggagataacagaagcaaatggcattggccatctttctgataygggtagtagagaatacagcctggcttaggaagcaacaatggaagcaagagattgaggcaggatgtcagagagaggtgtggagagacagggtagcagataggagatgctaagaaaaatgaggtgtcccagagtggataytggagactgatcactatgagagtaaagtgwtgaggagagaagcagctttgacaatggccttgaaaataaatgggattctacatggaagcaggttgttttagacacccaggagcatagaagatacagacatattcaaatatagcataattagtaagcagtatttactgcagatgtgtgtgtatacacatatgtgttctaacttargtgtgtaaccctttgyagtttgatgtgggatctrtcagtgaacagactttacacctgaaaatttcccrttagaacagtaattctttaatttttaggagtacattgctaataatcaaatgccactgaggactgataatttaatcctgcagtgaaaatcactttatcccaccaaattttaagaacgaaatcaactaagaaggaaggggatacaaaagggatarttttcaatgatagagatgaagaaatgaaggtagagggaaatgtacacacagaaatctaataaaccaatcctaggctgacaggcagcaagttcagcytggtgagcagcctcagaagtgggggctggtgtttatcccctggtgtctgtggacaaaaatgagtggttttcataaccaggatgggctgggcctgcagcaggaaagtgtggtcacagctttgggtcagttggcctcagtgttaacccyagccttggagctcctggatggcaggtgcagtgtgttgttgattgtttcagtgttcccagagcagtgtcctgcacatggagtgtcatcagtcctctagcatttgttgagtgttaggaattgaggattacagaggtagagaacaatgtagtctgaaaaaatggggatattcatgtaccctattccttttaagcaacaagtcatagagatccagaaatctctatctctccaattcattgaggtcaaagttggggagacattacgaaaacacacttgagaagaaggtgctgccaatgggatcctgaatccatttcaagagccaggtagctctatcatgtcccatggccatggacccactgcctataactgtgacaacagcctgccacattctccagtcacggccaatcttttataaattcatgcccaaggtgaaggggccagattcattggattgtgaaagtgtagaattgtgcagagmacttctggcctctggggccaaatagatgtgcatttgtatcctggccccatcttgtagcaagtgtgtggcctgagtgagttgtttaacctgtctgagatttagcattctcatctgagcctraggaaaatagtcatctcccttgcatgtacatagtctaatacctggaactcrgtaagtgttagtcttttcttccttctatcctattgtagacctaaaggggaactggaagagcctaaggtgggcacaaatgtgtcaggcatagaggatracttaaaaacacgcatctgctgtatttagcaaataaatctatacatcacaggtgcagtggaagcaaacatgaaatttgaaacattttctctttaaaawcttcatttaaaaaatactgtattrtkttccaattccagatcaccttttttttgttgttgttgttgttktttttttgagatggaatttcgctcttgttacccaggctggagtgcaatggcgygatctccactcactgcaacctccgcctcctgcctcagcttccygagtagctgggattaccgtacccagctaatttttgtagttttagtagagacggagtttcaccacattggccaggcyggtctcaaactcctgacctcaggtgatccacctgccttggcctcccaaagtgctgggattacaggtgtgagccactgcacctggcctagtgatagtcctgatcactaatttctgatcaggagtaacaacaactataaaatctattcacactcacttttggtcagtaaggcatttaaagagctaattcaattacactgagggcagcaactccagactttggtttattcaacagtaaaagaaggggattggaagaagttgccttgagaaacaaaacctaatatatatatacacacatttagaaaacaacatcaggagtttatagaccttttgaaaccaaagccaccctcccatcctgggccaagactctctgaacttatccatcagtgaagatcactgacattgtaaagatttgcttttctgacatccataatatattgtctgcagtaggatatgtgcgtgtgtgcgtgtgcatgtgtgtgtctctgtgtgtagactgcttaggttttcatttattaccccctgctcccatgacagtttttaaagttcttgctcttctgaatcaagmggaggcagagcagggtttgcacatcaatgaatcaatmtctttaataaaaataaaggaaaatattgtaactggttactaaagggaagatgggtgatatttgcaaagtttctgtagcattataaaatacctttacacttttattccatagaaattatactcagaaatggaaattaaatgtcatcagaagaaataaacacagctgtttcactgaaagacaagtaactagtaaaattgtggaagttaaaaaattttttcagataayctgtgaaaacagttactatcaaacactggtcaacagcacatcattgtataaggtaatgcttttataatattttaactttaagacttgatggaaaagataaaattcccaaatgaggggctgagagctaccattctggtctcataacaaataagctgcctgatcccacatggctcacttgccctgtttgagccaagtatcctcactggcttgttgtcaagagctgatacatagtattaaaatatgttccacagtagtttccctggatttggtgttcaataaatgatcacagtttcttctcccacactcttccttcattttccytctctttcgataagttagtttttaggaatgctagtttaaggatttccattttctcctgtcacatgtacttaacatgtaaaactcaattgtatatgtttttctgaatatattagttcattttataaaattggaaatggtaatgcttttataatattttaactttaaaactgaaaaatgaagaaagcaaaaatcactcataaatccatcacagacttttttttttctgtgaagcatctgctttttaaaagtggtatattttatttttttatgttttttcctctaagaattacgttgtgactatcccttcacatctttaaatgatcttctaaacatgggctttcagtttttatgtgcctggtttcatctaactaacccccttgtttcgtctaactaatcccattgttattggacatttgtgaattgcctatttttcactattatttaaaggctaaaatgaataccatttccacaaatccttgggtgtttatatgatttgtccttcaaccaaatccctaaatgtagaattactggatcagaggctgtgagcatgtttttatgtctttttcctcacactatcaaacttgtctccagggagctctgccaattttaccccacacttgaaaaaagaatcccaattttttgtcacctccacaacacagggaaataatrgtcccagaatgtttaaaatttgatatgaaaaatttctaaaactcctagtggttttttcacttttcttagtaataaattaaacttttgtatatatttattgcatcttactgcaatcaggcaattttgtgggttgcctgtttatttttttctgttttcttcagttggtatascttttacctgttgaattttaaaagctcttatacaccatggaatactatrcagccataaaaaagcatgagttcatgtcttttgtagggacatggatgaagctggaaaccatcattctcagaaaactaacacaggaatagaaaaccaaacactgcatgttctcactcataagtgggaggtgaacaatgagaacacatggacacagggaggggaacatcacacaccggggcctgttgtgtggggtgggagggtaggggatgtatagcattaggagaaatacctaatgtaratgacaaattgatgggttcagcaaaccaccatggcacgtgtatacctatgtaacaaacctgcacattctccacatataccccagaacttaaagtataataaaaaaaaaagctcttttagaccacgctataggaattatatatacacatacatagcgtgtgtgagtgtagtgtgtgtatgcataaaaaacatacrcactcccatccacacacataygcaacacaaattgtgtagttcaggggtccccaatccccatgccactccccctcactaacattaccacctcctgtgagatccgcagctgcattagactctcacaggagtaagaaccctattgtgaactgtgcatgcgaggaatctatgttgcatgctccttatgagaatctaatgcctgatgatctgtcactgtctcccatcacccccagataggaccacctatttgcaggaaaacaagctcagggctccactgattctacattatggtgagttgtataattatctcattatatattacagtgtaataacaatagaaataaagtgcacaataaatgtaatgcgcctgaatcatccccaaaccaaccattccccgctcaacccctgcccaccctggtccatggaaaagttgtcattcatgaaatcagtctctgtgtcaaaacggttggggacagctgatgtastttatatggaataacaaatctgaataatatgactctgtcgtggaaactttaaagacctataagagagtggtctgaacagaacttgggaaatctgaagcgagtgatgataatatccttgaaatttttgtttgtgccttatkcttgaacactgtttacttgtgatttccaaagacagctcttatctgaaatgttttctaaacactcgaatcagtcctgagttgactttattctatttcccatcaatgtacaaatgtgttacagtatatgtaaattagtgaggcttggtgtgctgagttttaagaaattccgttcgggtgcagtggctcacacctgtaatcccagcactttgtgaggctgaggtgggcrgattattaggtcaggtgatcgagaccatgctggctaatatgrtgaaaccccgtctctactaaaaatacaaaaaattagctgggtgtggtggcacatgcctgtagtcccaactgctygggaggctgaggaaggagaatcacttgaacccrggaggcagagkttgcagygagccgagaytgggccactgcactccagcctrggggagagagcrataytccgtctcaaaaaaaaaaaaatgaaattccaaagtgcagctatttaaattatgagcattggtgcaccaaggatatttagctaaacaattgaccacagggctaagtattctaagcctgttgactgatcatgacttcacccragagcaaggaggctaattcagtagataattgattggaaaggaaaatgaagagtctctgatcttttctatagcttgaaaaaattagtttggctttataaaattttgacttatacataaataatttactgacgtgaggtacacatgtgggtgcttcacgggcacattctatgcayaatgggtctagccccagtggctgccagctctgagggagaagtctgtgggcagtaggttctccttgcttggtgtttgcagaaacagtgtccaatggtcaaggatggccattcagcccccagacatcccatgtggtccctgcatggctctgggacctacctctgggtgtcagatgtgctggattgaagaaagtggctttattacaattagtattaattcctgtgacatgtatggaaatgtgtgtgwgagagagagagatgtttgagtgtrcctatggatttgaatattgctgatgcatttctaatcagctcgctggcttctgatggagggtgtcaaaggtgtgggtggtctgctagctactcattctctgagtaattctccacccatcccactatccaccccttggatgcatagtccagaatacacaaaattggactgaacatgtatgaaatagagttgtgactcaagcaagggtttttgaagtagtgttctctctctctctctgtctctcgctgtttctctctctctgcatgtgtgtraaagagagagatgaaagaatattgatgaaagcagctacagtgctcatattgccccatgctctacttcccagcatatattaataatgataatcatgccaacagcaatgggatcgcatttaattgtttcagtaaaagtagtaccaagtaactgggacatatgtccaggaattgctactttccattcttttttcctttttctctaaagatctttaactcaaaaatttggatcactgtaatatcaatttggcttttacttaaagtattttaacttgttttattaaaaacagaactgtaaaaagctactactggagaacaataaaaacccaacgataaagaagaacgccgagtttgaagatcaggggtattactcctgcrtgcatttccttcatcataatggaaaactatttaatatcaccaaaaccttcaatataacaatagtggaaggtaagggaaatcttagaattgggaagaaacagacgtattttagtaaaatggaattttttcattcttcaaaactgtgtaggaattgagagtccacttagttggggttgtgaccacaccactagttcaaatatgatggtcaaaatcttcattcyggtgctcctctacttggctaaataaacctttctttttggcaggaaatgaaaatctgtatgaataaacctcacatgagtcagctctctcttatatatgaaatttgagtaaattgtggaatcttttgttgttkaatttacattttcactttacaagtatttagtgaagatatctatactcaataaactgtacttagcacaaggaggcagggaagcaaggaagtatgagatgaagtgagcactgtactattctcaagggatttgattctaatcaggagaggcaataagctacataaaggtgtatgaaacagcatcatctgtgaggctgcaagagtgcagggggaggttggaggaaggacagatgcakgaggctccatttgacctgggtcttggagggggagcctcatgaaacagtgacctgctgggggaagggatctccactgggagagtgtaaggaacactgatgtgctggtgggaggggagggatgmtggacccaggctgtgtgtgatggaggaacagaatcctgggacattaaaggtatttaattaaacctcacccagtgaagatattcatcataaggcacagccaatgattgatcatccagtcccttcttgggaactatcaaggaaatgaccaaatcacacagcagtgtagtccagattttaatatctgattgttgaagtcttttttttccattgagtccaaatatcccttctcgtagcttccaaccactgattttgatttgccttcaagaatttcacagattaaatctggctccttcttaaaatgacagctcctttcrtgatktgaagacaggttgcttatccagtctggatttttttccccatcatcctgagaaactggaaactgtaacacttgtgtgrgtggcttgttcaacaaaatctgtgggctcacatttrctacagcctttgctttagcaacatctttcttcttcactacaaccatatagctatatacacccacatgttgccacagtaacaaattatcccaagtttagtgtcttcgstaaaatcaargttttgccagaattgctttacttctggaggctgtaggggaaaatgcgtttcttttatttttttatttattttatatttttgagatggagtcttgctctgttgcctaggctgcagtgcagtggcgcagccttggggctcactgcaagctccgcctcctgggttcacaccattctcctgcctcagcctcccgagtagctgggactacaggcacccgccaccactcccggctaatttttatattttttttagtagagacggggtttcaccgtgttagccaggatggtctcgatctcctgacctcrtgatccccctgccttggtctcccaaagtactgggattacaggcrtaagccactgcaccaggctggaaaatgtgtttctttgcctttgctttctccagcttctagagaccacttgcatttcttggcttgtgccacttcatttcagagccaaacacatttgcttccctcacctcatctcctttttgactctgacctttctgtctccctctgatgaggaccttgagacagcattgtgcccasctagataatccagggtgatccccctatctcaagatccttaatttaatcacacctagaggttccttttgccatgtaacatatygtattcacaggaactcaggagtaggatgtgggaaacttcagggtctattattctgcctgccacagcccagaacctgggaaacccataactgaattttaaactcaaaaacttaaattctgtgtataatcatctaccctaaactctccaactttactttcctacatctatttttaatctcatataaatctctgttactttgatactttcagaacctacaccctctttcccaccatctttgctttctgcccatcagcagctctttccttccttctttgatgaagctgtaggaatatccattattaaaagggtgcttgttatgggccagggatagtgccaagtactggagttgaatcatgtcatataatcctcacaacagctctrtgagactgtggccttgggtgagttaatttccttagttcctctctgcctcagattcctcatcatgaaatgggacagtaatggttcatccctcgtagggttggctgacaatgactgagtgagtgtgtgtacagctctagratggctctagggacagtaagagttctgctgtaatgaccatctcccactgctaggttcccaaacctcacctgcagcacaagctattcttctcccataattgtccatcttatttttcttgtcttcttggagaatgtcaactgagtctctcaggactccactcaaatgtcrctcctccttcatgcccccatggcctcttgtttgtatttctgattgctgtcagaattgcaatacatgtgtgtctctgtcaataacttgaaaggtttctggaaaggtttgcactgacttctgttcctcatctttgcatcttggatacctacaattggcacttggcacataaaggtgctcattacatgcctgttgtgtgcatcactgagacagaaacaactcctttgatgccacatacaacaagaagtctagacacttcaccatcctggctatttttctttggatttggcaaagtttgccacgagtctacagaaattagagcttggagttggggaagacagccaggaggtgttctgacctgtgttgaggacagagaggttctgagctcgtgccttctccatgttgtgtctttattacagtccccttgccttcacagatggagatctctcagctgctacatagtgactgctgtagtggtggaaaggtgtgatacctctcctccccatcctaagggtcatggcaatgttcccataacaaaagacagattaacaaggggcaagcaagttttatgtgacatgggagscttcagaaatgaagaccctggggccgggtgtggtggctcatgctggtaatcctagcactttgggaggccgaggcggatggatcacctgaggccaggagttcgggacaggcctggccaacatggcaaaaccccatctctactaaaaacagaaaaattagctgggcttggtggtgggcacctgtaatcccagctacttgggagactgaggcagggagaattgcttgaacccaggagatggaggttgcagtgagccgaggttgtgccattgcactccagcccaggtgacagagcaagactcggtctcaaaaaaaaaaaaaaaaaaaaaaggaaagaaatgaataccctaagactcagggaaacccgtttttttctttttaaatgcttaggttctagaagcatggacagccatgtagaaatgtgaytggacaaaagggtatgacctaatgctaatggactgagtggggaaacccagcaagacctgtccagattcttcttggcctctctgttatatttccttttcctgggtagagggcagagggtcttaagacttactgtcagaccaaagaaggccaaagaatttatagccaactcctagacagaaaggcaggagaaggttagagtcatgcttctaggttctatggcttactttggggaaaaggattctagtttttatgatctgcctttgggaagagggagtctggtttctgtgacttgctttggggagaatggaggcatgaagcaggarggtcagagagatcttgctttttgaggctgctttgaggccttccaatgtcgttgagtttaaagtactcagcctgccaaaacaccatactttgggactgtttttggagcccaggagttccattgccttcagcttgtgctcgtgaatcacagtcacctgaattcctactgggcatctgccactttcctggtcttatgctctggctgatcgggtggcgtctcctcctactgctgacaacctctatgccattttgactctgatagcctcctaggtaggctggccatgtcaagggcatgcactaagatgttgtcttccttccatgacctacatgggactgcacccttcactttacaccagttgtgcaaactcagggctgatctggatttccaatgatataatttgagtgttagtagacagcatcctttgctgaagatgtacttcacactgccccttctcaagtctyccatgtaagtttctgggggaaaaaatggatccagagaaaggtagtcagtagcagttttccccctcayaccgaaattgcctcctgccctttgtctttgaattcaagccggtgttgcttcttactgtcagacctgagagttagttctttccctggatacatctcagctcctcctgcctgtttgccaacattccaggcttgcccagagactccaaatcccaggataacccagacctgactctgaactccggagtccactgtgctggtttcattctcctgttcttgctcacatatctgcccactgcattctcaactgctcactctggcactgcactttctgagagggctcagggaggtgtgggagctgcaggwgcactcctgagtctcactgtactccactcaaccaggcattctgcttgctgagcacctgcaagtcccagaagggatgttctggacattgcttgggaatgcctccaaagcagtggggctactagcagggaacagtcctggtcatgaggaaagttaccaatgaggatatcagggctaacaataacttgactatgcaccagttcaaatctatgaccgcagctgctcttagggtttgcagttgccagctgccttaagcaagagcctgttgggtgatgacttacttcccaagcatcaccagatggggactgagggggcagaatttatgtgcagtacttccagtcgggrtcagaagccactcaggagcagaagtagaacttggcctacaggcatgaacttaacagcagggccagggccaaggtgaggttcctggggcacaatattgaagggacactgctctcagcatcctgcaagggaacggtgggcacatagagtgagggatttgcttttctcaacctgtcttggccctgcaacctgtaaatccatcactgkycagctgaggagkacagatggagagaatcgagacagggcagaaaggctcttcccagtgattttgcatggtttgactcttgcaygtttgatcatctgagagtcaggctgcagtggatgggcatcttcctctgccttttagttgaattgagcagaagctgcagatmtgagtgagagaaaaccagatacaaggtgctttcaacatctgtgacctttagttaatgcaaataggactcaagtgaacgtaaaccagtaactattggaatctttgttacatgaaatgagcatattatcatagatgcttgtcataaagaagctcaaggcaacactaatacatttgtcttttcttttgtcacttctagatcrcagtaatatagttccggttcttcttggaccaaagcttaaccatgttgcagtggaattaggtatatttcaatatacatatattctgcatttataagtaggggacataatagagccttccaagcgtaaatatgattcattattgaatgacactggatacacatttcatatttactgaataacattacaaaactaagaraagagtgccattttttgaatgttgccacttttaacctgacttaaaagtggcaacattttaaagttcaagagacagtggaactgcctgtggtctgtagactaaggtttttgttgtgctgtgtgtggcttgtctttaactctctctatggtcatttctaaatatgaaaatttaggccgggcatggtggctcacgcctgtaatcccagcactttgggaggccgaggcaggtgwatcasttgaggtcaggagtttgagaccaacctgaccagcacggtgaaaccccatctctactaaaaatacaaaaattagccaggcatggtggcatgcacctgtagkcccagctactcaggagactgaggcaggagaatctcttgaacccaggaggcaaggttgtaatgagctgaaatcacaccactgcactccagcctgggcaacggagcaagactctatctcaaaaataataataataataacaataataaatttaaaaattccgtgagagcactctggagagatgagtcaaactaattttgtggtgtgaatgtttgattaattgattcactttgaatcaattgactgaattgattgtatatttggagtttgtctagataagtcttatgaatcaacatgtccaattgagtaatttctttcaaaagagaaaggaaagaaagaaaggaagaaattcacatatgctamatatgctaagccaggtatcatgctaggtcattgaaatatattgttgaattaaatcctccaagcaacactgaggcatgtattctcattttatgaattaaataattgaagtgcaaaaaggctaagtaacttgtctaaagttaaatcactaaaaagtggcaagtctctgtttggggactttgcttccaaagtccccaccttataaccacagttggggtcacagtggtttatatgaccacatgggcccagtgcagctgggtcctatgccatttgtacatgaggtttacctgctttatatttttatttatttctgtctttgtctttcttatttttttcttctactcagtggggcttaacttgtatcttttgttctagtttgttgacctgaagagttagataattaattttaattatcctctggtagtatatacmttcaaactccaagtttccctgtaaacactactttagctgtttctcatattttcattctattcagtttaaaccattacttaaaatttcccttatgatttctttttccaacaaaaaaaattggtatttcttaatttccaaatatttggtgaactttctagttcttgtctcttattcatgtccagtttagattcattatagtccaagattatacacagtgtcatttcaaccttttggaatttgtagtgacttacttaaggcccacagtatggtatatcttgctgaatgttccaagtgcatttgaaacaaaggtatattctataggtttttgttttattattctttaaatgtctatttggttaagttcattaatggtgttgttcaaaaaatttatatcctgactaatcttttatctgcttgttccatgtgttgctgaaagagatgtgaatatctccagctattatggtcaatgtgtctctatctcctttagttctgtcaatttttgtcttacatagtttggagctatcttatatgcatacacggatttatgcyygttgaattaacacttttatcattatgaaatatctctctttatctatcataacacttcctctctcaatgtgtagctctgtcatatgaaataatcacacaagttttcttttgcttggaattggcatatttgtctttttttaaacatccctttactactaacatttttttttgttctatacataagtgtctctcataaactgcatgtatttgggtcttttttgaaatatggtcagtatggtgtttagtccatctgtatatttaaaattactgttacagttgctatatcatatatgcatgatatacaaatattcaatttattctttttaaaataaattacactttgttgaaaatgaccatatttccatccacttgtttatcttttcctctattttctttcaaacagttacagtttttaatctgctaaattcagcatctgtaggtctgcttctattagctgtcttttctattgattatggtgcacattttctgtgtctttgtatgtctcttaactttttattgttgttgatctttatgtatcaaacaattaaagtgaatacagtttgtgttattttttcttacaagtaggtagcctgagagttgagtatctcagttgactcagaattgagttggggtggctgggatgtaggtatgttcactccaatctgtcttcatctctgatagctggtgagggagggggtgctgcagtcatgtgtttgatgcaggcctcttctctaatgagacttgctctcctgattaccatgagactgcaagtgatatcatacagcctttacatccttttacgctgtcygagcgcttagcagtaattctgcaagcctgtgcagctgccgagagcttcactggattttcttgtttctatgagactctttctgttaatyacaaaccaaagcaaattctkccatggaatgaaatggccacctatcttagctcaccctagaaaggatccttcttaagtacgcttgtagttcaaaaatttctctttattttctctgtactttgatgtctttaatgtttgcttaatttaatttttttgtgatttatccatttggtttatctagaagtctcagtgagagtattgtcctgatgctacgaaaagaaagtacactgatcactctaagttttaatagttgattaaaaaataaatgtttaaaaagaagccaaatcatgttttgatgatgacttgtaattgctacctatttcttctgctttatatattttgttttatttaaagcaaggcatatttattctctttctgggatggagcaccacgttttgctttaggttaacatacattgattatattgttttgaaacttttaagaaamctgagtttcaaaaatcagaactttagttgccaacttttaccaggaaaaaamgtaaggctcaactgctctgctttgctgaatgaagaggatgtaatttattggatgttyggggaagaaaatggatcggatcctratatacatgaagagaaagaaatgagaattatgtatgtatgtgtaatatatrtgtcatgatatataccatataacaatcatatatattatatataayatcatattaaaaacactgggtggctgatgtgtrttttgggctagtttaaattataattataatggacatattttrtaattatagtggccataccctaggtggacgcattatgcagaaatgtattgccaagatctaagctggaaaagaaggtccatgagaaggccattgagggtatttagcatcaccttataaagtagcacttggtcagtcaggatccgatggggatggggattttacttagcttcttagaaaagggcagttgcctaggccaagcttttttttattttgaaaaatttgttaagttgtttatttttctaatgggccaaaaaggctccaaatggcatgcatattgatagttaaataagcctatattcttccattaaggaatggtcaaacttataaaaagaatcagtctaaacatatagtcacctaagcttttctgaatgactttgggtcatactgtaagtattcattattatactgatacactactcagggtctagtgagtgctgagcctaagttgtctaccacctttgctgcacttgttgagttttttcttctgctttttacacattttttggtaccttctttgttaccatgcttgcagctctacattcttgctgacacttgtctacaagctctttacaccacaaagtctggcttcttgcccgggagcaggcatgtggttcatgcccactacatgttgaattcatttgaaatttgtggatctcctgccatcatatctcatcctcagccactggcctccatttgagttttgtatttctccctttggataatctctttctaatttttagaggggtagaaaaccacagtgaatttcttagaaatgcagcttaagctacaaaagcagrgaggtctttctttatagttgggtgcacacacctttgatatcatctgttttgtcctctcaatggcctcctgtgttttacttctggatttcattggttttagatggttgttatttctggatgggtgacttaggaaaagaattacattccaaaatgtacttgaggcagttggaggctacagtggggctctgtgtcccgggtcctagatatccctgttgctaggaatgtgggcacatggggcccatgtctggctgtgttgactggtgtagctatcagagcctgtcattggtgggggaagtggatgtcataagtgtttacctggcatcaaccacaggacaacttgaatcctttaaggaagagaaaaagaacgtgctgccagtggctttctcaagtcattttctgacactcatggaacaacttaactggcacttctcatgtgcctcggggtgcttgagaacagtgttatgttttttaatgctgaacacattaaaccagtttgttggattccatggacaaatgtaatacgaatctgcatctatgctaaacaacttacagccttgtcataattagtgggaaccactctgtggaaagaaccccaagttgttaggaagagagaagtagagaaaaataattgagagagaatattttctyatattttcaacttagcatcatgatcttccagccatttaaacttcaggtaattgacagcaccattcccaaatggcctcaggagggctgtttctgtcagttctgatgctccacggaggaggggacgtttattgtagtccatgctttaagagtactggccagaaagggaagaaataatgcaggcaacatcacagctgccttcaagcattttaaacatgtgaattmccctctcaagggtaacgaacagagcctactgctaaattattttgccctyttacaggactccagaaggcaaatggcatgcttcaaaagtattgagaattgaaaatattggtgaaagcaatctaaatgttttatataattgcactgtggccagcacgggaggcacagacaccaaaarcttcatcttggtgagaaaaggtgagaaagatttatttttggaagttttgaaacttagctcattgctactgagaracatttcaaagatggccactttctcattttccacaccagaacccagctcctgagaggggaaatcagtcacctcatgtcacaggcattcagtggggcccctctgtctcatgatgccaagcagagaatgaaaacagaactcattcacctgctctcacagtcatattccatcccatgtggaaatcggggggcctgagrcttggagatacagatgctgagagtgaggctcatggggaggccatcaggacaacccctgcacccagcactgcacccagagcagccagaggggagtttgcagatctgcgtggggtgaggccagtgcaaacttggtgtgactgctgctccagcctgcctcagcagggtaccaggctcagggtccttgtgtgtgctcattcattcattgcctcctgaacttggcaagcaggccattgatagccctgatctstgggmtcttaaagtttttcagtgctcacctgatggagggccccagggtcgccatccctttcctccaccaaagtagcacagcccagggccttcagcccagtagctgctcagaaatggctgtgactggagccagaaagctgtgatttccakttgtcactactcattcactgttcattcccaggctccaccatcaactccctggatatgtagagaaaggtcaagatctgcaagagagagagaaagggagagagacagagactaacacacccagagacagatggagacggagagagacagacacagagagaggagaaagagagatacatgagatggagggacagagacaaacagacaactctagagagatgaagacagaaagagaaagagaaagagagacagagacacagagagacagagaaatgagagagacagggagagacacagagacagaggaacagagaaagagggagatagagaggcagagacatgaagggatgcaaatacagagagatgagagtgaaacagacagagagacagagtaagggagagatacacacagacacacacaaacatgcagagacagccacacacacagactgggccttggctttgtgagaaacggaaggagtgggacaggaagagcacaaaggctggaaaccccctccagctgggctatcctggtgcccaggggcagctcccccagcacacatgttttagagccgcctctctaccatatgcactcataacaacagctcacatcccatacatgttaattacatgacaggatctgggtgaagttcctgccatgatctcatccagtcttaacgacaagctttatagaggtgaagaaacttgcccagggtcacacggcaggtgaaggtattgaaactcagacccgattaaatctggaatctgtgttcttaccttctgcagggcttgtcgcctgtggtcttccacccctgtgtgattgcctgtgctgtggtccactcacttgtgagggagyggggctcaaatctttgttggaccatcacctggccaggctttcctggggcctgctcaccaccggatcacctctcctttcttagaacagggcaggactgtcctattcctgccctagacgcttctggccagtcaattctcctgctgctgctctcacaaatgtaggtttagaaattggggctcacaacccaccatcaccccgtgccaatgtgtgcgtgcgtgtttttgcaaatgtgtgacacagttatgactatgcagtcctttccaaggtacaggagccccagaccctgagtctgctcagagttcactattaaacaacattagctgcttgcctgaatcctaaagatagtagaaagatatggaaagataatttttraaaattgcaccaagatggcaaaagttttaagcacgtttatgctcattgacctagagatgcccccaccattacaatctattttaagaaagaattagaaatatggataaatgtatatgcctttttgtatatgtatatacatatatgcatgtatatatacacatatttgcaaatgtatatgcatatacatacaaggttacacatttatataaatattatacatgtatacacttatacatataaaatgtactgcaactttatgtctacttactaaaaattgcaatcaatctaaatattaggatattatgaattataattttaatgacctactgaaatgctcataatataatattcagaaataatgagtgattaccatataatctcagttaactaaaaagtttaagagacaaaaagaaaacccagaaggaaatattctatcatgttaacacagccttcaccacattgtgatttgttgttaaaaattactttattctttttattcctctgtattatctcagattgtccataataaacataaacggaatcaatctagaaaatgtatttttttccaaatgatacttttatacaaagaatttgctaaaattccaagagctgtgtgctgtattaactactttttgtgtaatatttcatttaatcttccccaaaggagcagccttgtaagtgaagcagttagtatcttcattttacagatgaaggtacmaaggtttaagggcattcacgatttttcctacaatacaaaataattgatggagcccrgctgcaaacccagacaaatgtcaatccagtgctctctctcttctctcaaaactatgcacctcaacccacttgctaatatttctgtgagtccctatgtgtttcagcctagtatctcttcaccccagaaatctgatttccacgggtacggatagaatacattactgtgtaatgttttcacttcagttctctaaatatccgtgtacacatttttattctttaaaaatctgagtagaaatatcactactccagactaaaggcaggaatgtggagtcactcagtggartgtgtcagcacgtgggttggcaactactgcattagtgttagcagtaaaaatggacaagcaygtgatgatggacaacactggtaagatttcttgattattttcttttcctttttccctttcttttctagcagacatggctgatatcccaggccacgtcttcacaagaggaatgatcatagctgttttgatcttggtggcagtagtgtgcctagtgactgtgtgtgtcatttatagagttgacttggttctattttatagacatttaacgagaagagatgaaacattaacaggtaacacatataaygctggaatttcttaccttatgttctcattaagaaatcagataaataggcattaatcttcatcttattgtgatgatattgtagaattaatctgtgggagaggttttctatgggaaatattgttctgcctgtaccatccattatgaatgttgtctatgtcttcttttcttgtgcttacttatgtgttgcccaaaattgttctgattgtctcgtgtatgtatgtcatagcttcctaaatgccctgggagatgctcgggcccaggaactgtatatctgggtgtctttgtgcatgcatcacttaggtatctttatagtacatacactcaataaagttgctttaagttagattgaattgtcctatcgctcattatttcaacctggcaaaggaggcttacataatggacgtgtaagaacccccagctggccgggcgcggtggctcacgcctgtaatcccagcactttgagagtccgagacgggcagatcacgaggtcaggagatcgagaccatcctggctaacagagtgaaacccygtctctactaaaaatacaaaaaattagccgggcgtggtggtaggcgcctgtagtcccagctactcgggaggctgaggcaggagaatggcgtgtgaactcgggaggcggagcttgcagtgagtcgggatcgcgccgctgcgctccagcctgggcgacaaagcaagactccgtctcaaaaaaaaaaaaaaaaragagagaaaaagaaccccgagctggaagccaaatgatctggaatcatgtctcctagacctgccagtttttatctgctactatgtcgacccgctggctctatgcctcagtttccttatacttaaaggtgaccagaagtcctcaagtttccagataattactaatttaaaggaagtcagtctaattcattgcacttgattttgttttgcatgtrtgtgtttgcaggaaaaaaaccttcacagagttcaaaacccaaaatgtctatgaaattatacttcagtagccccccttccagcctggtcctggatctatgattcccacccctcattgatagcacatctgaccaaatatcaatacagattcttattacacacctccttttaaaaagaacaaatcctggcttaatatgcgcactcttttcaactttgctctcttataccttagacacacttgcatgttactttataaagcagtccatcattttttagggccgcacagtattttatttgtgcagagctaccactgtttatttagtctccttttgatggacatttggcttgtttccaatcttttgttattataaaaatgctgcaatggacagctttatacattcatcgtttcatatgtatgcagtaggtctgaaagaaaaattctccaaaatggagtttctagaatacaagaaggagacacagccattattttgctagatactgtcaattcaccctccctactgccttcaaaagatgacagcaaattttttcccataaccttacccacaaccatttggagttgtgccaatctgataggtgaaaagttgtatttaagtgacattttaatttgcatttcccttactatgcaagagaaccagcaacttttcatttgcataaggctcagctgtatttcctttctcaacacacccattcatatcttttgcctattgttccatggggcaatggctttattttgcgtatttatttctaggagctatttatattttagggaggttagcttattatctataatatgaaatgcaaatattcccaggctgtaatttgtcttttgactttgcttgtagtggtgtgctatataaaagattttttgaaaaacatactcaaatgtatcttttatggtttctggatttgggatcataagcaaaacagccttcttaacctcaagttatacaaaaattatattagttcctctgagatttttataggtttagttttcacatttagaactttaaattgaacaacataaaattagcaaggttagtgaatttagctttgagcctgcatgtgcaygtgygagtttgctatggggagagatgatgctgtaacaaacggggaaatctgtatttgatattttctgaatggtctctgtttgcataggccagtgtttgtcttcaaataaacattgactagctcctctctttctgactttctggagctaagatttcttttttccttctccagttgtgtttgacatgatttgcggtaattttttcaattcacacttcttaactgtcaatatggcagtgcagagacatttagagacatgctctaaatcacttccattaaattatggtccatgaacaaatgcagtccacgaaaaggacagaaatggagatataagtatgaagataaaaacttttatcacaatttaatactgctgcaatatctaagaaagtgttcagtattggtttctgaaggattggaaatgaaactaatcaataaacaacaacaaaaaaaggcaaatttaaattaaaacatggtcattcaccaagcatagtttgaggaacatttgtttaacttactccttgaagtcccaaatatccacttgaattataatttcctttataattttcctttatgtttgaatatagagaataaaaacattaccattagttttcaaattcctttttttgaatactttactctgtcaattstcaagtcccctaaaccttttaaaacctgaatttaaaatatattgtaataaaattagcrtatttatattaaaagaattgcttaaaataaggaatttgaaagcaattaatagttgaaaagctaatttttcataggtaagagcaaasctatattgtatgtaatataaacccatatttgatgaaatygtcttcccagtttgttgcaatccattacatcataagaaaattatgccctttaaaaaagtgtgctcatttaattgtcttacatgttgatgcctgttttgtcactgacacagtgacaaccctagtgraagcactagctcttacttaactagtagatagttatatttgatagcagtttaagaaaagtttgagggggaacctacttactgattgataactggttttatttttaccaacatttcatacctttgatatttatgtaagcctgaaatttttaccaacatttttcatctttcaatgcatgcaattctgcaaagcaattgctttaaatcaacaataggttctaacccaaattgctgracagaatgctgtaagtagaactgaagaagattttgccagaagcagaaagtgttgtttggtgaccatgagtgctatggaggatgccaggctgggctgttaagcataaatgatgtggcaccataagagacatagatctagaatggttttatcctattagattttaataggggttgcagttatatgtagcctcaaactcagtagcaaattcattaatcccaacaatatgccatgcataaatcttacccatctgccatcatctgccatcaaaacaattgtcatgggataaaggtagaccattccccactactttccttctttctctacagatcccaattagcatccattgcattttttaggacctgactcaaaatttcctcctttcagaaagcatgtccatcgggatcactctttattctctggccaggttattttgtctgtgagttttgttattctttttttgttatgctatttttcttctgctaatgtgttgtctgtaacyttttccaagttgttgcatgcatctgctttgcttttaaaaatagattggatgaagctagaagagagagtggtatcatgttttaattacccaattaggagcawggtctttgttatttaggagacattttcaccttcttrggggtctttctgagcatagaaattgtgatggtggtagaattaaatgatatgagtaaamcagggtgagattttctttccactcctggaatgaggacacctttgggctcttggccttctaaggaacttaaagacttaagttcctttagtgcccagatctatggctyatatatctctgtattcttctgtggtgtcaagcagtgggatcttaaagtagatgcttaaaaacacattggctaattggttgcttggttagcatgggaggtttaaatataaacaactttatatataatttgttttttcaatgattctatactcattacttacgacattcacttaagtttgtacttaaataaaattttatttacacatgaattaaaagagycaatcttacctcctagatggaaaaacatatgatgcttttgtgtcttacctaaaagaatgccgacctgaaaatggagaggagcacacctttgctgtggagattttgcccagggtgttggagaaacattttgggtataagttatgcatatttgaaagggatgtagtgcctggargaggtaagagggaatgccagatagaaaaatattcaagatagtttctttttaaaaaatgaatgagctagcccccagagagctatcccattttccttaaaaacaaatgaataaggtcctttaagcaagaaataaccacgtaagtcaacaatcrayagtgagaaaacaaactaatgagcttccaatagtctcttctcttgggctctgttctttgtgcttcacggttctctgaaactttggggaaagggagagggcatttccttttcagaaccgggcccagagctggcgttatcatgaagcctttatttagaaatgacccacggtgagaatatctgtaccacagcagcagttcctaatttaacatgtgatgtgtggactagttaatcctcactagtaactcttactagaaataaacacgggttaattattactagaaaatgcatgggtttttattgtgttgatattggtgaygaaatttaagtagaaaataggaaaattgaaaagggaaaaataacaggaaagcggtgatccccatcagatcatagctatgaaattcaatgttttttttattaatataggaatacaaatggccatagtgcctatattaaagcaaattactgttaaatttttctttttaatgagtaacatttttagattttctctgaagtctttagaacaaacatttaaaatctggtgtcaaattattctggatactgatgcttaaaaaaaaaaaacaaatgtttgattattaccatcattcatgtattaatctaatatttattggatactattcctgtgccaagttgtgaactgggcatcaaagatataacagtgagaaagaaatagttacattcccccccatattacaaagtagaaaggaaaatattgctaacttacactactgtttagtaataaacaacttgtcaaaaaaatatgccagattatcagatgcatacattgtagtatttttggatagcagttctttgcatctaagaaggcatattgttacttaggaagcatttattctgggccatacatcaattttactatatttccgttattttctaggggcctttcttgaaaacagatttattcttaattcataaataaaaataatgtttgaatattcagctgtaattaggtttggttaaacctstatttgagaacagtgagaggtctagaacaggggttggcagtttaccagccacgggttccatcacacctgcaacccttattgaaacacagccacgcacattggtttacctgtcgcctgcgtctgcatctgagctacaacaacagaactgagtagttgtgacaaagacagtgtgacctgcaaagcctaacatatttactatctggccctttgcagaaaaagtttgccaacccctggtctaaaataatggatggttttgttttgttgtgcctttttgtcttttaatctttaaattctgattttagcatgctcttttctgcttgaggagaagcaggatagtataatagttagaaaaatgtattccacttgggtttagattctgattctgccatttactagctgtgtgactctgggcaggttacttaaccactctgtgctccggcttccttgtttgttaaatggaggtgataacagtatcttctctgtagcgtattatgatgattaaatgagttaatatacaaaaaacatttaaaataaggtatggtamataataagtgctaagtaggtgttcattattattgttacctagagattttttaataagcatataaaattaagaacaaatggtttgtcttaaagaaaaacttattagtgaggttaggagttartataaaataagactgtgcaaaatgrcttttatctcatgttccccctttcagttatcttaaattaataggggttatcttgcattttcagctgttgttgatgaaatccactcactgatagagaaaagccgaagactaatcattgtcctaagtaaaagttatatgtctaatgaggtcaggtatgaacttgaaagtggactccatgaagcattggtggaaagaaaaattaaaataatcttaattgaatttacacctgttactgacttcacattcttgccccaatcactaaagcttttgaaatctcacagagttctgaagtggaaggccgataaatctctttcttataactcaaggttctggaagaaccttctttacttaatgcctgcaaaaacagtcaagccaggtagagacgaaccggaagtcttgcctgttctttccgagtcttaatcttcagaaacagtgaacgccaaaaagaactcaagatattctggggactgagcatatgaacytgttcataacaaaggctgtgactmgaaataattaactttgtcaaaatcctgctcacaatttgaagatgaaacttgtcattaggttggcgggaatgagactaaagattgcgctgtgggctgtggtcacgtgctcccagaagacctggaattcaaaagaaatggagctattctttttctccctctttcataactggatgcagctgctcatactcaatcccatattcagcaagtgtgaagctggacgtgatgcaaaataaccgatgccctacaaaaagggcgcatctttaagagttttaatgccagtgcttaattygaatgaggggattttaagtgtctgaagasgcattttctagggaccagtgggtgactgagtaactgaaatgctgctttcactccctaacaccatggatctggttgtgcataggatgtgggaggaggggctggcagggccgccttcagaggctgcagggcctcagcctcaggatgcatttaatgtatcctggccacagytgcagccaacggttcttgaaagctcggtaaggccctgcaacgcmsagcctgcttatgtggatctatttatgggaacttcttaaaaggaccccagaatarctctttatctttcacaagagacacaaattctaattgagttaattatctgggcctttcactttggatgctctgaaacatttgttgattttgtgtgaatgtttatatcaaaatgtttgccaggttgtattagccattgaatagcaaaaaactgatagttacttgcttgttttttaaaaattacatattaaaaatgcccttggcataaggcagcatggtgtggcagttaagagatgggctgtgcagcccatcctgagctccagtcctgagtttgctacttacttctgkggcctctggaamcttatccaacctcttggtgcttcagtttcctcatctgtgaaattagaatttataataattgcacctacctcccaggggtaactaaatgaataaatataataaagtacttacagtggttcctgacacagactcagcactccgtcagtgttgccatgactatttttattatcattattaatgattacttagatcaattatttagcagtggactaatggaagctacagagcagggaagggaagcagatctagggaggaaggcagttttgatttgaggaggtttgcacatgtagagaagcatactggagaagcatatccagarggcgaaagatatctctccattgtgcatctgcctcttttgacgttggaagacacatgtcttacyccccaaagggagcccagcactgggagccttcytgatgatctcaaaaataatagctattcaagaaaatcaccaagtgactgtgaaaccgtcagttcggaaggctggttagaacatgtgggagcaacatgaatgttctacaaaagtttaaagcagagattgtttcaaatgggtgtagtagatattactgaaaaccaaaaaagagtgagattgtcagtgtaagaatgtgatttaatgtttgtagtgcttacaattttgtgtaccaactggatgactaaaaagagtaaaataayttaattaatagctcatattttatgtgtgaaaacatgttagtgaacatatataatcaaaatagatttcattgctattgcatagtctctaatacatagaatgattttgcttttctcttttattatacttgctttaaaatacttgaaatatattttgcattaaatgcatttcaagttaaatgtcttaaatgtatacattagatgtgtgttttaaaatgcataaaacacgttgaaatacattaatgaaccattagtctaatgcctttatttttgaaatatcatgacgtctttttcacttactttaagattccaattcctcgttcttaacatagactcctacctgttttaatagaatatgggccattcaaaatgaattcatgcacctctctctttttaaatgtcaaattgccttgcacctaccttcttgtttcacaccttccatccaggagcaaactaattctcttctgtttctcacaagccactcaatactaaacacagggacttatacatggtaagtcttcatatgtcagttaattaatgggcatattttaaaattctggtttaaacattccccaaccaggaccaacaaataacttttcaggtataaaacagctttcttttccatggttcagatgcccttaaactgtgaagtctattttagagaatcagcacaactacctttctagggcacgtgaagaaacacytcttacatgtctgtcatgtcctagaagcatttactcattagagctatatcttctcaaagcagtgagaagccttaggccccacgtattccaaacccaggaacttgaggcatggtaagtccagggacttggtcacagttgcacacgagcggtctgaccaggttggcacaggatggcgtacggcctcctcttggagatgagcatcttggaggctgcaggcacttttctggggccgacaatttaggctaagagggcctagggcaggggcctgcggaggggaagcgggctgtctaggactggctctgaggaggaaaagagagtgagagggatgctcaggattccttataagccattaaaaamaaataggcattcaagttcagtgcagggtgaaagagcacaattgatggagcacatccgcccactgtggcctctgctgagatacagagagttagaacctycggcatctgctaggagcccccggcctgtgttgaggcaaatgactcgccagttgggtttgctggggctytcagcgaggagcagaaaggagacagttgtccaaagagaggacattagcaaaatcagtgccccaaaccaagttgaatcatagctgtaaatactcagaggaattaacctgtcaccttggtctgaagttcagctgtgagggaggggacccagggttagcagaagccatctgagcagaagctgctctgagcagtgtgaccttaagcaatgcaaggatcttcaaagagtgaccaagccacagacctaacaggaaactcatgggcaggacacagggccctccagccccacctgcgtgccatgctgatagtgatcacagtccaggctgggagcttaagaccaacacccagatttctgtgtgagacttttgaaaatttttatctccttctggcatataactcgcgggtgcacagacacaccgggagaacaccatacctcatttacgtgattgctacaatttgatgtgtgtgtttaataattaatagtgaacatgttaactgactttcaaatagtggcttgggagtcttggggttcctcagaggtgactcagggaccatcctggatggtggaatggaaaattggagaacatgggagctgggctcctggatcttccctttcacctcactgctcccaccccctccacataccacaactagagccacactgcttttatccatattgtatgttgaggactcacataacattttatttaacagaacagaatacttccgaggaggtcatggtttagatacaatgaatataattctttctagccagtttaaacagaaatcattacagaattatttggagagatgaagaaacggactctaggctcctcttccagggatgtcttccaaagtcatatgaaaaacctaggctgccaaatagagctgttgatcttgccacaaccagaaagaaatctgtgcaaccaggaagctcttgctgcagctgccagctccagaaacagataggctgragtctaagttgactgagagccatctaatatggaattgttgattgagaaggccaattgtgcacctaactgagactgccaggagcagcagctttgagtggcagtcttaacaggaggtgaggcggggcactgccattcaaacattggtagaaatggcactgcaggcgccaccttctgatctaagccttttgctttagatgttctccaagtgaacactattaagatgagagatgagacaatagcagagcacagaggtcagtaagtcaatgccttaggcctagagttttttctccagaagaacatttggctctggttacttgcacgtgggcctgacgagaaaccatcttggtcatagggtgaccttggaaagaaacagactaaggccacttatattgggttttataccacttataaccagacttaatatggacaaatataaactccaaaacatgccttagaaacaatgccctctataacgaaactractttagaataattatctcaaacggcctgtgaaaatgaatgaatgaatgaatggctttttagaaatatgtgtagtaaaagaattagctttaaaactttcaagattctgttacattgtttatttctactcagtgatcatgtgcactgtgtacagaatgaaattaaaagatgaatgaaggtgttactaagatatgatccataactggcttgcattttttaacaaatatacatgaaattaagcatttatatgagagctgtcctcttggaagtaagcatgtaagcagatcacacactttctataatgattttcttgaatcaaaccacttttaaaattcayctttagaaactcacaaaccaaggcacaaaatagccaatacccttacattttcattytttagtcatgtgtttttgaaattascaaagtcacttgagctaaggctgatgagtaatggtgataaccaagttgatwtttttaaaaatcaaaaggaagttgtgatgttaaagttacatttgttttctgcagtgagttgcaaaccagttactgacttttcaagttgtttctcttgattttcagtgttatcatattattacattcaaattgtgaaacttagaaaaagtatggccaagagggaattcaagttcatattaagcaaagagagaaaaagagagcacttggctgctttaactttacattttaaaatgtttatwatgaaacatttgaaacatatggagaagtagaaggaaatatgcaacaaatattcatatatctacaatccagactcaaagattgttaacattttcccatatttaatttattcctgtctttttttcatactggatgtttttgttgtaggtttgttgcatcatgatgacattactcttgaatacttccgcatgcatctccagtaaatagatgcttatcttcaaaatcacgattgccaacatttaacaaaattaacaatcattttckaacactaaaattgtctattttgggccatcttcaggtggattcctaagttcttttgactccactgtagtatttttgatcatttcctaattttgttgttgtgattttctgatatgggaaggtgttccaggcttgttcttttcttagtcccggacaaagccatttctctaaggagccatggttcctttcagtgagaaattgttttcggagaccacaatttgggtctaacagttgcacactcttaactgagttcatcaatgtttctaggctttctgagtagatataataaggaaatacatatacatccataaaatgaattataaattaatactgaaaatccaatttaaatttaggaccgcaggttttacttagcytcatcaactttacattggaatcactgccacrcagaaaattccagttcccagtggcatcaacataattgttaatttgctttatccctcaatgtacatatatccaaaaggcatatattgcagaagaattataataccaacacatcctttaatattttgtttcctaaaaatagttgaaaacatttttgtactattttatcccttgagaatatttcactagaatatagagtcatcattgtattctaaagttatttgaaattattcctcttattgtggttttgtcagttaaacatatttatttgttttgttctgatttttakgaattgatttttaaaattttattttgttttataatagggcaaaacatttttcaaaatgatgttggtttatccttctatatttttatataagtaaatattcatgcatatttatttcttgtcacctctcacagataaatagtagagataaatagtagatattatatacaatttctccccttgattttaccacttgataatatattctagagatcactccataattgtacatggaactatttctgataaatactttttttatacagatacatggtataccattgtgtggctgtactatagtttattcaatcagtcccaaatatttccagtcttctgctcttagaatttatgttacaaagaagtcttatgcatgcatatttcatgctttttccttagaatatttttgggatattagacataggattkctgggtcagagggtaatacatatgtaattttgctccatattgccyaattcatcttcataggggttgtaacattttgtattcttatcatcaatgtcttggagtgcttgtgccttagctttggcccatttctctacagagattttgatctctttcattatcattgkgggaaggtttttacrtggtagacatattaagactttgtgatgtaaattgcaattgttttccagttttttttctttgyttttagattttaaaagaattaatccattctttcaatacagatatggacwcatttttcactttaaatcttcaatccatttggaatttactatggtgtttagtctgagaaatggatccattgcattgttttcatatgtctgtgtatttatcacaacaccwcttcttaaaaagttcatttttttacccactaacataagatgcccatttaatgtctattcaatttccatatcctattagacctagttctggaccatctattctgttccattggtcaatgtgttttaaattgacacataatgattgtacatatttgtggggtacactgtatgttttgatacatgtgtacattattaaaactgaaatcagggtatttagcatatccatcacttcatacatttattgtctttgtgatcaggacatttaaaaccctctgttctagctatttttaaatctataataccatcttgttaaccataggcaccctatgtgcaatgaaacaccaaaatttacccctcytaactgtacttttgtacctataggccaatttctccctatccttctgcttcctagcctctggtaaccactatcctaactctctacttctatgtgttcaacttctttagattccatgtatgagtgagataatgcagtatttatctttcggtgcctggcttatttcacttaacataatgtcctccaggtttatacatgtggcaaatgacaggatttctttttgttaattggataaatagtattttattgtgtatacatactccatttcctttatgcattcattcactgatagacacttaggttgattccatatcttggctattgcaaatagtgttgcaataaacatgagagtgcagatatctctttaacatactgatttcattttgttggggggatatatactcagcagtgggatttctgaattatatggtagttctgttttttaattatttaaggaatcttaatactattttccataatggctgtactaatttacattcctaccaacagtatataagagtttccctttctccctgtttgtaccagcatttgttatttttttatctttttgataattgccattttaattgaggtgagtttttatctctttgtagttttgacctgcattttcctaataattagtgatattgaacatttttttcatatacctgttgaccatttgtatgttatcttttgagacatagctatccagatattttctcca

SEQ ID NO: 13480 - DNA, 40644 bp, Homo sapiens
ttgggaagatgtggtcaaaggcagcaactactttcacgtccactgttgtcattcaaggcttgctgcagtagaattaccagtgtgggcaggcatatctactactgtggggaggcagatctgaatgaaagcgccagaagagaggccaggccacgcacgttctgtgaccttttcaactatttactgattagatacatcatacatctctccttccctagggagacatgaatggaggagacggcagagaaaggtggacattttcttccaacaacatctgatgctagatccaggtttggtgacacctgaatcttatgcaatttaagtggtcctccttaaggaaaagaatacaaaattacaagcataaaatttagtaaaaggttgggaaggggcatgagcaagtgaaggtactaaaacttaaacttcatagatttgttgtacatccttctcaacaaaggagaaatgtctattttcatgtgtgtatcagttaggatgctctcagatacaataatttaacttgtaagcaaaccaacttgtccaagattcaataacagagtagtggctgatgtaaatcaagagtccagttgttggacaggatctgtggttggttgatctagcatcttgacaatgtcatcaatgacccagtttctttccatctttctactgtgtagtccacagtatcaatttcatcttaggtggctcccttcaggtttatagcatgcatgccagcagcaatggggattcctagcttcctctttcatattagaagggagaagacaaggccaagcatggtggctcacgcctgtaaccccagcactttgggaggctgaggcgggtggatcacctgaggtcaggagttcgagaccagcctggctgacatggtgaaacctcgtctctactaaaaatacaaaaaattagctgggcatggtggtgggcgcctgtaatcccagctacttgggaggctgaggcaggaaaattgcttgaatccgggaggcagaggttgcagtgagccaagatcgggccacctcactccaacctgggtgacagagctagactccatctcaaaaaaaaaaaaaaaaagaatagtattactgattcccaaatagatgatgctgaagttgtttatacaattgacattcagaaatatattccatgctatcagttttttagtttttataattcttcaggtgaagtaaataagcaggcactgaggaaaatattatcaaattcacaaaaaatgtggtaggttgttacaaattccatcgtcattcagatcagatcatgacatttagagagaggctgcttcacaaaaacttgcaggagcatttttcaaaccaagacctggtttttctgctatgaacaccaagtataataacagaaagccgctctactcatcgactggaacatgccttatataaacctcgaaaaggactttttcacagggtaccttcagtggttgccaatctgggcatgtctgaacaactaggttataaaactgtatcaggttcctgtatgtccactggttttagccgagcagtacaaacacacagctctaaattttttgaagaagatggatccttaaaggaggtacataagataaatgaaatgtatgcttcattgtaagagaaattaaagagtatatgcaaaaaagtggaagacagtgaacaagcagtagataaactagtaaaggatgtaaacagattaaaacgagaaattgaaaaaaggagatgagcccagattccagcagaacgagagaagagcatccaaaaaagaccctcaggagaacatttttctttgtcaaacattatggaccttttttccagattctgaattcttcatgcatgtgttatgtctttaaaaaaacagacatgtttctaaaggtagctctaacaaccaccaccatctcgatgtagtagacaatctgaccttaatggtagaaaacactgacattcctgaagctagtccagctagtacaccacaaatggttaagcataaaaccttagacttagctgacagatggcagttcaagagatgacggcggacggatcacgaggtcaggagatcgagaccatcctggctaacacagtgaaaccccatctctaatacaaaaaaattggctgggcgcggtggctcacgactataatcccagcactttgggaggccaaggtgggcggatcaggaggtcaggagacagagaccatcctggctaacatggtgaaaccctgtctctattaaaatacaaaaaattagcccggcgtggtggcaggtgcctgtagtcccagctgcttgggaggctgaggcaggagaatggtgtgaacccagaaggcggagcttgcagtgagctgagatcctgccactgcactccagcctgggctacagaggaatacttcgactcaggagaaaaaaaaaaaaaaaaaagagtgttcacggctgttagacacacaagacaaaccatctaaaacagatactgatagtagtaaccaataaaaaagcatccaaaatgagcagcccagaaacagatgaagagattgaaaagatgaaggttttggtgaatattcacggtcacctacattttgatccttttaaccttaaaaggagatttttttaatttggctgatgggtaaagtcaaacatttccattgtttttactaggttgagctacttgcagtaatacaggtaagttcatttgtttttactatattcacctctttgcagtaatccacagataagtcttagtgcatttattttacaaagtactttttcaaacatcagatccttttatttccaaaccttttttcgcctttcaataagttgttgagggaaaggcttacacacattctttagaattggaaaagtgaggccaggcacagtggctcacagctgtaatcccagcacttagggaagacaaggcaggaatgattgaggccaggagttagagaccagcctgggcaacacagtgagacccatctctattaaaaaaaaaaaaaaagtattagaaaagctagaatagccttattttcacaatgtggaaagaaatttatatgaaatttatctgagtcattaaaattatccttaggtgataattttttagaagtacattacagctagtgttgccagataaaatgctggatctcacgcagtacctttgcaaaacatgatctaaaatttaaatttgtcctacatttgtacttgctaaatctggcagccttaattattacacaactataacgcaacacaaacaataatctctcccctagtttagagtcctttgcacgaaatttagcaaatccttaattttgagtacagtacaagcctggtaatccagtgtgtttgggataggctggtggaactcagaactgatacatatatacatacatgtctatcacattcactgtctattaggtgtaaatcatctttttatgtaaaagacactactggtttgaggatagagttgtctaggaatgttttgtcctgctgtgacagcatcactatgcatcccagtgtaacattcctacaaagggaagatctcttaaccaggcatacttacatttgctagttagaaaaccattctgagcagttttaactccattcagttgaatggtgtactacattgtatgagctatttgtggaccagatataaatgactatcacccagaaccactttcattcaacatatgtaaaatgtgatgagtgttaacattttaaataagcgatctgcttaatgaacactgattggtatgaaggggaagtgtcattctttacctcactcctgaaacacttttctatccaaaggttggtttgagtcagtattggcatcatacaaccacttactataaaataagtttactggtggtaatgtgatggaatttattccggatatctgatgttataaactttagggtccctgaaatatgcaggatccttgtatgtaactggcataaaccctgtaaagagataattaaagttcttgacaaagcataatgagcaaaatttcagctagctcaatacagttgttgaggtgctctttcttacccattgtttgagctctcttaattgcttttgtgatttgtttcttcccacaaagacctgtaaaataaaaagcttccttattcataaaaaagtcaatatttaaagttaaaaaaatgtttatttctcaaactgaaacattatttctctatctcttgaccttttagtacacgtttttgtatattcggttttactaaatcaagtcaaacctgttccaggtaatgtgatgttatacatgataggtttcatttagggtggggtggctaagttgcaacccttttaaatcaaggctccacctcaggaacctaggaatgttaggtaggagatgaggaagtccacagcttgccaagaacttcagctattccataaacaatctgattacatatcccgactcttgcacacgaaacaggttatccaagtcttaaacttgatgcttttgtgcagtatgaaccaccctttccgtggacataatcatgcatttgcacatttaaataccattttctatgaacagatcagtatgccaaaaaccactgcaaagtctcctacacacaccttgccttgactttctgtacatttctagtattaaagaatggtgtaggcaaaataaagatatatgtgtaagaaaaaaaagacatgcatgaaatggtttaattttagggaactagatttatattttatctgaaaagagtattaataatatataatagacctttgaaagttagacgcatagttctgcgaaagtggtgcctaagaatagtatgtcaattgacaaattttttccataaagaatctgattttgctagactacctaatcaccaattaacatcctccagtagggaaaaaaatatgcttggtgacatgtttaaatcgctctcaagagtactgaagatgaatgatcttccaatcaagtagctatttgatttagtaataacaactaaaagatgggaatcctcttcttcgcacactcattttaagctccaaggtaattccatagattcaacatttaacacgtatattcaatattacacattttttttccggagtgaaatggctctgaatgccttacagaatttgccctgctctccttaactaaatactttgtctattaatacttctttcttcttttccccttgttctttctgtgccagacccacacacgtctgctgtaattgaacatgccaggcacattctccatttaaagccttttaacagctgctgtctctgcctagaatactcttacttgggcacacacaaaactagcttcctggtctccctcaactgtctgctcaaacttcacctccttaatcatgtctatctgtccctcttatttaaaattgtaactctaccacttctgatctccacacttgatgcccctggcctcccttttcctccactgcatttgtcactaacatcccgtataattttcttaggtattatgtttattgcccatttctcaccgagaacatacgcctcagggtggaagaagtttgtctttttgttgttgttcactgcttatccccagtgtcaggagacatgcttggcacattgtaggtccgcagtaaatattttttgaattaataaagaatatttctaccatctgctagcttactgttcatgcaggagctcaaatgtgctttaagcatgtgatatgtttcaaaagtcaaacttcatccttagggagaacactgtcatcttctcctcctttaaaaaaaaaaaataggaaaaaaagcaaaacaaaacatcaccttctcatttccccacctccaacaaaaagagtgttgagttttctaaagaaataatacaaatggataaaactgcaatttgttgtcctttctctcacatgcaaaaagaaaagaaaaaatactgccgagatttcggcagcgtgctgagcttcatcaaagcattaaaacaatgctgcttgagacgtcagaggctcatccaggaagtgcaacccagagggcaggatttcctgctggactttgaaatccaacccggtcacctacccgcgcgactgtgtccacggatggcacgaaagccaagcgagtccccctgccgagctactcgcgtccgcctcctcccaagctgagctctgctccgcccacctgagtccttcgccagttaggaggaaacacagccgcttaatgaactgctgcatcgggctgggagagaaagctcgcgggtcccaccgggcctcctacccaagtctcagcgcgcttttcaccgaggcctcaattctgggatttggcarctttgctgtgaaagcccaagtgggtaaccaacagcttggaggacccgagtggattcgattctctctcactcctcggccactcaactgctccttgtccctgactccgcggtggggatgaataactcaactcatttcgggccgcttttctcagagggcaaagatgggtcagggtgggatgttacattagtgttgagactctttggatccgtttcgtgggtaccgaggacgcctgggtacgcgggacaggctgcacccgcctgctagaggcgccccatcgaggcgccacgggtgaagctcccggccccacctacggggcggggctccggctcggtccgactattgcccgcggtgggggagggggatggatcacgccacgcgccaaaggcgatcgcgactctycttctgcaggkagcctggaaggctctctctctttctctacgccacccttttcgtggcactgaaaagccccgtcctctcctcccagtcccgcctcctccgagcgttccccctactgcctggaatggtgcggtcccaggtcgcgggtcacgcggcggagggggcgtggcctgcccccggcccagccggctcttctttgcctctgctggagtccggggagtggcgttggctgctagagcgatgccgggccggagttgcgtcgccttagtcctcctggctgccgccgtcagctgtgccgtcgcgcagcacgcgccgccggtgagtgagcttgagccgaggcgcagagaggggcgtgcaggtgcgggcgcggatggaggcgcaggtgtggcggcrcgagcgggtacaaggaacacctcgtgctgggcagcttctttacgggggtctgtggtttcgtgcacaggggtgtgggtgcagagcgggctggcgaaccccgtcctcggtagattcggtgctacctgcaactagaactcctttaaaggaaatcctagtctctgcaggatacctgggtgtgattcgcacattcttagatttgagtgagtgtacttgaataaccagttccaggcccttgcattttgaagtgtttaaataaaatgttccggtggacctgtgtgcattactcaatcaaggacagactgcctgatggtcaggtgctttctcccgaagaagttcaggagttcagcccaggatactgcagggccgtgggaaacgctgagtggtcccaagcttgggcggtgcgagcagcccagagcaggccccaaagggccccctgtggccttttgcacccaagtcatgggatcgcctgtcccgtggctctttcccacgagcaagtcacagggctacggacttcctaactgcaagagacagtgagggacgagcgtgactctttcattttacagaagaggaagtagacctagagtgagaaaatatttagccagaggttacactgttgtttactgaacatgcgtaacgtccgagcctcttgacgcccagtactctttcataattcatttctttataaagcaatcagactgcgtttgtctttgccaacagaatcggataagtaggaacctggcgcatctggcctgaggctagatggtgatggtcttgaatagtttaggtaggttattgaaagtggaagcaagatgtgcattgtcttcttttatacctgtaaggagaaattctttaaaatcatggtgggatatgatttagccattaaaattgatataatgttcagcagwtaaaagtagaatccagaatagtatatacagtttttcctgtaataggaaaatacacagaacatgtatgtggacacgattaaaggccttaaaataaaattgctccattgtgggtagggaattaatttgcttgacggtagttggttttatgggaattgggagagactttgatactttgatactgtcagggcccttcattgaaagaccaccaggaacacaccataagctgaacaaattgggtttagtgttctttgaggcaaaggagaccacacaccatgagcgacggacggtaggttatagraaaaaacccattacagaatttgaacttcggttgcatgatttggggtaagactgaggaaccgggctttgctgtagatagaatgctgttagaaggtggggcaattctgactgagtaaagaaggaacagccattctgtttagcacgagaaggggatgtttggtgttttgtgcgttgcaggtgcccttgtttttgtctgttcttagasaaaatcttcaagtggcattgctttgtcttggtgtgtcatgtctcagaataatcttatccgacgtaggtatctgtgggattgttgatgtccaggaggaaaacagagcttacctggctgtgagtgtcagatcggcttgtaataatattgagagatagctgtgggactcagagcagtttcaggtgttggaggctgttttttcttctttctcaatagctttatttattctagcaaaagtattttgatagctattttcagaagaagaattaacaacctctcaatggatataatagttcttatctagaacagcgattatcaaagtctagtctggccactggtgtcactttgggaagctgttttcacaggttttcaakgaaactggaaaaataagaatgcaaaactaaaattattaatttagaatgttaatctttactctgattgtatggacttcaagttttcattgttgcaaacgtgttcttaaaaataacggcagaggtagatgttatgtgcatggaatttgttttgttttaacatctccatttggcagaataaaaatttggaccctcctgtgccaaggcctcattaatttttttttactggcctggaaaatcctgggatccatgcactgaaggacctttagaaccttacagaagtttagtgacttcattctctgagaagaataagcagtttttcaactggagtcattatatgataaactatagcctcatggtaacaaaagatatttcaaaagtactttcaataaatatgaataatgagaagcagctttaaattggaaacaagtcatttgatttagaacatctgtaaggattttttgtgtgtttgtttttgaggcttttcacaatattcgtatgtgaaggtcctcctgagttattcttcattattgaattttttaggagtctattaagagatgatggtgaagacagtggcacaagaaatgtctggagagatagcgccagatgacatcatccagggttctgtagactcttattaaggattcagaaatttatcctaaaaaatgggaggatctggaaccagccaatgggaggccattagatggttttagacaagataacattttcactttaaaaagatgagtctggattggaggtcagcaagggtagatatgaggagactagtccagaaaagaaaacagggtgcgttgaaggatggtggcgccaggggtgagggagagaagtagatgttctagaaaaaaatcaggagggcgaatgagctgaaggaatcgttgggtgaggatgagggagtgaggtgtcagcgtgacctgcacattgctgaagtgcttcgctgggcgaatggtggcatccgttccaggaaacatggggaggggaaagcttgggggctaaagaatgaggatcgttttcatttggggtgtatgttaaatttcaggtggcagagagrcatccagcaggccactcggactggcactcagaagagagacactgagagtcactggcataatgatattatatttgaagcccttggagcagatgaacttacctagaaataggatagagaaagagaagaaaagagaactaggcaaaggctaagtaacttgcacatgtatgtgtcaagaagaggagaaattgccaaagttaaaacaggacaggccgggcgcggtggctcatgcctgtaatcccagcactttgggaggccaaggtgggcagatcacgtgaggtcaggagtttgagactagcctggccaacatggagaaaccctgtctctactaaaaatacaaaaattagctgggcatagtggctcacgcctgtagtcccagctactcaggaggctgaggcgggagaattgcttgaacctgggagggagaggttgcagtgagccaagatcctgccattgcactccagcctggacaatgagcgaaacttcgtcacagaaaacaaaaacaaaaaaataggagagtaagtggaacaggaagctcagggaagagactgggacaggttaactatgttgaatattattgagatgtcagtggtattatgatgttgggcaactggaggtcattggtcacctcgactggagcagtgttgggggcagaaaacagcttgcggtaggctaagtgtgattggcaggaaaggaactagaggggagagatggctgctctgcgtaataaatctgacccacttcataagatgtgcgaagatgaaacgtaatggcttagtaattaattgccaaagtaaacttgtaaactcatttttatgcatcagcttctcatackagttaacagcgtatgtcarcattgttgacattacctattgaatcagctttagcaatgattttcacgcagttgccagaaatctcatagaccccatctggcctaggaatttattgcacttcatctgcttttccctacttctcccaaagarggaacacacaggtgtaatccattcacttattcaacaaatactgcttgcctactatgtgccagactcctaaacgctgggaatgcgtcagccaatgagatagatgaggtccttcctctcatggagggtttattcacattcctttgacctaaatatcagtagcttaataggatgccatcccatcaaagcccagaagacaagtgaaaacattttcaagctcatgtgaattcttgtacacgtaggaaacatgcctctttgtattcagtgtttctgctgagttgtacataagaggacattataggaaaaacttgtctgcaaaatagttgttgatgaattcaagaattgaatgaatgaaaaattgtcttgctagagttgtttggcttctggtgggtatgaaaactgacatgaggtatgtaattttagattatctttcattgtctctttctgagtatttcaataagacaagcacacaagggctttctggacttttaaaattcattattagaagcatacattatttcattgagggtctcctaattctttcgggctcaaatattttaaggagctgtacaagttatgccattttttaagggtatggcgctttcattgagaccttawtaatgttctctttatatttttgtkttttttttagaatgttgtgttcagtagctctgtaattaatttctcttaatgaatggggaggacattcaaagaggcttaagtttctatcaaataaccagaaaaattagagaattttytgacccaaacagtcttttaaaagcactttccagagagtttttttkttttttttttttttctgagatggagtcttgctctgtctcccaggctggagtgcagtcacactatctcgtctcactgcaacttccacctccyggcttcaggcaattctcctacctcagccttccragtacctaggattacaggcacatgccaccagctaatttttgcattgttagtagtaacggggatttcgccatgttggccaggctggtcttgaagtcctgacctcaggtgatccacccacctcagcctcccaaggtgctggaattacaggcatgagccaccatgcctggcccagagagtttcaaatgcattgaaatatcagatttttaccacttatcttcactcttaggagaccactgaggggcagggagaaaggtagggaagggcagggagagagagagaaagagaggtactgtggggagagggttagagagaattgattctaagttggattttgtttcctgtgatagggtgtacatagtataccatccagaccacataatctctcttcttatcatctgtttctaatctttacctatcatctatttaagtttttacctgccttaatagagttgtctgttattaaactgtttataaacttggggatagtaaggaactttaaataacattaagtaagttcattataattctgttttagggctactcgtgggttttgaagctgtgtctccctgtagaattcttttttgagggggaggaagtagctcttttttccaccctacccctaaaactaacctttttgcataaacgacttaggcgttcatgccatgtgagcccctgaaatactgtagtctcatagctgccaactttcttattttctgtcacatttatcctatttccttgcagccaggttctatgccaatttcacgtttgtttattgctaccaagagtcgttatcaacctcagactcactccacatgtattgttgctagcttgctctttagttcttacctctggggcaggtcacattctctcctaatactagacagagcattttcaactttgctcacagttgtctagtaagaaatgtgcctgtaatttgatgtttattttggctttggaacccagggcgtgcaaatgtcattattaggaagggatagsagtcattacrtttcacttaatttgccgagttgatkctagtgatcaccagaagccctgaactacgcgcagattattctgttaggaattaaattgaggcattggttttattatctctgtgggaagctgtttgatagaacagggaaagccattgactctgattctgtcaccagctgtgtaactttctacaagtcactaatggagcagggtcttaagtccacaacatgatcataaaattaagcacttgggttaagtacccatcacagtattcccaactcataggaaaacaatggtcagataaacaagaaaatgtaaagcggagtatctcctcacagcagaacttatttacaaattttacaaagtaaaattaagttgcaacccctataagtctctaagtagctcatttattagcaaaataaggaaagccatttaccaatggtggattacctaaattgtattcgattgtagtagcagaagtattgtgtccagggaaaatgaaattattttacatgtcattgagaacccttgtcctggactttgggaagaacatcaatatcaattaaagaacaaagcatgtgatttttgagtgatttttcttgactgtcaacataccgataactgatcagttgttgatatttattagatgatcattgccaagtttgaagtgactgaagagttagcctctgaatcatctgtataaaacaactacaggcgaggatgttttcgaagaagctgagaaaataatgattgagtataacctggaatggaatctgctaagatctataaaaattgacagtagtaaaaatatttgtgagtagaaaaaggcggagttgagcaaattcacaaaacttgtgaacatgcgaggtgtttaaagctcatggttatttattatagtattccttttcagatattttgkggaaaatattggaatctcacatgtgttattgaaccggcaatataaaccatgagcttcatttgctcttgtggatataaccgtcatcatttctgtgaattatcagaaatagaggccggatatcctgatgtctcttgtgacagagccattagatagcttgctagctgtaaagttttgcagtctttgagttcacagttgagactgaagtttttctaaacgagctgcccccagccactattactgaacacgaatggctttggaaattagcttttgctacagacttgatattgtttcttaatgaattcaacgcaaaattaccagacaaagccagacatatgtgagaaacttacagtgtggtaaggcaaatttgacagctaatgtttgaatcacaggtaatgtcaacctactttatatattccccatgttatcaaaagttaaaacaagrtgctagacctccattcttacacagctgtccagcagatacattttctgtgctcaagctacagttccaggagttttctgagctcaagctacagttccaggagttttctgagctcaagctacagttccaagagttttctgagctcaagctacagttccaagagttttcttacctactctactttatcttattttggatttgtacttttttaaaacaattattttactttcacagaactggttctccagaggaaaggagataaaagacacttgatatgttgaatgagtaacaaaagaatcataaatctgtgtggactttttttgataagtttaggagaaggttccattttgccactaagcttggacaacttcccctaaaagagtctgttcattccttgtctcaggcagtgacgtcagtgttgggggccgtcctcacctcaaggagcgcagagtctggtattgacaaggaacgcaaacagatgattataaagcagtgtcataaacatgttgatgagagtgtgcacaaatgctgtgggaggaaaggagggtatgaatattttcatatggaagatagatgaagacttcacaagaaagaaaatgcttgaactgaatcttggaagttagaaccagcagttcaccaggtggggaaaaggcattctagcaagagggaatagcacagacacaggcatggaagggtgagagatgataggaagtgcctgcgtatggctataaatactaaggggagtgtcaggagatgaggctgggatggtaagttaccatggaaagatgatgaagggccctgtgctgtgtgccctgaaaatctggtttgggaggcaaatcccaggacaggttgcaacacacatggctgrtaagtgcagataatacatcctatcaggtcatttacttttagtgctaagtcagcctctctaacataaatattttccatctactttgttacatttgttcgttactcaatatatttgaaatattagagccaaattataacacctagcacttttacaaattgaattgaaactgaaaatccacttaatggtttaggattttagaagttttcttggaargaaaagacttattttaagaggcattgaaacgtataaaagagcaatatcagacttgatgttgtcttcacagattaactacttttgaaattgcttattccrttggcaagcatttgttattttctgaaacttaattttctttgcttttyagtggacagaggactgcagaaaatcaacctrtcctccttcaggaccaacgtgagtaaacatcagatgatcaaaactccctttgacctttgtgaagttttttctgtatgtaataattgctcataaacgaacgatagtgaataaaatcttaagtcatgtttcccattccgagacagaggtttgtttctcagatttgtttattatgcatttggctgagatcttggacaaatatgaaaatatcttccgattcaaatgcccgtcgctagactatcaaaatcatcggaaagaaaaggattttcagccagacgcggtggctcacgcctgtaatcccagcactttgggaggccgaggcgggtaaatcataaggtcaggagatcgagaccatgctggctaacagtgaaaccccgtctctactaaaaatacaaaaaattagccaggcgtggtggcgggcgcctgtagtcccagctactctggaggctgaggcaggagaatggcgtgaacccgggaggcggagcttgcagtgagccgagatcgcaccactgcactccagtctgggcgacagagtgagactctgtctcaaaaaaaaaaaggaaaggattttcattctccactcaattctcctgtctaccatgaagggtttttctcatctttgacaaatgtaagggctgtatttgaaatgacctgtgattctctatggtgcctggatataaaccaccaaattatattgtaacaaaaaagcataggccctcatatgtgaaacgttctcaaaataaaccttggcacaacaaagctgtcgaggacaaaacaggattggaacacctaagaggaggaccaatgtcatgattcagtgtgtttaacattaatatttttagtctagattttggtctttccaaatcctcagtgtttaaatgggcctgtgagaaagccataataacagctcacagacccctcagagtgtacagaacagagaaaagaaggaacaggtatagggggtggtgatctttttctcctacactgccctttcgctgaaagtagcctgctgtttgtagggggaaacagtacaactctatctagtgatatcaagatgacattttcagttcgtgcaacattccaaattacttacgttgtactgttgttgtctaaacgatgtattttaaatagcctctgtcccagatagcgtgaaactgtaataaactaagttcttttgacttactcgcctttatgtagaaagaggccagtatttggcaggaagcaatttagaggtaaccagtttggatgttgtttggggccagtgttcattccagctctttcttcaatggcctgctgtctgaaagtcttcctttctgtcatcactggcatcattctggccttcagtgacatgtctgccttactgattaattatgtctctctgttggtctcactgccccaattcattgaacatttaatgaggtgccttccatgtttgaggccgtttctactcccttttaggtgcactttacatgtgtctataaattgaatgccctgcaaaccataaacctttcctgattaggcattttactgactcttattgccatgtgcatgtgagtgtgtgtctacctatgtgcatacatacctacatgtatacatacatatgtactccaaaacacatacacgtgtatacatggacataacttgtatgtttctttccttgccttcattttttcgctagctttctttttatctcactagcctgctttcctacacaaaaagcctcggctttgctcttatccttctcttctctcaactctatcaatggatcttgagatttaggagataactgtggtatttatgtacctttgaatgacaaacagacgttctgttcctttgagatcatccttttcaattaagtgcgtagatttgggcagcatccatgggcagatatgagggaagaaaaagataacctgtttggccagcatgactagtcaaatcaatgctgaagataaargaactgatagccagatcacccctgartccatctgagtcccattcagcatttctttcccactgctcacgggatgcctagcacttgctctcttatttgtatatgtgtgtgttgtgtcacctggactagtttccatgccacctaggtagccatgtgggttcaggtgatgttgctgatattatgaatggcatggacattgcaaacactaagtctcaaaaatgatgaaatgatatttcttgtttgcagtgaagtaggaaaataaattgtgatgactactgttgattgaataccaatgctgctaagtgttttttttatttttgcatttttcatatagtgtcttccctgctattataaggtggatactcttttattcttatggggaaattgaggcgtacaagttaaatactgaaatgttttagaaaactgtttaacgagaggtaaaatgtgcaattatggctaagctttagtcattaaaataatttggtttattagattaaccagttctctcaaattckaattagtgcaggtttgatggtagagaggtttgtggggtctcatcatccccacttcattgtaatcccttcattgtccgttgtgttgtgttcatcccctctcatcgcrtctctgagatccatgaacctacccaggactctaggctgaaaaagaatcaggaatttatggcggrtatagaggcatgatttgggattggttggatgttatgaggtgaggagcrgctgattggagttcatagggatgagatgcatakctccaacaggccactgagttatctttgctactagacatagaaatctaaatgcacagttgaagggagaggggagactagtaatacctgcccataatatggggaacaataattacttactgaattgtgggacaaaattttacatgtgaaattatggtctgtcagaaatggaattaatttgttgtgatgaaaagyttttttctagaatataagtattgtagcatttcatgtagatatcagctcctaagaaaatggggaacttgaaaatgctttgagaagaacaaaattcgttcactatgattttgtttaaatgtacatttccaaaatygaatatacttttcttttctgtctaaatcacaacctgaatgtctgctagttaacagtttcataaaacctcatacatataccagggccccaagttacacagcattatttagagaaccaagtaattatttatgayagtggaaatataaatagaaccacagttcatgacttaggtaataacccatccccagctatggacataagtctagataacatttctatttaggagactggtatcattgtggcacataccagagtcaccctgccagtctcaggagcagatcagtggaacagatgatggttatttttaggcataggtttatactgataaaccactaamtggcacacccttaaaagctatttcagtttagtaaccagggccagaaaataatgttcctatagcaacaaaaatagttgtagaattcatccaccagaaatatggcccagcttcactgataagtgactggatgttgctatatcctcagaaattgctgcacgtaagttaaagagtaggargttggaggatatgacagaatacagcttgggcttggactttgtccagaaaaatgagaagagaagaggtatatagtagggaagattaggatggctgacagaatcatgaaggttcttgaarctgatcgtgggaagataatacatgttgccatctggggcttaaaaggtgatcttcctgaaggcaacactggagacattggtttggcaatagtgttacactctctgagagagaattctgaaactggaaaccaattggagaattgtctagagcccagactaaatctttgcagatatttaggagaaaaaaaaaaatggcaggtatttcccgtcagtgataatcaggttagagctcttaagccatagttgattttttcatagaaaaccaattcacatgaaccttccctactagatmattctattccaggatttctgtgaccgcttatgattgtgttctcaacctagaagcactaggtagagaatgaactttctttccaaattttggtttgggtaaccaaattctacactgytgttaagactttgcctctcatatattcttatagatgtatctaactgaccctcacaaaaaaccctttcatcatttcaagrtgatacacctctcattacaggtacagaggtgcagttccatggtacaccataaatcttgacttaccaccctacaaaagatggcatgaattgatgcttgacaaggcaccartggtatgctatgatgcttaaatcttttatttctttatttttatttttatwtattttatttctttatttttatttattgattgattttttttttgttttgagayagagtctcactctgtcacccaggctggaatgcagtggcacgatctcagctcgccgcaacctccgcctcctgggttctagcaattcccctgcctcagcttcccgagtagctggaattacaggcacctgccaccatgccggctaatttttgtatttttagtagagacaagattttgccatgttgtccaagctgatctcaaactcctgacctcgagtgatcctcccacctcagcctcccaaagtgctgggattataggcatgagccgccatgcccggccatatttcttattttatttatttattttccccccaaggaccgtggagattctatattaaatcttttatttctaactttattaaatattattgtatttttaaaagaacacttcatgaaattacccacagaatagtttaaaattgtgcttttgatacctttctgccctatacgttaagtgacagcagaggaaaagaggtcattcctctgtagcctttgttcttttttgtaaactttacctttgtttctttccctttatgtcatctcccttcatgtaaataattaagaatcaaattcactttaaagataaaattagacttactgtattaatgtattaatcgaggccaggcacggtggctcatgcctgcaatcaatcccagtacttttggaggctgaggcaggcggatcacctgaggtcagaagttcaaggccagcctggccaacatggtgaaaccctgtctctattaatagtacatgggttaggccagggcgcggtggctcatgcctgtaatcccagcactttgggaggccgaggcgggtggatcacgaggtcaggagttcgagaccagcctggccaagatggtgaaaccccgtctctactaaaaatacaaaaattagccaggcatggtggtgcatgcctgtagtcccagctacttgggaggctgaggcaagagaatcgcttgaacccgggaggcagaggttgcggtgagcagagatcgtgccattgcactccggcctgggcgacaagagcaaaactccgtcttaaaaaaaaaaaatacaaaaattagctgggaatggtgatgcacgcttgtaatctcagctacttgggaggctgaggcaggagaatcgcttgaacctgggaggcagagattgcagtgagccgagatggtgctactgcactccagcctgggtgacagagcgagacgctgttttaaaaaatatatatataaattgtcaaatagcactctcttttagctacatatgggtaagccaaaaggtaatcttgacagcatttcattatgtcttttagtaagcattttatttatttttcagctaaaggttatagtgaattctctgaagaatatgataaatacattcgtgccaagtggaaaarttatgcaggtggtggatgaaaaattggtaagagatattatttctcamaataaatgttaagcacatagaaaatgcgctgttatttatttaaaggcataattcagcaacctcttcgcagggacttgggcaaatctgcatgaatcyagctcactgtcagaacttcagagggacttaaatttggggaattggtaatattagggttacagcatagcaaattatggtttcgtaaaaggggatgggactacgttacgacattgggcaaataaacatatttcatctgggagtgtggtatttccttccctttatgtagtgagttcactactgaagacttggttttttttcttaagtgtctcagggacatccagagattttttttttgtagatatgagcaaatgacatactcagcctggccccttattctgtagagttcctcagtagctctgaccctgaaactcatttgggctgagtgtttctgtgcaatcaccaaaccatttcattttcatcctcatcatgcaggaagactccatttctcagccctgtttttgttgacgcagaaccaatgaaacacctagggcctggcccctagaactgttaaagggatcctcattgctcttgatggcagattttgggcattaatgacatttggggttgggcagctttttttttttttttttttgagacctcatctcactctgtagcccaggctggagtgcactggcatgatcatagctcacagctgccttgatctcccaggctcaagggatccttctgcctcagcctcctgagtagctgggactacagtcacgtgccgccacacccagctacttttctgaatttttagtagagacggaggcttgctgtgtcacccaggctggtctcccaactcctgggctyaggcgatcttcccgcctcaacctcccaaagtgttctcccaaagtgttgggatcgtaggtgtgaaccgccatgcccggcctgggttggatatttctttgtcgtgggcttgtctacattccaggatgcccggcctggggtgggtgtctcttttttgtggggctgtcatgtgcattgcaggatgtttagcagctcaggatgcccggcctggggtgggtgtctcttttttgtggggctgtcatgtgcattgcaggatgtttagcagtgtccctggtccttacccactggatgctggtaacaccccctcagttgtgacaaccaaaaatgtccttagatgttaccaaatctcccgtggtcgagaatcattgccctagcggctgagtgctgtggccacatcctccctatgacacttgtacctgccaagcaccaaacccattatccctcacgtkcatgctctcggagcttttgtttcaggctatcctttatgttcatacttaccggacttcctcaaaacaaaaaaatgctggcaggagcaaaagaggatgaggcccccacgttccccgtatgccttaatctcccctctactctgaatgttatcagggagggcaacattgcagagagtttttgtgccacgccttggaatcggacaatactgggttttaaggctggatcagtcacatactagccttgtgtcctagggaaagtttcttaacctatgaaacctcagttttctcatcagggagaataataattactaatatatatttcatatggtggttgtaagggttaaatgacatactgtgtataaagcatagtgcttggatgtaataagtgtttaataaatacccattacgtcacatttgtttgttaaatggctggaacattccacttgggkaatgctttgagttcctagggaraaaaaaaatatgtttaggtgacattacatgtaattaccaagttggttaaaaaagtgagattcgtgaattttaagcagattatctcagcaaaaggccgtgaacttaagttgtgatctggatgttagtagttgccattgagaataaatatatgatgtccaccactgaatttgctcaatgtctctggttygctaaaagaatgcagttacttcatcttagctgaagatcagccattaaccatgacacagggctatggatagaatagtgcaggtttatctctgtgagtgtgggaaggaaatggtaagaacggtatatgccagtggctagagggtgaattcgtgcagagagataaggagtgcttgttaygatrtttttgtggtgtgggtcaggttaggtcatccaagtggaattactctcgttcctgccttctctggagaatgatggaaaaataaggcaggaaaaacaatctgagaatctggtctctgtataggggcccaatattcagtattacatagaatctttttataactacatgatgtaaaaatgctttaaaaaataattcctatcacttattatgatagcagtatctagaaaaaattatatgtccaagaactagatttcaaagcatgcttttattatatttgtttatattatattatatattttttattrttattatgttaaatgcttttattaatatatttgttttccagcctggcctacttggcaactttcctggcccttttgaagaggaaatgaagggtattgccgctgttactgawatacctttaggtaaagttcacttagaagctttaaaaaaaaaagtaattaaattcttttacaagtttccrttgaggtgtgatatacatacagcaaagtgcacaggtcttagatatacagctcagtgaagcttcagaaatgcatgcatgcatgtagccatgactcagatcaagatacggaagagcccagcactccacgatgctccatcatgcccctttgcagaaaatactgcctcctccagtaaacactattctgatgtcactatagattagttttgcctcttcgtgaactttgtataaatagaactgaacaatatgaactgtcctgtgtgatttcttgtatttcattatgggtggtgtgctattgtatcaacagggtatttgggtggttttcagatttgtgatattaacaataaaggaattataaatattgtagtacattttgggggtgtctgggtactcattttctggatatatacctaggaagtgaactgttgtgttatagagtaattgtgtgtttagccttatagattctgccaaacagttttccaaagtgattccagcagttgacaatcagcagagtatgagagtttcagttttctcctcttgataattctcctctcgatagtgtcagtctttttttttcctttttttttgttagtgtcaatctttatttgagcctttttgttgagtgtcgcagtatcgcattttagtttcaatttgcatttccttgatgattaatgagattgaacagtttattgacttttttttttttttttggttttctttgtttcttttggagaagggcttgtgaaggtcttttgcccttttaaaaattagattgaaggaattttttacatactttgaatataagccctttgtcagatatatggattctgaatatctgctcccagtctatgaccttcatttttattctcttacttttgtcttttgatgaacagaaatttttaattttagtgaagtctaatatctcagtcttctcttttatgagtagtgccttttgtatccatttaaggaatcttggcctaccccaaagtcatatatatatgcttatatattttcttctagatgtttaatgtttactttttacatttaggcctatcatctattttgaattatttttgtatatgctatgacttatgggtcaagcttcaggtttttctcatgtggtatatccagttagttaaacagcatcaattcaaaaggctatcctttcctcagcaaattgcagtggtgtctttgatataaatatacaatacatatatatatacacacacacacacacacacacacacacaatgtgtatctgtatatacaatcaggtgattgtatatatgttgttttgtttggggaattaagtttcatttacatatttgtctttttgtcttcccttatatcaatactatttcacctcagttactaaagctttatagtaagtcttcaaattaggtggtataattcttccaactttgtttttctcaatatttatttaagttactgatttctctgagcagtatcttttattttcagggagaagacctcrcatgycattcgttaaaattattcttagatattgatggtttgggaagctatttttaaaatttcaatttaagctttatggcatgtaacgaaaaatattttccccacgaccccaaaagttttatctttaagctagcaaagcagtagtgtcattattttaaatagccaacagtaccttcattttatgagatgattgagaatttgtgaaaatcagtagtatttatcaacaaaagtggctagttttgtgtgctgcttctttaaaaaaatcatttaaaagatagcatactggaaatatgtacttgctgcctttatggaaagcaagtctaattcctttattatgtaaagaactctagcaactcaataccaaatagaaataccttatggattaagaagaataacatgatgtataagtggtgtaaatttatataattattataaattattataaatgtataataaaataactagaatttcaccaaattagaaatttaatggaaataaaatacacattggatttgggtgaaaaaaacatgttgagcttaacatgttaatgttaaatgggacagaaatacaatgtgctgcctacttttgaattaaatgctaaatagcagtattatacattttgggaaaatattcaaaaaataaaataccctagaatggagtttcttggcagctctgtactaattttaatagttcttgaatctcctttttcaccttagaaattttagtcacactttaaaaatctgggcaaaatatatgtccagcaaacagccaagagccagatgtattaaatgatcatatttacgctcccaaaagaaaattcaaaatgaagcatgttgataaacattttggatgtgatgttggagaacaattgcaacctgcccagatgttcagctcgcccgaaggctgcctccttggtgacttgtttcatcttgagtctagagagtccaggctggggaagaaaaccacctccagccggccgttccagcacagcccyactggccaaagcacacactcacacaatgaaaacactgaaactttttcttaaaacaaatttttctcccattgtcatggttctgtatattaacacaaaattttcttttctcataggagagattatttcattcaatattttttatgwattatttaccatttgtacttcaatagtagcagaagacaaaaaaggtaattgtgcgctgagggagggtgggcagcatgaagcactacatraagaaaaatcttctaaatgaaattagaacttctgaaatttgggcttgctatgtaaattctgtrtatgttgcatacagctttttatttcttggyaaaattttgtgattgtastgaaaattttccttattttcagactactgtactgcctattaaagttgatttcagacatgcaaaaaacctggaagaaatgttgcagggctagaaacattcttctcttcctcatagtttacttctacccatctacatgmtttgatrgaagtgctcgcaggaggtgcttccttatcttcgtgtatgtcatgacatctgtccttttcttgaggcccagaacacacattctcccatcctttcccagccaggcaacccaatggataccagcctcactttcccgtatttttcctgactggttcccagagtacaaagcacaggacaacttcgctaactcaccctgatctttgacctatactctggktataaatctgcctgtaccttacccttgagatgtcctgctctaggggatgatgcctgaagggaaacatttgatgaatcacagtaattgaggctcagatttctgtgtcctggtagaaccatgtgatagtgaaccaaaacatgaccattgattccttttcccatattctgatctwacctggaaacccgtgctctcagattttgtggggttatctggcagatagayggtgacaacagtcccatctggtgaaggcttaggatattaggatgtttcttacttcttattgtttgaagaaacagttgtgaataaaaattaatcaaaattagaggccaggcacagtggcttacacctgtaatgccagcactttgcgaggccgaggygggcgratcatctgaggttgggagtttgacaccagactggccaacatggtaaaaccccttctctactaaaagaaaaatamaaaaaaaaaaaaaaaagtagccaggtgcggtcgcacatgtctgtaatcccaactacgtggaaggctgaggcacaagaattgcttgaacctgggaggcagaggtcgcagtgagctgagatcgcaccactgcactccagtctggccaacagaacgagactctgtctcaaaaataaatwaattaatcaaaaytaattgtccagctttgatttagaatcttaactgctattacacgtctcttctgtctaccttcaaataggtcatctaatacatgggagaaacatggattttggagtatttcttgggtaagtaaagaacaaagggtcaggcatggtggttcacgcctgtaatcccagctttttgggaggctgacacrggtggatcacgaggtcaggagttcaagaccagcctggccaagatggtgaaaccccrtctctactaaaaacataaaaattagccaggcatggtggtgggcatctgtaatcccggctacttgggagcctgaggcagagacttttttgaacctgcgaggcggaggttgcagtgagccgagatcgcgccactgcactgcagcttgggatacagagccagactccatctcaaaaaaaaaaaaaaaaaagaacacagaactgtttygktctgtaggaagagtaggttgtrttatattgatgataagtaagtcccaagtcacacccaaaatgtgatcataagtgaagataaatggattgcttgagtgctgagacaagagggacatgctcttctattttatgtgtccatcttgacctttctgaaaaaataagaatattgtaattagcattctatgtttgaatctgaggctcactatttataagctgtgtgatattgagagagttacctgacttctctgaacctcaattttatcatttggaaaacagaataawtataccatattgtaaaggtcttgttaggattgatcgtggtgactcggtaaataaagctcctagtgtaatgcctggccctcatcatcatgttgatcattactatcactgtgtttctgaaatgtcactgaaacatgtcttttataggtggaacataaataatgatacctgggtcataactgagcaactaaaacctttaacagtgaatttggatttccaaagaaacaacaaaactgtcttcaaggcttcaagctttgctggctatgtgggcatgttaacaggattcaaaccagtaaggagtctgttgttacataattatacaggtagccttctgtcctgttaccgttatgtaaaagttgaaatctaagaatatgaggacctaaagggaatatgaagccccatttcacccccttgtacttcttgtcacttcataggtatgagatctcgtggtagagaagagtagaaaggaaacggaggtttctgagcctcttctgggataaagagcatgtggctgggtgtcaagggctgggagtcacaatctgatttctagtcctgggtcttccgctcacttaggcaagtcaggcgttcattctctgcccttcagtttcckgtccaaaaagcgttgccagtgataccccacctacttatctcacatactagaatcaaaaatgctttgaaytttttaaaaagccttttatggttttgatttatttttgccttccccattacccaagctaggcctttatatcccactctgaagtacagtgagcgacagggccttaaagcgcatggttgatgtttctgacttsgttgctttgtcttyttctcagggactgttcagtcttamrctgaatgaacgtttcagtataaatggtggttatctgggtaagtagagcattctcaagtgaaatgggaatctcagagcttttttatgaggaaggctggactgtgccttctggttacaaagtccaacctcttccggttcccgactggttacaaagtctaacctcttctggttcctgactggttatatagtccagcctcttccrggtcctgactggttacatagtgtcacctcttccggttcctgacaytgtgttcatctcttccaggtattctagaatggattctgggaaagaaagatgycatgtggatagggttcctcactrgaacagttctggaaaatagcacaaggtaaagtgtttcgttgctttactattaaatatttattttaaattactcatattaaaaaataaaaatatttgtcaagctccagcttaatcctttgaggaactattgcagaatttcttargtgaacctctgacactcatgtggaattactcatgttttcttygtgcagactgtgtgttttatagcaaataaatgaattacttaaaaagcactagggatactgacattatgaaaggcacctatgaatatttttggtgtacagaaaaaaaatgacccacacacaaaagaacagtcatacagtaaaatcttcatttaaatggtagtacagaccaggcacagtggcttatgcctgtaatcctcaygctttgggtggctgagatagacagatgacttgcacccaggggtttgagaccagtctgagcaacatggcgaaamcccgtctctataaaaaatacaaaaattagccaggcatggtgacacgtgcctgcctgtagtcccagctactcaggaggctgaggtgggaggatcacctgagcccaaggaggtcgagactrcagtgagctgggatcagtccactgcacttcaccctgagtgatagagtgagactctgtcttaaaaaaacaaaataaataaatacaaaatgtactacatattaacctgtaagttatatcttgccttggtatagaaatcttacaatagcaaaactgcctttccttcattcagccagcactgcgtccaaataaatgggcatcaatcctatttttaatacttcccagggaataagatttaatgttagtagtgttctttgataacccacttcaatttttaatagtcctaattttcaagaaggtttactttctgttctctaagtcctacatactgtaatattatttccctttgttctgttgttgagtgaaaggcatggacagtaagggtggaagatgatctcttgaggccactttgtttctccttcagattagaggggcttcctaagattcccrcttcccatctcagtgttcaccatacagggtcagggattgcttttcccagaggcattgctcaccatccttttttagaaaacacattgtggctggccatggtggctcatgcctgtaatcccagtactttgggaggcgaaggcaagagtatcgcttgtgccaaggagttcgagaccagcctgggcaacagagtgagagcccatctctaaaaatagaaataaataaataacacattccttagatacttgtttttctttagtttctacagagctaaacatttccgttctaagtcatctaaaaatgtttcccaccatcatcctcagcaaactaacacaggaacagaaaaccgaacactgcatgttctcactcataagtgagagctgaacaaagagaacacgtgaacacagggaggggaacatcacgcaccagggcctgtcrgggggtggggtgaaaggggagggakagcattaggacaaatacctaatgcatgtagggcttgaaacttagatgatgggttgatgggtgcagcaaaccaccatggcacrtgtgtacctatgtaacaaacctgcacgttcagcacatgtgtcccagaacttaaagtaaaatttaaaaataaatgaagttatttactaaaattaaaaaaaagtttcatttttctttttaaatgtttctatatagttatgaagaagccaagaatttattgaccaagaccaagatattggccccagcctactttatcctgggaggcaaccagtctggggaaggttgtgtgattacacgagacagaaaggaatcattggatgtatatgagtaagtaggtttgttaaagcaaaagaagtagaaacaaaagcatacactgatatactttgagttttaaggcakgtagcctaagarggaatctctccttttgtatctagactcgatgctaagcagggtagatggtatgtggtacaaacarattatgaccgttggaaacatcccttcttccttratgatcgcagaacgcctgcaaagatgtgtytgaaccgcaccagccaagaggtacctttgcagggtcatctatagaaagaaactgttgccattaaagattcccttggttctggcatttttctttggccttcaagtaatttataaacgtyctatttttcatagtatctctagccactctccactratttttttgtttcgttttctwaacttaaagagcaaaattgtgctgtactttccttttctggttctaatgctggataccactctgaagttgaataacaaacaggcaagaatttaaaaaggggaaggagagagaggaaagtaatccattaaaactgttacctgtrtttctaacagtgactcccacagaaactccactgcggggatggaggggaggttgattaaagaatgtcttggtttctggtggcccatgtgtgtagataaggctgttggcttctgtatttaacttactgaacaaaactattttcttgtgttttagaatatctcatttgaaaccatgtatgatgtcctgtcaacaaaacstgtcctcaacaaggtattttaaatgttatatgtatatttgccttttagrgaaagaatttggccctatgttttatctttctctgttatctttgatcagtttgagcacaaaaggtgtgttcagcttaggactgaktttttattaaaaaatgtttttgtgtggctaaaactgtattttggaatacaagaaagaaattgatcactgaggcttgataggtcagaatattgtttatagctttatttacatagcatttgaattaaggctagcattttactcttattggtatctattaaaaatctcacactatataactaacacctaaatgtcaacaaaacaaagtctgcagtccattttcagacagagctctgtgtcttggtgggttccggtttcccttaaactttactacatctgtttatcttttccctacactgtagttttaaaaaaatgcaaaaagtttcctatcatcccaccactcgctaacaatcattccctgaacgttctgaatatgcccccctaattwtcccatttgttccttcttttcttggtccttctccacagctctccctaaagtaaacatgccgcctttaccctgccaggacaaatccctccggcctttagcatccaggtcaccctggctctcacaggaagcctgccttcagttcacgggccctgccatacttgcgttttgcctataccatctttgagcaagtcacaatctcgtgacttgtgtttgggtgkktgccttgtgatctgggtgcctgcagtttcccccactgtattggaaatgctttaaggatagggatagccaaagctccacggtttttactccataggacaccggcaggtctcccaggactgccagctgtgcgtcaaggagggttaaggcagtcttaaagcattgggggtggagcaatgtgctgtcaggaataagctcctataaggarctggagattctttcctgagcctgtttatattcattacctgaaacagtgatcctgttgaagttgtttgctttagytatttggtgagactttagctaattttatatgattatactatrttaatataaatatatasattatataacatgctttgcatatattaagttatattatttaatattaaataacttctaaagcaaattctacaagtatagaaatgctaatatatatcagaacatctctgaattgaaaacgtccttaaagtaaaaataacttttctttcagctgaccrtatacacaaccttgatagatgttaccaaaggtcaattcgaaacttacctgcgggactgccctgacccttgtataggttggtgagcacacgtctggcctacagaatgcggcctctgagacatgaagacaccatctccatgtgaccgaacactgcagctgtctgaccttccaaagactaagactcgcggcaggttctctttgagtcaawagcttgtcttcgtccatctgttgacaaatgacagaycttttttttttccccctatcagtwgatttttcttatttacagataacttctttaggggaagtaaaacagtcatctagaattcaytgagttttgtttcactttgacatttggggatctggtgggcagtcgaaccatggtgaactccacctccgtggaataaatggagattcagcgtgggtgttgaatccagcacgtctgtgtgagtaacgggacagtaaacactccacattcttcagtttttcacttctacctacatatttgtatgtttttctgtataacagccttttccttctggttctaactgctgttaaaattaatatatcattatctttgctgttattgacagcgatataattttattacatatgattagagggatgagacagacattcacctgtatatttcttttaatgggcacaaaatgggcccttgcctctaaatagcactttttggggttcaagaagtaatcagtatgcaaagcaatcttttatacaataattgaagtgttccctttttcataattactstacttccyagtaaccctaaggaagttgctaacttaaaaaacygcatcccasgttctgttaatttagtaaataaacaagtcaaagacttgtggaaaataggaagtgaacccatattttaaattctcataagtagcattsatgtaataaacaggtttttagtttgttcttcagattgatagggagttttaaagaaattttagtagttactaaaattatgttactgtatttttcagaaatcmaactgyttatgaaaagtactaatagaacttgttaacctttctaaccttcacgattaactgtgaaatgtacgtcatttgtgcaagaccgtttgtccmcttcattttgtataatcacagttgtgttcctgacactcaataaacagtcaytggaaagagtgccagtcagcagtcatgcacgctgattgggtgtgtacatctgtgttggtttggaggaggggggttattatcaagaaatacaagctgaacatcgtatctgaattaaataacaagggttatgtaagtgggttattaaatatgactaaayggtcacaatcttactcttacatgactgataccacctcttaaccagatactatcaacccaatttgcaggtgtttaaaggcagtttttcccccagataggtggtgcttccacaaaactttagtgattccaagattactttagtgaaacgaggaattataagaggatttacattaaaataggatttaattaatgaaaaaaaaactttactcagattttctacctcttacataaatgaagtcaggtcaacttgatgtatttttttgttaatgtaataacctttgatatgcctgatagtaaagaggtgagatgctaattgtttcagaccgatttctccggagtaaatcaaagtttacaagaaataacaggtattaagattttaggaagtaattgtttagtggtaaagcagttttaaaataggatatacaggatgagcctgtttatataacactttatatatgtacttatgcataactagatacacatctagaatatcaaaagatgactgggaggatattaaccaaaatgctgactgtagttcctactggataatggcaagtgctattttaattttgagaggacaaaacttagtagccattggacattaatgagactctatttttagaaatactataaaaaaataaggtccaggttggatccaaaccatgggctccatctaatttccctgccaagttttcgggagtttgattgtgaatggaaggctgaatcctacctgtattccttcacacatcgagctcctcagtcactcatcttaattagagctcttgcttatccatttatgtaccaggccttgtgattgataaggtgcttgacctagattacctcctcagcaaaccccggtatcacttgtaatcacacttgccagccatggaagtaacttgctgaaagttgcattaacagaagggcttagagccagggttttagccaggtctgtccaactcctgcgctcttatgacacccgaattcttgactttacaagtaggattgagaaacagctctgtcctatgagacccacacttctgctgccatggaccaggccacccagctgagcctggacaccactgtgtcactgccttctacttgttctgtgtcaattattaatgttcccatagggatcagaaaccctttggtgttaggagctgacaggtcacctgtttttgactaccctgagtctgaatcgtgctcagcttgtggggaatgcgttaagagctcctcagtctttctgtggctgtgacccaggagtacgtgaaaaatatgaatagttcagaaatttataaaaagtcactataaaacctcacacagtcattattgaagttagtctcacaaagtgaagcatagtttttgtttattggtgacaatttacaaaatacttgccagcttagcctcacatatgacagatgtgaccagcaggctccagacctcaccgagctgcatgctggccccgtctacaagcctggggaagtgtggctgggctcctcaaccttcacaacttggggaggttgctcagctcacatgaaaatcagtcctctctttttccctagggcactgtgtccctcttatgttgataaagtgggtttcccagccaggtggcacaggggatgctagactggtgtgcgttgggcaattctctgtggcagttctggacatcttcaaggatgcttgtctaggcagaggacagatttgtttcctgactacggtaataaagatcatcatctacctgtagggcaaaggttggatgagttgattggagaagcagcccatcttataactcgaggggtttcctgagcttggggttcctcagctgtgatacagatgatacatcataaattgggttgtcacacatcacctccttgggggacttggggtggggggcaaatggcattcccagagtaatacagtcctttgcctttggcccaggagtctgccagcatccaggaagctgtggcaggctaggtcattagcttgcaagcagggtaaaatctcaggcccttcacagggccgcagctttggggcagctgggcagggtctaggcataccagcctccaggctgcctcccacagccccggcttcctctggggctccttgaagggcagactgggacagtgatacggtttgggcctgtgtcctcacccaaatctcatctcgatttgtcaagggagggaccaggtggagttaattggagcatgggggtggtttcccccatgctgttctcgtgatagctagtgagctctcacgagagctgatggttttaaagtgtggtgcttcctggttctccgacttgcttctctcctgccttgtgaaggcgtcgtctcccgccctcttgccttctgccacgattgtcagtttcctgaggcctccccagccatgcggaactgtgagtcgattaaacctctttactttataacttagcagtgcgaaaacggactaatacagacagagtgggatagactgcatccctctgtgttctcacaggctgggaagggaggtgtggggcatgcaaggtatggagaaagttagtaaaaatcactggccctgtggaccagaagagacctgggccaactaggttttgcctctgtcaaatacaaaatcctcataaggaaacttaaccattcagccctcactgggggcccccccaattgtttttcaccaagacccaaacttggcttggtcgtcccggtcgtcagtggcagcaataacacctggaacttgttgctcccattgcaaggttgagcaatagcagctggcctgcggatctcacagacaagcggcctgtggcacaactggagtttatgttccaggtgcgcagaatgccgcacacagccctgctgcagaggtgggagggaggcgcataggcactgcggtctcctggtggattcagctccaggcagcatcccaaacattcacttcacatgtatctgattactgtgtccatttgtagctgacaggccaatttggaggcatctcagctggctgcctatgactgttgttaacaattcaagtgctttctgcaaaatagggcattgttattttaaaatacttcattggaattttttgttttgttttgttttgttttgtttttttgagacagagtcatgctctgttgcccaggctggagtggtccagtggcgccatctcgcctcacggcagcctccacctcccaggtgcaagcaattctcctgcttcatcctccagagtagctgggattacaggtacccaccaccacgcccagctaaattttgtatttttagtagagacggagtttcaccgtgttggccaggctgatctcgaactcctgacttcaagtgagccgcccgccttagcctcccaaagtgctggggttacaggcgtgagccaccatgcttggccgatatggcaattttgattgaattcaaaactcttcccaagataatttagtagtacatgtatcaatgaaagttaaaaaaaaattagttttcaaatataattccaatttctgtaaattcttgaatgcttgtacaacactgctttaaatttatcactcaattaggcatacaaattgatccttaatgatttttcaaaaatttgaggagatcataaagtctcggccaagaattgtgtataacaatttcaaatagaaaataggttataaaaacacgttaagaaaatggccgggctctgtgactcacgcctataatcctagcactttgggaggcagagacgggtggattgcctgagctcgggagttcaagacaagcttgggtaacatggtgaaaccctgtctctactaaaatacaaaaaatcagcttggcaaggtgccgggcgtccgtaatcccagctactcaggaggctgaggcacgagaattgcttgaacccaggaggcggaagttgcagtgagccaagatcatgccactccactccagcctgggcaagaaagtgaaactctgtccaaaaaaaaaaaaaaaaaagtctatagttttgcatttttatgtgtaatatctcccctgatgctttatcttctgttcattacttagacatttcataattaatataaagaaaatgtaatgaatttttcaccaagtccatatatcccctctcgtttacaaacactatccttttcagtatgtactgggacatacaaacaggccaaaaggtaacaaatctcacattgtttccattgcttcatcaccagcctgggtgaccagcgacacatgacttaactccttgcatccccatatctgcctttgtaaaatgagggtttagatccaattttctctaaggattcctctagcttgataaatctagatttaaattgtgtctcagttgcgcagggaatccagtagcagccgacacccaggtgtggttggactcgtcagaaccattgtagtctttgttagtcatacacatgcatgggtgaaatctagtcaaaactttcatatcaagtatttcaaaatgatgctctacttggcagaaagcacatgcagtttgggcagtcacgggcaggtagccaagatgcctccaaagtggcctgtgagctgcaaatgacagtttctacatgtataacatatacaaaatatgatgtatattttagtagagatggagtttcatacatatatacaatttatatatacacatatatatataatttgtacacacacacacagatttacagtaaatatgtttaaatttgaaaccatagtacctgagttcaatgccaaccctcactgaatgtcagaaaaacatagtaaggctgtgcatggtggctcacacctgtaatcccagctctttgggaggccaaggcaggagcatcacgtgaggccagaagtttgagaccagcctgggcaacatagtgagacttgatgtatactaaaaatcaaaaaataactagctaggctttgcagcatgcacctgtgtcccagctactcaggaggctgaggcgggaggagcacttgagcctgggagatggaggctgcggtgagctgtgatcgcgccactgcactcaagcctgggtgacagagcaagattctgtctcaattaaaaagaaaaaaaaagacatttacattatgctctatgatagtctagtggcctacacaaattctgctcttcccatgttgtggatatgaaataatgaggcagggttgatagcattatttcaaaatattataagaagtagcagttctaagaagtcaactgcaaggctatgcatgtccaaggctgtgtgtgggtgagtgaaatcgccttatgccaaggagccataaccaaggggaaattacttgatgcatacaccagttcttgcttttcacctgctcggtacaatggaccatacatattaccaaatggaataagtaagacttttcatcttagttactgagaaaaagtattccttggtaaagcaaacacccagtgattggctctgttattaaagaattaagtttactgtcttactatagaaaatcaagtttcagtagttgagtttcattacatttttgtttctgattgttacagttgctgggtgggaacaatgtgtaaagttttcacttgtttgctttcaagggtactgacttcataatatatagacatatacacacacacacatatacacacacacatattcatgtgtgtgtgtgtatatgtctctgtcaaagacacatatgcagtagtttttaagttattacattcattgccaatgagcaatggtgtatacaggggaagatgaacttgagacttgttctggtgttgtctctggcactcagttttcctatatttaaaatgtgaaggaagtaaggcactatgaaagatctttgatatctgcaaaatttttagggctgtcaaagacaagggactgtgaaaagttgacagccctttgttgtttgactgggttttttaaccaaaagaatatagaaatctatagcgatcatattaatatgtattgaataatactactgtcttatagaccagataaaaattaatatttttcaaatcattctccatgtggaaaatctgctatagcca

SEQ ID NO: 13481 - DNA, 13557 bp, Homo sapiens
gggttcactccatcctcctgccttagcctcctgagtagctgggactacaggcgcccaccaccacgcctggctaattttttgtatttttagtagagacggggtttcaccgtgttagccaggatggtctygatctcctgacctcgtgatccgcccgccttggcctcccaaagtgctgggattacaggcgtgagccaccatgtctggcctggccaggctggtcttgaactcctgacttccggtgatccatctgttctggcctcccaaagtgctgggattacaggcataagccaccacgccatgccgaagcccagcttgtttttaatttttttttttttttttggagaaatgaggtcttgcaatgttgcccaagctagccttgaactcctggcctcaaatgaccccgccttggcatcccaaagtactgggattacagatgtgagccaccatgccccagccttgctttcttgagatacgatttagaataccataagattcatcccttttaagcacataattcaatgacttctgtacaaacaaccatgactacaatctaattttaaaatatttcaatcactctaaamaagaaacctcctgcttatgtacagcgactctgtctacctcttaagtgaattctcctacctttaatagccctattttacagttcaggaaactgaggttcagagagacaaagtcacttacccacagcaaagaagcaaggctgggtatcaaatgcaggacccccccggtcctgatgcttttttttttttttttttttcctctgagagagactctcactctgtcactcagtctagagtacagtggcgcgatctcagttcactgcaatctctgcctcctgggctgaagtaatcctttcctcacaagtaaacctcagcctctcaagtagctgggactacaggcacacaacaccacgcctggctaatttttgtatttttaggtagagacggggtttcactatrttggccaggctggtcttsaactcctgacctcaggtgatccgcctgcctcggccccccaaagtgttgggattacaggcgtgagccaccacacgcagcctttttgttattagactctgtcattactgactttttttttttttttaatagaaacagggtctttctttcccaggstaaagtacagtggcatgatcacagttcactatagccttaaactcctgggctcaagtgatcctcctgcctcagcctcccaagtagcagggactacaggtgtgcaccaccacacccagttaaccattcattcattcattcattcatttattttgagatggagtctcgctctgtcacctaggctggagtgcagtggcacgatctcagctcactgcaacctccacctcccaggttcaagagattctcctgcctcagcctcccgagtagctgagactacaggcgtgcaccaccatgccagactaatttttgtatttttaatagagacggggtttcactctgttggtcaggcttatctcgaactcctgacttcgtggatccaccctccttggcctcccaaagtgctgggattaaaggcgtgagccaccgcgccctgccaacctttttttratttttcttagagatgggggtctccctatgttgcccaggcttgtcttgaactcctggcctcaagtgaccctcttgccttggcctcacaaagtgctaggattacagcctgagccatcacacctggccaacaggtttttttttttkttttgttttgttttttaaagaatgtctaggccaggctcatttactttcacctgtaatcccagcactttgggaggccggggtgggcagatcacttgaggtcaggaattcgagaccagcctgggcaacatgctgaaaccccgtttctactaaaaatacaaaaattagctgggtgtggtgacacgtgcctgtaatcccagctactcaggaggttgaggcaggagaattgcttgaacccaggaggcagaggttgcagtgagccaagatcatgccatcaccctccagcctgggcgacagaaggagactcagtctaaaaacttaattaattaattaattaaaaataaaaatacaaaaattaacctggtgtggtggtgtgtgcctgtaatctaagctactcaggaggctgaggcaggagaatcccctgaatcccagaggcagaggttgcagtgagccaagatcgagccactgtttgcccagtctagtgcactgggctgctgaatttatttgaccagacacctagcaatagactttgaagttcttttccacttttcactctaagatgctgctgtcatgaataaggaatattttgatccccttcacaaacactcggggccctcttaccagttttcactgaagatcttgacattcctatctgcttaggtgtctgggcgtgtttgggggagatactgaagaggtagggctcccaggcaggtgcagttcgtctgttaggcaggcagcaaggtccacttcaccagacacccccacctctgttttcctgcagggactccagaacgggtggaactggcacccctcccctcttggcagccagtgggcaagaaccttaccctacgctgccaggtggagggtggggcaccccgggccaacctcaccgtggtgctgctccgtggggagaasgagctgaaacgggagccagctgtgggggagcccgctgaggtcacgaccacggtgctggtgaggagagatcaccatggagccaatttctcgtgccgcactgaactggacctgcgsscccaagggctggagctgtttgagaacacctcggccccctaccagctccagacctttggtgaggattgaagaagccagcagggagaaggtgggggtggggtatcctgcaatgyggtgcctgtggccacaggatcttttgagatgggtgtggccccggctaaggggtgcatgtgttctaggcgtatgtgacctaggctgctgagtggccctggaagaggatctcgcaggagggggaatgaaatgccccagagaagggcttcgggacgtccatccctgtctgctcacacctttcttctctccctagtcctgccagcgactcccccacaacttgtcagcccccgggtcctagaggtggacacgcaggggacmgtggtctgttccctggacrgkctgttcccagtctcggaggcccaggtccacctggcactgggggaccagaggttgaaccccacagtcacctatggcaacgactccttctcggccaaggcctcagtcagtgtgaccgcagaggaygagggcacccagcggctgacgtgtgcagtaatactggggaaccagagccaggagacactgcagacagtgaccatctacagtaagaaggggcaggggcggagtggggcttcttgrgggtgtgacctgaacccggggcggggctcactgtgtgcctattccaggctttccggcgcccaacrtgattctgacgaagccagaggtctcagaagggaccgaggtgacagtgaagtgtgaggcccaccctagagccaaggtgacgctgaatggggttccagcccagccactgggccygagggcccagctcctgctgaaggccaccccagaggacaaygggcgcagcttctcctgctctgcaaccctggaggtggccggccagcttatacacaagaaycagacccgggagcttcgtgtcctgtgtgagtggggctgctggtcaatggcccctatcccccaaggcccaatctccctgaaggtcccataaggtcttgcctccaagtcctgcccccacccacctccatgtcatctcatcrtgtttttccagatggcccccractggacgagagggattgtccgggaaactggacgtggccagaaaattcccagcagactccaatgtgccaggcttgggggaacccattgcccgagctcaagtgtctaaaggatggcactttcccactgcccatcggggaatcagtgactgtcactcragatcttgagggcacctacctctgtcgggccaggagcactcaaggggaggtcacccgcraggtgaccgtgaatgtgctctgtgagtgagccggcgggcagarctgggtgggggcaggggccatggacctaatgcaatcctcaccgcctgttgtatcctccccacagccccccggtatgagattgtcatcatcactgtggtagcagccgcagtcataatgggcactgcaggcctcagcacgtacctctataaccgccagcggaagatcaagaaatacagactacaacaggcccaaaaagggacccccatgaaaccgaacacacaagccacgcctccctgaacctatcccrggacagggcctcttcctcggccttcccatattggtggcagtggtgccacactgaacagagtggaagacatatgccatgcagctacacctacyggccctgggacgccggaggacagggcattgtcctcagtcagatacaacagcatttggggccatggtacctgcacacctaaaacactaggccacgcatctgatctgtagtcacatgactaagccaagaggaaggagcaagactcaagacatgattgatggatgttaaagtctagcctgatgagaggggaagtggtgggggagacatagccccaccatgaggacatacaactgggaaatactgaaacttgctgcctattgggtatgctgaggycccacagacttacagaagaagtggccctccatagacatgtgtagcatcaaaacacaaaggcccacacttcctgacggatgccagcttgggcactgctgtctactgaccccaacccttgatgatatgtatttattcatttgttattttaccagctatttattgagtgtcttttatgtaggctaaatgaacataggtctctggcctcacggagctcccagtcctratcacattcaaggtcaccaggtacagttgtacaggttgtacactgcaggagagtgcctggcaaaaagatcaratggggctgggacttctcattggccaacctgcctttccccagaaggagtgatttttctaycggcacaaaagcactatatggactggtaatggttacaggttcagagattacccagtgaggccttattcctcccttccccccaaaactgacacctttgttagccacctccccacccacatacatttctgccagtgttcacaatgacactcagcggtcatgtctggacatgagtgcccagggaatatgcccaagctatgccttgtcctcttgtcctgtttgcatttcactgggagcttgcactatgcagctccagtttcctgcagtgatcagggtcctgcaagcagtggggaagggggccaaggtattggaggactccctcccagctttggaagcctcatccgcktgtgtgtgtgtgtgtatgtgtagacaagctctckctctgtcacccaggctggagtgcagtggtgcaatcatggttcactgcagtcttgaccttttgrgctcaagtgatcctcccacctcagcctcctgagtagctgggaccataggctcacaacaccacacctggcaaatttgattttttttttttttyyagagayggggtctygcaacattgcccagacttcctttgtgttagttaataaagctttctcaactgcctcagccttgtgtgagttgaggggaggtgtcacatccagctggagtcctttctaagcagccacagcctgatcctcccacttcctcccccaagaaaacattgtgggttgatggycataccctgaggttctggtccaaatcggactttctatgaccttctgggtctctagtgaaaactaaagactcctctccagaaaaaaacatttggtttctaatgaggcctggaatcttattcttgacctggggagcggaatccctttttgcagtactcccgggccctctgttggggcctccccttcctctccagggtggagtcgaggaggcggggctgcgggcctccttatctctagagccggccctggctctctggcgcggggccccttagtccgggctttttgccatggggtctctgttccctctgtcgctgctgttttttttggcggccgcctacccgggagttgggagcgcgctgggacgccggactaagcgggcgcaaagccccaagggtagccctctcgcgccctccgggacctcagtgcccttctgggtgcgcatgagcccggagttcgtggctgtgcagccggggaagtcagtgcagctcaattgcagcaacagctgtccccagccgcagaattccagcctccgcaccccgctgcggcaaggcaagacgctcagagggccgggttgggtgtcttaccrgctgctcgacgtgagggcctggagctccctcgcgcactgcctcgtgacctgcgcaggaaaaacacgctgggccacctccaggatcaccgcctacagtgagggacaggggctcggtcccggctggggtgaggggagggggctggaagaggtgggggaagggtagttgacagtcgctctatagggagcgcccgcggacctcactcagaggctcccccttgccttagaaccgccccacagcgtgattttggagcctccggtcttaaagggcaggaaatacactttgcgctgccacgtgacgcaggtgttcccggtgggctacttggtggtgaccctgaggcatggaagccgggtcatctattccgaaagcctggagcgcttcaccggcctggatctggccaacgtgaccttgacctacgagtttgctgctggaccccgcgacttctggcagcccgtgatctgccacgcgcgcctcaatctcgacggcctggtggtccgcaacagctcggcacccattacactgatgctcggtgaggcacccctgtaaccctggggactaggaggaagggggcagagagagttatgaccccgagagggcgcacagaccaagcgtgagctccacgcgggtcgacagacctccctgtgttccgttcctaattctcgccttctgctcccagcttggagccccgcgcccacagctttggcctccggttccatcgctgcccttgtagggatcctcctcactgtgggcgctgcgtacctatgcaagtgcctagctatgaagtcccaggcgtaaagggggatgttctatgccggctgagcgagaaaaagaggaatatgaaacaatctggggaaatggccatacatggtggctgacgcctgtaatcccagcactttgggaggccgaggcaggagartcgcttgagcccaggagttcgagaccagcctggacaacatagtgagaccccgtctatgcaaaaaatacacaaattagcctggtgtggtggcccgcacctgtggtcccagctacccgggaggctgagttgggaggatcctttgagccctgaaagtcgaggttgcagtgagccttgatcgtgccactgcactccagcctgggggacagagcacgaccctgtctccaaaaataaaataaaaataaaaataaatattggcgggggaaccctctggaatcaataaaggcttccttaaccagcctctgtcctgtgacctaagggtccgcattactgcccttcttcggaggaactggtttgtttttgttgttgttgttgtttttgcgatcactttctccaagttccttgtctccctragggcacctgaggtttcctcactcagggcccacctggggtcccgaagccccagactctgtgtakccccagcgggtgtcacagaaacctctccttctgctggccttatcgagtgggatcagcgcgggccggggagagccacgggcaggggcggggtggggttcatggtatggctttcctgattggcgccgccgccaccacgcggcagctctgattggatgttaagtttcctatcccagccscaccttcagaccctgtgctttcctggaggccaaacaactgtggagcgagaactcatctccaaaataacttaccacgctggagtgagaccacgaatggtggggaggggagggtcccacggacatattgagggacgtggatacgcagaagaggtatccatgtggtggcagccgggaaggggtgatcagatggtccacagggaatatcacaaactcgaattctgacgatgttctggtagtcacccagccagatgagcgcatggagttggsggtggggggtgtcaaagcttggggcccggaagcggagtcaaaagcatcaccctcggtcccttgttctcgcgtggatgtcagggccyccacccaccgagcagaaggcggactcaggggcgctccagggtggctcgagctcacacacgctgagtagacacgtgcccgctgcmccctgggtaaatacagacccggagccgagcggattctaatttagacgcccgcgaacgctgcgcgcacgcacacgtgtcctcggctcgctggcactttcgtcccgccccctccgtcgcgtgcsggagctgacccggaggggtgcttagaggtatggctccgcggggtcaaaaggagaaggatcagtgagagaggcatccccacaccctcccctagaactgtcctttccccatccagtgcctcccaaatctctcttagtccccaaatgtatccccgccctaaggggcgctggtgggaggagctaaatgtgggggcggrgctcggagtccagcttattatcatggcatctcagccagggctggggtaggggtttgggaagggcaacccagcatcccccgatcccagagtcgcggccggggatgacgcgagagagcgtggtcgcccccagaaggccctgggccatcatgccggcctccacgtagaccccaggggtcgctcactcctgccagctcgccttcaccaaggccaggagcttagcgcacgctcgcctcccgcccccccgccgcctctgccgccgccccctccttggaaaccaagttaccaacgttaaaccaatccccaagcgcaactctgyctcccccacaccccacccgccgcgccgcgcggagccgtcctctagcccagctcctcggctcgcgctctcctcgcctcctgtgctttccccgccgcggcgatgccagggccttcgccagggctgcgccgggcgctactcggcctctgggctgctctgggcctggggctcttcggcctctcaggtaagagcyccgctctggttcggggtggacagggcgggggcggagtccctggacctgagaaacggcctcctgtccctcccagctctgccctcgcctcgctsccacgcctctgcccccacctcgagcctgagtcttctccccttccccctcctccccaacacacacccgagccccagcttcctgactcctcgatagcccctacccgcttcgagatcctaggtgttcttccgcacccaacccttcgccctggagacccagtgtctctcctgtccgctccccgggtacctccttacgctstgctgtgcaccatggtccacgractggcatcttccccactcgcggtccgcgaagactccatctctccaactaccctgactcagaggcgctgttcccgctccacccagarccctggcaaccgggtccctcagctgttcccgcggttccttccatgagcccagccttgcgtcccggckccgtgttcttcaccgggtgtagggtccttcctgatccttgacccagcctcgtctctcctttgcccttgccgcaaacgcactctcctcgtatcccggcattctgccaggaccctgagaactggttcatcccccatcccccatcccgggtccccttctctcagccttgctgtgttcatccaagaacccacctttcctctcctctacgccctccccccatgctttcccgccgctccatcggcgctttggagaccatgsctctctgctaccacgtcccagagacaccctcgaggtttagactctgggagtgcgcctttaaaccggaggcctgggcasgacgcgggacgcctgggttctttccctggctgsagcctctcctcctcctccccgccctctgagaacccttgactcgacataggggcgctaagatgtcagggagttggctccccaggctcagcccgcgtttccctgggcagcggtctcgcaggagcccttctgggcggacctgcagcctcgcgtggcgttcgtggagcgcgggggctcgctgtggctgaattgcagcaccaactgccctyggccggagcgcggtggcctggagacctcgctgcgccgaaacgggacccagaggggtttgcgttggttggcgcggcagctggtggacattcgcgagccggagactcagcccgtctgcttcttccgctgcgcgcggcgcacactacaggcgcgtgggctcattcgcactttccgtgagttctgggtggccacgcgcgtactccactactctccctccctcccaggccccgccccctgggtcccagggtcctccccttcaggccccaccttctgttccaagtcccggygttcaaagagctgcggactcttcccccttgcagagcgaccagatcgcgtagagctgatgccgctgcctccctggcagccggtgggcgagaacttcaccctgagctgtagggtccccggcgccgggccccgtgcgagcctcacgctgaccctgctgcggggcgcccaggagctgatccgccgcagcttcgccggtgaaccaccccgagcgcggggcgcggtgctcacagccacggtactggctcggagggaggaccatggagccaatttctcgtgtcgcgccgagctggacctgcggccgcacggactgggactgtttgaaaacagctcggcccccagagagctccgaaccttctgtgagtgggtgtggggaggagatggggacccagtggggtcggtcggtgtttaggaggtttagaggtagatacatctgaatgctgaccccgacttcaaccctcgccggctgagctgtttccccctccgtgccttgaggrkgataatacgataagatagtgcatgtcaagtgcttaggacatattgagcgctcggagttagttcaaacttggttcttcgacccctagccctgtctccggatgccccgcgcctcgctgctccccggctcttggaagttggctcggaaaggcccgtgagctgcactctggacggactgtttccagcctcagaggccagggtctacctcgcactgggggaccagaatctgagtcctgatgtcaccctcgaaggggacgcattcgtggccactgccacagccacagctagcgcagagcaggagggtgccaggcagctgrtctgcaacgtcaccctggggggcgaaaaccgggagacccgggagaacgtgaccatctacagtaaggaaggaggcggggtctccgcggctccgaggtgggaccagaggaatgcgaaggcggggcgaagagtgggcgggacctcagtaccggaacaggcgtgkcccgagggggcggggcaggtgggggcggagacgtaatcgctggggaggaggagcctgtacagcctgagaggcggggcgccgtaccctagttcgttctcagcaccccgaggattcgggcagataaggggcgggccttgaccggagggaggggtatggtcagtatactacgaccaaatgctccgcccccaggcttcccggcaccactcctgaccctgagcgaacccagcgtctccgaggggcagatggtgacagtaacctgcgcagctgggrcccaagctctggtcacactggagggagttccagccgcggtcccggggcagcccgcccagcttcagctaaatgccaccgagaacgacgacagacgcagcttcttctgcgacgccaccctcgatgtggacggggagaccctgatcaagaacaggagcgcagagcttcgtgtcctatgtgagttggtgataacccctcgccccccaccttctggtgacttccaaggacccgcctgctccctcaccgtgtcgtggaggcggagccatttcttacgtctaagcctctgtaaccccacgccctgcccgcagacgctccccggctagacgattcggactgccccaggagttggacgtggcccgagggcccagagcagacgctgcgctgcgaggcccgcgggaacccagaaccctcagtgcactgtgcgcgctccgacggcggggccgtgctggctctgggcctgctgggtccagtcactcgggcgctctcaggcacttaccgctgcaaggcggccaatgatcaaggcgaggcggtcaaggacgtaacgctaacggtggagtgtgagtgggggtgcgcagrgtgcayttctatctggttcaaggtctggagggtggccagcctccagggaagagtaggagtagggtatgaggtgtccctttgggtgaggttttgggaaagggaagaggctggttagtggggttggagaaagatcttggaggatggaagggaccgggtgggcgtgcccctagcctagggcgtggtatttgggcggagtcgtggaaaggcgggcagtccagagtgtttaagtttttagrcgaaaaaggcgccactggtggctcaggaagctcccagacagagtgcatgsctcgactagcgtgacacctccttggatcggcgtccaagggttatgcagggacaacacttcgtggaagccttgccgcgccaaggagggtctagggacgtcagatttgcccccaaaccccaaagccaacaatacactccctcctccagacgcaccagcgctggacagcrtgggctgcccagaacgcattacttggctggagggaacagaagcctcgctgagctgtgtggcgcacggggtaccgccgcctgatgtgatctgcgtgcgctctggagaactcggggccgtcatcgargggctgttgcgtgtggcccgggagcatgcgggcacttaccgctgcgaagccaccaaccctcggggctctgcggccaaaaatgtggccgtcacrgtggaatgtgagtaggggcaccgcggagttaggcaggatctgtgggacaaccccggctggacttcctggcccccgtgtgagcccctgcaatcctgtttcccagatggccccaggtttgaggagccgagctgccccagcaattggacatgggtggaaggatctgggcgcctgttttcctgtgaggtcgatgggaagccacagccaagcgtgaagtgcgtgggctccgggggcrccactgagggggtgctgctgccgctggcacccccagaccctagtcccagagctcccagaatccctagagtcctggcacccggtatctacgtctgcaacgccaccaaccgccacggctccgtggccaaaacagtcgtcgtgagcgcggagtgtgagcgaggcccaggcgggtagggagcaggggtgccccacggtccaggcactccctgacatcccccatggctgytttgcagcgccaccggagatggatgaatctacctgcccaagtcaccagacgtggctggaaggggctgaggcttccgcgctggcctgcgccgcccggggtcgcccttccccaggagtgcgctgctctcgg

SEQ ID NO: 13482 - DNA, 18849 bp, Homo sapiens
ccctggaagaggatctcgcaggagggggaatgaaatgccccagagaagggcttcgggacgtccatccctgtctgctcacacctttcttctctccctagtcctgccagcgactcccccacaacttgtcagcccccgggtcctagaggtggacacgcaggggacmgtggtctgttccctggacrgkctgttcccagtctcggaggcccaggtccacctggcactgggggaccagaggttgaaccccacagtcacctatggcaacgactccttctcggccaaggcctcagtcagtgtgaccgcagaggaygagggcacccagcggctgacgtgtgcagtaatactggggaaccagagccaggagacactgcagacagtgaccatctacagtaagaaggggcaggggcggagtggggcttcttgrgggtgtgacctgaacccggggcggggctcactgtgtgcctattccaggctttccggcgcccaacrtgattctgacgaagccagaggtctcagaagggaccgaggtgacagtgaagtgtgaggcccaccctagagccaaggtgacgctgaatggggttccagcccagccactgggccygagggcccagctcctgctgaaggccaccccagaggacaaygggcgcagcttctcctgctctgcaaccctggaggtggccggccagcttatacacaagaaycagacccgggagcttcgtgtcctgtgtgagtggggctgctggtcaatggcccctatcccccaaggcccaatctccctgaaggtcccataaggtcttgcctccaagtcctgcccccacccacctccatgtcatctcatcrtgtttttccagatggcccccractggacgagagggattgtccgggaaactggacgtggccagaaaattcccagcagactccaatgtgccaggcttgggggaacccattgcccgagctcaagtgtctaaaggatggcactttcccactgcccatcggggaatcagtgactgtcactcragatcttgagggcacctacctctgtcgggccaggagcactcaaggggaggtcacccgcraggtgaccgtgaatgtgctctgtgagtgagccggcgggcagarctgggtgggggcaggggccatggacctaatgcaatcctcaccgcctgttgtatcctccccacagccccccggtatgagattgtcatcatcactgtggtagcagccgcagtcataatgggcactgcaggcctcagcacgtacctctataaccgccagcggaagatcaagaaatacagactacaacaggcccaaaaagggacccccatgaaaccgaacacacaagccacgcctccctgaacctatcccrggacagggcctcttcctcggccttcccatattggtggcagtggtgccacactgaacagagtggaagacatatgccatgcagctacacctacyggccctgggacgccggaggacagggcattgtcctcagtcagatacaacagcatttggggccatggtacctgcacacctaaaacactaggccacgcatctgatctgtagtcacatgactaagccaagaggaaggagcaagactcaagacatgattgatggatgttaaagtctagcctgatgagaggggaagtggtgggggagacatagccccaccatgaggacatacaactgggaaatactgaaacttgctgcctattgggtatgctgaggycccacagacttacagaagaagtggccctccatagacatgtgtagcatcaaaacacaaaggcccacacttcctgacggatgccagcttgggcactgctgtctactgaccccaacccttgatgatatgtatttattcatttgttattttaccagctatttattgagtgtcttttatgtaggctaaatgaacataggtctctggcctcacggagctcccagtcctratcacattcaaggtcaccaggtacagttgtacaggttgtacactgcaggagagtgcctggcaaaaagatcaratggggctgggacttctcattggccaacctgcctttccccagaaggagtgatttttctaycggcacaaaagcactatatggactggtaatggttacaggttcagagattacccagtgaggccttattcctcccttccccccaaaactgacacctttgttagccacctccccacccacatacatttctgccagtgttcacaatgacactcagcggtcatgtctggacatgagtgcccagggaatatgcccaagctatgccttgtcctcttgtcctgtttgcatttcactgggagcttgcactatgcagctccagtttcctgcagtgatcagggtcctgcaagcagtggggaagggggccaaggtattggaggactccctcccagctttggaagcctcatccgcktgtgtgtgtgtgtgtatgtgtagacaagctctckctctgtcacccaggctggagtgcagtggtgcaatcatggttcactgcagtcttgaccttttgrgctcaagtgatcctcccacctcagcctcctgagtagctgggaccataggctcacaacaccacacctggcaaatttgattttttttttttttyyagagayggggtctygcaacattgcccagacttcctttgtgttagttaataaagctttctcaactgcctcagccttgtgtgagttgaggggaggtgtcacatccagctggagtcctttctaagcagccacagcctgatcctcccacttcctcccccaagaaaacattgtgggttgatggycataccctgaggttctggtccaaatcggactttctatgaccttctgggtctctagtgaaaactaaagactcctctccagaaaaaaacatttggtttctaatgaggcctggaatcttattcttgacctggggagcggaatccctttttgcagtactcccgggccctctgttggggcctccccttcctctccagggtggagtcgaggaggcggggctgcgggcctccttatctctagagccggccctggctctctggcgcggggccccttagtccgggctttttgccatggggtctctgttccctctgtcgctgctgttttttttggcggccgcctacccgggagttgggagcgcgctgggacgccggactaagcgggcgcaaagccccaagggtagccctctcgcgccctccgggacctcagtgcccttctgggtgcgcatgagcccggagttcgtggctgtgcagccggggaagtcagtgcagctcaattgcagcaacagctgtccccagccgcagaattccagcctccgcaccccgctgcggcaaggcaagacgctcagagggccgggttgggtgtcttaccrgctgctcgacgtgagggcctggagctccctcgcgcactgcctcgtgacctgcgcaggaaaaacacgctgggccacctccaggatcaccgcctacagtgagggacaggggctcggtcccggctggggtgaggggagggggctggaagaggtgggggaagggtagttgacagtcgctctatagggagcgcccgcggacctcactcagaggctcccccttgccttagaaccgccccacagcgtgattttggagcctccggtcttaaagggcaggaaatacactttgcgctgccacgtgacgcaggtgttcccggtgggctacttggtggtgaccctgaggcatggaagccgggtcatctattccgaaagcctggagcgcttcaccggcctggatctggccaacgtgaccttgacctacgagtttgctgctggaccccgcgacttctggcagcccgtgatctgccacgcgcgcctcaatctcgacggcctggtggtccgcaacagctcggcacccattacactgatgctcggtgaggcacccctgtaaccctggggactaggaggaagggggcagagagagttatgaccccgagagggcgcacagaccaagcgtgagctccacgcgggtcgacagacctccctgtgttccgttcctaattctcgccttctgctcccagcttggagccccgcgcccacagctttggcctccggttccatcgctgcccttgtagggatcctcctcactgtgggcgctgcgtacctatgcaagtgcctagctatgaagtcccaggcgtaaagggggatgttctatgccggctgagcgagaaaaagaggaatatgaaacaatctggggaaatggccatacatggtggctgacgcctgtaatcccagcactttgggaggccgaggcaggagartcgcttgagcccaggagttcgagaccagcctggacaacatagtgagaccccgtctatgcaaaaaatacacaaattagcctggtgtggtggcccgcacctgtggtcccagctacccgggaggctgagttgggaggatcctttgagccctgaaagtcgaggttgcagtgagccttgatcgtgccactgcactccagcctgggggacagagcacgaccctgtctccaaaaataaaataaaaataaaaataaatattggcgggggaaccctctggaatcaataaaggcttccttaaccagcctctgtcctgtgacctaagggtccgcattactgcccttcttcggaggaactggtttgtttttgttgttgttgttgtttttgcgatcactttctccaagttccttgtctccctragggcacctgaggtttcctcactcagggcccacctggggtcccgaagccccagactctgtgtakccccagcgggtgtcacagaaacctctccttctgctggccttatcgagtgggatcagcgcgggccggggagagccacgggcaggggcggggtggggttcatggtatggctttcctgattggcgccgccgccaccacgcggcagctctgattggatgttaagtttcctatcccagccscaccttcagaccctgtgctttcctggaggccaaacaactgtggagcgagaactcatctccaaaataacttaccacgctggagtgagaccacgaatggtggggaggggagggtcccacggacatattgagggacgtggatacgcagaagaggtatccatgtggtggcagccgggaaggggtgatcagatggtccacagggaatatcacaaactcgaattctgacgatgttctggtagtcacccagccagatgagcgcatggagttggsggtggggggtgtcaaagcttggggcccggaagcggagtcaaaagcatcaccctcggtcccttgttctcgcgtggatgtcagggccyccacccaccgagcagaaggcggactcaggggcgctccagggtggctcgagctcacacacgctgagtagacacgtgcccgctgcmccctgggtaaatacagacccggagccgagcggattctaatttagacgcccgcgaacgctgcgcgcacgcacacgtgtcctcggctcgctggcactttcgtcccgccccctccgtcgcgtgcsggagctgacccggaggggtgcttagaggtatggctccgcggggtcaaaaggagaaggatcagtgagagaggcatccccacaccctcccctagaactgtcctttccccatccagtgcctcccaaatctctcttagtccccaaatgtatccccgccctaaggggcgctggtgggaggagctaaatgtgggggcggrgctcggagtccagcttattatcatggcatctcagccagggctggggtaggggtttgggaagggcaacccagcatcccccgatcccagagtcgcggccggggatgacgcgagagagcgtggtcgcccccagaaggccctgggccatcatgccggcctccacgtagaccccaggggtcgctcactcctgccagctcgccttcaccaaggccaggagcttagcgcacgctcgcctcccgcccccccgccgcctctgccgccgccccctccttggaaaccaagttaccaacgttaaaccaatccccaagcgcaactctgyctcccccacaccccacccgccgcgccgcgcggagccgtcctctagcccagctcctcggctcgcgctctcctcgcctcctgtgctttccccgccgcggcgatgccagggccttcgccagggctgcgccgggcgctactcggcctctgggctgctctgggcctggggctcttcggcctctcaggtaagagcyccgctctggttcggggtggacagggcgggggcggagtccctggacctgagaaacggcctcctgtccctcccagctctgccctcgcctcgctsccacgcctctgcccccacctcgagcctgagtcttctccccttccccctcctccccaacacacacccgagccccagcttcctgactcctcgatagcccctacccgcttcgagatcctaggtgttcttccgcacccaacccttcgccctggagacccagtgtctctcctgtccgctccccgggtacctccttacgctstgctgtgcaccatggtccacgractggcatcttccccactcgcggtccgcgaagactccatctctccaactaccctgactcagaggcgctgttcccgctccacccagarccctggcaaccgggtccctcagctgttcccgcggttccttccatgagcccagccttgcgtcccggckccgtgttcttcaccgggtgtagggtccttcctgatccttgacccagcctcgtctctcctttgcccttgccgcaaacgcactctcctcgtatcccggcattctgccaggaccctgagaactggttcatcccccatcccccatcccgggtccccttctctcagccttgctgtgttcatccaagaacccacctttcctctcctctacgccctccccccatgctttcccgccgctccatcggcgctttggagaccatgsctctctgctaccacgtcccagagacaccctcgaggtttagactctgggagtgcgcctttaaaccggaggcctgggcasgacgcgggacgcctgggttctttccctggctgsagcctctcctcctcctccccgccctctgagaacccttgactcgacataggggcgctaagatgtcagggagttggctccccaggctcagcccgcgtttccctgggcagcggtctcgcaggagcccttctgggcggacctgcagcctcgcgtggcgttcgtggagcgcgggggctcgctgtggctgaattgcagcaccaactgccctyggccggagcgcggtggcctggagacctcgctgcgccgaaacgggacccagaggggtttgcgttggttggcgcggcagctggtggacattcgcgagccggagactcagcccgtctgcttcttccgctgcgcgcggcgcacactacaggcgcgtgggctcattcgcactttccgtgagttctgggtggccacgcgcgtactccactactctccctccctcccaggccccgccccctgggtcccagggtcctccccttcaggccccaccttctgttccaagtcccggygttcaaagagctgcggactcttcccccttgcagagcgaccagatcgcgtagagctgatgccgctgcctccctggcagccggtgggcgagaacttcaccctgagctgtagggtccccggcgccgggccccgtgcgagcctcacgctgaccctgctgcggggcgcccaggagctgatccgccgcagcttcgccggtgaaccaccccgagcgcggggcgcggtgctcacagccacggtactggctcggagggaggaccatggagccaatttctcgtgtcgcgccgagctggacctgcggccgcacggactgggactgtttgaaaacagctcggcccccagagagctccgaaccttctgtgagtgggtgtggggaggagatggggacccagtggggtcggtcggtgtttaggaggtttagaggtagatacatctgaatgctgaccccgacttcaaccctcgccggctgagctgtttccccctccgtgccttgaggrkgataatacgataagatagtgcatgtcaagtgcttaggacatattgagcgctcggagttagttcaaacttggttcttcgacccctagccctgtctccggatgccccgcgcctcgctgctccccggctcttggaagttggctcggaaaggcccgtgagctgcactctggacggactgtttccagcctcagaggccagggtctacctcgcactgggggaccagaatctgagtcctgatgtcaccctcgaaggggacgcattcgtggccactgccacagccacagctagcgcagagcaggagggtgccaggcagctgrtctgcaacgtcaccctggggggcgaaaaccgggagacccgggagaacgtgaccatctacagtaaggaaggaggcggggtctccgcggctccgaggtgggaccagaggaatgcgaaggcggggcgaagagtgggcgggacctcagtaccggaacaggcgtgkcccgagggggcggggcaggtgggggcggagacgtaatcgctggggaggaggagcctgtacagcctgagaggcggggcgccgtaccctagttcgttctcagcaccccgaggattcgggcagataaggggcgggccttgaccggagggaggggtatggtcagtatactacgaccaaatgctccgcccccaggcttcccggcaccactcctgaccctgagcgaacccagcgtctccgaggggcagatggtgacagtaacctgcgcagctgggrcccaagctctggtcacactggagggagttccagccgcggtcccggggcagcccgcccagcttcagctaaatgccaccgagaacgacgacagacgcagcttcttctgcgacgccaccctcgatgtggacggggagaccctgatcaagaacaggagcgcagagcttcgtgtcctatgtgagttggtgataacccctcgccccccaccttctggtgacttccaaggacccgcctgctccctcaccgtgtcgtggaggcggagccatttcttacgtctaagcctctgtaaccccacgccctgcccgcagacgctccccggctagacgattcggactgccccaggagttggacgtggcccgagggcccagagcagacgctgcgctgcgaggcccgcgggaacccagaaccctcagtgcactgtgcgcgctccgacggcggggccgtgctggctctgggcctgctgggtccagtcactcgggcgctctcaggcacttaccgctgcaaggcggccaatgatcaaggcgaggcggtcaaggacgtaacgctaacggtggagtgtgagtgggggtgcgcagrgtgcayttctatctggttcaaggtctggagggtggccagcctccagggaagagtaggagtagggtatgaggtgtccctttgggtgaggttttgggaaagggaagaggctggttagtggggttggagaaagatcttggaggatggaagggaccgggtgggcgtgcccctagcctagggcgtggtatttgggcggagtcgtggaaaggcgggcagtccagagtgtttaagtttttagrcgaaaaaggcgccactggtggctcaggaagctcccagacagagtgcatgsctcgactagcgtgacacctccttggatcggcgtccaagggttatgcagggacaacacttcgtggaagccttgccgcgccaaggagggtctagggacgtcagatttgcccccaaaccccaaagccaacaatacactccctcctccagacgcaccagcgctggacagcrtgggctgcccagaacgcattacttggctggagggaacagaagcctcgctgagctgtgtggcgcacggggtaccgccgcctgatgtgatctgcgtgcgctctggagaactcggggccgtcatcgargggctgttgcgtgtggcccgggagcatgcgggcacttaccgctgcgaagccaccaaccctcggggctctgcggccaaaaatgtggccgtcacrgtggaatgtgagtaggggcaccgcggagttaggcaggatctgtgggacaaccccggctggacttcctggcccccgtgtgagcccctgcaatcctgtttcccagatggccccaggtttgaggagccgagctgccccagcaattggacatgggtggaaggatctgggcgcctgttttcctgtgaggtcgatgggaagccacagccaagcgtgaagtgcgtgggctccgggggcrccactgagggggtgctgctgccgctggcacccccagaccctagtcccagagctcccagaatccctagagtcctggcacccggtatctacgtctgcaacgccaccaaccgccacggctccgtggccaaaacagtcgtcgtgagcgcggagtgtgagcgaggcccaggcgggtagggagcaggggtgccccacggtccaggcactccctgacatcccccatggctgytttgcagcgccaccggagatggatgaatctacctgcccaagtcaccagacgtggctggaaggggctgaggcttccgcgctggcctgcgccgcccggggtcgcccttccccaggagtgcgctgctctcgggaaggcatcccatggcctgagcagcagcgcgtgtcccgagaggacgcgggcacttaccactgtgtggccaccaatgcgcatggcacggactcccggaccgtcactgtgggcgtggaatgtgagtgggggcagcaccggatggaggggacacggtcctcggaagaatgactcgcagcggtgggagcattcaagggcacctctcccaatcccattctcggggacagggaattccagcctaaaccagggggtaatgaaaattctagccaggcgcagtggctcaggtctgtaatcccaacactttggaaggttgaggcggatgaatcacttgaggccaggagttcgagaccagcccggccaacatggcgaaaacccgtctctacaaaaattagccggtcgtggtsgtgggcgcctgtggtcccagctacttgggaggctgaggcaggagaatcgcttgagcctgggaggcagaggttgcagggagccgagatcccgccactgcactccagcctgggcaacagagtgagactctttcttagaaaaacagaaaaagaaaattatagggaataggagcacggccctcctcaaatcctggattagaacactgacctgggcttcacctccttccattcggtgaagaagggcgaggaattttagccgcaacagcagyctgattgtcggggaaggaggctctgataggaggcaggatcctcttctgcccatcagaggcgcggtggtctcccatcgatcgttgtgggccggagcagggcatttgatcagtggctgggccggcgctaagccccacttcaccttctgtgcccttcagaccggccagtggtggccgaacttgctgcctcgccccctggaggcgtgcgcccaggaggaaacttcacgttgacctgccgcgcrgaggcctggcctccagcccagatcagctggcgcgcgcccccgrgggccctcaacatcggcctgtcgagcaacaacagcacactgagcgtggcaggcgccatgggaagccacggcggcgagtacgagtgcgcasscaccaacgcgcacgggcgccacgcgcggcgcatcacggtgcgcgtggccggtmmgtggcagctggggagaggcggggcgaggtatctgagagggggcgtgacctgggtcttggggcggccggccccgcctgcctccctctcggtcccggkagactagrcggwagtgggacagartagaagtcaaaggtgcctkagcgggtggggctgttgatcgcactttgaggggtgggagatggaggtggcagggggactgaattcaaggggagggaccctccggggctgtcactgctgcaggaaaggactttaaaacttgggctggattctgcgtggyggaaacttgacccaattcacaatccactgtggggaagattggggagggaccaaagtcattggatgwtggagggagagaggggtcaagatcgccttctctcacttcctgaagctcctggggctgggttctctctggggtcgggggaacctgacctggtcctgccggtcctcattttttgggggatggggagagttgacttgtcgccagggggctaagtgtggtcacgggtttatatccccatgggctgaagtgcgatataaatcgggactcgggtcgccctggcactgggagtggccttattgcatgggttgtctcccttctcccaaggccagacagtgagctccccggggcatgaggactgacttcgtgcctgtgggagtgcggggggcggtgggagaagccccccggagcttggccaccctccgcgagggtctccaccccgcaggtccgtggctatgggtcgccgtgggcggcgcggcggggggcgcggcgctgctggccgcgggggccggcctggccttctacgtgcagtccaccgcctgcaagaagggcgagtacaacgtgcaggaggccgagagctcaggcgaggccgtgtgtctsaacggagcgggcggcggcgctggcggggcggcaggcgcggagggcggacccsaggcggcggggggcgcggccgagtcgccggcggagggcgaggtcttcgccatacagctgacatcggcgtgagcccgctcccctctccccgcgggccgggggacgccccccagactcacacgggggcttatttattgctttatttatttacttattcatttatttatgtattcaactccaagggcgtcacccccattttctasccatcccctcaataragtttttatraaggaactccctgtctccgcttctgtttctgcaaggtggracaagsccagggttccagtcgtgacctcccgagttattcattcaawaagcgatttttgagagggcctggggtggtggcttaggcctgtaatcccaggacttgtgggaggcccaggtgggaggatcccttgcacccaagagtttcagaccagcctgggcaacatagggagaccctacaaaaaatatttttcaaaaattagccaaggccggtcgcggtggctcatgcgtgtaatcccaggactttggaaggccgaggcggccagatcacgaggtcgaggtcatgagatcgagaccatcctggccaatatggtgaaaccctgtctctactaaaaatacaaaaattagctgggcatggtggtgcrcgccygtagtcccagctattcgggaggctgaggcaggagaatcgctttaaccccggaggcagaggttgcagtgagccgagatcgtgccactgaactccagcctggcgacagagcgagattccgtcttaaaaaaaaaaccaggcgtggtggctcacgcctgtaatcccagcactttgggaggccgaggcgggcggatcacgaggtcgggagatcgagaccatcctcgctaacacggtgaaaccccgtctctactaaaaatacaaaaaaaaaaaaaaaaaaaaaattagccgagcgtggtggcgggcgcctgtagtcccagctactcaggaggctgaggcaggagaatggcatgaacccggggagcagagcttgcagtgagccgagatcgcgccactgcactccaccctggcagacagcaagactccgtctcaaaaaaaaaaaaaaaaattagccagggccgagcacagtrctctcgcttgaatcccagaactttgggaaactaaggcggggggggggggtcacttgaggtcaggagttcgagaccaccctggccaacgtggtgaaacaccttctctaccaaaaatacaaaaaaattaaggccgggtgaagtggctcacgtctgtaatcccagcactttgcgaggctgaggcgggcggatcatggggttagaagatcaagactgtcctggctaacatggtgaaaccccgtcactamtaaaaacacaaaaattagccgggcgtggtggcacatgcctgtagtcccagctactcaagaggctgaggcaggagaatcgctttaaccccggaggcagaggttgcagtgagccaagatcgcaccactgcactccagcctgggcaatagagcgagactctgtctcaaaaaaaaaccaaaaacaaaaacaaaaaaatacaaaaatttagctgggctgtagtggcacacgccctgtaatcccagctactcgtgaggctgaggcaggagaattgctagaacccgggaggtagagatcttgccattgcactccagcctgggcaacagaactagactctgtctcaaaaaaaaaaaaaaaaaaaaaaaagtgttttttgagggggctgggcatggtggctcaagcctgtaatcccaggacttttgggaggcccaggtgggaggatcccttgtgcccacgagtttcagaccagcctgggcaacatagcgagaccctacaaaaaaacatgtttcaaaaaaaaatttttttttttgagatggagtctcgctctgtcgcccaggctggacagcagtggcactatctctgctcactgcaagctccgtctcccgggttcatgccattctcctgcctcagcctcccaagtagctgggattacaggcgcctgccaccacacccagctaatttttttttgtatttttagtagagatgggatttcaccgtgttcgccaggatggtctctattcctgacctcgagatccacccgcctcagcctcccaaagtgctgggattacaggcgtgagccaccgcgcccggcctcaaaaaaaaaattttttttttgagatggagtcttgctctgtcacccaggctggagtgctgtggtgtgatcttggctcactgcaacctctgcctcctgggttcaagcaattcccctgccttggcttcccaaatagctgggactataggcatgcaccaccacacccarctaatttttgtatttttagtagagacagggtttcaccatgttggccaggctggtctcgaactcctgacctaaggtgatccacctgcctcggtctcccaaagtgctgggattacagctgtaagccaccatgcctggtgtatttttcaaaaattagccagacatggtggtgcatgcctgtagtcccagctacttgggaggctgaggcaggaggatcctttgagcctaggaggtcaaagccacttccagctatgatatygtcattgtgctccagcccaggtgacagaaccagaccctgtctctaaaaacaaacaacgaaaaaatccaaaaactttttttgaacacctactatgcatcaggcacaatctaagctgtctttttctttttcttttttttwtttttgagacggagtctctctgtcgcccaggctggagtgcagtggtgtaatctcagctcactgcaagctctgcctcccacgttcaagcgattttcctgcctcagcctcctgagtagctgggattacaggcgcgcgccaccactacgcccggctaatttttgtatttttagtagagacagggtttcaccatgttggtcaggctagtctggaactactgacctcgtgattcacctgcctcggtctcccaacgtgctggaattacaagcctgagccactgtgcctggcccggctggctgtcttttctcagtgtgacctagagctcgtcctctctcagtgcctgttttctgctctcttcacacccttgggcaggggtgggggcctcactccttcctcctacttatctcttccacccagcactgccctctgatccgggtcactcttggaggtgggggctaggtgcttcccccaggcctggttaccggcagagctgaggccgccttgccagggtgggtggaggccctctccgttgtgcccctgccctgagacttcggtgagaccttcctgggcaggcactggctgatgctatgggtgtcagcccttagcatgtcctccctgttaaagggggcacccctgccccgccctcaatgcctcctttgtcctgtgtccacccacagtgcttcagtttacccccaccctgcctttccactcagcccatcatgattcagaacagacacacacagggtatccgctgcaacccccactacacggcaccttcccccctcatccccaacagcataaggcacagcagctgggcctcctccccacagcctcctcctctgcccctcctccctcaaaagcaggaacacggagccctagagaaggaagccagtcccatgcaaacatgtaatgagcaaagatgagacggggaaatggcacaagagggcaggccagtgctcggtgctggagccaggggccaggtataacacccaaaaaggcaccagccaggtgcagtccctgccactaacagcacctcaccttttctgcctgtgccctccctacttaatgatctctctccgctcctactgacctcaaggtstctttcagagccttcagatgagatatttattttagtaggttggtgcaaaagtaattgctgtttttgccattgaaagtaatggcaggcagggcatggtggctcacgcctgtaatcccagcactttgggaggccgaggtgggcagatcacgaggtcaggagttcaagaccagcctggctaacatggtgaaaccctgtctctactaacaatacaaaaaaaattagccggacatggtggcacacccctgtagtctcagctacttgggaggctgaggcaggagaactgcttgaaccctgaagcggaggctgcagtgagctgaaatcacgccactgcactccagcctgggccacagagtgagactgtctcagaggaaaaaaaaaaaaaaaaagtaatggcaaaaactgcaattactttttctttttctttctgtttttttttttgtttgtttgtttgtttgtttgtttgtttgagacggagtctcactgtgtggcccaggctggagtgcagtggcgcaatcttggcttactgcagcctccgcctcccaggttcaagtgattctctcctgcctcagcctcccaataggattacaggcacccaccactatgcctggctaatttttgtatctttagcagagatggggtttcaccatgtttgccaggctggtctcgaactcctgatccacccacctcagcttcccaaagtgctgggattacaggcaggcatgagccatggtgcccgacatttttttttttttttytttttttttttgagacagagtctcactttgtcacccaggctggagtgcaaaggcaagatctcactgcagcctctgcctcctgggttaaagcgattctcccaccttagccccctgagtaggtgagattacaggcacatgccaccamacctgcctaatttttgtatttttaatagagagggggtttcaccattttgtccacgctggtctcgaactcctgacctcaagggattcgcccacctcagcctcccaaagtgctgggattacaggcatgagccaccacgcccgacctccttaactcttttatttccttgcacactttttctctgtagcccagctcacaacttaacatcctcttagacatacacctgaggttttttttttttttttttttgagagggagtctctctctgtcacccaggatggaatgcagtggtgtgctctcagctcactgcaaccttgcaaccactgcctcccaggttcaagcaattctcctgcctcagcctcccgagtagctgggactacagacacatgccgccacacctggctgattttttgttttttagtagagacagggtttcaccgtgttgcccaggctggtctcaaactcctgagttcaggcagtccgcctgccttagccttccaaaatgctgggattacaggcatgaggcaccgcgtcctgcctctgagttttttttttttttttttttactgtctcctaraacatcagccccrgtagagcagggatctttgttctgttcaccactgagggtcctcattgggtcctagcacacacagttgctcaataaatgttgaataagtgggtaaagacagccacgagcttgcagatatgtgttcaaggtgtgtccttgcagagagcttctctatacttggcactggagaggcctgtcgtgggcaaggacatagatgtggcgacctcagacttgagaactcctggggcagtaggggagatggatgtggataatgtaaccataagccttcctttctattttagactgagtggtcaaggaaggcttccagacaatggaaattctgataggttctaagagggagaccagcaaggagctgaaccggaggctgacacagggtgagagtgggaatgtctattttattttttttttggagacagggtctcactctgttgctcaggcagcagtgcagtggcacgatcgtggctcactgcagcttcaacttcccagactcaagtgatcctcccacctcagcctcccaagcagctgggaatataggtgcatgccaccacatccggctaatttttgtatttttggtagaaacggggtttcaccatgttgcccaggctggtcttgaactcctgggttcaagtgatcttgctgccttgggctcccaaagtgcttggattacaggtgtgagcctgtgagccacatctggcctattttattttttaattagttttttgtttttgtttttgttttgagatggagtctctgtctccaaggctggagtgcagtggcacgatctcggctcactgtaacctccacctcccaagtagctgggattacaggcacatgccaccacgcctggctaatttttgtatctttagtagagacagggtttccccatgttggccaggctggtctcgaactcctgacctccggtgatccacctgcctcagtttccca

SEQ ID NO: 13483 - DNA, 46215 bp, Homo sapiens
  misc_feature (1)...(46215): n = A,T,C or G, or insertion/deletion polymorphism (see Tables 1-2)
aatacatatttatccaaagacgatatacatgccataacaatataacaagtatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntccctaatctcaggtacccagggacacagacgctgcggaaggccgcagggtcctctgcctaggaaaaccagagacctttgttcacttgtttatctgctgaccttccctccactgttgtcctatgaccctgccaagtccccctctgtgagaaacacccaagaattatcaataaaataaataaataaataaataaataaataaataaaaaagatttctttggggggtgctgggaatgttctggaactcaatagtggtaactgcacaagtctgtaaatatactaattttgaatcattaaaactaaaattcattaacaatcattgaattatacacatgaaaacaagcgaactttatggattgcaatttttttttttttttttgaggcagagtttcgctcttgttgcccaggctggagtgcaatggcgcgatctcagctcactgcaacctctgcctccagatgcaagcrattcttacatctcagcctcccaagtagctgggattacaggcatgcaccaccatgccccgccaatttttgtatttttagtagagacagagtttcaccatgttgcttcgtctggtctcgaactcctgacctcaggtgatccgcccgcctcgacttcccaatgtgctgggattacaggcatgagccagcatggtggccatggagtgcaacttttatctcaataatgctgttttgaaaatagtacagagagttcttgtgtacccttcacgtagcttgagaactttttattttattttatttttgagcgagagtctcactcggtcacccaagctggagtgcaatagcatgatctcagctcactacaacctccacctccgggtgcaagcgattcttatgcctcagcctcccaagtaactaggattacaggcatgtgccaccatgccccactaatttttgtattttagtagagacaggttttcaccatgttggctaggctggtctcgaattcctgacctcaaatgatccacctgcctcagcctcccaaagtgctgggattacaggcgtgagccaccacacctgccccctgcccaccccccagaacttgttttttttttttttttggagacggagtcttgctctgtcacccaggctggagtgcagtggcccgatcttggcttactgcaacctctgcctaccgggttcacaccattctcctgcctcagcctcccgagtagctgggactacaggcgccygccaccatgccyggctaatttttttgtatttttagtagagatggggtttcaccgtgttagccaggatggtctcgatctcctgacctcgtgatccaccctcctcagcctcccaaagtgctgggattacaggcgtgaaccaccgcgcccggccaccccccagaacttcttatacaaccatagagcgacaatcaaaccaggaaattgacattggtacaatactctttttttcttttttgagacggagtcttgctcttttgcccaggctggagtgcagtgactatctcagctcactacaacctctacctcctgggttcaagcrattctccttccttagcctctcaagtagctcgaagcacaggtgygtgccaccatgcccggctaatttttttgtatttttagtagagacagggtttcaccgtgttagccaggatggtctcgatctcctgaccttgtgatccgccagcctcggcctcccaaagtgctgggattacaggcgtgaaccaccgcgcccggccacaatactcttaatgaaactacagaccatagtaggatttcaccagggcttagagcaatgtctggcacgtagtgaaccttacacaggtgaaaggacttcactaccatgacgatgatgatgatgaagatgataatgatgatgttggactttctagcacagccagattgatatggtgcctattttcagagcatgccatgttagtttctatatctaaaccttttttggcctggcacggtggctcacgcytgaaatcccagcaatttgsgaggctgaggtaggcagattacttgagctcagtagttcgagaccagcctgacaaacatggagaaacgccatctctacgaaaaatacaaaattagccgggtgtggtggcacatgcctgtaaccccagctactcaggaggctgaggcaggagaatcgcttgaatcctggaggcagaggttgcagtgagccgagattgtgacactgcactccagcctgggcgacagagtgagactctgcctcaaaaaacaaaaaacaaaccaaaacccccactttttttctatgaaaccagcctcgctctgtcacccaggctggagtgcagtggtgccatcatgatcctcccacctcagcctcccgagtagctgggactacaggcatgtaccactatgcctggttaatatttttattatttgtagagatgagggtctcagtatgttgcccaggctagtcttaaactcatgagtttaaccaatcctctcgccgctgcctcccaacgtgctaggattacaggtatgagtcacggtgcccggcttctttcttaactctttctagtagttctaccacttgggattacctttttccttcctctccatttacctttatgaaatcctcacatccatccatctccatcaaatctttaacaattctcctctgtcttttttgactgtagggacctttasaacacccagcattaaaaaatagatttcaggccgggcatgggggctcacgcctgtaatcccagcactttgggagggccgaggcaggaggatttcgtaaggtcaggagtttgagaccagcctggccaacatagtgaaaccctgtctctactaaaaatccaaaacttagccggcagtagtggcgcgtgcctgtaatccagctactctggagactgaggcaggagaattgcttgatcctgggaggtggaggttgtgatgaattgagatcgcgccattgcactccagtctgggcaacagagtgagaccctgtctcaaaaaaacaaaaggaatattttttaaatttttaccgttctgaaagcacattgacatcctttgaatttttttctaattatttcactttgatttgtaaattctcaactagattcaggggctgtatgggttacaattcctctgcaccctccacrgaatttcagacttttttttttcccccgagacagagtctcgctctgtcacccaggctggagtgcagtggcgcgatcttggctcactgcaacctccccctcccgggttcaagcgattctcctgcctcagcctcccgagtagctgggactacaggcgcccgccaccacgcccggctaatgtttgtatttttagtagagacggggtttcaccatgttggccaggctggcctcgaacttctggctttaagtgatccgcctgcctcggcctcccaaagtgctgcgattccaggcgtgagccaccgcgcccggccaaggtcttaattcttgcctgcctttctgctcccctgtgaactctactggttgtcttttttcctgctttatccctcgtcctyggtagacagtgatggttaaatgaatgaatgcatgaacaaatgactgtccaggagctagtactgcattgcatgtacacattgatgacaacagacatcgtacaatgcgcaatcttggcaaatttattcaaaccctttagacttcgstctctcacagtgcgacgccrggagcccatcacacgctgaggtctgtcagaggccccagaaacagcctcggaaatggaggaggcggggcytcaccccgaccacacccccttgcgttcaaagcytttccgcctatgggcccgcctcctcggcgcagtgtgcaactctaattggtcgtctcactaatccatctgagcacctcggcgccgactggatcaactgctgaactcgggttgcgcacttcccggcgctgggaacgcggagcggacgcagtctggccgccattgcgctgcggggaaagcggcctcttgtgtgagggcctgtggggtgcgtggcaggcgtttaaggccgggctgcgggaggcgtggtcgggtcgggccgagtgaccgaaggggttaggccgggcggggctggatgcactgtgtggcgggactgcaggccggggtccccggaygcctttctgctgcgcttcttgtgggcccgggcctgtggttagtgaatttttctatcccgccgctccccagattctccggatatggccggagtgtttccttatcgagggccgggtaacccggtgcctggccctctagccccgctaccggactacatgtcggaggagaagctgcaggagaaaggtgaggcgagagtgtggagcggcgcgcgggccggaggcggggcgggtgtgcgygcgcgcaggcgggtggggaccctccccgtttgggcagctcctgaggtgtcagctcccttgttatttccagttartttttcatcaagtcattttaagcgcgtattatttgcaagcgctgatccagcgggggtacagtagtgacggagacaaaattcctgtccttacggggtttaaattacagcgggagagacagagaataacaaaaccttgaagctctgtaataaaaatgtcaggccgggcgcggtggctcacggttgtaatcccagcactttgggaggcccaggcgggcggatcacctgaggtcaggagttcgagaccagcctggccaacacagtgaaacctcgtctctacgaaaaatacaaaaatgagtcgtgtgtggtggcgcgtgtctataatcccagctactggggaggctgaggcaggagaatggcttgaacccaggaggcggaggttgcagtgagccgacatcgcaccattgcactccagcctgggagacagagtgaaacaacctctcaaaaaaaaaaaaaaaagtcagatagtgatcaatgtgatgaaaggaaaaacagagtaaaatggtaagggaattggcaaggggtgcttcttcctgctggtgcctgcttctccctcacactcactgacaggagcttaccctagggcaagaggtgaagaggattaggsggagggtgtgcaggcctttaaactgaggtgcctttccagctcgaaaatggcagcaattgcaggccaagcgctatgcagaaaagcggaagtttgggtttgtggatgcccagaaggaagacatgcccccagaacatgtcaggragatcattcgagaccatggagacatgaccaacaggaagttccgccatgacaaaagggtttacttggggtaaggaacatcctgaaataatttcatttggaatttggcccttttcycttctccctgtcccacagtcttggattgatgctttgacagctcatcttggtggatataagagaaaggagaaaaccagtaggagtctctgataatttctacatcttccacttttgcagtctgtttcccctctcttcccgatctgggactggtgctttaatttgtcctgttgatgatattataagatgtccctggccaggcgcggtggctcatgcctgtaatcccagcactttgggaggccgaggcgggtggatcatgaggtcaggagatcgagaccatcctggctaacacggtgaaaccccgtctctactaaaaatacacaaaattagctgggcgtggtggcaggtgtctgtagtcccagctacttgggaggctgaggcaggagaatggcgtgaacctgggaggcggaacttgtagtgagccgagatcacaccactgcactctggcctgggcgaaagtacgagactccgtctcaaaaaaaaaaaaaaaatgaaaaataagatgtccctatggttgagctggttgaagtccagagtgggatactgtgcatagtggcagcctgtcgctcctcagggacctgaattctgtgtttggggtatttaatttcagaggtttccctactcctgttttttctgtggctctaaactgggctagtacaggtacagatgtcttagcagattcctgttctatttggacacaaaaatgtttgccatgtaatgaactggaagttttgtttatttcaaaaaatacttagagaactgtgctggctgctggggatatagtagcgagcagagggtaacaatctccgcctttctgcagtgtgcrgtctagtggcctgacagacatgagacaactggtgatagtgaagtatggtgaatactttattatgatttatgggaagatgcggagggaataggatgtgagagagccgcaaagctgtctccagagggatagccgttgatttagaggagctgataccagcattgtgggattatgacgtttaagaagagtggtgcaaggtgaagttggagagggagaggcagggtttctggttaggaagggcctgtgggctaagtttgggagtttggattgtaaggtaggactgtggaacatgaacatgtggcttctctgcatgggacaggtagcagaacacctcgtcatttctgatagccttctctttttctaatgtgccagtgccctaaagtacatgccccacgcagtcctcaaactcctggagaacatgcctatgccttgggagcagattcgggatgtgccygtgctgtaccacatcactggagccatttccttcgtcaatgagattccctgggtcattgaacctgtctacatctcccagtgggggtgagaaaggctgaaatatggtgggtggtggtggtggtggtggttgggaggcagtgggtagaaatggttgtgtgatgtcttgccttccaggtcaatgtggattatgatgcgccgagaaaaaagagataggaggcatttcaagaggatgcgttttcccccttttgatgatgaggagccgcccttggactatgctgacaacatcctagatgttgagccactggaggccattcagctagagctggaccctgaggaggacgcccctgtgttggactggttctatgaccaccagccgytgagggacagcaggaagtgagtgatagatggagatactacacctgggaggagttctggaaatgcagaaggagtcytgggagatcagtaggtggtatgggtttgtctagctgcttacttgaggtgggcctttcattttttacctaggtatgtaaatggctccacttaccagcgctggcagttcacactacctatgatgtcgactctctaccgcctggctaatcagctcctgacagacttggtggatgacaactacttctacctgtttgatttgaaggccttctttacgtccaaggcactcaatatggccattcctggaggccccaaatttgaacctcttgttcgagacatcaacctacagtgagttggagagattagggattttagacattttgagttgaatgaaacgtaatcttgatccttaaagtcctgatataacttccaaattagtctgtttacaccaggtgcagtggctcacgctgtaatctcagcactttgggaagctgaggcaggaggattgcttgagcccagaagtttgagaccaatctgggcaaaatggcaaaaccctatctttaccaaaaaatgtagctgggcgtggtgacactcacagcttcgtgtagtctcagttacttgggaagctgagctgtgggaggattgtttgagcccaggaggtcacggctgcagtgaacgatgatcatgccattgcattccagcttgggtgataagagtgagaccctgtctcaaaaaaaaaaaagtctgcttattcttgatgttgtaccctagggatgaagactggaatgaattcaaygatattaacaagattatcatccggcagcctatccgsactgagtacaagattgcttttccttacttgtacaacamtcttccacaccatgtccacctcacctggtaagagacctggaacacaacatttggaaaggagaaggctgctgtttaggttgggccarggcgggaaaactttggctgactcttcctttcrttttaggtaccatactcccaatgttgtattcatcaaaactgargatcctgacttgccagctttctactttgaccctttgatcaacccaatctcccataggcactcagtcaaggtgaggaagggaagggatgctttccctcagctcttctaggagaaatgcgtgaggttggctgatgttactaaacgctcaggtggagggagatgtgttttccgtcttgctaagtrttccccttgagctataagcgaatatgagaattcagcatttgctttaaaacatgtcattggtataatcctgttttctgtgattatccttttggactttacggttcttttcttgggtgctctagataatctgtcccggtctgtctctattgtgtttgtttgttttagcctttatattgagatgtagttaacataccatacaagttatccatttaaagtgtgtaatttgatggtttttagcttattctcagagttgtcccaactgtcacgacatgcaatttgagaatatttttattacttgagaaagaaacccttagcagttactcgccatttctccccaacttccttacgcaaccactaatctactttctgtctatagatttggctattctacacatttcatatgatagaatgaaatagaatcgtacactatgtagtcttcagtgactggcttcttaagcttaccataatgtttttgatgctcatctgtgttccgttgtgtccaagcccagtgtttggagcttgggtgggagatgattgcaatgttgacctcctgtgatgttggggctccattgggaggctttctggtggtcagccagttgaggtgtgagaagtgacgcttgctttcctggtggccctgtcttgttctttgctgtcttggtttcctttgtgctggcacttcagggctgcttttgtcagacagcccagtttccatagcagatacaggctttgtgcttggccccagagaatttccctcatcttaagtctgtgcctagttcagcaggagctaaacccttagagggattcctttttcagagccaggaaccattgccggatgatgatgaggaatttgagctcccggagtttgtggagcccttcctgaaggacacacccctctatacagacaatacagccaatggcattgccctgctctgggccccgcggcccttcaacctacgctctggtcgcacccgtcgggccctggacataccccttgtcaagaactggtaaggtttttccctgtggcagggggaatgatagtggatgtgtaggagaaaagactccaactaggtgggcatgtagccttttttttaaattctttttttttttttcccataaaaatggtagacaacccaaggcttgcagcctttagcagagtgtctggaagaagagatggccaaactctggtgggcttatttttccaggtatcgggagcattgtcctgccgggcagcctgtgaaagtgagggtctcctaccagaagctgcttaagtactatgtgctgaatgccctgaagcatcggccccctaaggctcaaaagaagaggtaaggtgccccaggggccctgcgcagacttctgttccagagatatcagtaggctgactcttactctccatgttcccacctcaggtatttgttccgctccttcaaagccaccaaattctttcagtccacaaagctggactgggtggaggttgggctccaggtttgccgccagggctacaacatgctcaaccttctcattcaccgcaaaaacctcaactacctgcacctggactacaacttcaacctcaagcctgtgaaaacgctcaccaccaaggtgcctgcattggaccctaggggcctcctgggcttcaaggacggacagttgttttcctctggttactgatgaaggcatacatcagttgggtccattgctcattcaygttctgtctgttttttgcatcttctccaggaaagaaagaaatctcgttttgggaatgctttccacctgtgtcgggaagttctgcgtttgactaagctggtggtggatagtcacgtgcagtatcggctgggcaatgtggatgccttccaggtaaggttaggtattcccaacccctgcctgggtgaggacgctggargaagcctgtgctgaccgtggagctggtttaagctccaggtctgatggggcaattgtattgcagctggcagatggattgcagtatatatttgcccatgttgggcagttgacgggcatgtatcgatacaaatacaagctgatgcgacagattcgcatgtgcaaggacctgaagcatctcatctattatcgtttcaacacggtgagaccttgactttactgactttcttttttttgagacagagtcttactcttgtctcttgggctggtgtgcaatggcacgatcttggctcactgcaacctccgcctcctgagttcaagcaattctcctgcctcagcctcccgagtagctgggattacaggtgcccgccaccacgcctggcaattttttttttgttttgttttgaaactgagtctttctctgttgccccagctggagtacaatggcacgatcttggctcaccacagcctccgcctcccgggttgaagtgattctcctgcttcagcctcccaagtagctgggactacaggcgcgcaccaccatgcctggctagtttttgaaattttagtagagatggggtttcactgtattggccaggctggtcttgaactcctgacctcaggtgatccacactcctcggcctcccaaagtactgggattaccagcgtgagtcaccgtgcccagcctcactggacttaactttctcagatcttttttcatgtatacatttagacagggctctttccagggacctatttggagagcagctatgactgtgtccttactgctcctttaaattcacatgggcgatcttagttcctggtttttgccttaaggtttctcatttacccttttgttttagatgttgaggtcccagagtttttttttctttttacccctctactgccatacctacattcctctgtatgtatattatacatatatgccccacctctgcccaggtttctattgttgtttaaatgcattgctaacttgtattcttaacttctgyttgggatcgtagggccctgtagggaagggtcctggctgtggcttctgggctgccggttggcgagtctggctstttttcatgcgtggcattacccctttattagagcgatggcttggcaacctcctggcccggcagtttgaaggtgagtggttttctctgtgtccaacttctcctgttattgcttcaaaagtacctgcccctgtttgagtctgttccctgctcttgtrtgagcactcttcctactggattgcctttaggtccagttctgaaatgagtctgacctagtattctatttcttgggcttccttctggggccttgagaggcagtcatgcatttgcaggagtggaaattcctcagaagcatagttgtgaatgtttaaggtagctcgtctttttgcatatgctgggcacagggacgctttgttaatacctaattttattaataaccataatgagtgaggagcatgaaggtagagacccttattgaaagcaaggaatcttccttgtaatccccttgggacactctacttccaggtcgacactcaaagggggtggcaaagacagtaacaaagcagcgagtggagtcacattttgaccttgagctgcgggcagctgtgatgcatgatattctggacatgatgcctgaggggatcaagcagaacaaggcccggacaatcctgcagcacctcagtgaagcctggcgctgctggaaagccaacattccctggaaggtgggtgtctctttatttccttggaggcgtaaacatccgtctttagggtaggattaccacttcgggaatcattagggggctatctggctccaatctcttttcttttcccttttagacagggaaaagaagcaccatgttgcttaggctggcctcaagctcctgagctcaagcgatcctccttagcctcctgagtagcygggactacagatgtgtgccacagtgcctggctggatcctggcttgattgtgctttttggacttttaggtccctgggctgccgacgcccatagagaatatgatccttcgatacgtgaaggccaaggctgactggtggaccaacactgcccactacaaccgagaacggatccgccgaggggccactgtggacaagactgtttgtaaaaagaatctgggccgcctcacccggctctatctgaaggcagaacaggagcggcagcacaactacctgaaggttgggcagagtaggctgggctgggtgtgagtggtgggggagtgggcaagagggaggactgtagagttgtgactgaaccttgttctggcaggatcgggctgtagcgggaggctaatttcatgtccaccttacaggacgggccttacatcacagcggaggaagcagtggcagtatataccaccacagtgcattggttggaaagccgcaggttttcacccatcccattccccccactctcctataagcatgacaccaagttgctcatcttggcattggagcggctcaaggaagcttataggtgagtagtagggtagataggttcctgctgggaaggtgacagcagggaatggygtcatcctcagagtccaaagaaagaaggtgtagccccagtctttcctggttttacttcctcctagttttcccattcacccttcccattgcttttgtcagtgtgaagtctcggttgaaccagtctcagagggaggagctaggtctgatcgagcaggcctacgataaccyccacgaggcrctgtcccgcatmaagcgtcacctcctcacacagagagccttcaaagaggtgagtgaggcctcccaagttttctttttggttctaccaaaggtagcagttgcctttggttctaccaaaggtagcagttggtggattggtgtgaaccagcctccttgtcccacaggtgggcattgagttcatggatctgtatagccacctcgttccagtatatgatgttgagcccctggagaagataactgatgcttacctggaccagtacctgtggtatgaagccgacaagcgccgcctgttcccaccctggattaagcctgcagacacagaaccacctccrctgcttgtttacaagtggtgtcaaggtagaactttcatgagatcgccctgtgaggaacggggcaggaatttagttctacrtcaaaaatctcatctgggtagcaygattggtttactctcttgatgcgtggtagtaaagggaagtagtgttcgtgttaaactgaggaaaagcccrtrgtcaaagcaatccaratgaatacgtggaatcatagtgggattggttatggaaggtaatgatagttcctgtggggctagtcttgcaagaggatttctaacctgctggagacctgccttgctactcctcaggcatcaataacctgcaggacgtgtgggagacgagtgaaggcgagtgcaatgtcatgctggaatcccgctttgagaagatgtatgagaagatcgacttgactctgctcaacaggctgctgcgcctcatcgtggaccacaacatagccgactacatgacagccaagaacaacgtcgtcatcaactataaggtgcgtctcaggcgcagtagcatggaattgtgtgtggagtgcttgtctggcccactgactcagaatttgctgaggaggaggctgggtgcggtggctcatgcctgtaatcccagcactttgggaggctgaggcgggcagatcacgaggtcaggagttcgagaccagtctggccaacatggtgaaaccccgtctctacttaaaaaaatacaaaaattagttgggtgtggtggtgggcgcctgtaatcccagctactygggaggctgaggcaggagaatcacttgaacccgggaagtggaggttgcagtgagctgagattgcgccastgcactctcagcctgggtgactgagcacaactccgcctcrggagtggaaaaaagtagaatttgctgaggggagaacaaaagaggttaacyctggagaatcctggggcatggctcacattcttaagaattgtagttckttctttctaggacatgaaccatacgaattcatatgggatcatcagaggcctgcagtttgcctcattcatmgtgcagtattatggcctggtgatggatttgcttgtattgggattgcaccgggccagtgagatggctgggccccctcagatgccaaatgactttctcagtttccaggacatagccactgaggctgcccaccccatccgtctcttctgcagatacattgatcgcatccatatttttttcaggtgagggctttccyggattcctagccttgcagggtactgaggcatrtgctttgcctctgaaatcagctattgtacctgagttgacttaactgctgttggggctttaaaatggaatgaagcggccgggtgcggtagctcacgcctgtaatcccagcactttgggaggccgaggcaggcggatcacgaggtcaggagatcgagaccatcctggctaacacagtgaaaccccgtctctactaaaaatacaaaaaattagctgggcgtggtggcgggtgcctgtagtcccagctactccggaggctgaggctggagaagggcgtgaacctgggaggcggagcttgcagtgagccgrgattgcgccgctgcgctccagcctggggaaagagcgagactgtctcaaaaaataaataaataaaaataaaatggaatgaagcccggggagggtgggggtaggatggggtggggtctccgtctattgagctggaggacttgtgggtgtcccaaatctcagtgtactggggcctcagcagtgtacctggtctggtgtaggttcacagcagatgaggctcgggacctgattcaacgttacctgacagagcaccctgaccccaataatgaaaacatcgttggctataataacaagaagtgctggccccgagatgcccgcatgcgcctcatgaaacatgatgttaacttgtgagtctaggttggggctgtgtgagctggaaggacataagctaagggcccagagagggcatacctgaggctgcgtcctgggtgggagaggcgtggctgtgtcaggatgtcatcagttggcctttgaagggaagttccttccaagaaactgctgtgaccatgtgttctctgtgggcagaggccgggcggtattctgggacatcaagaaccgcttgccacggtcagtgactacagttcagtgggagaacagcttcgtgtctgtgtacagtaaggacaaccccaacctgctgttcaacatgtgtggcttcgagtgccgcatcctgcctaagtgccgcaccagctatgaggagttcacccacaaggacggggtctggaacctgcagaatgaggtacagcctgggcggggctgggagtgacatgaacgcgcctgcacttcctgggtcagtcaccggagtcttgttgggtggaaagacttgartggtgggcacagttggctcttgcttctgtgggagttcctcggacatgttaaccttgactttgtggtttaggttactaaggagcgcacagctcagtgtttcctgcgtgtggacgatgagtcaatgcagcgcttccacaaccgcgtgcgtcagattctcatggcctctgggtccaccaccttcaccaaggtacarggccgtcatgcccagcttccctcttgtcctctgctgtcctctgctcatttcacacccctttcacttcgtcccctgctggctgcttccttctcttctttgcttagtgtgccagtttccatgctctgtgccatagtggcttatagtatgtcaggtcacttcatcgttattttctgagcgttccttgtagaaattgtgtagcctccttcttgtggacttgtgatgattctaaattaaggcaagagtaaaagttggatttattattttgaacagaaaagcattatttttgcattttctcaggtgcttatctaagtcatgttaaccagtggcatagagaacctgtgaaaaagcagccctcataggcatctcggggttcgtttctccttcacttaccttcagaggcccagccgaaggcaaccggaattgagaaagaaaaatctgaggaattttgaactacgtatatttaaggttttgcaaaatttaaaaagttacctcggccgggcacggtggctcacgcctgtaatcccagcactttgggaggccgaggctggtggatcacctgaggtcaggagtttgagaccagcctgtccagtgtggttctgaaacctcgtctctgctaaaaatacaaaaattaaccgggcctggtggccggcgcctgtaatcgcagctacttgggaggctcaggcaggagaattgcttgaacccaggaggcggacgttgctgtgagtcgagatcgtaccattgcactctagcctgggcgacagagcaaaaactctatctcaaaatacaaacaaacaaaaaaaagttaccttactctggtttccattagagtaactcttagctataacatttttcttgcattccgaccttcatatctctaaatgtgcggcatttgcatgcgcagaatgttttctgttttttagttaagtctgttaaggatacgttctgttatgttttagaactattgcattacggttgagtttcctttatccaaaatgcttgggaccagaaatgttttggatttcagattttcttttttaatattttcattatttttattagagacagggtctcactgtcacttaggctgaagggcagtggcgctatcatagctcactgcagctcaagtgatcctcacacctcagcctcccaagtatctgggaccacaggtgcatacgccaccatgcctggctaatttttaatttttttttttttttttttttttttgagatggagtcttgctctgtcacccaggctgcagtgcagtggcgcagtcttggctcaccgcaagctccgcctcccaggttcacgccattctcctgcctcagcctcctgagtagctgggactacaggcgcctgccaccacgcccggctaagtttttgtatttttggtagagaaggggtttcaccgtgttagccaggatggtctcgaactcctgaccttgtgatccgcctgcctcagcctcccaaagtactgggattacaggygtgagccaccacacccggcctgatttttaaattttttgtagagctgggatctcactctcttgtccaggctggtctcagactctggattcaagcagtcctcctgccttagcctctctaatgctggattataggtgtgagtcaccgtgcccagccttgaaatattttcattatacttacaggttcagcatccctaatccaaaatttgaaatgccccaatgagcatttcctttgagcgtcatgttggtgctcagaatgttgggactcagaaagtttcagctttttgtgagcattttgggttttagattaacctgtatgtgggaatctgtgagagcactrgagttagtgattgctstagcccagtctggaagtggaagaggaaaggattcctgaaagaagtagcatgtgatgagacaggtgagggagagcattcctttagccagaagygtggcgatgtaactagcttgtgtacatgggaccatggaaagttcaaggtttgctggagtaaattgtggaattgggaatgttaagagatgaggctggayaaatagtggagagccatatcatggagggcatcgcacaccttaggaagaatcatataagggtcttaagcacagagtgactttgtcagatgtgtttttyttcttttttttttttggcttcccacactacagatgcagactttgtcaaatttctgtgttagatgattcactcttgcagctgtgagaaagatggacctgaaaggataggatgggagaccaggtttggggaccactgaagaagtccagataaaaatgatgagagcaggccaggcgcgggggctcacgcctgtaatcccagcactttgggaggcccaggcaggtggatcacctgaggtcaggagtttgagaccagcctgaccaacatggggaaaccccatctctacttaaaatatgaaaattagccgggcgtggtggtgcacacctgtaatcccagctacacaggaggctgaggcaggagaatcgctggaacccgggaggcggaggttgcagtgagccgagatcccaccagtgcactccagcctggcaacagggtgagactctgtctccaaaaaaatacataaatcaataaaaatgatgagagcactgaaagtagaggtaggaagaggggaacagatttgataagaagttagcagataaaatcagcagaactttgtggtcctgggatgctcaaagaaaagtcaaaaatgatgtgcagattttggcatgggtgactaggtgggtgttagtgccaccaactggaagaccacatgaacaagaacaggtttaggatcgaagataaagaaatctagtttaggatatataaagtttgaagttcctgagaacattcagatggagatttccccaggtatttatttataccttatttcttcagttccaagatacatatttaagtacatatatacacatgtgtagattcctgattccttctgctcccttagtggtgcctctttaattgatgatctgttagatttgatttaaaaagtatgagtgagacattccagggagagaaatgaaactagaaaggtaagagcagtcagggatagcttagaggttcctaggtgagaagcaatctgaagaaacatggagaacaggtctggattaaagatgtagatttcggagcctatccacaaaaggtcaaaagctcaagaatgagtgacatcacccagggacaatgtggagtgagaagaggagagggaggaatttggaaatgtggggaatactaagatgaagtgtggtcagaacctgtgggagggtgccgggtcttggaaccaaggccttcaggaacacgtgtccagaattggggtgatgctgagcagtgtcagttgcctaagagcatttcagttagatgaggactgaaaagtatccattggatttgacagttaggacgtcattggtgaccttagcaggagctgttacagaaatagtagggatggaagccagatggcagtgggtgaggcttcatgggaagtgagtgagtggagacagcaaggacaatctgtttgtcagttgaagagaaggaaggacatcagatgccacctagagggagctgtaagtcagtgcaggtgtttttgaatgacagtgacttgagcgtgttttaattaaggagcccagtagcagttgagtgtacaagagaaaagtgtggaattggctggacacagtggctcacgcccgtaatcccagcactttgggaggccaaggtgkgtgaatcaccaagtcaggagttcgagaccagcctggccaacatggtgaaaccccgtctctactaaaaatacaaaaattagccaggcgcggtggcgggtgcctgtaatctcagctactcgggaggctgaggcaggagaattgcttgaacccgggaggyrgaggttgcagtgagccaagatcgtgccactgcaccccagcctcggcgacagagcaagactccgtctcgaagaaaagaaaagtaggtaattgatgagcagaggtgcagagggtctccctagggatagaataaagagcaagcagaggaaaaatcctctgaacctgacaggaaagaggtctggaaagatgtggatatagatgaggttagtgggaagctataacaggattttgagtttttcagcttttcttgggctgcagttaggggaaagagttgtgcatagtgaatttcatggtattagggtatgatgattgctgaagaaactgagagggattggaaggtgtgttgggagctcagctgggttttgggaagacaactctgagcatttgtttttcccagaatcacccagctactcagtgacagggatgcagaaggtggatagattacactggtgattaaggaatagagctctgttagaagacagttgtagagtggtaaggcattgaatgcaagggaatcaagagtgcgggacccagccggccgcggtggctcatacctgtaatcccagcactttgggaggccgaggygggtggatcacgagttcaggagattgagaccatcctggctaacgcggtgaaaccccgtctctactaaaaatacaaaaaattagcyggatgtcgtggcgggcgcctgtggtcccagctactcaggggggctgatgcaggagaatggcaggaacctgggaggcagagcttgcagtgaaccgagatcgcgacactgcactccagcctgggtgacagagcaagactctgtctcaaaaaaaaaaaaaaaaaaaaaaaaagaatgctagaccccattgagatactggaagaggggagaggagagagagcagaagaggccattggcctgggaaagaattgtaggcatcagggaactggatatcagaagttagaggctgaggagtggaggagtgtctgagagggtaaggatgcagttgactctagtggttagaagcacaggctctggagtcagatggggttcacatcatatctttgtcatattactagttgggatcttgggaatattgcccatgctgggcctcaattccctcatctgtaaaatagggatactgataggacctaggtcagacggcttttgtgagaattaaatgaaacggggtatttagtaagccatattacttggtaaattgcatgataaagctgggcatggtggcttatgcctgcaatcccagcacttttggaagccgaggtgggaggactgcttgagcccaggaatttgagaccagcttaggcaacatagcaagatcctgtttatatttaaaaataaataaataggccgggtgcggtggctcacgcctgtaatcccagcactttgggaggccgaggtaggtggatcacgaggtcaggagttcaggaccagcctggccaatatggtgaaaccccatctctactaaaaatacaaaaattagccaggcgtggtggcacatgtctgtagtcccagctactctggagactgaagcaggagaaccacttgagccccggaggtggaggttgcggtgagctgagattgcgccactgcactccagcctgggtgacaaagtgagactccatctcaaaaaaaaaaaaaaaaaaaaaaagctatgtcatgggcaagttctataacttgttttttatgaagacataagaggtataacatatataaatttcttaccatggtacctagtacacgtagacctgagtaaatattattttccttcttgcctccccttatcccccaggaatttctgctatttagtaaaggaacactgggctcctcaggaatttatgcctcctccccttcagggatagagcactgttaactacaacagaaatactgtgttccattacacacatcagcaattccaagtgcagtccaagaatttactaaacctaatgggaatcatccacttgcctttaccccagtatctagcctatcctggcccctggccctcctttttttttttgagagggagtcttgctctattgcccaggctggagtgcagtggcacaatttcagctcactgcgacccccgcctcccgggtttaagtaattctcctgcctcagcctcctgagtagctgggattacaggtgcctgccaccatgcccggctaatttttgtatttttagtagagacagggtttcaccatgttggtcaggctggtctcaaactcctgacctcatgatccaaccgcctcggcctcccaaagtgctgggattacaggcatgagccaccgcacccggcccccctcctttctgtagatctgcctggttgtctcatcctgtggacatgcgagatgctcagtctagctttcatagtagggtttgagctgttatctcacctgcagtcttttctccttgcttgtctgaataccatttgctcaaggcagattactatagtaactccagccaacgcactctttcacctcaataattgttcagaagacattttttgccttaaagtcttgactatatcatttggtattttgtggtttgctatcttgttttattcagcttttcaaagaaacagctttggtttcattaatttttatcgtttttctcttttttgttgcattgattttttttttttttgagatggggtctctatgacccaggttggtgtgcagtgtcgcagtctcagctcactgtaacctctgcctcccaggctcaggagaccctcccaccttagcctcccaagtagctgggaccacaggcacatgccaccatgcctggctgatttttctttgtattttggatacagacagtttcgccatgttgcccaggctggtcttgaattcctgagctcaggtaatccacccccctsggctcccaaagtgctgggattgtaggtgtgagccaccacgcctggccttgttgcattgatttcttctcttatcattgccatccctttgctagtttgttaaggtaaaaggttagattatcaattttggacctttctctttttttttttttgagacagagtctcgccctgtcactcaggttggagtgcagtggcgcgatctctgctcactgcaagctccgtctcccgggttcacgccattctcctgcttcagctcccragtagctgggactacaggtgcccrccaccacacccggctaatatttttttttgtatttttactacagacgcggtttcaccgtgtttgcgaggatggtctcgatctcctgaccaccacctgatcagcttgcctcggcctcccaaagtgttgggattataggtgtgagccaccgcacctggcctggacctttctctttttctttttttttttttttgagatggagtctcactctctcacccaggctggagtgcagtggcgcgatctcagctcactgcaacctccgccctctgagttcaagcgattctcctgcctcagtctcccgagtagctaggattacagatgcctgccaccgcacccggctaatttttttgtgtgtttttagtagagacagggtttcaccatcttggccaggctggtcttgaactcttgacctcgtgatccacctgcctcgtcctcccaaagtgctgggattacaggcgtgagccaccgtgcccagctgacctttctcgtttttttttgtttgagacggagtcttgctctgtcgcccaggctggagtgcagtggcgcaatcttggctcactgcaacttccgcctcctgggtttgtgtcattctcctgcctcagcctcctgagtagctgggactatagtcgcctgccaccatgctcagctaattttttgtatttgtagtagagacgggtttcaccgtgttagctgggatggtcttgatctcctgacctcgtgatccacccacctcagcctcccaaagtgctgggattacaggggtgagccaccgtgcctggccaacctttctctttttctaatagtattattcacttctgtaaattttcctctcagcattgctttagctgcattcctccctttttttttttttttttttttgaggcagagtctcacattttcgcccgggctagagtgcagtggcacgatctcggctcactgcaacctccgcctaccctgttcaagcgattctcctgcctcagcctcccaagtagctgggattacaggtgcccgccaccacacccagctaatttttttttgtatttttagtagagacaggtttttaccatgttggccaggctggtcttgaactcgtgacctcgtgattcacccgccttggcttcccaaagtgctgggcttacagatatgagccatcgtgcccggccccattcctcacattttaatatgttgtgttttcatttttatttagttaaaagtatattctaatttcccttatgagttcatatttcaccttaggttgtttcaaattatgctgtttacatatttgggggtttcccttattagtttctgctttgattccattatgattaggaaacatgttgtatatgatcttagttttaaaaaatgtatcaagattttttttttaataattaattcatttagaggtgggatctcactcttgcctaggttggacccaaactcctgggcgcaagcgatcctcctgcctcagccttccaaagagttgggattacgggcatgagctactgcacctggctgaggctgactttttgatgtcctagcgtacagtctctcttggtgcctgtcctatgtgtgctggaaaatatctgttaatctgtattctgctattgttaggttgagtgttttacaaacattaggtccagtcarttggttacattgcttaagtcttctatatccttagtgatattttttgtatacttctatcgattactgaggagtattagaaatctctagtaatcccagcagtttgggaggctgaggctggtggattgcttgagcacaggagttcgagaccagcctgggcaacatagcgaaaccccatttctacaaaaaaaatacaaaaattagctgggtgtggtggtacacgcctgtagtcccaggtgcttgggaggctgaggcgggagagtctcctgagcctgggaggtggaggctgcaatgagtggagatggtgycattgcactctagcctgggcaacagagcaagaccctgtcttgcttgagagaaagatccarctacagctgtgagtttattgtctttcaggtccatcatttttgaaattctgttattagttacataatgtatttaggattattaggtcttctgaacgagttgactactttatcgtatcaaatatccctctgtattcctgataacattccatggtctgaagtctttgtcttaatcagtagtgccactccagctttgttttgtgtttgcatgggtgtatttttccatctttttactgttaatctgtgtctttgtaactaaagtttatttcctatagacagcatatagttggctctttttttttttttttttttttttttttttgagatggagtctcttccttggttgcccaggctggagtgcagtggcatgatcttggctcagtgcaacctctgcctcccgagttcaagcgattcttctacctcagcctcccaagaaactgagactacaggcgcgtgccaccacgctcagctaatttttgtatttttagtagagacgggggtctcaccatgctgtccaggctggtttcgaactcctgaccccgaggcccgcctcagcctcccagagtgctgggattacaggtgtgagccaccatgcccggcctttttatttaaatccaatttgacaatgtttgccttacaaatggtctaaatacctcaattaaggttaatgtaactatcaatgtggcaatgtagctcagtttaaatctaccgtcttactcttttttttttaaattattttttctgcttttctcttgtcctgccttcttctgaatttagttgttttgtgactttatctccacttttcacttatttggctacatggtttttttcttattgtttgctctaaggtttacagtatatacatagctcacttactgkgatctactttgaccattagtctactacggatcacttcacatatagtacaagaaccttagaataatacactttaagttccactcccactcttagtagtatttttgtcataacattttaattgtacatgtattataagtgctataatactttgttactctttttgctttgaacagcctttatcttttgtagaaattgcaaaatgagaaaaaatatttttttgcattttacccacatacttaccatttctggtgttcttcactagtttgtatagctccatctggtgtgcttttttttttctttttcttttcttttttttttttttgagacacagtcttgctctgtctcccaggctggagtgcagtggtgcgatctcagctcactgcaacctctgcctcctgggttcaatttctgtatttttagtagagacggtttcatgttggccaggctggtcttgaactcctgacctcaggtgatccacccacctcggcctcccaaagtgctggcatgacaggcgtgagccaccacacctggcccaggggaaccatttttttttttttttcccctgagatggagtctcgctgtgttgcccaggctggaatgcagtggcacaatctcagctcactgcaacctccacctcccaggttcaagcgattctcttgcctcagccttctgagtagctgggattacaggcgtctgccaccacacccggctaattcttgtatttttagtagaaacagggttttgccatgttggccaggctggtctccaactcccgggctcaagcagtcctcccaccttggcctcccaaagtgctgggattataggcatgagccatcgcgcccagcctcattgtgttttgctttctatttccctagtgactaatgatgttgaactcaaatctttctttagtagtagggataaaactaactgcatcaagtagtctccaccctccccgcccctggctcatctgtaatttrctttttttyctactacctttagattgtgaataagtggaatacagctctcattggccttatgacatactttcgggaggctgtggtgaacacccaagagctcttggacttactggtgaagtgtgagmacaaaatccagacacgtatcaagattggactcaactccaagatgccaagtcggttccccccrgttgtgttctacacccctaaggagttgggtggactcggcatgctctcaatgggccatgtgctcatcccccaatccgacctcaggtacagcctggttcaacgtatttctaaaccctattgctcaggccctaagggaagtgggtatttctttagttttaggctttattttttctgtaatcttggttgtacacccaaacaggtggtccaaacagacagatgtaggtatcacacactttcgttcaggaatgagccatgaagaagaccagctcattcccaacttgtaccgctacatacagccatgggagagcgagttcattgattctcagcgggtctgggctgagtacgcactcaagaggcaagaggccattgctcagaacaggtgggcacctaggagggcatgccaaccctggggcaggggcagtggtggcctttgaaccgtgtggagttcagggtcagagcatgccatggttgtatggaggtgagaaggctggttctactgaccctaattatttttggccaggaaggagtgctgagctcctcatatgagatcacgttttgacttgaatctttctttttttggaagacgcctgactttagaagacctagaagattcatgggatcgtggcattcctcgaatcaataccctcttccagaaggaccggcacacactggcttatgataagggctggcgtgtcagaactgactttaagcagtatcaggtatgtagagggagcagattttccctgagtcaggaaaatccatggctatccccgaaacttggggcaataggcacccagaagcttgaccgtgcctgccttgccatctaggttttgaagcagaatccgttctggtggacacaccagcggcatgatgggaagctctggaacctgaacaactaccgtacagacatgatccaggccctgggcggtgtggaaggcattctggaacacacactctttaagggcacttacttccctacctgggaggggctyttctggtgaggattctcctctcttagagggacctgtcacaaccctttgagctcatctcttgtatgcctctgtgatttcctgtggtgtttcccagacagccacctccaggaggttagcagtgtgctgggaaatggcaggatatcacctcacctgcttctcttgctccccagggagaaggccagtggctttgaggaatctatgaagtggaagaagctaactaatgctcagcgatcaggactgaaccagattcccaatcgtagattcaccctctggtggtccccgaccattaatcgagccaatgtgagtgtgattgacactggagaggggaagctaaagacagttgctgcttcttgccttggttatgtcgtgagcgcccgagtctcttgatctctaatgtcacattgtcgttttcctggcaggtatatgtaggctttcaggtgcagctagacctgacgggtatcttcatgcacggcaagatccccacgctgaagatctctctcatccagatcttccgagctcacttgtggcagaagatccatgagagcattgttatggacttatgtcaggtgggctggaatcgaggggagagggtactgtagagagtcagctcaggtggaattgaggggagagggtactgtacagagtcagctcaggtggaatcgaggggagagggtactgtacagagtcagctcaggtggaatcgtggggagagggtactgtagagagtcagctcaggtggaatcgcagggagagggtgctgtacagagtcagcttaggtggaatcgcggggagagggtgctgtacagagtcagctcaggtggaatcgcggggagagcgtgctgtacagagtcagctcagcttgctcttttgcatatgggaaatccaccctggaagctctgaggatgagactcctattgcctcattatcttattgtacaaactctgattttaattgggcttccttaacaagtcttaatctctccatgttttccttcaggtgtttgaccaggaacttgatgcactggaaattgagacagtacaaaaggagacaatccatccccgaaagtcatataagatgaactcttcctgtgcagatatcctgctctttgcctcctataagtggaatgtctcccggccctcattgctggctgactccaagtaagtgcctcaggacccagccctaggcagccaggacactttcgktttcctgttcttctagccctgcaactttaggaattgtcctgtctgcctttgtttcaaacttggagccagtgctaygcttggagcctgtcaacacccttagtcagatctgctgattctctggggtcctgctgacctggaacaagttggtggagtgggtgggatggttttgggatttaagtggttctggttctggggacattggttatgcccatggtttcttagaagcttgaaccctcttcatcctcagggatgtgatggacagcaccaccacccagaaatactggattgacatccagttgcgctggggggactatgattcccacgacattgagcgctacgcccgggccaagttcctggactacaccaccgacaacatgagtatctacccttcgcccacaggtgtactcatcgccattgacctggcctataacttgcacaggtgagttgaggctcaggaccatgtattttcaggccaggcgcagtggctcacacctgtaatcccagcactttgggaggccgcggtgggcagattgtctgagctcaggagtttgagaccagkctgggcaacatggtgaaaccctgtctctaccaaaatacaaaaaattagctgggcgtggtggtccacgcctgtagtcccagctactcagaaggttgaggtgggagaattacttgaacccgggaggcggagcttgyagtgaaccgagattgcgccactgcactccagcctgggcgacagagtgagactccatctcaaagaaaaataataataataawaaataaataaataatccgtgtattttccattagctccatactttaacgtagtcatacttttttactttacctaagtgagaggaagtggcccattcctcctatgggtcactgattctcttctccagcctgtatgtacacatgrgcagagtgttgtcagcctggcgaacagtctttcttcctctgtagagttggcagcttgtcttgtttctggggctgtcattctcgtcttaacttttcttgacccttttatcctcacagtgcctatggaaactggttcccaggcagcaagcctctcatacaacaggccatggccaagatcatgaaggcaaaccctgccctgtatgtgttacgtgaacggatccgcaaggggctacagctctattcatctgaacccactgagccttatttgtcttctcagaactatggtgagctcttctccaaccagattatctggtttgtggatgacaccaacgtctacagagtgactattcacaaggtgagtgttagcagcagtgtataggtgcgggactcygtacatggctgtgggagagtaatgggctaagtgtgtacacatgctgggaagaaggcaggatggggatgtgttgtgtaggccatgctaacgaatgccgtcctcctctagacctttgaagggaacttgacaaccaagcccatcaacggagccatcttcatcttcaacccacgcacagggcagctgttcctcaagataatccacacgtccgtgtgggcgggacagaagcgtttggggcaggtgagcaggtttaaagatgaagaggctgtagaaccatgtkgcctcttattcttggggtggacttggyaatatttactggtttattagatgaaaggctgagaacatctcatttgaacttatccccaaaataccttgggaagtattctgtgggaggtccaagagtgtatgaggtgcttcgttcccttccagctggtctgtttcctgaatttctaaccttgaacagggctatcaaaaatcatttttccaaaggcaacgcatactctttttttttttttttttttttagccggagtctcgctgtgtggcccaggctggagcacagtggctcaatctcggttcactgcaagctccgcctcccgggttcacgccattctcctgccttagcctcccgagtagctgggactacaggcgcccgccaccacgcctggctaattttttttgtattttttagtagagacagggtttcaacgtgttagccaggatggtctcgatctcctgactttgtgatctgcctgcctctgcctctgcctcccaaagtgctcggattacaggtgtgagccactgctcctggccagcaatgcatattctctttttttttttttttttttgagacggagtcttgctctgttgcccaggctggaatgcagtggcctgatttcagctcactgcaagctccgcctcccaggttcacgccattctcctgcctcagcctcccgagtagctgggactacaggtgcccgccaccacgcccggctaaattttttgtatttttagtagagacggggtttcaccatgttggccaggatggtctcaatctcctgacctcgtgatccgcccgccttggcctctcaaagtgctgggattacaggcttgagccaccgtgcccggcccagcaacgcatattcttgaaacatccactttgaccaaatctcttctctacctcacaactcttgctgaattaactcttctttagcttcctagacgttcaacatctggctgggctgtatctgtccagccagtttctcttcctttacatttatagcatgtttcatcttacattcagtccaggatcttagtagcccaaacccctgatgctcatctccaaatctgtgttttgcttgtatttttctttctagaatgaactcccctctttgctctgttaatcacagtccctccttaagacacgtttttttgtgcagcttttttctgatcctagtagccttaatttcttttgttcctgaactctgtaaaacagtgtatagtttagcacatactcatgtgtcagcttgtggtattgtcttgttgaaaggggctgtcagcctggtcattggacacggccatttgatactctttgtaccttctaagtgcctaacatttaacatcagtgttcaatagaaacgtagttggattatttcaaaactaggatattctgttctagttgatctgggagggtagagactaaatttccattttcttctctcttgcttttaagttggctaagtggaagacagctgaggaggtggccgccctgatccgatctctgcctgtggaggagcagcccaagcagatcattgtcaccaggaagggcatgctggacccactggaggtaagagggtggggtggggtaggagaaaagagaccttgagaccttcaggstgtttctcatcttggacttgatcttgtcttaggtgcacttactggacttccccaatattgtcatcaaaggatcggagctccaactccctttccaggcgtgtctcaaggtggaaaaattcggggatctcatccttaaagccactgagccccagatggttctyttcaacctctatgacgactggctcaagactatttcatcttacacggtatgaacctcgggaagagaagatcgctggaggaggagygggtttagggttaggagaagatcctgtgtcaggtttttgccattttcacatttttagcctatagattgggtgggaactctgttgactttcatgagagtttaagaccttaaagttaaaaatcaactcttggggccgggcgtggtggctcacgcccgtaatcccagcactttgggaggctgagttgggtgaatcacctgaggtcaggagtttgagatcaggctggccaacatgacgagaccccatctctactaaaaatacaacaaaattagccgagtgtgctgggatgcacctgtagtyccagctactcgggaggctgaggcaccagaatcactggaacccaggaggcagaggttgcagtgagccgagatggcaccattgcactccagcctgggcgacagagtaagactgtctaaaaaaaaaaaaaaaaaggccgggcgcagtggctcacgcctgtaatcccagcactttgggaggccgaggcggcggatcacgaggtcaggagattgagaccatcctggctaacacagtgaaaccccatctctactaaaaatacaaaaaattagccgggcgtggtggcaggtgcctgtcatcccagctattcgggaggctgaggcaggagaatggtatgaacctgggaggcggagcttgcagtgagccgagatcatgccactgcactccagcctgggcgacagagcaagactctgtctcaaaagaaaaaaaaaaaattcttgggtttcatgaaaggttaggattaaagtgggagagcctcaagcagctgacctaccccactcttccaaatcttttcccaggccttctcccgtctcatcctgattctgcgtgccctacatgtgaacaacgatcgggcaaaagtgatcctgaagccagacaagactactattacagaaccacaccacatctggcccactctgactgacgaagaatggatcaaggtcgaggtgcagctcaaggatctgatcttggctgactacggcaagaaaaacaagtgagcagtgctggtggggacacagacaggaggtctatatacggttttctggggttttttggaagcacttaggcttagaagtttctcaagaaggccaggcgcggtggctcatgcctgtaatcccagcactttgggaggccaaggtgggtagatcatttgaggtcaggagtttgaaaccatcctggccaacgtggtgaaactccgtctctactaaaaatacaaaagttagccgggtgcgatggcgcctacctgtaatcccagctactcgggaggctgaggcaggagaattgcttgaacctgggggcagaggttgcagtgagccgagatcatgccactgcactccagcctgggcgacaagagtgagactgtctccaaaaaaaaaaaaaaaaaagacgtttctcaagaaattatcttgtcttagccaggcttgagtgctcatgctagtaataccagcactttgggaggccaaggtgggaggattgcatgagccaggagttgaaaccagcctgatcaacaagagactgacgccatctctaccaaaaaaaaaaaatttaaaacaggtgtggtggtacacgcttgtagtcccagcttcttggaggctgaggcaggaggcttgcttgagcccgggggtttgaggctgcagtgagccatgatgatgccactgtactccagcctgggtaacagagcgagactcttgtcttgaaaacaaggaaagaaattatcttacagagtctcgaggaagagagatacagcagtgtcttcsaatagtatgggaagcatccctgttttagggcttcagtctgactcttggccattgtttctcactgttgccatttcaaacagggcatttctttactgtccatacatgggaagaattttgaacatccgagaccctaagtatccgagactgctgccaacacacacacacaccttcctcccctcgtctccctccctgtcatcgtggcaaccaaaattatccatagggtgacggacaataccacctctgattaagaaccagtattctagggtttctggggtttccatttctgagaacagttccatgccagagcattgttttggtcaaggaagcgtagggtttatggatgctaaacagtgggaaggtgcacacgcagtgtgctgtcccgcttggatctgacgaatcttggaagtgttagtgcacctccrtttcacacttcctgtagaagcagctcttgtggattgtctggggcgtgagtataggctgtcctgtcctaccaagttacaccctttccattgaggcagaagtgaccaaggggaagggatccttgtaatataacccacaccatccccacagtgtgaacgtggcatcactgacacaatcagaaattcgagacatcatcctgggtatggagatctcggcaccgtcacagcagcggcagcagatcgctgagatcgagaagcagaccaaggaacaatcgcagctgacggcaacacagactcgcactgtcaacaagcatggcgatgagatcatcacctccaccaccagcaactatgagacccagactttctcatccaagactgagtggagggtcaggtactgtcgggcaagagggtggggatggaaaggccggctgcactacctaaggtgctgggctgagcgatgctgacactccctgcctgtttttagggccatctctgctgccaacytgcacctaaggaccaatcacatctatgtttcatctgacgacatcaargagactggctacacctacatccttcccaagaatgtgcttaagaagttcatctgcatatctgaccttcgggcccaagtgagtaagtggactcagctaggccacagtgtgtgcccaactcattttgtgcctaaaactcagacctgagattgtctggaacttgagatgctggtttcaagattcatggatgagtaattatacaaggatagccaaaacaacgaggtgggttttggccccatgagatagcaaaagctgtggcagctgagagaaggtagtaattrtagtattggcctgatagtatttggaagagaacagatatggtcagaaacaaattcctgaccaggtgtgcgtgctggctcatgcctgtaatcccaacactcggctgggcacagtggctaatgcctataatcccagcactttgggaggcctaggtgggtggatcacctgaggtcaggggtttgagaccagcctgaccaatatggtgaaaccctgtctctactaaaaatacaaaaaattagccaggcatggtggcatgcgcccgtagttgyagctactagggaggttgagacaggagaattgcttgaacccgggaggtgaggtggagcttgcagtgagccaagattgcatcactgcactccagcctsggcaacagagcaagaccccgtctaaaaaaacaaaaccaaaaaaaacgtggctgtagtcccagctactcaggaggatgaggttgcttgaacgcaagcagtgagctttgatgaccccactgcactccaggctgggcacagtggctcatgactgtaatcccagcactgtgggaggccgaggtgggcagatcttttgagcccaggagttcgagaccagcctgggcaacatgacgaaatggagtctctacaaaaaaaaaaaaaaaaaactagccaggcatggtggcatacacctgtaatctcagctactcaggaggctgaggtgggaggatcacctgatcctggagggtggtgagtgtagtgagctgagatcatgtcactgcctgctagcctgggtgacagagtgataccctgcttcaaaaaagagaaaagatgcataactttactagtgtatcagggatattatagtttataaaacatcattttgggccaaggtgggtgaatcacttgaggtcaggagttcargaccagcttggccaacgtggcgaaaccccgtctctcttaaatatatgaaaattagcggggcatggtggcatgtgcctgtagtcccagctactcaggaagctgaggcaggagaattgcttgaacccaggaggcggaggtcgcagtgagctgagatcacaccactgcactccagccttgctgacagagtgagactccatctcaaacccactatttagtggctgtcaggttggcaaatttgaaaagattgttaatatcctgtgtgggtgagtttatagtaaacagatcctctttctttcttggtgataatgtaaaacttaaaatagcaccaagtgctggttttccagatgttttcagcttgtgaaaatacactgagctgcatgtgtgctcatttgcttgtgaatactatgcttaataatcagctggggagcttgtgagcagtgcagattcctggaccccactcaggagattctgatgtggtaagtccgcgatgaggtccatgtctaacattttgaacaagcaccccagctgattctgatacagggggttctgatcacgttttaagaaactctgtcctcgttcttgggggaaggaaggaaacagagggctggcagctccaactctgacctggtactaagaagagttttggttcctgacccctttgtctccagattgcaggatacctatatggggtgagcccaccagataacccccaggtgaaggagatccgctgcattgtgatggtgccgcagtggggcactcaccagaccgtgcacctgcctggccagctgccccagcatgagtacctcaaggtaatggggagtgatggagcctgggagtgtggaaaagctggtgcgattcctgtctgtggatgggattcagctctgtactcctctttacctataggagatggaacccttaggttggatccacactcagcccaatgagtccccgcagttatcaccccaggatgtcaccacccaygccaagatcatggctgacaacccatcttgggatggcgagaagaccattatcatcacatgcaggtgggcctgggctccttgggaggaagtatggtggggcagggattgcaggccagggcccagaacagtggcctragctgttactctgtcctcgttcctcccccagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggtaagtgggaggagcctggggatgtggggatagcagtagggataaggtgaggccatygccctttgcacttggggcctggctggcttggaggtggcgcaggctgcatgaggcaggagccctgttaacattggctgtttccttctccccraaggtgttcggcatgaccccaacatgaaatatgagctacagctggcgaacmccaaagagttstaccacgaggtgcmcrrgccctctcacttmctcaactttgctctcctgcaggagggggaggtttactctgcggatcgggaggacctgtatgccygaccrtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaatagragttcaggggctggtttgttttttttttcccccccaaactcaaattctggatttaggtctaacaggaggctggactggagcggttcacagcaagatgctgggctcggctgtgaaggggggagtatgaggcccccttcctattcagggctttggggtagatagcccctggactcagtggagacctgaggcagggctgggctttcacactccgctgccttgaccacatttgctgctttttccacaaaactacttggaagctctcgcctcctttccacagttttgggagcagttgccctttcccgggtctaggaactctgtggcttgtgctgagcggctgcggtgtccagcccagccctttaagctttctgtgtcagtcctggtcaggaaaacaagcacacaggcaggcagtttgtgtacagccgggcggaggccagagaccggctgcctacctgtcacctctcgcctggagcgggccactgccaagttggccccatgactccaaacgggcggagcctggattgggcctgtggggagggctccactcaagtgaccacttgcagccctgaacctcagctcttggacgcctggctggaagttggctgtcttgtttcctgtgaccttgggggtggaaaggacagagcccaggcgacctagggcactatctccctaccccacgccttctcccttcctcgttcctccctacccttatcgcttctaccccgcccacaccgccctaaacggcttcctggggcggaactgtttcgcttttccccgtcccagtggagggtggggtgggggggtcgcagccctaagcctctgggagacatggagcccaggagggcggcgcccggggtgcctggctgggggtctcgggaggccgcggggtcggcatcggccgcggagcttgtgtaccatctagcmggggccctgggcactgagctgcaggatctggcgcgccgtttcgggccggaggcggcggccgggctggtgccgctagtggtgcgggcgctggagctcttggaacaggctgccgtggggcccgccccggactcggtgagtcatggccctcccttcgccacccacggggycggcagggccgaagcctgagacccgggtctccccagctgcaggtgtcgrcgcagccggcggagcaggagctgcggcggctgcgggaggagaacgagcgcctccgcagggagctgcgcgcggggccacagggtaagcgcagccccggccagggcagggcgggtgacgacctgctcgggtcctcccctccctcccgcgggccgcgcgccgccgccgctaagaacgccccttcctcagaggagcgcgcgctgctgcggcagctcaaggaggtcacggaccgacagcgggacgaactccgggcgcacaaccgcgacctgcggcagcgcggccaggagaccgaggcggtgagggcggggcggggctctggggcggggcgggggcggagcgtggcaggcgctgggcggggctccgggggcgggggcggagcgaggcaggcgctgggcggggctccggggggccctcggtgccccgcccaccccaccctttgctccgctcccagttgcaggagcagctgcagcgcctcctgctggtgaacgctgagctgcggcacaagctggcggccatgcagacccagctgcgcgccgcgcaggaccgcgagagggagcgccagcagcctggcgaagccgcgactccgcaggctaaagagcgagcgcgggggcaggccgggcggcccgggcaccagcacggacaggagcccgaatgggcgaccgccggcgcaggcgccccagggaaccctgaggacccggtgagtgccgtatgagggcaaggacccagcccaggackcagcgtccagccctcggtgggcactcaagcaaggtttgcatgctgcacagcaggtcggccaggaagcggggaggtggcagacagatctgcgcccccggccggcctcggcccccgctctcagctggagcactgctctgttatctgttagggcacccttgtcccccaagtctcccggcccgtcacttcctctagcattcccatgatggccctggggcgggggaacgccagccgaggcgaccctctgactgtgcctgtccttccaaaggcggaggccgcgcagcagctcgggcgcccctcggaggcagggcagtgccgcttcagtcgggaggagtttgagcagatccttcaggagcggaatgaactcaaagccaaagtgttcctgctcaaggaggaactggcctacttccagcggtgaggacgctgggaagccggggggcctccgatcaccccacctcattctccagtcattgacatgtccacagtgacatgtgccaggcctgcgctgggaactgggaggacatgaattgtacagcccttgccctcctgcaatgtcatccagacaggggagagggacagtacaaagggttgcagctgcagcagccagggaatctctcctaggagggggccacggggccacctaatttaaggtctgagggtgtcagcaaggcagagcgcttcccgtgttcagggaagagctgcgtgcacaggtaccaggagtgaggactgcggctggcatctccactgctggcatccccatggctggcatcaccagggctttctccctccctgccccttttctttagggagctgctcacagaccaccrggtcccyrgccttctgctcgaggccatgaaggtggctgtccggaagcagcggaagaagatcaaggccaagatgttagggacaccagaggaagcagagagcaggtaggtccctgcctgcattcccacggagccaggmctccctccctcattctgctgagcctgatgacccagcctggtcaccctctgagcccattgtctcagactgaggctgtcaccccaacccggtcaccccttgagcctccctagcctggccgcttctagggcctgctgacctgctctggctgtgtcccatggccgctgtccagcctgcgcccttctccctggatctcaccactccccttgccttgcctgccatccattctgcctgacaacactgcctctcyacattcattcttcaagttcctgtcttggctgggtctgtttattcttacgggggtgaaactgtagccgcggctgtgtcagggcctgctgtgtgtcaagctataaaataaacccttggcagggcgcggtggctcacgcctgtaatcccagcactttgagaggctaaggtgggtagatcacctgaggtcaggagttcgagaccagcgtggccaacatggtgaaactccgtctctactaaaaatacaaaaattagccgggcatggtggcatgtgcctataatcccagctactcaggaggctgcggcaggagaatcgcttgaacttgggaggcggaggttgcagtgagctgagatcgcaccactgcactccagcctgggcgacagagtgagaccctgtctcaaaaaaaaaaaaattaaaaattaaaggctcgacatcctgcatctccccagggttgccttctctccagccccgggggccctgcagtccctccatcccccctgctggattcctgttgtccctcagggccttgatcaatggccctcacttctcctctctcctctgtctcagtgaggatgaggctggcccatggatcctgctctccgatgacaagggagaccatcccccayccccggagtccaaaatacagagtttgtatgttggggaaaggggaaaggcaagagtgtggggagggaggaagggccctggctggtccttctcargatcccctttcccgcttctctgcccrtcaccctgctgtgcttggctctaagcacaccgtcccctcctgcttctctggccctggcccccatcaccttcacactccctcaggctgccctttcttccccctctccccttttctcaccaycccctgccctcacccatatccttgacctctctggcttcctggctcaaagtgcctctggctgtctctctccagctttggcctatggtatcggggtaaagctgaatcctctgaggatgagaccagcagccctgcacccagcaagctagggggagaagaggaggcccaaccacagtctccagctcctgatccgccctgttctgccctccacgaacacctttgtctgggggcctcagccgccccagaggcctgacttaggggtctggctgtggaaggatgtgtggcctcaaatgaggacagggctcccgccttcacagccctcgccaggggtctgccccaatcctggcctgcatcagggcaggacggggtctcagcccgcctccctctctacgtctctgtacygagcctctggggccagatataagagtgcctctctgagtctcagtttccccatccatgaaatgagagctgactgcctagctcccagggctttgtgmagacggcctgagctcatgtaataaagaactgcccgtaatacacagaaactgttcctcgcctgtctgtccatgtctgtgccacctcccaaccctgccaggagcagaggcaggctgaggggtcctcgctggtctccttgctcagtcactgggtggggkggcttcttgyagctcaggccttgctttgggagtgtggcctgatggaaagccgtggctcccagcctcagtccacccccttccctggccccggcacccagggacctgcaacttcattcttctggcccttccaggcccaggccagtcagccctgccattgcctttctttccctttctttttttgagtgtcagtctttccagccaccccctccctctcagggaggtgcctcgtggcagcccgcccctcyggcctggtttcctcaggaaaagccctgagaggaagcagkgagggggttgggagctgtgggggccagacgaacccgagcgctcccaccgagctgcctgccatggggctggggctgctgctcccgctgctgctgctctggactcgggggactcaggggtccgagctggaccccaaagggcagcacgtctgtgtggccagcaggtgggtctcgtgggagtctgatgcgtgtggccagcaggtgggtctcgtgggagtctgatgcgggtggctgaaccggtgttgaggccgttaggggaaggaggagactaggaagggggcttaggctgaaaggaagggactgctgatggcggtctggcaggtagtggccagccagggcagatggtggaagggtcagggaaggagaggggaggggctggggaccctagctgtaaagatccattaggcctccccagggggctaaggcagcctcccccactgcagccagagacagtgatccaccttcctcagggccaggctgcaccccccaccatgtccggctgacccctttttgccccacagcccctctgctgagctgcagtgctgcgcaggctggaggcagaaggatcaagaatgcaccatccgtgagtagccaggacagaccctcagccaaggagaagggaggccgtagcccagtgacaacccttccttcctaccccatggggcctgcccctcctgawaccaggagtcagggtttctcctgtgacgcacycccaggcctgaaggggcacctcttgaggaggcatggcccctggagccagtgagagggcaggggtgtcccctggtcctgctcccgtctttccaacctgggtggggtgtctttcagccatctgtgaggggccggacgcctgccagaaagacgaggtgtgtgtgaagccgggcctctgtcgatgcaagcctggattctttggggcccactgcagctcccgtgagtctcaagggccagatgaagttgctgggcagagctgggtacgggggcagtggtgtgggagcaggcgaggcaggtagccatgcagcctcaggacagcagggccagaatcccccccagcttcactgaggaattgcggtccagagacaggaagtgacacacactcccgggagatgacctgagtcaccgggtttttacccacatcc

SEQ ID NO: 13484 - DNA, 67858 bp, Homo sapiens
  misc_feature (1)...(67858): n = A,T,C or G, or insertion/deletion polymorphism (see Tables 1-2)
gaagatggaacagcatacacaaaggcccagaggtgagagggatgtggctgtgtgccattgaaagagttttagcttggtaagagtgtgacagtatttcaaagtagggagaggtggtgagaaaagagtatagagaccaggtgtggtgactcacacctgtgatcccagcactttgggaggctgaggcgggaggactgcttgaggccaggggtttgataccagcctggccaacatagtgagaccccatctctacaattaaaaaaaaaaaaaaaagagtgtagaagtaacagtgtctacctgaattggtccttctgccactctcctcatccttgccctcttccttgccctatttttgaggcctcctggaagatgctgagctgtgggtaggatgcattggggtggccagttcagctccagccaagctcttctgtctcctctgccagggatggtccctgtggcccaggcagggtcgtcagaggccagcctggctgcaggtgctttccygccccctgaggacgcctccacgccattcgccatcccgcgcacctccagcctagctcgggccaagcggccatcggtctccttcgcrgaaggtaccaagtttgcaccacagagtcgccgaagctcaggggagctctccmgcccgctccgaaagcccaagargctctcccggggggcgcagtcgrgtcctgagggccgggaagccgaagagtccacaggcccagasgaagcagaagcccccgagtcctttccggcggctgccagtcccggggattcagccactggccaccggyggcccccacttggtrgccggacagtggctgagcacgtggaagccattgagggcagcgtccaggagagctcgggccctgtgaccacgatctacatgctggcagggaagccccgcggatccgaaggccctgtccgctctgtcttccgccattttggtagcttccagaaaggccaggcggaagccaaggtcaagagggccatccctaagcctccgcgccaggccctgaatcggaaaaagggcagccctggccttgcctctgkctctgtcggccagagccccaactcagccccaaaagctgggcttcctggggccacagggcctatggcagtcagaccagaggaagcggtccgggggctgggggctggcaccgagagttcaaggagagcccaggagccagtmtctggctgtggctccccagaacaggatccccagaagcaggctgaagaggaaargcaggaggaacctgagtatgagaatgttgtacccatctccaggccaccagaaccctgatgaccttgaatttggggagtggggagagtggatggactagactgtgctgtgtgctggaaaatgatcccggggccaggacagacaaaccagagcctctgcgcctccacagggaaaaggcaaggcttccaggccagttggcccaggcccctggcagtgctcccggaggggcccaggaaggcctgggcagagaccctgtaggatggggtcaggaagggttgcctgcagggacttttgctctgctgtcctggaccctgtgtgcctcataagggctattctttctttcacgtgcaaaacatttttctgaaatagcaaacaacctacatgtttgctgataaaagattggctaaacaaawttttttttttttttttgagacagaatctccctctgtcccccaggctggagtgcagtggtgcgatctcggctcactgcaagctctgcctcccgggttcacgcccttctcctgcctcagcctcccgagtagctgggactacaggtgccctccaccacgcttggctaatttttttgtatatttaatagagacagggtttcaccatgttagccaggatggtctcgatctcctgacctcgtgatccacctgcctcggcctcccaaagtgctgggatgacaggcatgagccaccacgcctggtctatgaactttttaaaaaggatgtatgtgtataaaaacagattcaagggaaaggcactaaatggttttttcctctggaagatgagattgtaggtgatatttattttcttctgaaacttttgtatagtttgcaaattttctacagtgaacattcttttttacttttgttactagattgaatttgataaagtataataaaaagcaatgatctttgttaaaaaaataaaaagtactaacattacagacatgtataaagtaaaacggagatttcctttctccccagaggcgtctgtgggtcaagagagaggtagaatctacttttccytggcagctttttggtcttgtttgaattctttgctcacatattacctagtcagaaaagaaaaggggcaaccctccccccgagctttatttttttttttttaagatggagtctcagtctgtcacccaggccggagtgcagtggtatgatctcggctcactgccacctctgtctccccggttcaagcgattctcctgyctcagcctcctgagtggctgggattacaagcgcccgccaccatgcccggctaatttttgtattttttggtggagacagggtttcaccatgttggccaggctggtcttgaactcccaaactcaagggctccacagcttcggcctcccagagtgttgggattataggcatgagccaccgcgcccggccaggggcagccccttctatctcagtgctcagagagtctcatcaacagttgaggtgctttctttcagatgtttttctgtgtacatgtcaacaaatattttaaacaaaaaattttagcatactaagcatactgttcctcagcttcttttttttyttttttttttctttttgagacgaagttttgctctgttgcccaggctggagtgcagtggtgcaatctcagctcactgcaacctctgcctcccgggttcaagcgattctcctgcctcagcctsctgagtagctgcaattacaggtgtgtgccaccacacccagctaatttttgtattagtagagatggggtttcaccatgttggccaggctgttctcsaactcctgacccgcctyggtctcccgaagtgctgggattacaagcgtgagccaccgcggccagcctcaacttgcttttttacttaacgacatatcctggatatagttcaatgtccataaatgtaaagctaactctctttatttaaaaaatgactacatgagattccatstagcacaattatttaaatcattcccccgccaatggaaggttgggttgttctgatctgttttgatacaataagcaatgacatagtatacaactttgtccatatttatttatttatttattttttgagatggagtttcactcttgttgcccaggctggagtgcaatggcacgatctcagctcactgcaacctcggcctcctaggttcaagcgattctcctgcctcagcctctcgagtagccgggactacaggcgcatgccaccacgtgcagctaatttttttgcatttttagtagagatggagttttgccatgttggccaggttgctctcgaactcctgacctcagaagatcttcccaccttggcctcctaaagtgccgagattacaggtgtgagccactgtgcccagccactaaagcttctaaaaagtatatataatttttgtgtgtgtgtttagccatcaacaattatatctcattacaatttaaagttctatgagtattctaaggttgtttcttttccgtcttggctcactgcaacctccgcctcccaggttcaagccattcttgtgcctcagcctcctgagtagctggaattacaggcgcccaccaccatgcccagctaatttttgtactttttgtagagatggggttttgccatgttggccaggctggtctcgaactcctgacctcaggtgatccacccacctcagcctcccaaagtgctgggattccaggtgtgagccaccgcacctggccatttgccccttttcaggagttcatgttttcattccacaaactcatattgtgcaactgctttgtgcttgcttctctatcaagggctggtcatacaaagttgaataagacaccgtcctgcccccaaagagttcatagtcaattagagaggaaggcaaacagacgaatagctaattataaaacaatgccagcagtggacaaataaagtgaacagtattaatggggagtggttagggaaggcttcccagcggaggtgcygtccaamatgaggctatgtcgygagctagaggagagagaacagcaggtgcagaaaccacaggcaattccatgtgactggagcatcggggaccaggcaggtcagatgtccttcagagggagggagagggaggagcctgtgtgggtcaaattggggaactggaacttttaaattttgtttatttttttgagacggagtctcgctttgttgcccaggctggagtacagtggcacaatctctgctcaccgcaacctctgcctccccagctcaagcaattctcctgcctcagcctcccaggtagctgggattacaggcgtgtgccacatcacccagatcttttttttttttttttcttttcagacaaagtttcgctcttgttgcccaggctggagtgcagtggcacgatctcggctcacttcaacttccgcctcccaggttcaagtgattctcctgcctcagcctccagagtagccgggattacaggtgtgcgccaccacacccagctaattttttgtttctttagtagagacagggtttcaccatcttggccagactggtatcgtactcctgatcttgtgatctgcccacctcggcctcccaaagtgctgggattacaggcgtgagccaccgcgcccagccatttttgtatttttagtagagacagggtttcaccatgttggccaggctggtctttaactcctgacctcaagtgatctgcccgcctcagcctcccgaagtgctggtattacaggtgtgagccaccgtgcccagccaggaactggaactttatcctgttttacaaataatagtttctgaaggattttggcagaagtcacatttacatttcccttagtgccctgggatgagatgggggctggatttgaggaacygaaatctgaaggtggctcaacaacagtagttgcgggcctaagggcacagatggaccgattaggtaaatatgtaggagatacagctgtatcagtttgatggggatgcggtgagggagaggcagaatcacagcgactgcctaacaaatgtctgatgaaaggatggttctcagcagggcactgtgagtcatgcctgtaatccctgcactttgggaggctgaggtgggaggatcacttgagcccaagacttcaagaccagcctgggcaacagggcaagaccctatctgtacaaaaaatacaaaaattagccaagtgtggtagcatgcacctgtggtcccagctacttgggaggctgaggcaggaggatcacctaagcccaggaggtcgaggctgcagtgagctatgatcatgccaccacactccagcagtctgggtgcctgagatcctgtctcaaaaaaaaaaaaaaaaraaaaagaaaaagaaaaaagacagggttcttggtatctaacttcagtagacagtagtagtatggttatctgagagaaaatgtggaggacagttctgggggatatttgaggcatgtttgagccctgcagcgccgtcaggctgctcaaagaggagggaagggtgaagaaagagatttttcagatggcagttgaaaccttgggagtgggaagggttccacagggtgaggaaccgggtaggctaccagctggagccgccccccagcrggctgacagctccaagcgttgtctgggggaggttgccctcgccaggtggcccgggcggattstagacagtagggggcacactcggactggggcaggtggagcaagaggcgtttggggctcccacagccctggggtggtggtggggttttatttttggtttttattttggtagagatggttctcgccatgctgcccaggctggtctcaaactcctgtccccaagtggccctccgaccttagcctcccaaaccgctgggattccagacgtggacaccgcgcggcagccctggggtgctaagccagccccccggagcgagccagggtgaccaaggcgattctggggcagtcagagggtcttcccgggtcgggttagtgcctcgaatccgggggacgaagacggggagctgagctttcggagcccgggcttatcagacggggacccggagccccctcgaaccctccctagcttgtaccagctggcggacgtggcccgtagcatcgccctgcagaggggaccttccctgaaagggacggggaacggggtgaaggtggccagcgcgggcagggagcacccagatgacgatcaagggtggagggtccccggaggaccgagcagtgcgtgaacacgggcggagaaaggtcagtctgatggggggagctcaggagaccccatcctaggacgggacagaccagccccaaatccccttgcagatttccaagggccaacttccagggaccgggcagacgccaccggggagaggggaaggggtcggtgcatcagcggggggcgccacggctggaccgggtccgggatcccaggccccgaatacgccgggacgggaaccaccggggcgggggagcgaggaaccaggacccaaagcccgaggcggcggggacggcggcgctgcgtggggaggaggcggggtggggattcgagagtggaaccaccgtgcggagccggcgcatctgggcgtggtgacccgcgcgcagggggcagctggggacggcggggcggccgcgggagagcccggctgggggcgctggtggcccggcggcttctggggggagtccgctgggggccgggacgcggagccggagccccagcctcgcagggtcaggccgctggagaggccgcggggcgatgtcgccggggattcccggccgcgctgtgactcgggttgaaggctgcaaagccgaggcccggcccgcagcgcccaggcccctcccgtcccccatctctcttgtttgtctccgagtccggccggaaccggcttctgctcgcggcggggcgggcggggggctggctgctgattggtcgacgcctgtttccagccccgctcagccaatcagcgggcggcagtgttttcttcttggggtcggaataaaagggctggaataaaagagggcagaaaaggcgccgggcgggcccgacacacgccggaggagccgggtgagctgcagcagggaggggatcgcggccggggcgagggcgcgggggcagaagcggccgccgaaggggcgtagggagaaaacgtgggaacaagaggagagagatggagcgatgagrggccgccagggaagagatgacgaacagatgcgggctggggaatggaggcgcgggggtccgaggccatggaaacgggcgagttgccgggggaacgcccgagatgggggtcgcgcggctggctcgcgccrccggtttgaaccggctcctcgtctcccacgctgggttcgcgtggccgcagcgcctagcgacctagacggcggccaatggcgcggcagttcctgcgccgtccggccaatgagcgcgccggggcgggccgttccgtaggtctgggcgctgatcttgtggttgaagaaaccagctctggggaagggtctcgggcgcgggcgggagggcacctgtcagggtcccygggagaggcagccctcggatctgccsctgcccacctcacgctgcgttccatgctggccccakgcgatgtcagtcctgctgcaggccaggactagttccacggccctgagcatgcgttagccccttcttgcctccatgcctcagtttacctcggagtgagctgcgggagacgtctccctgcctggccggggcggctctgtcgtagcggagggcagcggtacgagccggccgcgggctcggggtgtcccaggtccgggcagggctggggttcgcttcctctgctgcgcgcaccggccgccgcggccggggaggggtggcaatcccgagccctgcggcagcggtcggggctgctgggggcggccgcaggggctgggcaagggccggccgctgacgccgagttctgtgcgcaggtggtgcagagccggagccggagccggagcygcgccgcgccgcaccatggcgcccaccctggccactgcccatcggcgccgctggtggatggcctgcacggccgtgctggagaacctcctcttctcggcagtcctcctgggctggggctcgctgctcatcatgctcaagtcagagggcttttactcctacctgtgtaccgagccaggtgagacaagcgcctggggttgcgggggggctcctggagctggggctttgggagggggcgggatgggggcgaagacctagcgagccacagcaccgcattgcccagtgcctctmgggtatcagaaggcccatctgatcctcacccagccctgccgggtacttgtcattgcccctgttttgtggacgaagacatcgaggctcagagcgatctgtcttgcgcaaggccgcagagcctgggcctgccatccacccagaaccccacctgctgtccagggtgttccttccacccgctacgaacaktgctggactgctctcctctcctcccagccctggaacatagcttggctggtagtaaacatgttgctgtctgcttgtgagaaagaggaactccagattaaggggctggggtgcagcaggagaggaagtggccttgcctccaccccagggagggctcatctagaatctagacgttcctcaggccattgtggagtctcctaagtgcttgctggacacaatttcttgtctatttttgctgccttatgattctccaaaggacatttcccccacgggctctgaggacatctccgtggctttccaaccccatggggatgaaggggaagagaagaaaggaacgtttatggaaatgatgctagggttgttctctcctctttgccttgtcactggaattgctgaaggcaggctgaggatgcttctctacatgacatctgcaccacccaacrcacacttaccttcacaccttcataccctgttggagggtcctgatgactacagggcagtaaattcagccccacaggagggccacagcagcccccagcctctagcctcctaccctccttcttaggcaaccttgacaggaaattttccctctgccttctccttgatcccaacggtagctgcataatagctgagctcacataatccctgtcgccagtgctagagtgcccttagatggaggtagcccaggtttgacttcctgaatccccagcagcaggccttttctttctagagctctttgcaggaagagaaagctttggaccagctcatgctgggtgtaatcctttgtggaagcctccctgtttcccttctctgatctgccccggagattcctgtgtgtcccagtctctagggagggaggcttagctggagaggttcagggcaggagaaagcaggagaatgcagaggccgcggggagaggacagaaagtatatcatttataactaacctttagcctttagccactcaaaaatatttcctaatagcctaagggttcttggcaggtctttccccacatcagcaagaaatcttgggagttgggaagagtcagaccttgttccctgaacaagctttmtgctttggccaagagttgttaggagattaatgcctgtcccygaaaggcacaggttggagtgtttacttcttcctctcctttcctctctccyccsttagagatcgtgacccttcctgcttgcytccctggtgggctctttcaggctggacacagggtttaaaaaaaaaaaaaaaaaagcagaaaaaaagtcatcgtccccagagaaagcttttagtgtctcacccagaccagagaactgttgtgggcaggtgtttttttgtgtgttttttttttaacccaccatgatgtcggaaggtcagattctaggtgttttttgtttgttttttgttttttgttttttttttaatagaatgtccacggatttaattgattgtatggttttggcagaattgggtctggtcctttcattcctgcctcaacctcagcttcctcctctgtctaagtgggaggagtcccagagattgtgccagcgcagtgctgagttggtgttttaagccctgggcagacttgacaggtaactccactaaaccaaagtgaaggtgaagggtcaggattgtgggttgaacatcaacttcttatcccgaacttttgctcctgcctccaattttggtttttcttattatctggcaaacatgctgagcccacgttctgggcgggaaggctgctgattccacacagcttatctctctggtcacactgctccttgattcttggagtctgcatcaccagttttctttcaggccagaaatccccgcatttggctcgtctgggagtgcctggcgaagttagggtgaaggtttctgcttcagtctaacattttcaaacttggtgcatggctgaattgcagagaagcagataggccatttttgaatttattgaattagacttgtgaaagcctgagcagtgtccggctgattgagatgcaaatttgtcagcttcgtgtcactctaggacgatgctttagtttgttctctaaagaaaatttgcctgaacctgttgaaaggttcttagaactctttcttacgactccagccagaatctcgccacagacaccgtgttgggttccagcctggtgaggtggcagaaggaaggaaacagctcatttctcggctgccccgcagtttgttcttccttgcctgctgggagacgtggcaggctgggtttggggacctgggtgcgggaagttggcaatgggttttgcacaacgtcctccaggtgttggctgctggatgcctccctcgtccccctggtgagggcaggagaccagttgggttctcagcccgagaagcacggggcttcctggagctgtgtcctcttggcctctgggatggcaacgtgacggcccactcctgagctctttcttcrttttctctgttgtccagtggcccccgcttcaacagggtcagggtcagcctggggggctgcggctacctgtggatggtttttttttatttgagacagggtctcgctctgttgcccagtctggaatgtagtgttgcaatcacagctcactgcggccttgactcctgggctcaagcaatcctcccgcctcagcctcccgagtagcagtagctgggactacaagtgtgcgccaccatactcagctaatttttgtattttttgtagagacagggtctcgccatgttgcctaggctggtctcaaactcctgggctcaagcgatcctcctgcctcagccttccaaagtgctgggcctgcaagcatgagccatcaaacccagttagttttttgtttttgtttttgggattacaggtgcccaccaccacgcccggctaatttttgtattttttagtagagatgtggttttaccatgttggcctggctggtctcgaactcctgacctcaggtgatccacccgccttggcctcccaaagcactgggattacaggtgtgagccaccacgcccggtcaaattttttgtagagatgagggtttcatcacgttgctcaggctggtctcaaaactcctgggctcaagtgatccaccagcctcagcctcccaaagtgctgggactacaggtgtaagccaccatacccagttaatttttaaatgttttgtagagataggggtttcaccatgttgcccaggctggtcttgaactcctgggctcagtcgatccacccacctcgggctcccacattgctgggattataggcgtgagccaccgctccaggcctacatgtggatcgttaatcccctctttcttgtaacctaaacattcagtaaacattgacgaaggtgcmgtgctgggtgcagaggaaacaagtcatcacacgcatacctgtgtaacccgtataattccagggggtggtcgggcccccaagaaagcagggcgccaggagctagaacagcagcggagatgtggctcctgctgggtgggagggcctctctgcggttcaggtggaagcctggaggttgaggaggggtgattcaggagaggagggyacaccctggaggagaggagggtacaccctggaggagaggagggtacagcctggaggagaggagggtacaccctggaggagrggagggtacagcctggaggagaggagggtacagcctggaggagaggagggtacaccctggaggagaggagggtacagcctggaggagaggagggtacagcctggaggagaggaggatacgccctggaggagaggagggtacgccctggaggagaggagggtacagsctggaggagaggagggtacaccctggaggagaggagagaagtgggaaggggcgggggctgcagggactgggaggccattcggggaaactgaattttattcccaagacaggaggaagccagggagatagaggagggcgaccatccaattcccctgttagaggcttgtgtgaattgctgagggcttgccacatgctggtatgtttgggtggcatagaaaccagaagtcatcacggcctctgcctgaggaagtcacccacagtctgaccatgggcatgaaggccgaccccagttgtatgctcttgacctctgcagtttctccrcctgtggtggtgggagagagcctctcaccctggcacagaggtccctgcgagctcgccctggcacagagatcgctgcaagggcagaggggctgccgcccaccttggggaagcaggcccaggcttgatccccacgggctgagtgaagctgcagatgtggacaggagatttctctgctgcctcgaggacctcttttcttgggggatggggaggagggaacggagtttcactcttgtcgcccaggctggagtgcagtggcgcagtctcggctcrctgtaacctctgcctctcgggttaaagcgattttcctgcctcagcctcccaagtagctgggattacaggcgcctgccaccatacccrgctaattttttgtatttgtatttgtattttattttattttatttttttgagatggagtttcactctgtcgcccaggctggagtacaatggcatgatctcagctcaccgcaaactccatctcccgggttaaagtgattctcctgcctcagcctcccaaatagctgggattacaggtgcccaccaccacacccggctaatttttgtatttttagtagagacagggtttcaccatgttggccaggctggtctcaaactcctgacctcaggtgatctaccagccttggcctcccaaagtgctgggattacaggcgtgagccactgcgcccagctcaagggcctctctttttagagtctctcctcacacccacaggcaagtgtggatagtttttttttttttgagacagagtcttgctctgtcgcccaggctggagtgcagtggcgcgatctcggctcaccgcaacctccgcctcccgggttcacgccattctcctgcctcagcctccccagtagctgggactgcaggcgcccgccaccacgcctggctaaatttttttgtatttttagtagagacggggtttcaccgtgttagccacgatggtcttgatctcctgacctcgtgatccacccgcctcggcctcccacaatgctgggattacaggcgtgagccaccgcgcccagccggatagctttcttaaatccagcctttcacttttattgctataaatatgacttttaaacttttcccccagtttatttggaattttaaaaattccatagcaatgggtaagaaggtttaaaggctggggccggcagcctcaggatgcgtctcagagaagagctggtggccttggctcttcccacygccccagcctccctccttcttggttcgtgacctcatttccctcacagacatccactggccacccctggcttctggtgtccatgaaggtcctgtccagcttaggctggctctcagggacctcgtgggagagtcttagtcccattcccaccaagcgatattcagggcctcctggtgttgccggcacatgggcagccttttcccggctctgttctctcagcattttctctctgggatatgagcctctagcccaggtaggccagcatcggcacagaccgagtggtaagagcgggagctttggggtctgacagcctggagtcaagcccagcttccccagggacccccatgagaccttctgcaagtgacttacctgctctgagcatccctcggggacactctgacagtatcctcgtggggaatatggggtgggcgtgggcacacccgttgagcatggcagctggcacacactttcattgcacacacggcagccgctgctgggaccactgctcrggggccaggccctggtcagcccaggacggcctctgcctgtccgtgccctcctgcctgttgtttgctctgtgtctgagccgacctctcacctacatctcccctgccggactgaggactgagatgctgcttcctgttgccggatagactaaggatttgagagacgggagatcctgggcaggggccatcggtgggctgtccaggggcccgcaccctggagggggggctcggaaagcgactagtcagggaagggggcagctcaggaatttagaggggacctcaagccaggtacttcttggccccctcaagcatcatcttggaggcccccctccctttgtctccccggggtgtggggaggctcctctttgcctcaggggagcctggggggccacagcaccctcttttctccctgattcctctgtaaagatcttgtgcgtcttctgtgagtggggctgaacggtgtacgtcctccctggccctgggtctcctcctaagcagccctgttcctgttcttggcactcactggccacaccaactcttgcctgtcttctcagttcaccttctctggccaggctgggctgggccacttctggccaccccagaggaggcatctgtttaataaacaggtgcaggtgaggagcagagcagcctggccgggggtgagcagagcaggctggcccggggtcaagctccaggctgggagcagagggccaccccacgccttggcacttcctgggtgcttaatctgtttgtctctctcctgacccacggtggcccaggtgggascagagggagaggaacagcctgggtgtgtctgtttgggcatctgctgggtgcatgtgggctgtttactgtcaacagagcttctgggctcaccaagggcttccttccctccagcaggagggagactctcaaattgctccacaagcagaaggagaagccgctcacctccccggccccaggcgcctctgttgctggacgggacggcctggaggcaggcggccgggcagagggcctggtggccccatcggcagggatttgtttaagacgagaaggctgttggcctacgtgcaaggtccctgcccctgtgtgtagtcgctccagggtaaaagatgggaaggacagatacccttgcctctaccctgaccttgcctcttccctatgtggttaaaggggtgaccagatctctaatcaatttaagacttttgtttgtttgtttgtgtgtttggagacagagtctcactctgtggcccaggctggagtgcagtggcacaatctcggctcactgcaacctctgcctcctgggttcaagcgattctcctgcctcagcctccaaagtagttggggtyacgggtacctgccaccaagcctggctaaatttttttgtatttgtagtagagatggggtttcaccatgttggccaggctggtctcaaactcctgacctcaagtggtccgcctgcctcggcctcccaaagtgctgggattacaggcgtgagccaccgtgcctggcctagccttgggatttttatcttctggctctagatgagaaaacccatgggtttagagacccagctgtggttcctccctggggtaactggaggtccctggtgcctttactcaggcagtgctgcytcacccactccattccttgtccccgtggctcctgcttgcagcagtagaacstgcagccccccaagccctcagttattccacggcccctgtgcagtcactgkccccacaagtcacccatcctgggccctggcgtgctctctccatccatcctctctgtcacctctgtgctggtttgctcctatctgcatgtcaacctggaaatggctgttgctttktagagaccctctttccctgacttcagagccaattcctttgctgctggcagagctgacatttgaaaccaacaccaactcacaaagcagctcctcctttccagaagctgccccactgtggatgggcgmgtggcccaggcctgtcggctgtggcggtgtacatgacygctctgagctccaccctgacgggctcgaggaccccgtctgccatgtgtttggctgaccgtgtggtagagcttctttttggaaaaccgagagaaagtggccgaggtgggaatctggttggtgacgttgtatttctgtggctccacatggttaacctcgtggctctgatctccttaaatcccccctcgattcaacgtggttctgttgattcctctctcgatctttttggccattgtgatctggtgccattgtttttgttttgttttgttctgttttgtttttcgagacggggtctcactctgttgcccaggctggagtgcagtggtgtgatctcagcttaccacaacctccgcctcccggcttcaagcaattctcctgtctcagcctcccgagtagctgtgattatagacgcccaccatgcccggctaatttttgtatttttagtagagatggggtttcaccatattggccaggctggtcttgaactcctggccttaggtgatccacccaccttggcctcccgaagggctgggattacagactgagccactgtacccggcctgattctrtttgtttgtttgtttgttttttgttttttttgagacagagtctaactatttgcccaggctggagtgcagtggtgtgtgatcttggctcactgcagcctccgtttaccgggttcaatgattctcttgcctcagcctcctgagtagctgggattacaggcatgcgccaccatgcctggctaatttttgaatttttagtagagacggggcttcaccatgttggccaggctggtcttgaactcctgacctcgggcgatccacccgcctctgcctcccaaagtgctgggattacaggcatgagccgccacacctggccctgttgtttttatttattcagtaaacagctattgtaggccaagacctgggtgagatactggggacacagaagtgamcacagtgcaggccctgcccttcggggctcacagcccagtgggggattagacatgtctttgcgcttccacacacgctgacgggactgtgctccccacagccactgcatccggctctgtgccagctgatggtgccgtgattccccgccggagcctccaatagcagcaatgatcatgataaccacgagaacagcagcaacttgtagctattcattattgagtgctttctatgcctgggtgagctccagaaggttttctgaatttttctcattgatcttcccccacactctaggaggtggatcttatcattatatgatgtccatgttatggacaaggaaactgagctagagcaaggtcatgcaggtagaaagtggagaawcaaacactggaagctagaaaccagattccagttccacgctcttcatccacacggccccggcggggctccttggccacacgttggcatgaagcacgagtccacctgtgcgcatcctttccagtaaccttggaggaaccccgagaggcctgagcaagcttttgcaaacctcggcgctacagccctggcgccagagggctgcaattggaaggcaggcagttaccggaagaagagcgtttccttgactctcccagcgtgacctcatgtctaatcaaagtcggctcctgttttctgcaggattagtcagcatctcttaactagcagtcccggccaggagagctcctcagccacgttcccagcccgtcctccaccctcccatcttcagctgccacagcacttttctcttcctttctgtgttgttttggtgctgggtggactttgaagggggccattaagggctgggtgtggcaaacacaccagactcagcacccagcgaggtctaggcatggccacgggatggcaccactgtgaccccggcaaggaaaataagaaaggtgcatatcggctgggtgtggcggctcacgcctgtgatcccagcactttgggaggcagaggtgagaggatcacctgaggtcaggagttcgagaccagcctgggcaacatgatgaaaccccatctttactaaaaatacaaacactagccgggcgcggtggcaggtgcctgtaatcccagctactcgggaggctgaggcaggagaattgcttgaacccgggaggcggaggttgcagtgagccgagatcgtgctactgcactccagcctgggcaacagagtgagactccgcctcaaaaaaaaaaagaaaaagaaaatatcagggggagaaggtggcatctgttctatgtttgagaaggcagctggacttcccattgaaggaggcgccgcaktctccccacatggacagaggagaaccaggctattggggtgagaccagtgcttgtgcttcccaagtggtctgggttctgcctccatactggctgcagtctgtccccacggacatagctgccgtgagaaggttctcaccagcctggggccccacagccaaggctgggccctgaggtctgccgttctagggtggcggatgctctcgaatgggactctcagcctgggcttcgttgctcttcaagggacacacaaagctcctgaaactgtggataaaccttggtgtgcattttctggggaggtctttattggatttttcaaagggtccatggcccccacaaaagttaagaacctctacattttcactccagggkacttgggccaaatggccatccaagcctgctgcggggtagcctgagccctcgagaggccgccagccagccctggcattcccagtggggggaytctgaaygggcacctgcccttctgatctttgggaatccctgtcatgaccctgaggtcagggtttccttccctcttcacacagagaatgtcaccaatggcacagtgggcggcacagcagagccggggcacgaggaggtgagctggatgaacggctggctcagctgccaggcccaggacgagatgctaaatttggccttcactgtgggctcctttctgctcagtgccatcaccctgcccctgggtatcgtcatggacaagtatggcccgaggaagctcaggctgctgggcaggtcagtgtgggtcccttagggggcagggagtgggcaggtggacccyctgggctgagttccccacagaagggtatcctggtygtacctgatatcaggtgtactgtggagctccctgaaggccctccagaatggagttcctaccccgtccgccaccgaatcagcaggtactgtggtcctcgccgtgctccagtacygaataagaaaagctccaggctccaggccgcccagggaccggagctgcttgtcactaagaacatgtgtttcccatccctttgtagttcataagcatgataattggggtttccctcgcatgtgtgagacatgcttccctcaaaccttgttacgaagctggcacagtatccatctgatgagaaaaaaaaccaacaacactggtttccacagcccgtttgaccttatagctccaccagaaaaaagattttcaacacgtacccccaatataataagcacatggaattataaatgatgtatatctgtgctctttttttttttttttttttcaagacggagtcttgctgtgtcgcccaggctggagtgcagtggcgtgatctcggctcacggcaacctctgcctccccagttcaagcaattctcctgtctcaccctcccgagtagctgggattacaggcgcctgccaccacacccagctaatttttatatttttcatatttatttatttatttatttatttatttatttatttatttattgagatggagtctccctctgtcgcccaggctrgagtgcagyggcgcgatctcggctcactgcragctccgcctcccgggttcacgctattctcctgcctcagcctcccgagtagctgggaccacaggcgccygccaccacgcccggctaattttttgtatttttagtagagacggggtttcactgtgttagccaggatggtctcgatctcctgaccttgtgatcygcccgcctcggcctcccaaagtgctgggattacaggcgtgagccatcgtgcctggcccctatgccattcttttttttttttttttccttttgagttggagttttgctgttgttgcccaagcaactggagctggagtgcagtggctcccggccccctatgccattcttaatgtgctttataatacatatacaaaaatataaatgaaaatgggctgggcacggtggcttacactggtaatcccagctttttgggaggcagagttgggtgggtcacctgaggccaggagttcgagaccagcctggccaacatggtgaaaccctgtctccactaaaaataraaaaattagccacgcgtggtggtgggcgcctgtaatatcccagctacttgggaggctgaggcaggagaaatgcttgaacctgggaggcggaggttgcagtgagccgagatcgcgccactgcactccagcccgggtgacagagcaaggctctgtctcaagaaaaaccaaaaaccaaaaacaaaaacaaaacaataacactgaataaagtcataatggtaaataacattgcgtttctgcttggttttagcgcctgcttcgcggtttcctgcttgctgattgcgtacggagcaagtaaaccaaacggtgagtgtcctctccctccatcttctgtcagggaccggggagagagtgccctgagctgctcccaggcccacctgctcttggacactgtcctgggcctgctgctccctgctcaagttagaggggacacctgttacgcctctactcagttacttatctcaaatagacggcgagatcagagagcagccaccccagacaggagcttccagggtatgagcaacttccatctcatcaccaaaccaagcyagtccctcactgatgccaacctgagaggcaagttctaagaaccaggccggctgcaggggcatggtcatcggtgtgtgcagaagtcacaagctgagtcccctccaggcagcacaggycaaagcatgaaggatggcttagaagccacctggtccccaaccctgttcaaggatttgtagagcaaacaccaaaagaggactcgagtttcaccaaaatcttagccaggctcatctactgattttcaggaacctgtatttttggtttcagtgaagtagcttccttaggcctcctgctcgctgctgtttgtttttttgttgttgttgttttgttttgttttgttttgttttgttttagagacagggtctctctctgtcaccctggctggagtgcagtggtgcagtcacagcttacwgcaccctggacctcccaggctcaagcgatcgtcccacttcagcctccagagtagctgggactacaggcacgcacacacacagctagctaatttttttkttgttgttgttgagacagagtctccctctgtcgcccgggctggagtgcaatggcgcaatctcagctcactgcaacctccacctcccgggttcacgccattctcctgcctcagcctcctgtgtagttgggaccacgggcacccgccaccacgcctggctaattttttgtatttttattagagatggggtttcactgtgttaaccaggatggtcttgatctcctgacctcgtgatccacctgcctcagcctcccaaagtgctgggattacaggcgtgagccaccgygcctggcttcacctggctaatttttaacttttttttagaaatggggtctcactttgttgcccaggctggtcttgaacccctgggctcaagcaattctcctgcttcagcctcccaaagtgttgggattctaggtgtgagtcactgcgcctggacactgctaatattaattggagaaaagaagatgggtgtgcagctttttcaagagcccacgctttgtgaaataggcaagaggaggctgggcatggtggcttatgcctgtaatcttagcgctttgggaggctgagatcggcagatcacccgaggccaggagttcgagaccagcctggccaacatggcaagacatacaaaaattagccgggtgtggtggcgcatgcctgtaatcccggctacttgggaggctgaggcaggaggatcacttgaacccgggagtcagaggttgcagtgagccaggatcgtgccattgcactccagcctgggtgacaagagcaaaactacgtctcgattaaaaaagaaaaagaaataggcctagaggagggggtgagaaaggggcagttccactccccagatgtcaggtactaaccccggcctgcgtttactggatttactgggagcctgcaccgcgcaggactctgggctggtccyggcttccctggagctcagctggggtctccactcacgagctttccatgtccctgcagctctctccgtgctcatcttcatcgccctggctctgaatggctttggtgggatgtgtatgaccttcacctcattaacagtgagtacrgattttttaaagctctgtagttcagtaatctgtttctaaatttgaggccgctttgattggtttctgtttccttgccttccatgtgcctgcatgtgmctgggtgtcccaaacagtagaggggctatgggcgaggtggcctggcagggcctcctcagctgaggtccacaggcagcagggcgtggcttcacaatcccttgcctttttttttttttytgagacggagtcttgctctgtcgcccaggctggagtgcagtggggggatctcggctcactgcaacctccgcgtcccaggttcaagcgattctcctgcctcagcctcccgagtagctgggactatgggcgtgcgccaccacacccggctaatttttgtatttttagtacacatggggtttcgccatgttggtcaggctggtctcaaactcctgacctcaggtgatccacccgccttggcctcccaaagcgctggggtgacaggcgtgagccacctggcctggccgacattccctgccttctgatctgggctttgatgctgcggaagcagctcactagccttgtgcccaaggaaggcagaggcaggaagacaaaacrctgccgcccactttcttttcctgttttcctcggcagctgtcatcagggtctccgggagcttcggctcatggagcagcctgaccacccgcctcccgtggaactgcctcaacctttgcctttgtccggagccagatggaaaatgcagggaacatctggtcttctgctcctcttgtttcctccgtgcccgggcacagacagtcgcctgggggagatgttttctcggggtactaarcacccccttgttgggagccccaggacatcacaaaatatgctccttcttgatgtcagggaggcagaaggaagatggggttgaaagaaagaaagtcaaaaaaggggctgggcatggtggctcacacctgaaatcccagcactttgggagactgaggcaggcggatcacttgaggtcaggagtttgagaccagcctggccaacatggtgaaaccccgtctctactaaaaaatacaaaaattagccgggcgggtggtgcatgcctgtaatcccagctactcggaggctgaggcgggagaattgctggaacctgggaggcggaggttgccgtgagccaagatcaagccactgcactccagcctgggcgacagagccagactctgtctcaaaaacaacaacaaaaaagaaagtcaaaagaggaaccaaaaagtctctcccagagggaagaagggaactctctgtgggctcgcccagttgggcaatygtgccattccgagctggccattgggaaagaagtgagaataatagcttcttcagagaggcttctgtccatcaaggaaacctcgcctgcatcagtttaccggtgaaaaagtttctaagacacagtacctaccattactatttgtggtacactctggtttctgatttcccttgtcgtgccattgaagggttcttgtttagctttgagggagctctgggggcttctggacctcttcttttttcctttttcttttttttttttttgagtctgctcggttgcccaggctggagtgcagtgacgcaatcttggctcactgcaacctccgcctcccgggttcaggcaattctcctacctcagcctcccgagtagttgggactataggcgtgcaccatcacgcctcrctaatttttgtatttttagtagagacggggtttcaccatgttggccaggctggtctcatacccctgatctcarccaatctgcccgcctcagcctcccaaagygctgggatgacaggcgtgagccacggcgctcggccgaaaaccagcagctctttcatcagcatgaaaactaaaaacctggcctcacctccrttattttagtcacgcgacgcctctgtcacggcaggcctgaatttcagggataaaggaacgagatggtccttgagcttgaggacctcacaccccgaaatgccgagaggtgttttgtctgaaaaacgaccaagaatccctgttaagaaagactttaggccgggtgcggtggctcacacctgtaatcccagcactccgggaggccgatgggggtggtggatcatgaggtcaggagttcgagaccagcctggcccaagatagtgaaacccmgtctctactaaaatatacaaaaattagctgggcacagtggtgggtccctggaatcccagctacttgggaggctgaggcaggagaatcgcttgaggccgggaggcggagtttgcagtgagccgagatcgcgccactgaactccagcctgggtgacaagatcaagactccccctcaaaaaaaaaaaaaggaaaaaaagaaagactttaaaagggaccctgcggttggagctaataggccagtaagaattctttgtctttttttatgttttataattataaaacaaaatttttttcattacattttttattttcattttttacagatggggtcttactatgttgaccaggctggtctcaaactcctgggctcaacagatcctcccaccttgacctcccaaagtgctgggattccaggtgtgagccaccatacctggcccaaaaatgattttattttaaaaattcaggttgggagcagttgctcacacctgtaatcccagcactttgggaggctaaggtgggaggatcatttgaggccagggttgagaccagcctgggcaacatagcgagacaccttgtctctccaatttttttttttttttaattagccagggcatggtggcagttgcttgtagtcccagctcctcgggaggctgaggtgggaggaaggcttgagcccagaagttccaggccacagtatgccacaatgacaccactatattccagcctgtgtgacagagcgagaccttgtcccaaaaataaaagtaaaaatttaacatttcagaaatatgaattgtagactaaacttctatgagcctgccaggcgcagtggctcacacctgtaatcccagcactttgggaggctgagaaggttcccatcacctgaggtcaggagttcgagaccagcctggccaacatggtgaaatgaaaccccatctctactaaaaatacaaaaatattactcgggcatggtggcacacgcctgtaatcccagctacttgggagactgaggcaggagaatcgcttgaacctgggtggcggaggttgcagtgagccgagaccgcggcattgcattccagcctgggcaacaagagcgaaactccgtttaaaaaaaaaaaattctatcagcctgtcttcatcagtttggaatatatttcttcagtatttaaaagatctgcatgtaccagtgttattctttttttttttcttaaaaaaaaaagaactgtgataacttgccttttcccttaatgtatcttttacatcctttcctgtcagtacttagagatctgccttattattaagcagttctgtatattattctttaatatagatggaccatcatttattcaacctgtttccaactaatggacttttggcttggttcccaatttttccaatttatgaatgctgctgaagtgagcatccctgtacatgtatttctgtaaaataagttcctggcagccctgggccacaggattagcatgttttaaaatttaatatgtactgttaaatagtcttctaaaaatgttatctggccgggcgcagtggctcacgcctgtaatcccagcactttgggaggctgaggcgggcagatcacctgaggtcaggagttygagaccagcctgaccagtatggtgaaaccccgtctctactaaaaatacaaaaattagctgggcttggtggagggcgcctgtaatcccagctacttgggaggctgaggcaggagaatygcttgaacccgggaggcagaggttgcagcgagtcgagattgcgccactgcactccggcctgggcgacgagtgaaattctgtctcaaaaaaaagcctgcctgccaccacaggcccaccagcacgtacacgagtgtcttttcctccatgtcccttccagtgccatgtcattcctctttaaaacatagccactctgatcctatgaaaaacgacatgccatttttaaaatttatttcattattagtgagacagagcattttttctcctctttattggtaaattgcatttcttctgtgaattgcttctttgtgtcatttgtctatttttctacagtgctcttgattttattattattagtatttagtgactcgtaagagctctttcaaatacaaagacactagtgttctttccgagtgagcaggagatcttaccctggggttttcaggtctctacatggtccatgagtaagcttcaggagagccgtgcacacccttgaaattccatgccaacaaagcgtgtgtaggtgctgctcagctgtgtctttctggaggggagggtccattactttcactggcctctggcaggtctgtgtgaaggctaaaaaccactgcggtggccgggtgcggtggctcacacctgtaatcccagcactttgggaggccaaggtgggtggatcacctgaggccaggagttcaagaccagcctggccaacatgatgaaacccaatctgtactaaacatgcaaaaattagcctgggatggtggcaygttcctgtaattccagctactcgggaggctgaggtgggagaattgcttgaacccgggaggcggaggttgcagtgagctgagatcgcaccactgcactccagcctgggtggcagagtgagactccgtcttaaaaaaaaaaacaaaacacacaaaccactgtggcaggagcgtttctattcactctttgctctcccactggaggcaaaaagctacacaggctagagagtgaccaggcaagagagtcacctgatcaccatttgaagcgtttggctaccagaggtctgtctaagggaggctgttggtttgttcttcaaggttttcattttttgatctagagcaggagtcagcaaaccgccattgccaggccaaatccagaccactgcctgtttttgtaaacaaaacttcatggggtagagctgtgcctgtttgctcctgtctgtggctgcttttgtggtatctcatcagagtcaacgcagtcgtgacagaggccatatggcttgtaaagcccaaaaggtctactgtcttagccaggcacactagctcacgcctgtaaccccagcactttgggaggctgaggcgggtggatcacctgagctcatgagtttgagagcaggctggccaacatggtgaaaccccgtctctactaaaaatgcaaaaattagccagatgtggtggtgggcgcctgtagtccccacgactcaggaggctgaggcaggagaattgcttgaacccgggaggcagaggtygcagtgagctgagattgtgccactgcactccagcatgggtgacagagcgagactctgactcaaaaaaaaaaaagtctattgtctggccctttatggaaaaagtttgccaacccttggtccagaggccccaggaagctgctacgtcactgttcctcgtctgagggcatgtgctgacacccaccattcacacccacaccctctggttgcatgggccagctctccttctaagtcatctctttctgcctccccccagggtggagggagttccatgggcattcccctgccccctgaggcctctgatgagggctccagtgcctgctccttgagaacagaccccaaaagggaaatgaggtcagtgaggacagggctgaagcagttaagcaacactcttgggctgactggggcttctgctgagcagagccgaatctcattctgatacaacccaggacttcagaaagcagaactgtcgggatcagctcccagagacgccaagctcagggcacaatggcactttctgtttgtgtctcccacccgtgttctaatttgggggacaaaggagtctccagggtcgcctttaggaatttctaactccaatcttcaacaaccatgttggggctgtggataatagctctgtgataacccaggactctaggggacggcgttgctgtggaagccttaattcggggacttcctgggtcccggggcctttgtgctgcatgggctgtggtctaaatacagatgaccaggggctgcgagctgttacccccactggtaggagagggggctccaagcgggcacacgccttttccttgtagtccagaaggagatggccaygagccatccttccagagcccaagaggtcggcacccatggtggtatttccctcccaagtggaggctccgaggggcaagggtggctgtcgcgtcaggtaggctgcccagtagccagtgctggctctcccagggccctgcagcacagggcctgggccatcgcgtgccatccgtggagggcggacgccaggtcactccatgggggcagagcacyccccacggtgtggatcctcagcctcccccgggacatctggacggcacgctcagtgtttgttcagtgcctcgcgtttgtacagccctttgcactcgcttcatcggctggagcacaaacacggccggcggctgaggccgcatcytggggtcgccaccctccaacccggagcctgggttgcttagagatgggagcagctgtagccaaaattgtgaacctgccatttccactccattactctgacccctgtccccgtgggtgggatggggatttctcagcagaagccacacagaaaagcgggtttcaaaatgttgccaggctccccgatgagacatttctctgtggattttcccttttgattccttcaagtctgactttaaacctgaggaaggcatgatttcatgggaggtgggatctgagggaagtgaagaggataaacatccctcttcagatcctggagaggagggcaggatggcagatgcccccagagaggggacaggagtttagtgccgtggctcagtagaccccgcgtctgcagccaggagagggtcccacggtggcccccggccagctctggagggtccaggagagggtcccgcggtggcccccggccagctctggagggtctaggtgcctggtragcgggacttgccagtgcccagtgcctgctgtgcctccccaccttcctctctttctgtcctgtaccttggggaagctcaggcagtcagctacttgccattggtttggggagaatttgccatctgagggttctgcctcatgaatttgctgcagtatgtgaccacgttcagacggaaagggcagcggtattggcaggactggacccggccgggaaggcacaggaggtggccgggggaggggagcacacccttcycctcccttcagcactgaagcagaaaggtgaccacaaggaccttgtcccggrcagcatgtgcttggaggtgcccggttgttgtgggtaggaaacagcccagcctggcagagtctacctgtgcagtctggttccgggatcccggcctgtgcaggttgtacagaactctgggtgtgtactccagccacttggggacaaggctccctctggaggggacccgagggccagaatgccagcccccacccaccacccagctccccagcccccacccacctcccarctccgcagcccccacccaccacccagctccccagcctcctgcaggccagggaggactcgggagtccgtggatgtggaaagtcagggccgggggtgccacggttgccccttgtttctgcctgccagcaatgccatggcctgccctgggccaaaaggcacgtacgtccggcatcttagagaarctcccgcgcccgcactgtcccagggccttggccctgcaggcactcctgtccggtggtcawgctctatggccagaatgccaggggaggggccgcctgcagctgctgttttcccctctgggaaggtcacacagtccggcctgtttatgctgcagccagggggctgaaagagagagagtcacgggcttccctgtgtgactgaggctgcgtggaggcagtgagtgaacagcccgggctggcaggacaggttgacccgcacggaggcagaggcggcgagggggctgtgggaagcacctgagggcgggaagaggggcttgcactcccacctgtgagtgtggtggtgagtcaggaaacagctccggcttcctgcttggcagcaaagctggtccttcccctcctggggtccttcccctccgccagccctcgaggcccgcgctagggcgctctgctcagcgctcagccctcactccggcaccgcggcttcgaacagccattatgcgcagctgagaccggtggaggcagggaagctggggacggagtgagcgagagggggaatgtggggagtgacccagatgtcaggatgacctacgggagtccacaggcaaatgcaagcccatccgatgctgtggcgctggaccatggggaggtcagccgaaggcaacagcaggaggtgagggcagggggcagatgggtctaaaaggagcttcagaaggaatgtaagccatctctagttggggactgggcattgtggtatccccctgtagtctcagctgctcaggaggctgaggtgggcagatgagttgagcccaggagttctgcacaatagcgtgctgtgttgatgagatgtctacactaagttcagcatcagtgtggtgacctccggggggtgagggacccccaggttgcctaaggagggctgaaccggcccaggtcagaaacagagcaggtcaaaagtgtcctgctgatcagtagagggatcatgcctgtgaatagccactgcgctccagcctgggcaatacagcatgacctcatctccaaaaacaaatttaaaaaaatgaccgggcgcggtggctcacgcctgtcatcccagcactttgggaggccgaggcggatggatcacctgaagtcaggagttcgagaccagcctggccaacatggcgaaactccatctctactcaaaatacaaaaaaaaaattagctgggcatcgtggcakgtgcctgtaatcccagctactcgggaggctgaggcaggagaatcgcttgaaccagggaggtggagcttgaagtgagctgagattgtgctgctgcactgtagccttggcgacagagtgaggctctgtctcaaaaaataaataagtaaatgaatgaaaaataaacctctagttgaagggcgcakattggatcttaataaggcacatgtaaaagccgtgggatccaaactgaagtgtgtattggccggagccacaggagactccagakaggcagcgtggcctggggcctacacacagaggcttggcctggcttgaatccccaatctgaccattactagcttgggggagtcccttgacttttctaatctttaagtttttgttttgttttgttttgttttgttttttgaggcagagtttcactcttgttgcccagactggagtgyaatggcgcgatctcaactcactgccacctctgcctcctgggttcaagcgattctcctgcctcagcctgccgagtagctgggattacaggtgcacgccaccacgcctggctaattttttgtatttttagtagagatggggtttcaccgtattggccaggctggtctcraactcctgacctcaggtgatcccctgcctcggcctcccaaagtgctgggattacaggtgtgagccacygcgcccggcctcatggtgttttttgaccaataaaagtttttaaataggtggtcaaaagtgtgtttcagcttttagggagtacctagcatttgtgtcaaatgaaacctctctgaagagaacatgaaggatgaccttgaccagtgaaacccaaagcataaacatcctgacagcagtcaatgtgtggtcacaacagaataacaaggacaggagaagaaaggccatctctgtggacactaattatttatttaaaggggaatactaatttgtgttttatcctgtagtcggcttccttttcttcctcccagagctgtggttcctgccagaggacacttccctcgttggctrtgcccaggagcagcttgaccagaagattttccctgttatgaagtcataacacatatcataatagtaactattgttaatacctrccctatttatgatctttaaaaccctcggccgggcgcagtggctcacgcctgtaatcccagcactttgggaggctgaggcgggtggatcacctgaggtcaggagttcgagaccagcctggccaacatggtgaaaccctgtctctactaaaaatacaaaaattagccgggtgtggtggcgggtgcctgtaatcccagctacttgggaggctgaggcaggagaatcgcatgaacccgggaggtggaggttgcggtgagccgagattgcaccattgcactccagcctgggcaataagagcgaaactccatctcaaaaaaaaaaaaaaaaactgaaaaaacaaaacaccatgaattaagaagttaaatgacaaactaggaaaatttattcatagtatatagaactgtgaatgtcttcattttattttatttttattaatttttgagacaagagtctcgctctgtcgcccaggctggagtgcagtggcacaatctcggctcattgcaacctctgcctctggggttcaagcgatttttctgcctcagcttcccaagtagctaggattacaggtgcctgccaccatgtccggctaatttttgtatttttagtaaagacgaggtttcactatgttggccaggctggtctcaaacccctgacctcaggtgatccgcttgcctcggcctctgaaagtgctgggattacaggtgtgagccaccgtgcccggcctgtgaatgaatgtctttaatacataaagagccttcacaaaatcaatatacaaagattggccgggtgcagtggctcatgcctgtaatcattgcagtttgggaagccaaggtggaaggatcgctggaatccaggagttcaagaccagcctgggcaatagagtgagaccctgtctctataaaaatwattaaaacaaagctgaaggagaccttgctatgcagccccctgccgcttgtgcacccttgtcgacccacacgcaccttcaggagggcggcgcacacctggggtagtcacagtgcaggactctggctcaatagcgcctttgcattggtttggaccttcgggagggcggtacacgtctggggtagtctcagtgcaggactctggctcaatagtgcctttgcattggttgggaccttcgggaaggcagtgcatgcctggggtagtctcggtgcagaaggactctggctcagtagcacctttgcatcagtttggaccttcgggagggcggtgcagaaggactctggctcaatagtggctttgcatcggtttggaccttccggagggtggtacacgcctggggtagtctcagtgcaggactctggctcaatagcacctttgcattggtttggaccttcgggagggcagtacatgtctggggtagtctcaatgcaggactctggctcagtagcgcctttgcattggtttggaccttcgggagggcggtgcatgcctggggtagtctcagtgcacgactctggctcagtagcgcctttgcatcgttttggacctttgggagggcggtgcatgcctggggtagtctcggtgcagaagggctctggctcagtagcgcctttgcatcagtttggccttggctcccagcactggttgtttccrgcggggttgtcggctgtgtgaagcaggccgtgtgcctctctggctgtggggctctgttcggtggtgtagcaggcctgagtgcttattagccatctcgggatccagggaacatttgggttttcccagctacacctggaaacttggcgggcatatgggaatgagattctaccactctggaagattcatgcccacaggtttcattgcagtttgctgatggtccgcaagcctgaaattagcgtgtggaacagacccctttggtagcagtctagtgccagctcagacctacgaagaattaaaaatctgcaaacttccactatttcaatgtttaagggaaataaatgcagcatttttgcatttctgacattttacttaaaacaaacaaacaaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctgtcacccaggctggagtgcagtggcgcaatctcagctcactgcaagctctgcctcccaggttcacgccattctcccgtctcagcctcccgagtagctgggactacaggcgcccgccaccacgcccagctaattttttgtatttttagtagagacggggtttcactgtgttagcgaggatggtctcgatctcctgacctcatgatccacccgcctcagcttcccaaagtgctgggattacaggcgtgagccaccgcgcctggccaaataattttttaagttgtagaaaaatgttgaaagtcattagtaaaagttttttgtttttttgagacggagtctaactgtgttgcccaggctggagtgcagtggctcagtctctgctcactgcaacctctatctcccaagttcaagcgattctgctgcttcagcctcccaagtagctgggactacaggtgcctgccaccacgcccagctaattttctttatttttggtagagacagggtttcaccatgttggccaggctggtcttgaactgctggcctcaagtgatccacctgcctcagcctcctaaagtgctgggattatagatgtgagccactgcgtctggcctcagggtgatttttaccttattctttttatactttgctccaaacattttgcaatggatatgcttttcttttctttttttgagacagagtctcactctgtcgccaggctggagtgcagtggcatgatcttggctcattgcaacctctgccccctgggttcaagcaatcctcctgcttcagcctcccaagtacctgggactacaggtgcacgccgccacacccggctaatttttggtatttttaatagagatggggtttcaccatgttggccaggatggtctcgatctcgtgatccgcccacctcagcctcccaaagtgttgcgattacaggcgtgagccaccgcgcccagcccaggcattgccgttctaaggaaaagatcataattaaaaatacaagatgtcagtgttggtttgaaggctacctagtgtggttcccctgaggcactctactccctaaggaatggccctgctgaccagaataacatgttgggaagaattttcttggtgctggtaagaatgttccaggcggcaagaggcagggcatcaaagggagcagctgggaggcccctgccctgtccaggcctgagggcaaggcctcatccatggacagatggagagtcggcctcttccccaggttctgctcttccccatcctggatctagtgctggggagaagactccagaagaccaggcagggccacatggtcaccccagggccctgtggctctgttggtctgtagcctaggttagggttaaggcaggcagscttgagattaaaaaggtagaaggaaaatgcctagctagcaagctctctgcttttccggaacattctctagctctgttgaaaagtttgagacactckttttacccaaaggtgactgcagcaacctacatgttagcctcacctgaccctgcaccaagggagccaggctctgggcttccatttgcccttctggttgggttccaagccttctctgggcctcccttttttttttttttgagacagagtctcgttctgtcacccaggctggagtgcagtggcatgatctcggctcactgcaacctctgcctcctggattcaagcaattctgcctcagcctcttccccagtagctgggactacaggcacccaccaccacgcccagctaatttttgtatttctagtagagacaaggtttcactgtgttggccaagctggtctcaagctcctgacctcatggtccacctgcctcggcctcccaaagcgttgggattacaggcgtgagccaccgcgcctggcccctttctttctttctttctttgcgccggctgtgctggcatgccgggcaggaacacttccctccttccgcataagcagaacaaatatttgcattctcactgggrtagatatggccacggagatgcctttgctacagtgcagtaatggagcagcccaaatatgtgagcttgggaaccgaggcttgtcctttgaactgcaacctacctgggaggcaggtacccagagagtaagattgctcacctgggcgtgcctgggcacgtgtgagcacatcacatttcttttgtcttctgttggaagggatttcttttcttttctttttcttttttcttttttttttctttttgagacggagtctcactctgtcgcccagggtggagggcagtggcgatatcttgactcactgcaagctctgcctcccaagttcaagtgattctcctgtctcagcctcctgagtagctgggattacaggtgcccgccattatgcccagctaatttttgcatttttgtagagatggggtttcaccattttggccaggctggtctcgaactcctgacctcaggtgatccgcccaccttggcctcccaaagtgctgggattacaggcgtgagccacctcgcccggcctcatttcttttttttttttgagtcttgctctgtcgcccaggctggagtgcagtggcacaatcttggctcactgcaacctccaccacccgggttcaagcaattctcctgcctcagcctcccaagtagctgggattacaggtgcacgtcaccatgcctggctaatttttgcatttttttagcagggacggggtttcaccatgttcgccrggctggtcttgaactcctgatcttgtgatctgcccacctcggcctcccaaagtgctgggattacaggcgtgagccaccgtgcccagcctcttttttttaaaacgtagtcttgctctgttgcrcaggctggagtgcagtggcacgatctcggctcactgcaacccccgcctgggttcaagtgattctcctgcctcagcctcccgagtagctgggattacaggcatgttccaccatacctcgctaagtttttgtatttttggtagagacggggtctcactatgttccctaggctggtctggaactcctgacctcgtgatccgcccgcttcggcctcccaaagtgctgggatgacaggcgtgagccaccgcgcctggcctcactgtgactttttggtgtcctaatgggtatcaagtggtatctcattgtggctttgatttgaatttcactatgattaatgatgttgagcatctttccatatgcttattggccatttgtatatcttctttggagaaatgtctattcagatcctttgcccatttaaaaaattggttatttcaaaaaatagctgggcgtggtggcacatacctgcaatgggaggtgccgctcgggaggctgaggtgggagaatggcatgaacccaggagacagaggttggagtgrgccgagatcgcaccactgcactccagcctgggagacagagcgagactccrtctaaaaaaaaaaattggttatttatctttttattattgagatgtaggggttctttatatgttctattttttgttttttgaataactgttgggcactatgtttatatattctagatgcaagctcttgatctgtgatttgtaagaagtttctcccattctgtgcattcttttcactttcttgaactcctgccctcaagtaatcccgctgccccagccttccaaagtgctgggatgacaggcacgagccaccactcccagcctgttttcactttcttttttttttgagatggagtctcgcactcttgcccaggctagagtgcagtggatcaatgtcagctcactgcaacctccatctcccggttcaagggattctcctgtctcagcctcccgagtagctgggattacaggcgtccaccaccaygcccggctaattttttgtatttttagtagagatagggtttccccatgttggccaggctggtgttgaactgctgacctcgtgatctgcctgcctcggcctcccaaagtgcggggatgacaggtgtgagccaccgcgcccggctctcttttcactttcttgatgccatcctttgaagcacagaggttttaaattttgctgacatcccttactcatttttaaaagtgggcaaaacaggcagcagtgactgcagacaggtatgtcgccaagttcaaactccctccgctcagtaacagttaatttgcttgcaggcaggcaggtttgataaaacaaaaattatttaktttgggaggccaaggtgggagaagagcttgaggccaggagttcaagtctagcctgggcaatatagtgagaccccatctctacaaaaataattaaaggccgggcgtgatggctgatgcctgtaatcccagcactttgggaggccaagatagatggatcgcttgaggtcaggagttcaagaccagcctggcagcatggtgaaaccctatctctactaacaatacaaaaattagccgggcatggtggtgcrcacctgtggtcccagccacacaggacgctgaggcaggagactcgcttgaacttgggaggtggaggttgcagagagccaagattgcatgtcagtgcattccagcctgggtgacagagcgataccctgcctccaaaaaaaaaaccactagctggggcatggtggcgtgggcctgttgtcccagtgacttgggagctggggggggaagatcacttgagccaagttggaggctgcagtgagctatgattgcattactgcactcccacctgggcaaccgaatgagaccctgtctctctctctctttttttttttttgacacagagtctcgctctgtcccccaggctggagtgcagtggcgcagtgtcggctcactgcaagctccgcctcccgggttcaagccattttcctgcctcagcctcccaagtagctgggattataggcgcctgcccccgcttccggctcctttttgtttttttcgtagagacagggtttcgccatgtttgccaggctgatctccgwattccctgacctcaggtgatctgccccccttgtctctctctcttttttttaactttaaaaagatacagaggcagggtttcgccatgttgtccaggctggtcttaaactctgaggtcaaaggcagcactctgggattgcaggcgtgagccactgcgtccagcagatcctgtctcttaaaacaagaaaaaaaggccgggtgyggtggctcacgcctgtaatcccagcactttgggaggccaaggcgggcggatcacgargtcaggagatssagaccatcctggctaacgtggtgaaaccccgtctctactgaaaatacaaaaaaattagccgggtgtggtggcgggcgcctatagtcccagctacacgggaggctgaggcaggagaatggcgtgaacctgggaggcggagcttgcagtgagccgagatmgmgccactgcastmcagccyggccgawagagcgagactccgtctcaaaaaaaaaaaaaagaaagaaagaaagaaaaagattcaagacaaatggggagtggtggggagggtggaggggacatagattaagtccccataagcagcctgaatttaatgaaataggttggcatggctatccagagggcagcccccaaggccagggacgctgggtgtggacaggaaaggtttgctacacacagtgtgatgtctcttgaggttagagaacctgtgcctctttgggaggatgtagtttgccctaggcctggatttcggtagaatsagcaagagttagccttgaagtcctgttcaggtgggccccctcttgccctgtacscagaatgagctgatgtgagatgccgagagtggcttcgttgggaagagagcccggaccttgcttcccgttggccttccaggatgctaactgctcgggccgaacatcctgtgggaagataatcccctgcttgtactgagaaattcagaagcaggaggccgggcgcggtggctcacgcctgtagtcccagcactttgggaggccgaggcgggcggatcacttgagatcagcctggccaacatggtgaaaccccgtctctactaaaaatacaaaaattagccaggcatggtggcgggcatctctaatctcgcgacttgggaggctgaggcaggagaatcacttgaaccagggaggcggaggttgcaacgagccgagctcacaccactgcgctccagcctggggaacaagagcaaaaccccatctcaaaacaaagaaaagaaattcagaagcaggaatcctgggccagcttcatcctcagaccgaagagaactgtagaattctgattgacatcttccaaaaacctaccctctccaaaccaaaagcagtttttgctgacatctggtctttctggaatgctgatatttttatttataaaatgatgctattatccccaaatagattcttatttttaacaggctttctccctttgagggctgcctgaggctcataactttgttctctggcatctcagtgttaccctgaaaagacaagaaggctcctgggctctgccaggagcagagagatagggagggttgccagccggaaagtcagacaactgcttgtattctgcattacctccctccttggccccatcagcctcagtccatgaaggagaaaccttcagtgagcggtcattgcccctgaactaatgccccygtgagtcacacaggaaggggcgcaggtgaagaaggggcctcatggggcctagttctctgtcccctcctcctccccttccctggtgcatcctccccactgaggtttctctgcttcttatctctcagctgcccaacatgttcggcgaccttcggtccacgtttattgccttgatgattgggtcctacgcctcctcggcagtcacctttccaggaatcaaggtgagcacgtgtattttgcactggtgtctgtgcagaggcctgctccaggctccttccaccctctctgaagagggaggcaattgtgggcacccggggtggcccctctccaccacccccacccgggcaggatgcacctgggcatcacaggggcgacaaatgaaaaccgcggggcctcaggggacgggaatcacgcatktggctgcaggatctgccgcaggtgcctttrcatttcrgggctggggcaggggaagggcggtgggtgagtctgtttccagttgtgagtcttgcccccgtctcctccgtcatcctggtctcccgctgctcccctgctccccaacccccagcctgctgttattgtaccgttactccccgccagccaaagcactgctcttggccaagtgtttcagctgtttccctcctaggcaggattttgagcctgtggaagtcacacagggtcaggacgaagcaaacacctcacagtccatcagcccaagttccccagaccctgtgggtctgccagggccccgtaggggcttctccyacctctgaccctcacactaagtaaaagcccctttcctcggtggtgtgtgtgggaatgctgttggcgaggagagggggwcacggtgtgggctggccacctgggcatygaagtggtgggagctgggactctggggccagccatcctatggacttgcagagattctcatgcccctggactggggagcatcccgaaagwtcttcctcctcctttttttgggggggaacagggtcttgctctgtcgcccaggttggagtgcagcagcacgatctcggctcactgcaacctccacctcccaggttcaagtgattctcctgcctcagcctcccaaggagctaggattacaggtgcccgccaccatgcccggctaatttttgtatttttagtagagatggggtttcaccatgttggtcaggctggcctggaactcctgacctcatgatccgcccactttggcctcccaaagtgctgggattacaggcgtgagccaccatgcctggcttccttgagcatttctttggcctctgccatgtgagctctcagaggcactggggaagcatcagtggacggggctggccggttcccgccttcagggagctccgctaataccagacaagccgacggaccaggagcaccgtcccctctgctgggccgatcactatgagcctgcaagacgtgccgtggtcatggcggggcggtcaggaaggcctccgagtcggggggctaatcacacgccaggcccagatgaccagcagggcaggcacggtgggaggactggaaggcgggtgcctgatgccccaacgcccaggctggcagggctgtgcctctttgcgcggctcagcacagggacagcaggggtggccagacgcccctgcctgctgcggctctggcctccccgggctaactctgcccccyccccyccccaccccgtccccgcggtgcctgtcagctcatctatgatgctggtgtctccttcatcgtcgtcctcgtggtctgggccggctgctccgggctggttttcctcaactgcttctttaactggccccttgagcccttcccggggccggaggacatggactactcgtaagtagaggtgcccccgtcccgcctgcccccagcccccgccccccagccggggtcccgggcagcacccacagacactctcccggggccccagggtgaagatcaagttcagctggctgggctttgaccacaagatcacagggaagcagttytacaagcaggtgaccacggtgggccggcgcctgagtgtgggcagctccatgaggagtgccaaggagcaggtggcgctgcaggagggccacaagctgtgcctgtccaccgtcgacctggaggtgaagtgccagccggatgcygcaggtacccgcctgagaccgcagccgggcgacgggcagggagtgctctgtgggtatcggctcaccccattcccacctcacccmaaaaggggaggcggccccgcccgccctgttctgcagaggcgctcaggaaggcytgggggagggaaagggatttgcctgatttcacccaagaggtgaccccaccgcagcgccaaccccgttaccctcaccaggcccgtcccgagggccccctcctggcctccagcgtggagggatctgcgtgtcccccsggtggtggggacagtgtgccccggccctgagccccgcaccctctccctgcagtggccccctccttcatgcacagcgtgttcagccccatcctgctgctcagcctggtcaccatgtgcgtcacgcagctgcggctcatcttctacatgggggctatgaacaacatcctcaagttcctggtcagcggcgaccagaagacaggtaggtgccccgggcagcctcggtcgctgtcactccccggcctgagcccagcccactggccaccgsccrgaatgtgttaagctgagccgggccagcsgggccatggaaaggccgcatcccaggmgctgtctgcccgtcagagctattgcatcactgccagccccaactgtttcttcgtgtccccatcagggtttcctggtccaggagggagggaaggaccaaaatagcctcctgggtgtggggtgtggggtgtgtgttttccagtgcctgagggggaggkttgccgtgtgtgtctgtaaatgaaaacagaacagaacgctccacctgagcatggctgaaagacagcaggtcaagcccaaagtcctcccagaaagtggcacrgtgggtgcgtggacaccctgggcatcgaggtcaggacggggctggagacgctggggcaactggcccacactgggatctgcatccctcaccgagaaacagggcagggcagagacttcctcggagcttgcgaacagttgaggcttgtcagctccaacaaacacagctgataacccacagtccacttttccaaacagggcaggtcttcagctgattagaggttttgattctacagagaaagtcaggacttccccggggcctgagctgagtcagccttagtcatccccaggcgggacaaacactccaaatcctttttattggcagcctccctggtgtgccactttttccgatggtttccttgtttttatcaaggtgaagataccctaggacttgtgaagaatcagttatcaggtttttaggggatgagaaatccagctttatcaaaaggaaaagatagcaaagggaaccagataacagccagttctactgtgaaaatggtagtctaggccaggcacggtggctcacgcctgtaatcctagcccttttggaggctgaggcaggtggatcatgaggtcaggagttcaagaccagcctggccaagattgtgaaacccccatctctactaaaaatacaaaaaattagccaggcgtggtggtgggcccctgtaatccctgctacttggaaggctgaagcagagaattgcttgaacccaggaggtggaggttgcagtgagccgagattgcgccactgcactccagcctgggcgacagagtgcgactccatctcaaaagaaaaaaaaatatctgtggaacacactttggggaaccctaatctatyatgtctctttctttcttgtttttttgaggcagggtctctttctgcgttgcttaggctggagtgcagtgatgtgaacgctgcagccttgacctcttagggctccccaggtgygcgccaccacacccagctaatttttaaattctttgcagagatagggtcttgctgtgttgcccaggttggtgtcgaactcctrggctcaagrgatcctcccctcttggcctcccaaagtgctgggattacaggcgtaaacctccacacccagcctgataaacattcagccctggagtggcggaaaccccaaagtgtgcagagagagctggtccctggccctcgaaaggctcatctccctgctgctgagtcagcgtctkttactcaagctgtctgagaaatcttttgctgcccaggaggaatgtttccaactgtttcgtatgttcaaaaagtcaatttcaagaagtagaggaagccaggccaggaaggttggtctgtggcagacgaggcactggttttccccctcctccttctgtgacccgttacacccaacacccatagccctagctccggccgagaggcagctgcagggtccgggtcactttcygcacactcgtgagctttgcggctccgcaggagggggtgtgccgtgctgctgaggaacggctcaaagcaccagagccatcgcctccgcgtacggccccgcgaccacccgcggcagaggctcccgggtgctggttccgaatggagactccaggccttgccgctgaccggtgactctgctgcctcccagcgtttgagacccgccrtcaaacaggagttgcggattcagggaaaccctaactagccagggtgctggcagctgggaaaaggccgccttttttttttttttttttttgagttggggtcttgctctgccacccaggctggagtgcagtggtgcaactgatagctcaccacggcctccgactcctgagctcaagggatcctcccacctcggcctcctaagtatctgggactacaggtgtgtgccaccatgcctggctaatttgttttttttttttttccataaagacaaggtcttgctatttttcccaggctggtctcaaactcctgggctcaagcagttctcccacctcagcctcccaaagtgctgagattataggcatgagccacaatgcccagccaaaaatacagtcttttttttttgacatggattttcgctcttgtcacccgggctggagcacagtggcatgagctcggctcactgcaacctccgcctctcgggttcaagcgattgttctgcctcagcctcccaagtagctggggttacaggcacctgccaccatgcccagctaatttttgtatttttagtagagacggagtttcaccatgtctccaactcctgacttcaagtgatccacgtgcctcagcctcccaaagtgctgagattacaggcgtgagccacgatgcccagccaaaaagccagtcttgagatggggaagacgtggcscatgctgtcctcagcagtgcccagtcccagccaaagtgggcactgctgcctcactctcccacccaccctcagggtgtggcacttactgggaagaagcaggcattgagaaacagaattraggagggraaacagtycagggccaacagtgcttggggattgaggcctgaaaatgggagcagggtacagaggctgtggctggccagatgggtcgggtgccccctgcacccccaccccctagtcaggggccacctgtcctaccctccctttgtaagagttgacaggtgacatgttttcctattgttgtccttgacttgataacaatctaggagttaaatagatactatcatctgtttacgtcatcatttatgatagatactatcatcatatacacctgaaaaacgaggcctggagykatggaggagcttgttcaaggtcagagccagcactcayatatgggtcttaagacactggagcagccaagggcctctagaccaggacattccactcggagcagcagctcaggggccaccaggcctctgtggcaggggggccatggcccaaggaaggggagcaggcccaggcatggtccccgttycttggagtggaagggagaccagctctggccatctggaggagacccatggtgtcagatgccttggctgggcrtcaggggcaggttctttgacctttccctctctctgarcacagcargaggtagatgtgacagagccgcttcccgcaggcagtgtggtgacagggaccctgattgcaccaggtcttccgcatgcccgccacttccccatcaygctmcccrccaacgtcacaggcctgattcaccagtccgcctgtgacccggcaccagcagacaggagaatgtcagcaggggcccgggctgggcattgtcccaagtccacttccagaggcctggctgcagctctgcctcccctgagcgccccgagtcacgcttrgtgggaaaygcagtgcgggaaacgcagtgcgggaaacgcagtgtgggaaatgcartgcgtgctgggcatggagtgagcctgcctcctctcccatctctctgtagcactgagatttctgccactaacctctcttctttctgctttttcacttttgctttcttgatgcagtgatggccacgggtaagcrgggggtgggggggattgtcagggaatgctgtgatgtcccctcccagccagtctctgttcaacccagaagctcctcacctcaagctccagacatgcctcctggctagagccgtgggggtaaaactggggcaatcaacattcctcgtctgcttccctggaaaatccactgtcattttaagtctttgaatatggaagccctgacatcagagccccgtgagcggtgcctttctgggatatttcttttttttttgagatggagtcttgctctgttgcccagggtggagtgcagaggcatgatcttggctcactgcaaccttcacctcccgggttcaagtgattctccttgtagcctcctgagtagctggggttacaggtgcctgccaccacgcccagctagtttttgtatttttagtagagacggggtttcactgtgttggtcagtctggtctcgaactcctgacctcgtgatccgcccacctcgggctcccaaagtgctgggattacaggcatgagccaccgcgcccagccgttctgggctatttctagagrcagaaactaacggcccgtcrcttagcctccgtcacaggagttcccaagttatagcgacttcctggagctctgggaaggccattgtgacactctgggtttcattagctgtttcttagaaacaagcaggggatttggaaccgagaagaaggtgacctgccccgtgctccatcctcaacttcagagttaaggtctccgggctcctcgcaagacccatagtgacagggggttctggggcagaccccagaagagcctgtggggaccagccccttcccagctggtgcccagtccctgctccagggctgtctgccaggcgtccccatgacgcagcgccttcctccacagttggcctctacacctccatcttcggcgtgctccagctgctgtgcctgctgacggcccccgtcattggctacatcatggactggaggctgaaggagtgtgaagacgcctccgaggagcccgaggagaaagacgccaaccagtgcgtaggcagggccggtgccccggctcccagcccgcagcccctgcagaaagaccccagagctgcatgtcaggcacagggtgggtgggacagagggagagagcaatgcactccagctsctcccggagcccttagagagactcactcattcagctcagcatgcgtttcaactgctcccctctttatggaaattgtttggaatgcaatggaaatgctaaagtttgaggccaggtgcggtgactcatgcctgtaatcccagcactttgaaaggctggggtaggaagatcacttgaggccaggagttggagaccagcctgggaaacatggccagcccccactccccgtctctacaaaaaatttaaaaattggccagggagggtggttcatgcctataataccaacactttggaaggttgaggtgagtgaattgcttgagcccaggagttagtgaccagcctggccaatgtggtaaaacccggtctctactaaaaatacaaaaaattagccaggtgcggtggcggcgcgcgcctgtaatcccagctactcaggaggctgaggcgcgagaattgcttgaacccgggaggtggaggttgcagtgagccgagatcacgccattgcacttccagcctgggcaacagagcaagactgtctcaaaaagaaaaaacaataaagaagaagcattgagtaagaaggaagaaaaagagacacaggtgaaagtgtacagacaatggctagcagaccattttgctcctaagaccaccctccctccaccccttggcagtggctacaccatcttaaagcctcccaaagtactgggattaacaggtatgaggcaccgcgcccggctcagatggtgactttcattcattgcattcaatcatgcagcccaccaaccctttgttatctgcctgcaaggtttattccggtcagtttgagtagtragttgctataamcatattatgtgttaatagagttgttcatgattgtgaagattaaacaaggtactggagtcctactttatgtaagggatgggctccaagatcrgaggatgagttaaacgctgttttcttttttctttttctttttttttttttgagacggagtctcgctctgtcgcccaggctggagtgcagtggctctatctcggctcactgcaacctccgcctcccgggttcacaccattctcctgcctcaggctyccaagtakctgggactacaggcgcccgccaccacgcccggctaattttttttaatatatatttttagtagagacaggggtttcacagtgttagacaagatggtcttgatctcctgatcttgtgatccgcttgcctcggcctcccagagtgctgggattacaggcataagccaccacgcccagccaaacgctgttttccatggctccacaccttaatataataagctacggtttattgcmtgaggccctccaccgaggactccatgcacagtatctcagtgaagactcccagcaccctggcgaagtggggaccagtgttatacccattttacagatgagggagctgaggctgggacttgcagtagtttgcctagggccgcacagttaggaagtggtgggcctgggactccctgcacatctgtgagcacctggggtccgttcttggatcatccagggtgtctgygtgggtgtgagactgggatcggtaatcgttcattcacgagagataattgcagagggtgcytggccgggcgcggtggctcacacctgtaatcccagcactttgggaggccaaggcgggtggatcacaaggtcagaagatcgagaccatcctggcyaayayggtgaaaccctgtctctacaaaaacgcaaaaattagccgggtaaggtggcgcgtgcctgtagtcccagctactcgggaggctgaggcaggagaatcgcttgaacccaggaggcagaggtggcaatgagccgagatcacaccactgcactccagcccgggtgacagagcgagactccatctcaaaaaaaamcccaaagaacaaaaaaacaaaacaaaacaaaacaaaaaacagtgctgtgctatctaggtcaggtcctgcagccaagaggttatttgtgtccactccagttccatctgctgcctgctcatttcccctttaccctctcctgtccccacaaggggaaacccattcactcccctatttggcttgtatctggcttcttatcagcgtcctgcaagatttgggtgaacttgaagccagtggtgaagtgaggctttgccatgtgccagctcaggcacacgctgctacttctctccccgtcgtcttagctcagccttcacagagcactgcagcatatggatggccatcttcttgtasccgagaccccctccgagagtcacactcagcttgccactgagaagggccggggagtgtccgtagtgctggtccagccccgacacagtccctaaaacgtgcctgggtggcttctgagtcttgcgtcagtttacctgctgcgacgcttgaggcctgacttctcaggagcacccggcttcctccggggagccctcccacccctgcacgttctgtgtctccacagaggcgagaagaaaaagaagaagcgggaccggcagatccagaagatcactaatgccatgcgggccttcgccttcaccaacctgctgctsgtgggctttggggtgacctgcctcattcccaacctgcctctccaggtgggtgtggggagtgggaggggcaggtgggaggtggggcagtcagaaggaacatgtaaagactcaaaagtgtgtaatgtttcatggaagccatcaacaaagcggatgactttctttatttttttgagacagagtcaaactctgttgctcaggctggagtgcagtggtgtgatctcggctcactgcaacctcagcctcctgggttcaagcgattctcctgcctcagcctcccgagtagctgggattacaggtgcgcaccatcacgcccagctaatttttgtattttcagtagagatggggttttgccatgttggccaggctagtctcgaactcctgacctcaggsgatccacccgccttggcctcccaaagtgctgggattttacaggtgtgaggcaccgtgcccagctcasatgatgactttcattcattccactcaaccgagcagcccaccagccctttgttatttgcggagggcctgttccctgccaggctctgtgcttgctgctgcaggtgagctggacacctggattgtcttctgcaaagggactcctccccggaaggcatgtcttggttttgggggcgtcttgcataaccgtggataccaccatcatgccatttcccggaagtgtgtggggtcgctgtagagttccttgttttgtatcggctcaagcagctggaatctgacgtccaaagagatctggccaatctgtggtgttggtgggagcatctgctcccctgtcaccagagtctcacggggtttctacactgaacagagtggaggaagaccttgatggtggcttcatatctggattcaaaagcttcattccaggccggtggctcatgcctgtaatctcaacactttggtaggtggaggcaggtggattgcttgagctcaggagtttgagaccagcctgggcgacttggtgaaaccctgtctctacagaaaatataaaagttagctgggcatggtggcacactcctgtaatcccagctactcgggaggctgaggcaggagaatcatttgaacctgggaggcggaggttgcagtgaactgagatcgcgccactgcactccagcctggatgacagagtgagactctgtctcagaaaaaaaaaccaaaaaaaaccaaaacactttgggaggctgaggcaggtggatcacgaggtcaggagtttgagactagcctatccaaaatggtgaaaccccgtctctactaaaattacaaaaattagctgggcgtggtggcacatgcctgtaatcccagytactcaggagggctgaggcaggagaattgcttgaatccgggtggcagaggttgcagtgagccgagattgcgccactgcactccagcctgggcgacagagtgaggctgtgtctcaaaaaaaaaaaaaaaaactgaatttctttgccaaacttttgaggcttctggaacctgatttttgacagagattttgagtaaggtggcccttgtcacctgcctggctccacccactggtctgtgaaagtggtctagcagtaggttttggcccaatccctaaatttacaaatggtggagggacgcaagtgtggcttttccttccagagaggtgtagcctgagtccagatggcatcttgggtcaagtccaggagggaagtaagagtccctccctttttacaggaggccttgaggtacgttgaacacccaggtgtgccccaccgtgggaactgttgtgtgtacgtgccaacactgggcgtgcagagcgcagcgggccgtggaacatttgtgccggccccagggggtgctgcatccctccggccctccctggcctcctgggctgctttctctgcaagactggcagacctttgccctaaccgccttgtccagtcgaggggcagtgctcagtggggacagtcatctttttgttttatgtaggtctcactgaaagaaaagttgtaaaaaggcaacaaggcatttgaggtggggaggcctgcacagcktsygtgtgtgtgtgtgtgtgtgtgtgtgtgtgtgtgggcactgggcacagccctctttcaacactgccaagagcagcccctgcccccccaccacccacattcctgggaacaggtcctggctgctgagcgggatggcagggctgtgtacagaagacaaggcgaccacagggacctggtggccaagaggatggctcttaaaaagtgcctctcrgagttggcggagtccgccagcagcagccttcctgggcagggggcctcccacagacagcgacagaactttactaggaccagcctgggcaatatggcgacaccctgtctctactaaaaataaaaattagccaggtgttgtggagtgcacctgtagtcccagctactcaggaggctgaggtgggagaatctcggctcactgcaccccgggaagttgaggctgcagtgaactgagattgcaccagtgcactccagccygggcaaccggagtgagaccttgtctcaaaaaaaaaaaaaaaaaattagccggcctggtggcacatgcctgtaatcccagctactcaggaggctgagggagaacaatcgcttgaacccaggagacagaggttgcagtgagccgagaccacaccactgcactccagcctggggtgtagagcgagaccgtcccaaaacaaaaccaaacaaaacagaacaaaccacaaaaagaaaacaaaacaaaaagcgaagaaacacttcacgagggaggtgagagggcagccacctgctgggagggccgggtgaccaggcttgggagaccctggagcacagtccgaggtgggcaaaggcagctcgaggccgtggtcagcaacctcttgctcagtgctgtgcccatacacgtctgtcagcagggccctggttctagtgtttgccgacttccacggtgcacrtgcactcaccgtggctgatttccagctgccyatgtgttgccactgactgtggaactggagagtcacagtgacacgtggtatttctacagtagatgtgaaaagcctggccgggcacggyggctcacgcctgtaatcccagcactttgggaggccaacgcgggtggatcacctgaggtcaggagttcgagaccagcctagtgaaaccccgtctctacaaaaaatacaaaaattagccgggcttggtggcatgcacctgtaatcccagctactagggaggctgaggcaggagaattgcttgaatccaggaggcggagcttgcagtgagccgtgccactgcattccagcctgggctacacagcaagactctgtctccaaaaaaaaaaaaaggaaagcctgatgcgtgcacaggctctagtgaaccaagtaaaataattaggaagggatgaggttttccatggttttgttcgttcattttgtttttttttgagacagggtctcactcccatcagccaggctcgagtgcagtggtgggatcttggctcactgcagccttgacttcccragctcaggtgatcctcccacctcagcctcctgagtagctgggactacgggcacgtaccaccaagcccagttaatttttatatttttttgcagagatggggtcttgacatgttgcccaggctggtctggaactcctgggctcaagygatcctcccaggcctcccagagtgtggggattacaggtgtgagccactgcaccaggccaggaagtgatgagttttcagagttttgagtattcattacctttaytttaatataatttatttatttagtcataaatttatgtaatttttttttttttgagacagagtctagctctgtcacccaggctggagtgcagtggtgckatctcggctcaccgcaacctccgcctccccggttcaagcgattctcctgcctcaccctcctgagtagctgggaatacaggcgcccgccaccacacccggctaatttttgtatttttagtaaagatggggtttcactgtgttggccaggctgatctcaaactcctgacctcatatgatccacccacctcagcctcccaaagtgctgggactacaggtgtgagccaccattctcggcttataatttaattattattattattwwtwttttttttttgagacagagtctcactttgtcaccaggctggagtgcaatgccgtgatctcagctcactgcaacctccacctcttggttcaagcgattctcctgcctcaacttcccaagcagctgagattacaggtgcccaccaccacgcccagctaattttttgtatttttagtaaagacagggtttcgccatgttggccaggctggtttcgaactcctgacctcaggtgatccacctcctcggcctcccaaagcactgggattacgggcgtgagccaccttgcccagcctataatttaatttttaataatgactcggttaggctgggcgcagtggctcatgcctgtaatcccatcattttgggaggctgaggcgggtggatcacaacgtcatgagtttgagaccagccgggccaacatggtgaaaccccatctctgcttaaaaaatacaaaaattagccgggcatggtggcgtgggcctgtaatcctagctactccgaaggctgaggcaggagaattgcttgaatccaggaggcgaagcttgcagtgagccaagatcacgccactgcactccagcctgggcgacaaagcaagacttcttctcaaacaaaacaaaaaacraaacaaacaaacaaacaaaaaatgactgtgttaacgactggcttgcaaaatttctgaaaattcacaattggctccggaggatggggttgatccaactccaggctgacactgcccctggggtgagggcccccargaattggagggcgggggctgaggggacggtcccytaaggccttatgcccacagtcgccttttcctcccccagatcctctccttcatcctgcacacaatcgtgcgaggattcatccactccgctgtcgggggcctgtacgctgccgtgtaagtcctggaagccgcaggtggcctggtgggcgagggtgtgggaatggccggggggaggttgctggtgggactgagactctgaggcagggtcagcctgtcccagaagggctcatcttcctgcttcaggggacaggtaccagggtttctgctgggtgtttcagggaaaggccatacctcgtgggaagcaggtcagtgggcagacagttgggtgctcacaagccttggcattcaacacgaagtcagttcccccagccagggtcaggcacctgtgcagctcattatggcctcaggggccactacagccgagtcctggggctggccctggctgctcactgggaaggatgggtaggttctggctgcctgaagctaaatgcggaagttccagttgccctcatcacgggcagcaacatgggtgactgagtccagaatacaccagacgggcccatccagagcctcagtgcgcccagctctggccatagctttctccagccctggctaaaatgaaacctgtatctttttccaagaagccccagaaacataaaaggaaccacagtggttccttcttctctggctcaggccttgacccaaaaactgaaactcaaacatcatcatccacagtctctgatgtgggaccagctcatgtgttgctgggattcctttcccacctctgggccagcagagcctgacatgtgctaagatttagcccggaactctctcccaattcccgcaacagcccctggggtaatcccagctccgcttgccctccgcctgcccctccccaggcctggaggaagctgtggctgtcctggcagggtctgagggaggggggcgggatctgtggtgctgagtttccgcgattactcaatgcttctctggacgagggcactgcagagccaagcccagcctccacactcctctctgggcctgtttcccaaaccgcaggtccccgctggcaccacgctttccactcggctcagccagacacccacaggccctgggcacagctgagtggggtgggccctccccagagtctggggcctggagctggtccaaagagaaacactttgcagaaccacccagcagggccgggcgcggtggctcacgcctgtaatcccagaactttgggaggccgaggcaggcagatcacraggtcaggagtttgagaccagcctggccaacgtagtgaaaccccgtctctactaaaaatacaaaaaattagccagatgtggtggcgggcgcctgtaatcccagctactagggaggctgaggcaggagaattgtttggacyggggaggcggaggttgcagtgagccgagatcgtgtcattgcactccagcccaggcgacagtgcaagactccatcttaaaaaaaaaaaaaaaaaaacagaactgcccagcaggaaggaatccgagggctggcaccccacccttctctggcaccaacggtgcagccyggggtcaccagacacctggggccaagcaaagcccaggaggcaggatggctgtgagctgtcgcttgccctgcaggtacccctccacccagttcggcagcctcacgggactgcagtctctgatcagcgcgctcttcgcccttctgcagcagccgctgtttctggccatgatgggtcctctccagggagaccctctgtgggtaagaggggtcgggggatggtgggtcatgggcgcctgcccccttctgctaactgcgagctgcaaggtccccctcgggggcttcagggccccgaggacatgtgggagcgttggttaggattggttaagagtccctttgtgaatggtggcyaggcaggaaaaggaacatgtcctctctggacctgatttggggagaaatagaacagagttcctgggccgggcgcggtggctcacacctgtaatcccagcactttgagaggccgaggcgggagcatcacttgaggtcaggagttcaagaccagcctggccaacatggtgaaaccaggtctctactaaaaatacaaaaattagccaggtgtggtggcaggtgcctgtaatcccagatactcgggaggctgagacaggagaatcacttgaacccgggaggcggagattgcagtgagctgagattgcgccactgcactccagcctgaatgacgacagcgcgagacttcgtctcaaaaaaaaaaaaaaaaaaaaaagaacacagttcctgtccccgccccacctccgagggccagatttcctcaccaggtaccaggaacttgttccaagcccagaggttcagatcagcccgtgtttcctgggggcccaggccctgagggtggccacatggcctgtgaagagttgggaaccgggacgctggcatatgggacctcgtgggccttcctgtttcgttcccccytccaccccgtgaccttctcccctttcccaaacccgagtggagggcgggtctgcagcctcggcgcaccaccacgccctgtgatgcgcggcctccctgcctccccaggtgaacgtggggctgctccttctcagcctgctgggcttctgcctcccgctctacctgatctgctaccggcgccagctggagyggcagctgcagcagaggcaggaggatgacaaactcttcctcaaaatcaacggctcgtccaaccaggaggccttcgtgtagtggctgccgcctcggaactgcggtctcctgcctgtgcttcagtgactgacccctgtcctgcccctccagagtaccccacgcacccccaggaccttcgccgtctccgtgccagcgttcacgctccctcccggggccctgcctcggagctctgtggtggaaggacgggagagggccccggacacgcgmgttttctcctgccgaacgcaggggctgccctgactttgctctgccgccccccggggacccggggcctggggtctctgtggtgcctgcagcaggagccaggaacgcccggcaggcaggcgctctcccgccagtgtctggattctgcctcttgccaaagcagagggggctgccatcccctgcctgccacctgcccctcggctgcatgcccacagccrtacctgcctgaggacaaaggcttgcactgtctcgccygcgcctggcccccaccccctccccggccagcctgaggctgcctgaggaaggaaggacccgcttcctgttgtcggtgctaattcctttgtaattccagccccctgtcgcctgtccagggcctgcccacccgttggaggccggtggagaagccccacctggcttatgccctggagagggtttagcgggctgggtggacccctcgcctcctccccgagggccaatgccgcgracacgttttcactgtcaccctcgttctgtctgccacctgaagggaatttgaggaccgccgccagggcaccccgtacatacacacagctgcttttgtggaggtggacgaaaggctgtggccggcagacgtggaggtccaggccggggtggggacgtgggtgggtccgaggkgtgtgtggggtcggggtgggctctaggagttagcccttatccccactgaccaggcgggagccgccaggcctgcagctgggccagtgcccaggagccatcctggcgtggggccaggagcttgtccaaggccacaggcccacagcaccccctgccggcgggctccgtggggccctggagctgatgacgggggaggcccgtccgcctggcccaccaacccgcccaccttgactgcccccagaagtgtgtcttgagacctcctgggcgtgcttaraggggtgagttgtgtttggatttttagttattttctcttcagttttattagacttcttttttataaagcaataaatccattttcctccgggtaagggatgccccttctggcatatcagttaatagctgcatgtgcctattttgagcttgagaagaaaaggcaggacaagaytctctgccaccgaccagctccagccgtgcccagctgctcttcgtctctctgggggactgctgactcgggagggacagtgggccaggaaaagaccttcctccccaacccccaaacaaactgggcttgtgcagacatcttagaagtgtgagccaccctcctctaccgattttcccagccaaacaggcgaatcctggtccctttccatccctacacccttccacaaccctgaagattcccgctgggttcttctgcaggctcagagcagttcaggatgtgggcggcagggagggggatgaaaggagaagaggaaagggcaggtccaggccacattcaagctccacattaacagcttgggcgcctggaacacatatctcctaggctttatttcactcaaatatttaaaaaaagactgggcgtggtggctcacgcctataatcccagcactttgggaggccaaggcaggaggctcacctgaggtcaggagttcgagaccatcctgaccaacatggagaaaccccgtctgtactaaaaataaacattaatcgggcgtggtggcgtgcgcctgtaatcccarctactcgggagcctgaggcaggagaatcgcttgaaccggggagacggagattgccgtgagtcgagatcgcaccattgcactccagcctgggcaacagagcgaggctccgtctcaaaaagaaaaaaaaaaagagaacgagataaacatgcccactcctgagaacactcgttttgtgatgttagtggttattctgattttcaagaaagtattatagtcaagtttgggaaaggctgagttaaaagtcaagcctgtttccttacagccagcactgacagcactttgccaacgctcatgagctccgtggctcctcaggagcgggtgtgctgtgctgccgaggaacggctcgaaccatcagagccaccagcctccacgtgcggctccatgatcacccccagcagaggctcccgggtgctggttccaaatggagactccaggtcttgccgctgaccggtgactctgctgccagcatttgagacccgccatcacacaggagttgcagattcggagaaaccctaactagccagggtgctgccagctgggaaaaggccgcctttttttttttttttttttttttgagttggggtcttgctctgccatccaggctggagtgcagtggtgcaactgatagctcaccacggcctccaactcatgggctcaagggatcctcccacctcggcctcctaagtatctgggactataagtgtgtgccaccatgcctggctaattttttttttctttttcataaagatgaattcttgctattttgcccaggctggtctggaactcctgggctgaagcaattctcccacctcagcctcccaaagtgctgagattacaggcgtgagtcacaatgcctagccaaaaagccagtcttgagatggggaagacgtggcccgtgctgtccccagcagtgcccagtcccagccaaagtgggcagtgctgcctcactctcccmcccaccctcagggtgtggcacttactgggaagaagcaggcattgagaaacagaattgagggggggaaacagtccagggccaacagtgcttggggattgaggcctgaaaatgcgagcagggtacagaggctgtggctggccagatgggtcgggtgccccctgcactcccaccccctagtcaggggtcacccatcctactttgccttgtgtggagctgacaggtgacatgttttcctattgttgtccttgacttgataacaatctgggagttaaacacatatgatcatccctgctttacaactgaaaaacgaggcctagagatactatcatcatatacacctgaaaaacgaggcctggagcgatggaggagcttgttcaaggtcagagccagcactcatatatgggtcttaagacactggagcagccaagggcctctagaccaggacattccactcggagcagcagctcaggggccaccaggcctctgtggcagggggacctctgtggcaggggggacctctgtggcgggggggggcctctgtggcaggggggtcacagcccaaggaaggggagcaggcccaggcatggtttccgtttctgggagccaagagccttctcagaagagggggagagagctactgcatggaatcatttgggccctggaggctgatgggtacttgggggagcaatccctggtgaccccaaccagcaagacaagtgccctgtgaaggggaagggactacagctgatcaaaggagcaggcaccagtggccgggcctcccgtctgcccctcatcctccaggctctggcgggaaggagcaggaagggctccctgcccttggggttttgatcagtgaggaggggggcttgggtctgagtctgggtctgggtctgctgccgaaacactgcccccagtccctctcctcactagactctggggtctaggcgtgtctttgtggtcggccttctccaaaccctctaggcctctgtctgcagctgctgctgcctggacctatacacaaggtcccacccctcaccggggccaaagacgtggttkcaggccctggtggatcctttctgttttgctccatccccgtcccctcttgcrcccagcatcgtcctggtcagaacttccgtttaaaccttccttgcctgccgtgcactccgaggggggcgtcactttgccataggccccagggctgaaaatggcgggacatccagtattgggctcacgtgcataagactgtcccagacagcagcacaatcacgttcagccaagtggagtttccgacgcacttgtgtggcagccgcgtgaatgtgagccgatatgcagctgggaggggttgtgggcctcctgcggtgaggggctcctgccaggagctctgagaagcctccacagaatcagccgtcgggctccttcagcagcagctccccttatctgtgccaacgactgggggcctaactcaagggtgccagcccgtcttccgccaatacagactgtgggattctgagagttaggagcctggggtcccctggggtggggtggtcagggtgagcaggtgggctctgtgagcctgtttccccatgccctgactcaccccaatccctgggtgaggacagagctcctgaaggccactgaaggaggtgcagcacactccacctgggtggccttccgcarctcagccctcttcctgccagcaggaagcctctgcctgtgctccttaagttagccatcctcaccccctccgggcagctctgagactgagccagggccactagcagcacccagacctcgacccttctcagaccgaggcgccaccaccccaggccgaggaggcaaggagggaagaccaaagtctagaggactgtcttggtggccctgggcgagtcttgaactttggtgccatcatctgcaaaagggaggaaagaatgcctgcgtggtgcagctacgtggatacgcagtgaagacccgcatggtgggacgcctggcacttaacaatggtagcatttggccgggcgcggtggctcacgcctgtaatcccagcactttgggaggccgaggcgggcggatcacgaggtcaggagatcragaccatcccggctaaaacggtgaaaccccgtctctactaaaaatacaaaaaattagccgggcgtagtggcgggcgcctgtagtcccagctacttgggaggctgaggcaggagaatggygtgaacccgggaggcggagcttgcagtgagccgagatcccgccactgcactccagcctgggcgacagagcgagactccgtctcaaaaaaaaaaaaaaaaacaatggtagcatcgttttcagtgcccaggaagaaggcagctgggacagggaaagggccaccacaccacacccaagcccatacaacaggagagccactttcagcagctctgagcaggacagacttgtggccaagtcaagaaagtaaggtctggtcccagcgaggtggctcatccctgtaatcccagtgctttgggaggccgaagsgggggcggggtggatcacttgaggtcaggggtttgagaccagcctgaccaacatggtgaaacctcaactctactaaaaatacaaaaattagggccgggcgcagtggctcacgcctgtaatcccagcactttgggaggctgaggcgggcggatcacaaggtcaggagatcgagaccaacgtggctaacacagtgaaaccccatctctactaaaaatacgaaaaaaaaaaattagctgggcgtggtggtgggtacctgtagtcccagctacttgggaggctgaggcaggagaatggcatgaacccgggaggtgaagcttgcagtgagccgagattgtgccactgcactccagcctgggcgacagagcaagactccgtctcaaaaaaaaaaaaaaaaaaaaaaaaagtaaggtctgtatctgctgaccccacccttctccgaagccctctccgagcaaagccttaagaaactcttctctcgttcacttttcttttgtggctttcacgttttggtaagacttggccaaatagctgctcgagataatcaatcactggtggacaagtttctgctgagtgaggtttctgctgagtggggcgactcaaggcacggtcacgtaggcagcacctgtacaccgcatcctcatacagctgcgggaccgtgcctctgactgtgtgcgtgtgtgtttatctaagtgtgagatgcatccgggcatgtcagggtgtgtacatgttgggaagactgtgtagatttcttgtgtgccgctctctgaatggaggagaggggaagcgtcttacctcgctgaatccctttccattgctggaaagaacacctgggcaggagcggccccaagaccccgcccaggccctcggaagggagcctgaagggttaatccgtaccctgtattaaccagggtcaacccagcggctgacccgcctcttccctgctcctttgccgtttctagcacctggcttacttcctggcacacagtgagcactcaataaatgtatgctgagaatgrctgcgagcggcttcctccttggctcctgtgtctctttctccctagatcacacatttctcgcctcttgtctggtgcccaggttccctgtcccttgactgggatgcgttcctgacccccacccctgccaggctgcatttgctggttgatctgcattgccatttgaaggagtgtgggagggcagagcaacaggccttttgggtgggaagaccaaggctgctggtgaattctgcttataaaggaagccccctcggatcacctgaagtcaggagttcgagactagcctgaccaacatggtgaaaccctgtctcttctaaaaatacaaaaagtagccaggcgtggtggcgagcatttccagcactttgggaggccgaggcgggcagatcacgaggtcaggagatcgagaccatcctggctaacatggtgaaaccctgtctctactaaaactacaaaaaatgtccaggtgcggtggctcacgcctgtaatcccagcactttggaaggccgaggcgggcagatcacgagctcaggagatcaagacaatcctggctaacacggtgaaaccccgtctctactaaaaatacaaaaaaktagccgggcgtggtgrcgggyrcctgtactcccagctactcgggaggctgaggcaggagaatggcgtgaacccgggaggcggagcttgcagtgagcggagattataccactgcgctccagcctgggcaacagagcgagactccgtctcaaaaaaaaaaaaagaaaagaaagaaaaaaacattctttgaaggctggcgcatgctctgccttggtccccactctacccccagtgcctagaatcgtgcctggcatggaatagctgctcaataaatatttgggggacgaagtttaaaaagagagagagacagaaataccacagaaaagaagctaaaatagactaagaggctgggagaagagcagagcrgaagatggaaacagtgaaatacagtctccccaggacacccagagatgggttacagggctggctataaccgacgcagtaccaagggtcaaccacccaggggaaaccatgctgagaactggaaccgtgagatccacagacacaatgatgaaagagtggccgggtgccgtggctcatgcctgtaatcctggcactttgggaggc

SEQ ID NO: 13485 - DNA, 16082 bp, Homo sapiens
tcttggggccgggcgtggtggctcacgcccgtaatcccagcactttgggaggctgagttgggtgaatcacctgaggtcaggagtttgagatcaggctggccaacatgacgagaccccatctctactaaaaatacaacaaaattagccgagtgtgctgggatgcacctgtagtyccagctactcgggaggctgaggcaccagaatcactggaacccaggaggcagaggttgcagtgagccgagatggcaccattgcactccagcctgggcgacagagtaagactgtctaaaaaaaaaaaaaaaaaggccgggcgcagtggctcacgcctgtaatcccagcactttgggaggccgaggcggcggatcacgaggtcaggagattgagaccatcctggctaacacagtgaaaccccatctctactaaaaatacaaaaaattagccgggcgtggtggcaggtgcctgtcatcccagctattcgggaggctgaggcaggagaatggtatgaacctgggaggcggagcttgcagtgagccgagatcatgccactgcactccagcctgggcgacagagcaagactctgtctcaaaagaaaaaaaaaaaattcttgggtttcatgaaaggttaggattaaagtgggagagcctcaagcagctgacctaccccactcttccaaatcttttcccaggccttctcccgtctcatcctgattctgcgtgccctacatgtgaacaacgatcgggcaaaagtgatcctgaagccagacaagactactattacagaaccacaccacatctggcccactctgactgacgaagaatggatcaaggtcgaggtgcagctcaaggatctgatcttggctgactacggcaagaaaaacaagtgagcagtgctggtggggacacagacaggaggtctatatacggttttctggggttttttggaagcacttaggcttagaagtttctcaagaaggccaggcgcggtggctcatgcctgtaatcccagcactttgggaggccaaggtgggtagatcatttgaggtcaggagtttgaaaccatcctggccaacgtggtgaaactccgtctctactaaaaatacaaaagttagccgggtgcgatggcgcctacctgtaatcccagctactcgggaggctgaggcaggagaattgcttgaacctgggggcagaggttgcagtgagccgagatcatgccactgcactccagcctgggcgacaagagtgagactgtctccaaaaaaaaaaaaaaaaaagacgtttctcaagaaattatcttgtcttagccaggcttgagtgctcatgctagtaataccagcactttgggaggccaaggtgggaggattgcatgagccaggagttgaaaccagcctgatcaacaagagactgacgccatctctaccaaaaaaaaaaaatttaaaacaggtgtggtggtacacgcttgtagtcccagcttcttggaggctgaggcaggaggcttgcttgagcccgggggtttgaggctgcagtgagccatgatgatgccactgtactccagcctgggtaacagagcgagactcttgtcttgaaaacaaggaaagaaattatcttacagagtctcgaggaagagagatacagcagtgtcttcsaatagtatgggaagcatccctgttttagggcttcagtctgactcttggccattgtttctcactgttgccatttcaaacagggcatttctttactgtccatacatgggaagaattttgaacatccgagaccctaagtatccgagactgctgccaacacacacacacaccttcctcccctcgtctccctccctgtcatcgtggcaaccaaaattatccatagggtgacggacaataccacctctgattaagaaccagtattctagggtttctggggtttccatttctgagaacagttccatgccagagcattgttttggtcaaggaagcgtagggtttatggatgctaaacagtgggaaggtgcacacgcagtgtgctgtcccgcttggatctgacgaatcttggaagtgttagtgcacctccrtttcacacttcctgtagaagcagctcttgtggattgtctggggcgtgagtataggctgtcctgtcctaccaagttacaccctttccattgaggcagaagtgaccaaggggaagggatccttgtaatataacccacaccatccccacagtgtgaacgtggcatcactgacacaatcagaaattcgagacatcatcctgggtatggagatctcggcaccgtcacagcagcggcagcagatcgctgagatcgagaagcagaccaaggaacaatcgcagctgacggcaacacagactcgcactgtcaacaagcatggcgatgagatcatcacctccaccaccagcaactatgagacccagactttctcatccaagactgagtggagggtcaggtactgtcgggcaagagggtggggatggaaaggccggctgcactacctaaggtgctgggctgagcgatgctgacactccctgcctgtttttagggccatctctgctgccaacytgcacctaaggaccaatcacatctatgtttcatctgacgacatcaargagactggctacacctacatccttcccaagaatgtgcttaagaagttcatctgcatatctgaccttcgggcccaagtgagtaagtggactcagctaggccacagtgtgtgcccaactcattttgtgcctaaaactcagacctgagattgtctggaacttgagatgctggtttcaagattcatggatgagtaattatacaaggatagccaaaacaacgaggtgggttttggccccatgagatagcaaaagctgtggcagctgagagaaggtagtaattrtagtattggcctgatagtatttggaagagaacagatatggtcagaaacaaattcctgaccaggtgtgcgtgctggctcatgcctgtaatcccaacactcggctgggcacagtggctaatgcctataatcccagcactttgggaggcctaggtgggtggatcacctgaggtcaggggtttgagaccagcctgaccaatatggtgaaaccctgtctctactaaaaatacaaaaaattagccaggcatggtggcatgcgcccgtagttgyagctactagggaggttgagacaggagaattgcttgaacccgggaggtgaggtggagcttgcagtgagccaagattgcatcactgcactccagcctsggcaacagagcaagaccccgtctaaaaaaacaaaaccaaaaaaaacgtggctgtagtcccagctactcaggaggatgaggttgcttgaacgcaagcagtgagctttgatgaccccactgcactccaggctgggcacagtggctcatgactgtaatcccagcactgtgggaggccgaggtgggcagatcttttgagcccaggagttcgagaccagcctgggcaacatgacgaaatggagtctctacaaaaaaaaaaaaaaaaaactagccaggcatggtggcatacacctgtaatctcagctactcaggaggctgaggtgggaggatcacctgatcctggagggtggtgagtgtagtgagctgagatcatgtcactgcctgctagcctgggtgacagagtgataccctgcttcaaaaaagagaaaagatgcataactttactagtgtatcagggatattatagtttataaaacatcattttgggccaaggtgggtgaatcacttgaggtcaggagttcargaccagcttggccaacgtggcgaaaccccgtctctcttaaatatatgaaaattagcggggcatggtggcatgtgcctgtagtcccagctactcaggaagctgaggcaggagaattgcttgaacccaggaggcggaggtcgcagtgagctgagatcacaccactgcactccagccttgctgacagagtgagactccatctcaaacccactatttagtggctgtcaggttggcaaatttgaaaagattgttaatatcctgtgtgggtgagtttatagtaaacagatcctctttctttcttggtgataatgtaaaacttaaaatagcaccaagtgctggttttccagatgttttcagcttgtgaaaatacactgagctgcatgtgtgctcatttgcttgtgaatactatgcttaataatcagctggggagcttgtgagcagtgcagattcctggaccccactcaggagattctgatgtggtaagtccgcgatgaggtccatgtctaacattttgaacaagcaccccagctgattctgatacagggggttctgatcacgttttaagaaactctgtcctcgttcttgggggaaggaaggaaacagagggctggcagctccaactctgacctggtactaagaagagttttggttcctgacccctttgtctccagattgcaggatacctatatggggtgagcccaccagataacccccaggtgaaggagatccgctgcattgtgatggtgccgcagtggggcactcaccagaccgtgcacctgcctggccagctgccccagcatgagtacctcaaggtaatggggagtgatggagcctgggagtgtggaaaagctggtgcgattcctgtctgtggatgggattcagctctgtactcctctttacctataggagatggaacccttaggttggatccacactcagcccaatgagtccccgcagttatcaccccaggatgtcaccacccaygccaagatcatggctgacaacccatcttgggatggcgagaagaccattatcatcacatgcaggtgggcctgggctccttgggaggaagtatggtggggcagggattgcaggccagggcccagaacagtggcctragctgttactctgtcctcgttcctcccccagcttcacgccaggctcctgtacactgacggcctacaagctgacccccagtggctacgaatggggccgccagaacacagacaagggcaacaaccccaagggctacctgccttcacactatgagagggtgcagatgctgctgtcggaccgtttccttggcttcttcatggtccctgcccagtcctcgtggaactacaacttcatgggtaagtgggaggagcctggggatgtggggatagcagtagggataaggtgaggccatygccctttgcacttggggcctggctggcttggaggtggcgcaggctgcatgaggcaggagccctgttaacattggctgtttccttctccccraaggtgttcggcatgaccccaacatgaaatatgagctacagctggcgaacmccaaagagttstaccacgaggtgcmcrrgccctctcacttmctcaactttgctctcctgcaggagggggaggtttactctgcggatcgggaggacctgtatgccygaccrtttccctgcctcctgcttcagcctcccgaggccgaagcctcagcccctccagacaggccgctgacattcagcagtttggcctctttccctctgtctgtgcttgtgttgttgacctcctgatggcttgtcatcctgaataaaatataataataaattttgtataaatagragttcaggggctggtttgttttttttttcccccccaaactcaaattctggatttaggtctaacaggaggctggactggagcggttcacagcaagatgctgggctcggctgtgaaggggggagtatgaggcccccttcctattcagggctttggggtagatagcccctggactcagtggagacctgaggcagggctgggctttcacactccgctgccttgaccacatttgctgctttttccacaaaactacttggaagctctcgcctcctttccacagttttgggagcagttgccctttcccgggtctaggaactctgtggcttgtgctgagcggctgcggtgtccagcccagccctttaagctttctgtgtcagtcctggtcaggaaaacaagcacacaggcaggcagtttgtgtacagccgggcggaggccagagaccggctgcctacctgtcacctctcgcctggagcgggccactgccaagttggccccatgactccaaacgggcggagcctggattgggcctgtggggagggctccactcaagtgaccacttgcagccctgaacctcagctcttggacgcctggctggaagttggctgtcttgtttcctgtgaccttgggggtggaaaggacagagcccaggcgacctagggcactatctccctaccccacgccttctcccttcctcgttcctccctacccttatcgcttctaccccgcccacaccgccctaaacggcttcctggggcggaactgtttcgcttttccccgtcccagtggagggtggggtgggggggtcgcagccctaagcctctgggagacatggagcccaggagggcggcgcccggggtgcctggctgggggtctcgggaggccgcggggtcggcatcggccgcggagcttgtgtaccatctagcmggggccctgggcactgagctgcaggatctggcgcgccgtttcgggccggaggcggcggccgggctggtgccgctagtggtgcgggcgctggagctcttggaacaggctgccgtggggcccgccccggactcggtgagtcatggccctcccttcgccacccacggggycggcagggccgaagcctgagacccgggtctccccagctgcaggtgtcgrcgcagccggcggagcaggagctgcggcggctgcgggaggagaacgagcgcctccgcagggagctgcgcgcggggccacagggtaagcgcagccccggccagggcagggcgggtgacgacctgctcgggtcctcccctccctcccgcgggccgcgcgccgccgccgctaagaacgccccttcctcagaggagcgcgcgctgctgcggcagctcaaggaggtcacggaccgacagcgggacgaactccgggcgcacaaccgcgacctgcggcagcgcggccaggagaccgaggcggtgagggcggggcggggctctggggcggggcgggggcggagcgtggcaggcgctgggcggggctccgggggcgggggcggagcgaggcaggcgctgggcggggctccggggggccctcggtgccccgcccaccccaccctttgctccgctcccagttgcaggagcagctgcagcgcctcctgctggtgaacgctgagctgcggcacaagctggcggccatgcagacccagctgcgcgccgcgcaggaccgcgagagggagcgccagcagcctggcgaagccgcgactccgcaggctaaagagcgagcgcgggggcaggccgggcggcccgggcaccagcacggacaggagcccgaatgggcgaccgccggcgcaggcgccccagggaaccctgaggacccggtgagtgccgtatgagggcaaggacccagcccaggackcagcgtccagccctcggtgggcactcaagcaaggtttgcatgctgcacagcaggtcggccaggaagcggggaggtggcagacagatctgcgcccccggccggcctcggcccccgctctcagctggagcactgctctgttatctgttagggcacccttgtcccccaagtctcccggcccgtcacttcctctagcattcccatgatggccctggggcgggggaacgccagccgaggcgaccctctgactgtgcctgtccttccaaaggcggaggccgcgcagcagctcgggcgcccctcggaggcagggcagtgccgcttcagtcgggaggagtttgagcagatccttcaggagcggaatgaactcaaagccaaagtgttcctgctcaaggaggaactggcctacttccagcggtgaggacgctgggaagccggggggcctccgatcaccccacctcattctccagtcattgacatgtccacagtgacatgtgccaggcctgcgctgggaactgggaggacatgaattgtacagcccttgccctcctgcaatgtcatccagacaggggagagggacagtacaaagggttgcagctgcagcagccagggaatctctcctaggagggggccacggggccacctaatttaaggtctgagggtgtcagcaaggcagagcgcttcccgtgttcagggaagagctgcgtgcacaggtaccaggagtgaggactgcggctggcatctccactgctggcatccccatggctggcatcaccagggctttctccctccctgccccttttctttagggagctgctcacagaccaccrggtcccyrgccttctgctcgaggccatgaaggtggctgtccggaagcagcggaagaagatcaaggccaagatgttagggacaccagaggaagcagagagcaggtaggtccctgcctgcattcccacggagccaggmctccctccctcattctgctgagcctgatgacccagcctggtcaccctctgagcccattgtctcagactgaggctgtcaccccaacccggtcaccccttgagcctccctagcctggccgcttctagggcctgctgacctgctctggctgtgtcccatggccgctgtccagcctgcgcccttctccctggatctcaccactccccttgccttgcctgccatccattctgcctgacaacactgcctctcyacattcattcttcaagttcctgtcttggctgggtctgtttattcttacgggggtgaaactgtagccgcggctgtgtcagggcctgctgtgtgtcaagctataaaataaacccttggcagggcgcggtggctcacgcctgtaatcccagcactttgagaggctaaggtgggtagatcacctgaggtcaggagttcgagaccagcgtggccaacatggtgaaactccgtctctactaaaaatacaaaaattagccgggcatggtggcatgtgcctataatcccagctactcaggaggctgcggcaggagaatcgcttgaacttgggaggcggaggttgcagtgagctgagatcgcaccactgcactccagcctgggcgacagagtgagaccctgtctcaaaaaaaaaaaaattaaaaattaaaggctcgacatcctgcatctccccagggttgccttctctccagccccgggggccctgcagtccctccatcccccctgctggattcctgttgtccctcagggccttgatcaatggccctcacttctcctctctcctctgtctcagtgaggatgaggctggcccatggatcctgctctccgatgacaagggagaccatcccccayccccggagtccaaaatacagagtttgtatgttggggaaaggggaaaggcaagagtgtggggagggaggaagggccctggctggtccttctcargatcccctttcccgcttctctgcccrtcaccctgctgtgcttggctctaagcacaccgtcccctcctgcttctctggccctggcccccatcaccttcacactccctcaggctgccctttcttccccctctccccttttctcaccaycccctgccctcacccatatccttgacctctctggcttcctggctcaaagtgcctctggctgtctctctccagctttggcctatggtatcggggtaaagctgaatcctctgaggatgagaccagcagccctgcacccagcaagctagggggagaagaggaggcccaaccacagtctccagctcctgatccgccctgttctgccctccacgaacacctttgtctgggggcctcagccgccccagaggcctgacttaggggtctggctgtggaaggatgtgtggcctcaaatgaggacagggctcccgccttcacagccctcgccaggggtctgccccaatcctggcctgcatcagggcaggacggggtctcagcccgcctccctctctacgtctctgtacygagcctctggggccagatataagagtgcctctctgagtctcagtttccccatccatgaaatgagagctgactgcctagctcccagggctttgtgmagacggcctgagctcatgtaataaagaactgcccgtaatacacagaaactgttcctcgcctgtctgtccatgtctgtgccacctcccaaccctgccaggagcagaggcaggctgaggggtcctcgctggtctccttgctcagtcactgggtggggkggcttcttgyagctcaggccttgctttgggagtgtggcctgatggaaagccgtggctcccagcctcagtccacccccttccctggccccggcacccagggacctgcaacttcattcttctggcccttccaggcccaggccagtcagccctgccattgcctttctttccctttctttttttgagtgtcagtctttccagccaccccctccctctcagggaggtgcctcgtggcagcccgcccctcyggcctggtttcctcaggaaaagccctgagaggaagcagkgagggggttgggagctgtgggggccagacgaacccgagcgctcccaccgagctgcctgccatggggctggggctgctgctcccgctgctgctgctctggactcgggggactcaggggtccgagctggaccccaaagggcagcacgtctgtgtggccagcaggtgggtctcgtgggagtctgatgcgtgtggccagcaggtgggtctcgtgggagtctgatgcgggtggctgaaccggtgttgaggccgttaggggaaggaggagactaggaagggggcttaggctgaaaggaagggactgctgatggcggtctggcaggtagtggccagccagggcagatggtggaagggtcagggaaggagaggggaggggctggggaccctagctgtaaagatccattaggcctccccagggggctaaggcagcctcccccactgcagccagagacagtgatccaccttcctcagggccaggctgcaccccccaccatgtccggctgacccctttttgccccacagcccctctgctgagctgcagtgctgcgcaggctggaggcagaaggatcaagaatgcaccatccgtgagtagccaggacagaccctcagccaaggagaagggaggccgtagcccagtgacaacccttccttcctaccccatggggcctgcccctcctgawaccaggagtcagggtttctcctgtgacgcacycccaggcctgaaggggcacctcttgaggaggcatggcccctggagccagtgagagggcaggggtgtcccctggtcctgctcccgtctttccaacctgggtggggtgtctttcagccatctgtgaggggccggacgcctgccagaaagacgaggtgtgtgtgaagccgggcctctgtcgatgcaagcctggattctttggggcccactgcagctcccgtgagtctcaagggccagatgaagttgctgggcagagctgggtacgggggcagtggtgtgggagcaggcgaggcaggtagccatgcagcctcaggacagcagggccagaatcccccccagcttcactgaggaattgcggtccagagacaggaagtgacacacactcccgggagatgacctgagtcaccgggtttttacccacatccacaaagcactgcccacctgagcatcttcctcttccacttctcagaaaacctgtgattccccttcattgtaaaatgagtgtattacttgcctttcccacatataccttatacatgggcagtggatggaagggggcccctggctgggctctctgccctctctggcagaaagagagggaagggaaaggggttgggaagcaggagagccagagggtgggcatcaggaatcaaggaatcactaggggaaaggtggcttctcccgacaccctggcgggcagtatccaggcctgagatcaggagaaagccagctctcctccagcccagcagagatccatctcggcagggaggagcaggcatggaggaaggcccaccaacctcggtgccacgctctgggcaagtcccctgcccactcaggatctctgagtgtgttctggaatgtgaagtggcaggctgagcctcccactaatggctaagggttttctgtaggtcagagcggagcaggaagtgagtgttgcccaggacaggctgccggatgttctgagggtctgtccccggctcttggaggatgggcccagcgccccttttccttgaggaaggggacgcagggtaagggtctgcgcgcggccctgagcccgctgacccctcccgtccccacccccgcaggctgcccgggccagtactggggccccgactgccgtgagagctgcccctgccacccgcacggccagtgcgagccagccacgggcgcgtgccagtgccaggccgaccgctggggagcccgctgcgagttcccgtgcgcctgcggcccccacgggcgctgcgaccccgcgaccggcgtgtgccactgcgaacccggctggtggtcgtccacgtgccgccgcccgtgccagtgcaacaccgcggcggcgcgctgcgagcaggccacgggcgcctgcgtgtgcaagccgggctggtgggggcgccgctgcagcttccgctgcaactgccacggctccccgtgcgagcaggactccggccgctgcgcctgccggccgggctggtggggtcccgaatgccagcagcagtgcgagtgtgtgcggggccgctgcagcgccgcctccggcgagtgcacctgcccgcccggcttccgcggagcgcgctgcgagctgccctgcccggcaggcagccacggggtgcagtgcgcacacaggtgagcgggcggggcggggacaggtgggctggcggggcgggggcggacacaagtgagcaggcggggcggggcggagacaggggggcggggcggagacagggggcggggcgaagacaggtgggcggggcggacaccggtgggcggggcggacaccggtgggcggggcgggcaccggtgggcggggcggacaccggtgggcggggaggggggccggggtggaaactggtgagcgggcagggtgggggcggggcgggcacaggtgagcggtcgggggagggggcggaggcggacacaggtgagcgaggctgcgcggagacctgtgagcgggcggggcggagcggagacaggtggccgcggcggggcgccgggaggaggggtcagggcttcgcggtgctcctctcaaaaaacatacaaagcagaggaacgagaaaggggaaaagtcggataggtggggtggctcacacctgtaatcccagcactttgggaggctgaggcgggtgcatcacctgaggtcaggagttcgagaccatcctggccaacatgctgaaacctcgtctctactaaaaacacaaaaattagccgggctgcgcctgtagtcccaggtattcggtaggctgagacaggagaatcgcttgagccctggaggcggaggttgcagtgagccgaggtcgcaccactgcactccagcctgggccagagagcaagactccgtctcaaacaaaacaaaacaaaaacttttaaaaacgctttgttgccccaggtccagcctcacctgctcatttcattgattactgctgtgcaaaatatactagcactgctagcaagccatatgtaggtaataagtggatcgagtccaacaatgatagactgggttaagaaaatgtggcacatatacaccatggaatactatgcagccataaaaaatgatgagttcatgtcctttgtagggacatggaagaaattggaaatcatcattctcagtaaactatcgcgagaacaaaaaaccaaacaccgcatattctcactcataggtgggagttgaacaatggaatcacatggacacaggaaggggaatatcacactctggggactgttgtggggtggggggaggggggagggatagcattggcagatatacttaatgctagatgacgagctagtgggtgcagcacaccaacatggcacatgtatacgtatgtaactaacctgcacaatgtgcacatgtaccctaaaacttaaagtataataataaaaaaatatatataaatatatttaaaaaaagaaaattaaaaaaatggtttcttacaaaaaaaataataaataagtggatcgagtgaccaagggtcctgagcaaggtccctttagggctcagtggctttcaaactttgactggctgcactcacagtaagaaatttcatccctggctgggcgcggtggctcacgcctgtaatcccagcactttgagaggccgaggcgggcggatcacctgaggtcaggagttcgagaccagcctggctaacatggtgaaacctcgtctctactaaaaatacaaaaattagccgggcatggtgttgggcgcctgtaatcccagctacttgggaggctgaggcaggagaatcacttgaacccgggaggcggaggttgcagtgagccaagatcgcgccactgcacgccagcctgggcgacagagtgagactcagtcttgaagaaaataataataaaataaaataagaaataaaaatgctggtcaggatcagctaaatggcttttataaactgcccttcttctcccctactaatgggtctgacccaagtatatgatcccagctagttaagcatctgagggagaaacttcaggtaactattaggcatcaatgggaaattaagatatggcaaatgtgaaattatattggtgacaacagtggtctccaaccttttggcaccagggactggtttcatggcagacaatttttctattattacactgtaatctataatgaaataataatatgactcaccataatatagaatcagtgggagccctgagcttgctttcccgcagctcgagggtcccatctgggggtgatgggagacagtgacagatcatcaggcattagatcctcgtaaagagcatggaacctggaccctcccgtgcgcagttcacaataggactggcgctcctatgagaatctgaggccaccactgatctggctggcagcggagctcaggcggtcaggctcccctgctggtcatctctacgctgtcgcccagttcctaacatgccacggactagtaccagtccatggcccagggtttgaggacccctgggtgaaaacactttacattttttgcatttcgtgtgatggggtagaagacactactgagtcccattcatgccagacctggggacggctcagtgtggaaaaaggaaaagtgaaaagagcaggagggaaggcctggcagacctcgcaaatgggactcagagcttggtggtgactcgcctgccctggctgggctgctggctcctgatggtcctgggacccagggaaagacggtcacagagcagatgcctggaaggaaagggatgggatcctgtaagagccctcatttgtcctcattgtacaacgtggggaaactgaggctcaaacctgcctgacccaggtgggacccgaacactctccagggcccccgaaggcctgcgtggagtacaggggtaggagggggtgggcgctccatccatccacccccactgttcccacgaagcccttctcttcccagctgtggccgctgcaaacacaatgagccgtgctctccagacacaggcagctgtgagtcctgcgagccgggctggaacgggacccagtgccagcagccctgcctgcctggcacctttggcragagctgcgaacagcagtgccctcactgccgacatggggaggcctgtgagccagatactggccactgtcagcgctgtgaccctggctggctggggcccaggtgagggcaccattctgttcagggtggggtacaccttcccccaggaccctcagctcagcggctctctccgagagcaccaccctccccgacacacaggttcatgcggccccaggggcctccctcctgttgaagactgggggagagcagtgggttctgggggggcctgggcaggatcccagctccctcccctctgaggcttcctgccctcctcgccctctggggacttgtagtctgtcacctgctggatttggccccaagttcaaggccctatttgcacctgagcttcactgctgaggagt

SEQ ID NO: 13486 - DNA, 18097 bp, Homo sapiens
acatggtgaaaccccgtctctactaaaaatacaaaaaattagccgggtgtggtggtgagcacctgtagtcccagctactcaggaggaggcaggagaatcgcttgaacctgggagatgggggttgcagtgagccgagatcatgccactgcactccagcctggatgacagagcgagactccgtctcaaaacaaagcaaagcaaaacaaaacaaaatacacatagaatttgtccaagttattatcacccagtgtgaaaagcagattttatagtataaccgtttttaaatgaggggcctaagagagggcagtggctggttagtcctatgttagatattaacaaatacgtgtaggctggatgtggtaggtgacgcctataatcctcrcaccttcagaggccaaggtgggaggatcacttgactyaggagttccataacagcctgggcaacatagagtccgtctctaaaaaacaaaaaacaaaaacaagtatgtatacagtgcctaccatgttgtcaggggtcagtctcctttattacactttttgtaagaataagccacagtttaccctcacaarcttccattcttggctcaggtattagagtcaggtgccacaggtatataatgaaccggcagatctggaaaggataaagaaattgagagatgagctctgagatcaaggacagtgtttgggggatgakagcttgaactagggaatcagatgaagacatcaacactatgacctggcccacagtaggtgctcagtgaaaatttgtgaattgaatgactggccctcacctccctccacagcttcatctcccactagcttgctctagccatcttctccatgatgttgctccaagcactagtccttgtgcctgtggtggcttccttccctctccactgtctrcagtccccgactgactgtcctcagagggcccagagtcaaccttgtgcagacaaccttgatacttgtgtgccaaggccaggtttccagccacctgagagccactgggtcaggatgcctgtcaggaaggctctgggtccctggggggagggttcaaaggtccagtttacctggagaggactgcggtgactgccccctcctcctcttgcacagcacataggaaagggctgcggtgaggatgaagatgatggccaggaggcacaggacyggcactgtggctgatktcctggctgtgggaccagcatttttttccggctgcttctggttctccccagcctcaggcccarctgccagactgtggcccgcagtgtgaatggtggtttcattgggacgagtgagctctttgtccgaggacagtgatcctactgggagggtggggcgctgagtggactgcaaggtggacaggagcatctgggcaggggtgtggatatctgaagatgccccctctgaggcctgagaarttggggggctggtaggaagtaaatgcttctggtgggccacaatccccgagtaagcatgtccacattctggaaaggaaagaaatgaggaatcaggactatcaggagacaaggtgaaaaagcagatagaggtgtaggggagaaaaagtaatatcttttcctcacccatcgcaagggtcaaggctgatacccctataaataaaaaacattaacaagagaaaagcctaacatttatttaatcacagttttacatgacataggaaccttcagaaacaaagacccgagaaaagtgcatttttatgcttargcttgctgtgaagaatggacagctgtatagacgtatgattggattggccgggcgcggtggttcacgcctgtaatcccagcactttgggagsctgaggtgggtggatcacctgaggtcgggagttcgagaccagtctgaccaacatggagaaacccagtctctactaaaaatacaaaattagccaggcatggtgtcatgtgcctgtaatcccagctacatgggaggctgaggcagaatcgcytgaacccaggaggtggaggttgcagtgagccaagattgcacaactgcaytccagcctgggcaacaagagcgaaactccatctcaaaaaaaaaaaagtatgattggacaaaaaggrtatgatctaatggcaataaatggggggtgggggaccagcaaggcctgtccagattcttcttggcctccaagtatagggcaggacccmtctgaaatgagagcctatgacctacttccacgtgaagttagagaattcctttatggccagctctcacagaaaaacagaaagagcagagtgagctacttacttctgctgttttcktaattaccaaggtgccatgttttggagtgtcatgttctgagctccaacagagggaagagtgagtcagggaggttatcacgctgaaggccagaagaggaaggcagatgacagacggaaaaggtaggggacaaggaagtgagcgaaccacgagacaagtgggtgtcatgaactgggaaatcagaagaccagggttggattccaagctctgctgtaaagtagctgtgtaacctcaagtagctgtgtaacctcaccccttgtccctaacctctccggaagtgatatcttccagctgtaaaatgaggataattgtagtaccaagggccakggttcctgggaggatgaaaggaaatcatagaggtctaggcagacttaaaggcagtatggatgacacagatcctacaaaactttagctaggacatggaagaaccttttgtattttaatggttgtatatttattttaagagaaaaatataaccaatgcatcaaacttgtgacttcacagatattattgcttaggataatttactatttaagttttctttctttttttttgttgcccaggctggagtgcaatggcctgatctcggctcactgcaacctccgcctccaggttcaagtgattctcctgcctcaacctcctgagtagctggaattacaggcacatgccaccatgcctggctaattttgtatttttagtagagatggggttttaccatgttggtcaggctggtctcaaactcctgacctcaggtgatccaccggcctcaacctcccaaagagctaggattayaggagtgagccaccgtcctggcctctacttaagttttcaaaactagtttgtgcacacttaaaagtaattcatttcattgtatgtaaatttgaactcaaaagaaaaaaaagcattaaaatattgaactctacttaatatacatgctgaaatgtcttgggatgaagtgcaatgatgtccrcaatctgccttgaaatgcatcaagaggccgggcactgcggttcacacctgtaatcccagcactttgggaggctgaggcrggtggatcacctgaggtcaggagtttgagaccagcctgaccaacacggtgaaaccccatctctactaaaaaaatacaaaaattagctgggcatggtggcgggcacctgcaatcccagctactcggaaggctgtggcaggagaattgcttgaacctgggaggcggaggctgcagtgagctgagggcaccattgcactccagcctgggcgacagagcaagactccatwaaaaaaaaaaaaaaaaaaaaaaaagaaatgcatcaagaaataaggtgatggatgatggatagaagaatgaatagatggatacttaataaagcaaatatcgtgtaattgctgtaaaattgatagtgtaaaatatatgtttatgtaaatatgtaaaatatacatatataaataaaattgtagaatctaggtggaggcactggatattcagtgtgccattctttcaacttttgtatatgtgtaaattttcataataaaatattggaaaagaaaaataggccaggtgtggtggctcacgcctgtaatcctagcacttttggaggcygaggcgggtggatcacaaggccaggagttcgagaccagcctggccaacatggtgaaaccctgtctctactaaaaatacaaaaattagccaggcttggtggtgcgcgcctgtaatcccagctactcaggaggctgaggcaggagaatctcttgaacctgggaggcagaggttgcagtgagccaagatcgtgccactgcactccagcctgggtgacagagtgagactccatctcaaaaaaataaaataaaatagtactttgatttcaagaaaaatattaataagtagacaatagcacacgtggtagaatgaattggcaaaactcatgaaggtgatggtgaatgatcaccccgtttggcaaacagggactcgagtctaagtactttggacaggatcagaagaaggttctaggaatgtgcggccccaggggaaaaggctcaggtaaagaaaactgtcaggtggaagctgctaagccctggaggcagagcctgaagagcagtggaaaagtctcacctttgagatcaagacagctcatcaattcctgaacccatgggtccttgttgccyccacacacgctccaggaaaggagctggaacctgcggaggagagacctgggcttagctgcggcgccttctttccttccccggctccttcctcattccagaggcgtgamgttgccaccaagaaagagccctttctcctgggactgggaaactccccagtaggtgagacggagtcatgaagtttcggggaatgagagcaaacggaacccggagatggggctcggtgagccgggaaggagttcaggctggaccagagagggtcctggaggcacctgcaaggaggggccgcccaggcgctgccctcgcagaggcaggtraaattacctcgtgtagtatagacaccgatggtaagctctcaggtgtttccggagacgattcatgaactgaaccgatggcggggagtcggaagaaattcttttaccacaataacaacttccagtgacgctgccctcgttgccattgcctgcgcrggacggaggtggtcggcacccattcccaggcccagggtccccactccgctgttccctggcatccaatccacagccccakgacagcctctcggtggacccagggtcagagcgccaggctcaacccacacatcatcacgccccckacaacatccataatcccgcccggagccaggcgtccccgggcctctgtccccaaccccaggcggctggctggctttcctcttgtccccgctgccttcatccactcaactccgtgggcctcgtgtcccctccccaactcacccccttcccgtgacaggggaatctgggtcccctgccccgcccccggctaacctggctgagtcaggtacaccagcaggagcagaagcaggagcaggagcacgcgggacccgggccgcaagtcccgtcccrtctcggggctccgcggactctgcggggatggagccacctcgctctgactcccagacatgctccggcgcgtgacgtccagctggtgtctcaatggctttcgccggggaccggaggagacggcggccggagaggaggcgcgagccagctgcacccmccggccctgctgtgccccgaccgtgckytcagtactcggcccgcgccatgccagcctctggacgcagggaaagccgaggaggtggagctcccgcgccctgcgcccccgcactgggcccggctccgtcgagggaaggccaggaatcttggaagaaaccgaaagaaaactccggcggcgggcgaggaggggcgggaggacgacggcccgaggagccgattcggttcggttcaggaggccgcccgcctggcccgtccgccgacctgtgaggcggctgcactgccggaccggccctcctcctccgaggcactttcacttccccgatccgggcgccgcgggacccagccgcgctgcatgagcctcccgggcggcccggtggagagagtcgccgccagccccggccgcgcgcacctgcggggcagccacccgcggacgcaccgagcccggggggcgtggccgcccgctgagccggcgagggctcgggcagccctgacgtcacaaccgcacccgcgcaccctccaccgcgaggtatttaccttcgaaaagtggtggcggctgcaggtaccggaggagtggggcggccgggaggggctaggtctaccggggctgcccgccacgcagatccgagcccagggaaccccctcgctcccactcccataccccacagacgcatccaaaatgcttccctccccaccaarccgttcccgataggattagccctctctcctctctagccttaatttaaactctgcttttgagggtgtgaactctccaattttaagccccaaataccatctcatccctgagtagtcttctccaaccctggtcacccactttcaagtccagcccccattttcctccctaaactcccatcctcagccctgaaaaatcctcttctccgctcctagcatatccacggatccaaccctaagtgactctcaaacctaccctctccctcaatttgtgacccagccccaaactccatcattgctctcctgtccctcaccatrtatcccttcttttgctcagtctgggccggggccctgtgccgctgaagacatggagtttgtgtctggataccgggatgagttccttgatttcactgcccttctcttcggctggttccgaaagtttgtggcagagcgtggagctgtagggactagccttgagggccgctgccggcagctggaggcccagatcagaaggctaccccaggaccctgccctttgggtgctccatgtcctgcccaaccatagtgtgggcatcagcctggggcaaggggcagaaccaggtcctggaccaggcctggggactgcctggctcctgggagacaaccctccactccacctgcgagacctgagcccctacatcagctttgtcagcctagaggatggggaggaaggggaggaggaagaggaggaagatgaagaagargagaagagagaggacgggggtgcaggcagcacagagaaggtggaaccagaggaggaccgggagctagcccctaccagcagggagtccccccaggaaacaaaccctccaggagagtcagaggaggctgcccgggaggcaggaggtggcaaggatggctgccgagaggacagggtggagaacgaaacaagaccccagaagaggaagggacagaggagtggtaagaacccagggctggccctgccctaccccttgcccagccatcctcccttcggragccctcccctgccactagttctgagtgctggccttcaggccaatctggcctgaaaaggtgtttttattgacccacagtggggtttttttttttaatttaatgtttaaacattgcaagaaaaaaagtatccagaagtctggatttacacattcccaagaaaaatctcaagctctgacagtgggcctacatttctgcatggcagcgcattctggtcctctgtagcagctgtcccctttagaaggagcgtgccctctctacccagagccctttactcagtgaggttacttgcctagccccgtaggtatttgagtttggtactcctgaccctgaccacatttgtctctcgctgccccctaccacctcaacttttccctctttccccagaggctgcccccctgcacgtttcctgtctcttacttgtgacggatgagcatggcaccatcttgggcattgatctgctagtggatggagcccagggaaccgcaagctggggctcagggaccaaggacctggctccttgggcctatgctctcctctgtcacagcatggcctgtcccatgggctctggggatccccgaaagccccgacagcttactgtgggagatgcccggctgcatcggtatagaaatctggtatctgaggctggggaggactcgggccctggattcccaagcacctcctccagcctgatgccatctcccccccaactgcatttagagagctggagagcttggtcccaaggctaggtgtgaagttagccaaaaccccaatgcggacatggggtccccggccaggcttcacctttgcttcccttcgtgctcgaacctgccaygtgtgtcacaggcacagctttgaagcgaagctgacaccttggtgagcagccccaaagctgggggagaggaagaccccaatagrcaaatagaaggaaggcagggtggtggggggcgcctagcagacagaaggagaggcagggacatgagaagatgcagaggaaacaatacagactgttacaggcggttagagggtgtaagacaaacagaccgagtgacatatgggcagctgctgggcagttgaacagcagacaggacctacagaggttaacactaggtgcccaccaccygctgtgtccccagcccccagtgtagtgctgtcttgtattgtggagaggcttgtctccgggctgactggcagcggtgcccagatgatgtgagtcaccgattttggtgcccaaggcttgcagccttcatggagcgggcaggagaactggcaaccctgccttttacctacacygcaggtaccataaggaggtcagaatggttgggggaaactgggaccaggtctttgagactgggaattagatgtctgggaacagggtcctgcagttgaaggctgagtgtctggggctagagcctagatccctggaacaagggcaggggctgggtgtttggggctggagacagggtctctgaagccgaggcctgagtgtctgggtccctgagagmgtgcagggattgggggacagggattcaaacacttacttgcttcccagctccaccactaactgcagtgtgrccttaaacaaaccactttacttcttgaagcttccgtgtcctcatgagggatacggagaaggcccatggaattgttacaaggattatcttggcttggtgcctggtacgctggaggcactcagaaatggtagttcccggcctgactggaaccagacttagaaccagggtcctcgcgggaggctagggagagttcaaggctggggttctaggccgggcaatggttcacacccgtaatcccagcactttgggaggccaacttgagcccaggaatttgagatcagcctgggcaacatagactctgtctctacaaaaaatagaaaaaattagtcaggcatggkgcactcgcttgtggtcacaattctcgggagactgaggtgggagaatcgtttgagtccaagaggtcgaggctgtagtgtyccgtgatcacgccactgcactctagcttgggtgatagagcaagactctgtctcaaaaaaaaaaaaatgtctggggttctagcccagcacctcaactcctccccttctccttctccagaggtgaccagtgaaaccttcaacaaagaggccttcctggcctctcggggcctcactcrtggctattggacccagctcagcatgctgattccaggcccgggcttctccagacacccccgaggcaacacgccatccctcagccttcttcgcggtggtgcgtggggtctctccaggcrtgggccccttggcctagagggaaggactgggaagaagttgtctgggtcccagatgatccctccacatacacactgacccctaccaacagcaccagggccatttcaggcctttcccagccctcaatggaatcacccctaccaactccacccagaaaccccatccctatgcaaacccccattcctcttactgcggctgtctcagggaatacagcccctttggaaggaagaargaratgggtcaggtgggggtctccctgaccccaggcccctcyttctttcatcctctcaggagacccctaccagcttctccagggagacgggactgccctgatgcctcctgtgcccccacatccaccccggggtgtttttggtgagctggaggggccctgtggaagctaggggtagggccagggactggagaaccagagcctgggtggctgtgaagaagaggtttgttagactagarggggtggsggtccagggccaggtcctctagcaaccctctcctgccaggctcatggcaggattactacacatggcggggcctcagcttggactcccccatagccgtgcttctcacctacccgctgaccgtgtactacgtcatcacccacctggtgccccagtcctgtaaggagagcggagtggggggtggagcaggatgggggagtgagagtggaccacatccttaaagcgctggtttttcacccagtccctgagctcaacatccaaaacaaacagtcactgaagatccacgtggtggaggccgggaaggagtttgaccttgtcatggtgttttgggtaagtcaccccaggcctgaaggttgggcattttggtatgggggtgggcacagggtagaccccagatctttctttctttctgtccttcaggagcttttggtcctgctcccccatgtggccctggagctgcagtttgtaggtgatggcctgccccccgaaagcgacgagcagcattttaccctgcagagggtgagggctgagggggccctgcttttcagccctgacccctccagtgacctcctggttgggtcctgcccttctgccccccactccccatcttgcctggtgcatcctccagttccctgacttccagtggcttttccaccccactcctggggcccctcaggacagcctggaggtgtctgtccggcctggttccggcatatcagcacggcccagctctggcactaaggagaaagggggccgcagggacctgcagatcaaggtgtcagcaaggccctaccacctgttccaggggcccaagcctgacctggttattggtaaaagcctgggtctcagggttaggcatgtggggaaggtgggagagaagcccaccgtgggagccagcttctccctcctctctgtctgcaggatttaactcygggtttgctctcaaggatacgtggctgaggtctctgccccggttacaggtgggcaatgggggcaaaagggaacttctctcccctcckgcctggcccctccccatctccttttctgaaagtctctgggctctcctcctcttcaccatcacctgctccacaaacctggggagtgcccacgggtccccctgcctctctctgtgtctgtctccgtcctccccctgctcccctccgcccggtctgtccggggacctcggctttcagcccggtctgtcattctggctgctgggatggatttggggaggggcctctcagagcgactctcgctccaccccagtccctccgagtgccagccttcttcaccgagagcagcgagtacagctgtgtgatggacggccagaccatggcggtggccactggagggggcaccagccctccccagcccaaccccttccgctccccctttcgcctcagagcggccgacaactgcatgtcctggtaagggtctgcgaccctatttccttcctgacccttaacttctcttactctctggctccacatcctcgaaggcccacctctaccctagtccctgctgtcctggggccctcctgcccccagcccagcaacctgccttctctgtccccactactcgtcgccccsatgggaggtctcgacatcccccagcacacccctctttagatctagctcacggaatctccccaacccacaaaagaccccgcgaccctccaacagacccaaccctgagtctagccccacgccctggaactcagaggggcaagccccgccccctggtccctgaccgcccggtggagccccgccccctggtccctgaccgcgcccctgggagccccgacccctgggagcgccgacccctgggagtcccgccccgtggtccctgactgcgccccgcgcccccgcaggtactgcaatgccttcatcttccacctggtttacaagcctgctcaagggagcggggcccgcccggcgcccgggcccccacccccatccccaactccctctgctcctcctgcccccacccgaaggcgccgaggagaaaagaaacctgggcggggggcccgccggcggaaatgaatgctgataccctagtagtccccagctcccaaacactgaaaggaaaacgtgaaaacactcaaggcctagggggaggacaggttggtaaaacaygaaaaggtaaataaaattacttgtttgaaaccactgagtcatggatcttttgattacacgctcataattgggccattaaactgggaacgaagagaaagatttttttgtttgtttgttttttgagacggagtttccctcttgtcaccgaggctggagtgcaggggacacgatctcggctcactgcaacctctgcctcccgggttaaagcgattctcctgcctcaccctccggagctgggattacatgcatgcgccaccacacccggctaatttttgtatttttagtagagacagggtttcgccatattggccaggctggtctcgaactcctgacctcaggtgatccgcccgcatcggaaaaggagttagggatgacttactttcccccagacccttttagtcccctcracggctgtcatttctttaactcacagtcagggattgtgaccctccttggtaatcccatggttctcctaattatgtgttggctagtcactttccagccccggtaaccctcagggaccggccccaaggcaaggaaagtggcttcttcctgggggcgggagaagcaatcaacctcctgggaccacacagatccttggtttggattcagtgaaaggccccagccacccaactccaccttttctcaccacctcgtattcaataatcaactcctgctgagctcttctgaaatcactcaagtccatcaaggtatgtccattcctgctgcaaactccaccgtatctcatcgccacattgcagcccagagtattcctcctcaaaaaaagacatctgagggccgggcacggtggctcacgcctataatcccagcactttgggaggccgaggcaggtggatcacctgaagtcaggagttcgagaccagcctggccaacatggagaaaaccccgtctctactaaaaatacaaaattagccgggcatggtggcacatgcctgtaatcccagctacttgggaggctgaggcaggagaatcgtttgaacctgggaggcggaggttgcagtgagccgagatcgcgtcattgcactccagcctgggggacaagagtgaaactccatctcaaaaaaaaaaaaaaaagaaaagaaaagaaattaaccgggtgtggtggcatgggcctgtaatcccagctactcaggtggttgaggcaggagaatcatttgaacctgagaggtggaggtggcagccaagatcgcgccactgcactccagcctgggtgacagagtgagactctgtctcaaaaaaaaaaaaaaaagacatctgacctcatttctccctcgcttcagtcccttcagtgacttcccttagctcttaacagtgtgggctgcccttaatgacttcagtcactgagtatagatagggaaaaacagaggagaaacctggcagataccaccttaaccaagggattaaggtgaacaattaagtcctgttgatgttactcttttttttttttgagaaggagtcttgctcagtcgcccaggctggagtgcagtggtgcaatctcggctcactgcaacctccgcctcctgggttcacgcaattctcctgcctcagcctcccaagtagctgagactacaggcgcacgccaccacgcccagctaatttttgtatttttagtagagacagggtttcaccatgtcggccaggatggtctcaatctcttgacctcgtgatccgcctgcctcggcctcccaaagtgctgggattataggcgtgagccaccgcacccagccctgttgatgttactcttaagtctctttcattttgtaacatacctccttggcttttattttttatttcatgacactgatttgacaagacacagaatcatttgtcccgtaaaatgttcctcactcaggagctggctgattacttcctcagggtgttttttcatgtgttcatttatcttcttcagttcctgtcaaccagtagttagatcgagatgacaaggttctgctgatgtggtccctgccaacctctgcaggctgatctcatgccatttccttcccctgtcaactctgcagccagatgcttctaaataaagacgcgctctctcactgtggaacttcccatgtgttttttgttttgttttgtttttgagatggagtttcgctcttattgcccaggatggagtacagtggtacaatcttggctcactgcaacctccgcctcccgggttcaagtggttctcctgcctcagcctcccaagtagctaggactacaagcgcctgccaccacgtgcagctaatttttgtatttttggtagagacggggtttcaccatgttggccgggctggtctccaactcttgacctcaggtgatccacccacctcggcctcccaaactgctgggattacaggtgtgagccactgcacctggccagaacttcccatgttcttgctcaactaattcttagcctaggtggcagcctaaatgtcacttccttaggaaaggaagcatttcctgacccccagatgaggttagacacccctctccctattaagccctcatagcaccttgcatatgccctttgatgacctttatcacacaatttcttgtctaccctttcaayggtcaacccagaaggggtgggtgctacctctatcccccagggtctagcctggccgggcatatggcagcatacagtaggagctcgttaactgcttatcagattgctttccccccatactttcaaccctccctcctcatcttttctctcagcttcacctcctacagccagaaaggggaagcctgggtctctcgtggactgaggagaaatagaccttttcaccactccgttggccaaaaaataagcttttcctaactcctgacatctattacataacaataggaaaggatgtggttatctcccagtggtggggttactaaggatttgtttattcattttatttagctggactgctcatttttcttccatgaacacaagtrcttttgtaataaaaatgcttaatatacaaattgctctttaataattcacttaccaactattsattgaatacacaaggctttgtgccgaaccttagcgacgcaatggggaaaaaagacacataatggtctctgcctccataaagcttacagtttagggcagggatcagtaaactacggcttccagccaaatgtagcccaccttttgtttttgcatggctcgtaatctaataatcagatttcacagccgggctcatgcctgtaatcccatcacgcctgtaatcccagcactytgggcgcccgaggcaggcggwtcacgagttcaggagatcgagaccatcctgkctaacacggtgaaaccccgtctctactaaaaatacaaaaacaaaaaattagccgggcttggtggcgggtacctgtagtcccagctacttgggaggctgaggcgagagaatggcgtgaacccaggaggcagagcttgcggtgagccgagattgcgccactgcactccagcctgggtgacagagcgagactccgtctcaaaaaaaaaaaaaaagaagatttcacgagaaaattattcgaaattcaaattacagkgtctataaatttatattgaagcagagccacaaccatttctttctgtattgtccgtggttactttctggatgcaaacggcagggtttgagtgccgcaattgcagcagaatccctatatgacctacaacgtctgaaatatttatgaacagatcctttgcagaaagtctgccagcccctagtccaggacaagatttccaaaatgcaggtttatacaattttgtgtggatcatgaagtcaatttagtgagcctcaagcagcatctttttttaatgaaatagaatagataaaaatatgtatcacatgtataattaataactattttgtgaaacatttgttatacatacgatatatgcttatatgtgtatgtgctgcatcctgatgtaaaatgtatttcttactgtggaccatgttcaaagcatctgaaaggctgggtgcagtggcctgtaaacccagcactttgggaggctgacgttgtrggatcacttgaggtcaggagttcaagaccagcctgggcaacatattgagacttcatctctactttttaaaaaaaaaaatctgaaggtgtctggcttagagggaagcctggaataaacagagaagtaagcagaaaataacagtacagtgtaattggtgcaatgatgagttacagacccttagggtatatcagaggcacttaagacagcctcagggctgtcagtgaaggctaccaggaggaaatgacacccaaacagtgacctgaaggacacgtaagagttagacaggtaaagaagagaagagccgccgggtgcagtggctcacgcctgtaatcccagcactttgggaggctgaagtgggtggatctcaaggtcaggagttcaagatcagcttggccaagatggtgaaaccctgtctctactaaaaatacaaaaattagccaggcgtggtagcaggtgcctgtaatcccagctacttgggaggctgaggcagagaattgcttgaacccaggaggcagaggttgcagtgagctgagatcacaccactgcactccagcctgggcaatagagcaagactccatctcaagaaaaaaaaaaaaaaaaagaagtgtggtgggatgggaagggcagcatggatctgtttgggatgctagtctcaacccagcctcatggactgacgtctgagccctgcaagaggaaccacaggcagaggctgaaggaagagtcactgtatagagcctctggaaggtcagcagggcacaaacaccacagcacagcacctaaatccccggaatcrgtgtcacacggggggcagggatccccccatttctcaggggacacagtgtggttttgagaggcattgagaatcccaaggaacccaaaaatgtggctctgtatgacttcaatcgtttttcttttttcttttatttttttgagacagagtttcgctcttgtcgcccaggctggagtgcaatggtgcaatctcgkctcactgcaacctccgcctcccgggttcaagcgattcttctgcctcagcctacctagtagctgagattacaggcatgcatcaccacgcctggctaattttgtgtttttgtgggtttttttgttttgtttttgctttcttgggttttgttttgttttgttttgttttgtttttgtttttgtttttgttttgagactacaagcgcccgccaccgcacctggctaatttttttcttttcgtgcttttagtagagatggggtttcaccgtgttagccaggatggcctcgatctcctgacctcgtgatctgcccgcctcggcctcccaaagtgctgggattacaggcttgagccaccgtgcccggtctaattttgtatttttagcacagatagggtttcaccatgttgcccaggctagtctcgaactcccgtcctcagsggatccaccctccgtggcctcccaaagtgcttagattacaggcgtgagccacagcgcctggccaatttcaattttttaaaatgtattggggttggtttgatggcccgggatatatgcactatattggtatctgttgcatgagtacttgaatacgtattctcctgtcattgggtggaatgatctataagtattcactacatcctgtttgtttatgacattgttgagttcttctatctccttactggtttttgtctagttgttcaatcaattgctgacaggtgaaccatgaactatgaatttaaacaaacctggtttgaaactggactcatctggttactagctgggtggtcacgagcagatttagaattagactctggagaaactcttctgagatccaaactttactggtctgacatggaaattacaagtagcaaacgttcatatagcgcttactctgtgccagactgtgttctaatcacttggcatttatcagtctattcctcacacaacaaacttaagtcaggtgtttattaccccccattttacagatgagaaaactgaggcacagggaggtgaagataaa

SEQ ID NO: 13487 - DNA, 41309 bp, Homo sapiens
cacccgactattttttttttgtatttttatttttatttaatttttatttatttatattttttaattttttttttgagacggagtctcgctctgtcacccaggctggagtgcaatggcacaatctcagctcgctgcaagctctgcctcctgggttcatgccattctcctgcctcagcctcccgagtagctgggaccactggtgaccaccaccacgcctggctaattttttgtatttttagtagagatggggtttcaccatgttagccaggatggtctcaatctcctgacctcgtgatctgcccgcctcggcctcccaaagtgctgggattacaggcatgagccaccgtgcccagccgttttatttatttatttttgagacggagttttgctctcattgcccaggctggagtgcaatggtgcgatcttggctcaccacaacctccatctcctgggttcaagcaattctcctgcctcagcctcctgagtagctgggattacaggcatgtgccaccatgcccggctaattttgtatttttagtagagacggggtttctccacgttggtcaggctggtctcgaactcccaacctcaggtgatctgcctgccttggcctcccaaagtgctgggattacaggattacaggcatgagccactgcggctgaccttttttttttttttttttttttttgtatttttagtagagatggggtttcactatgttgccaggttggtcttgaactcctgacctcatgatctgctagcctcggcctcccaaagtgctgggattacaggcgtaagccaccacacccascctgtaatttcttttacaattargtaagtagcctgtagagtgatactttgatggcatttcccagcaatctttcatctaaaggttttgaagtccattgatagtccttgtctgagtcaattatttcattaaggtttgcatcatggttattgtctaattctatattttattttatacttattagctggcatcctatagtaaagaagagtttttcctcatcaactgggtataaaccacattctttattaaaaaaaaaaagaaaaaaaaagcagggtaggttgggagcagtggcccatgcctgtactcccagcgctttgggaggttgaggtgggagcatcacttgagcccaggagttcaagaccagcctgggcaacatagcaagaccccatctctaaaaaaacaaaaaagcaagcaaaaacacttagcmaggtatggtggcaggcacctgtagtyccagcttctgacgaggcacgaggatcacttgagcccaggaggtcaagactgcagtgagccatgtttgtgccactgcactccagcctggatgacagagcaagactctgtcttaaaaacaaaaacaaatgaaacaaaaaacaaacagggtaaatgctatctccctttaataactaattttcagagtatcaaattggtgtaatagacactaccaatgatggaaaaatagtttccctcttctcattctctcttctctgtactagagagtagacttttatttattcagtatttgcaatcaattgtattcattttctttttgacgctaaaattgccctaaatttgccccctgggagatccttcaagctggctcccatgtctctaaaatttatttttgagagactgaaaatacaaatggtaaatggccagaatatacataaaaacagaattctgacccattacctacaacaactagcccagtaaaccaaccacttatttaccataagtgtactctcagcctgaaagccaaacctgctatcaaccagacttgtaggaagtcagactgctatctctggtagcaatccaggaagctaaataataacttctatgacaatcagctcaaaatggccaggacttgattaaaacttgacagcttccctactttttgtcctcacttctagcttatgcccatccagagaaagccaaatatgctcctttarccaagaccataggatgccaacttgtagttagcttccagcttccccatgccaacagcttccaatcaggcatacctgtgaaacctttccttttgtccactgtaaagctttcccactcctctgcatgcctttgaacctctgctaaaacataagggatggtggctgactcccttgctacagcaagttctcaatcgactttgcttttctcatttggtttgcaataaaatgcattctttacagtgacacaatttgatgaattttgacaaacgtatacattcccactaaccatgacacagaacatttccatcacccccaaaagttctcccrttttcctttccagtcaattccttctctcttcccctcctaaccaaccactgatctgctatctaccactatggattagtgttgtttgttctcctaactacagttggcatagcctcattggtctaagcacttcctctgcattcaggcacaacgaaatacctggctcatcttgtacctttcccgtcccagagctggaatcagccagttctccaaaggagctctggatctttttagtgggaaatggaatttagaaaccaagatctcagtgtcagatgtgctcactgttactgtagggtgcccatgcctatacatcctggttcagccaggactgttccagttttaatctgaaagtccagcatccagagaaaacccctctgtttgtggcaaactagaacaactggtcaccctagtgcttctaggccctttcagtccacagaactaggacttttttttgcagttgaaacttttttttctttttgatagggtctgttgcccaagctgtagtgcactggtgagatcacagctcattgtaactttaaactcctgggctcatttgggcctctcgcctcagcctcccaagtagctaggactataggcacaggccaccacccctggctattttattattttgtattttgtagagacaagatctcactgtgttgcccaggctggtcttgaactcctaagccactttggcttcccaaagcactgggattacaggtgtgtgccactgcacccagccctccagtttaaactcaatactacagactttttttttctgaacttcttaaaattctttatattagtttccacccccacccccggatgaatgaacgtcttaaaaattgttttaaattttttaaaaaatggagacagggtcttgctatgttgcccaggctggtctcaaactcctggactctagtgatcctcccgctttggcctatcaaagtgctgggattacaggcatcagccacccggcccttttctgaacttctttgatcttgtgtttgtatctcattctctcayacactgcacatctttgtatatagtaacattaaaatacttatgttatcctaccatatacagtacagagttttaaaaccacagtaacaatgttaccattaatcataaatcagtgaagctgaaagctcctgtgcacttttttcatccttagaatacacagttgacccttgaacaacactggtttggactgccagggtccacctatatgtggatttttttcaccccaacacagatgaaaaatacagtggggcgagggacggtggctcacacctataatcccagcattttgggaggctaggtgggaggatcacttgagcccaggagttcaagaccagcctaggcaacacagctctctactgaaaatagaaaaaaattagctagatgtgctggcacatgcctgtggtcccagctactcgggaggctgagatgggaggattgcttgagcccaggaagtcaaggctgtagtgagccatgatcgtaccactgcactccagcctggacgacagagtcagaccctgttctcaaaaaagaaaaaaaaaaagaaaagcaagagaagggaaggaagggaggggggaagagagggagggagggaagaagggagggaagaagagagggagagaaagaaaaaaagaaaagaaaaagaaaggaaagggaaggaaggaagaaaacaaaacagaagtacagtgggatgcaaaacacacctacacaaagaaccaactttccctatgctcagctccgggactttagtatgcagatttctgtatatgctcgcagaaggtcctaaatccaatctcctgcatataaggaaagactacactatcacaacacagatacactactagagtactgtgttcaaaagctcrgaggggccagtggtggtggttcattcctgtaatcccagcactttgggaggccaacctgcaggcggatcamctgaggtcaggagttccagaccagcctggccaacatggtgaaatcccatctctattaaaaatacaaaaatcagcaggggatggtggcgcatgcctgtaatcccagctattcaggaggctgagctgagagaatcgcttgaacccaggagacagaggttgcagtgagctgagattgcaccamtgcactccagcctgggcaacacagtgagactgtctcaaaaaaaaaaaaaaaaacccaaagaataattattttttctgkgtatcttagttatattagttaacagttaagttcatttgtttcaatttgctttcaaccttaggatttactttgtttccttttttatttacttttttggctatgtaaaactaaaagttcaaagacagagaaatcttgtctccaccccccactctttataggcaactaaaaatgttaagtttccaggatatccttccaattcctccccgaaaataagcatatacacataaatattcatattaaatataaatatatatttttatgtatttaagtaaatacataaaagcatatatgcttatttttgcttttgaatacagtgaatacttactacacttaaatatttaagtgaatacttaatacaacctgagactcattccaaagcaacacacgattatttcctgaatctttttaatggttgcattgtgttctactgtatggatgcaccattcccaatcagttccctattaacggatatttgggttatccctaacttttgctatgacaaatagcactgcaataaccttgtatacctattgtttccatgtgtggagctgcaccttcagaataaggttagggttagaagtataactgcaaggtataagaataaacacaagtaattttgtactccgtggaacttgaaccatttttccactcccaccaggaaaggtaatttcaacgtgtatttccattgtaagtgaggtggagcgactttctatgtttaaagaccattacggtattttttctgagaatcatctgttcatgtccttccccattttctcctttggcttttgcactttttgttttcaatttttgagagctcttgtgatacgagttgcaaagattttctccagaccgatctgattcactggaaatatactacgaccatctggartgtactttaatcttatcctaataaatcaccttactacaagacactcctttggggatgaacaggttygataaagccggctaaggacagaccaatcaaaagaattacgtgctcttctagtaagtgtttagagactgtttcacgttctccaggtaacaccgccattactcggcggtccagatggcagtcttrcttcarggagtctactccacttgcaggacctctttgattgagttcactaaacctcacagggccgccttcccmgtgttccagttagcaaggggccctcaacgccgcggacacagcgcaacctccgacgccagagaacaatagctcctcgatgcgtctccagagatgtcaaggaggaacgaacccagcggccaggagactgcgcctcacgactgatgagagggaaggcatcggtttctaagttctcaaaacttacaggtgagcttctgctaagagtaaacgcccgcggctcgccgcccacggcctctctcttgaggtggcacctggtcctccgacacgcggaagcatcacggatgagcgtcacgaacacagagcggccaatcacgcgccgccttcgcccagatccctccgcacgaggcagccccgcagccgcaggtggccccggcgagtacttccaccttcccttcccgtgatgccctggggctgacctccgacctcgctggcccgcccctcccctcggccgcttcccttactgagcttgctgagctccggggcccgcggagctcgcgccaggctcctgggaaaggacggggagtgttaccggggagcagctgctccattgtgcctcgaggccccgatcgggctaggccgacggcctccctcccttcacctttcctctcctggcggggttcggcggcgggcgagtgactgcggccacgcytgaaaggcgactctcctgtgagtgggccagaaggcgaacatggcggagcggggaggctggcgggaggcgggaggcgggaggcgggaggcaktggcgctggcctgcggcgcgttcggaccggctgtggggcggggcagggcggagcggagccgtgcggcggggcggggccgggcggcggggcctggtttcctccctcagcgccattttgtggcagcgagacccacaaataaaggggagcgcaggggttgcggcgggactaggagcgcggcggggccggcggcagagctgtccggctgcgcggtggcccggggggcccgggcggcagggcaagcagcgcggcctcggcctatgcgaccggtggcgccggcgcggcttctgcctggagaggtaggygcgggccggctggcgggagcggacgcgggggacctccggggcctgagggctgatgcgcagccgcccccggcgggtaaggggcgggcagggcccgaaaggccacacgggcctggtgcggcaccggtctctcgtgagccgctctaccttcccgcctgcggggaacacttccgccgcttcgaggccattttatctcygtcctccgtccccaaggcccgggttgagaggggtgctctggcggccggagagaccggccactcasggaggccggaggatgccctccccgggctgagcggcggcgctcgttttttcctcgcctcggggtcgcccccttcacctcccttgggcctctcctgaggacctggcggcactaacgagttcagcaaggaaaaaaagaaacattcgttccctacatttcatgtcacgcagtaggatgttactacgttctcttgtagacttccatttttaaatgagtataagcattctgaggaaagaaactgaattattgcagatttttgtgaaatccaagtcttaccttggatccctgtgagacagttactagatttttttttcaccgtttttcataagtctgtgtacacgtaatggaaaagcccgagttcttgttttgataagaaagtcacttggttgtttgatcccaaaggattagcttaacattatcaaggactagcataactgtgattatgtaaaaaaaacaaaacaaaacaaaaaaactattatttagtctggtagggaaatacttctatgagtatgttacaattggaagttgtatttgtgcctattttatctagttttagttaattccattgcttcggaagataagtggacgtcatagatccatcgcaagttctcgttttttggattttaaaattttgaccattaagttttctacgatagataaacatgttgtggacatttaaaaccgtaatttaaaactatgagcgaaaaatcttttcaagatggatacattttaattcattcaagtagcatctgattagccaagtcggggaaagattgcagtccgcaaagctggcttgtgataaggttgaggttacattttaagggtttgggtaggtgtgtttcttacagtgcttttatatgttaaggtatcttaagcagacacatggtttaaaagttcagtatttttagtactttttcattggcagaatttggacaagctaccagaattgctaactcctaaaggataaaagtaataataatagtgtgtcccaggcactgcttatttttacatggctcttttatgtctagcttttccaattcaacgttgagtcatgtttgctgaaaatatttttgtgtattgtttgtcagaaataagctggtagagatgaaacacaatgtgtaaaaagccctgtgatgtggagatgagcattgtcacaatttgtacagtacattaaagcgttcaaggtctcttatggtcttgtatgtagtattgaatccccttgaatatattgtttagcagttttgatcattatgtatttgcttcttgctcctcaaaattgtaygttagttagtaggtccttcagcaaaagaagactgaagatagtattttggttttattcttgtttttaatttttttagttgtctccaacttttctgcctctaaatattttgcttcttgtagttactaagcttaacacagaaaaacttttcagtatctccacaatagtaaacttcattgtgtattgtgtataacaagatgttccatctgactaaaatatattgctgtaaatattttctgcctttgaagatgtagttaatagaatttaatcttttctaagtgcacattgaagttgccttttatgttcatattatgttcatattttatttgaaaaatckatagcatttttattgtgctgaaagcattaatatttgcagcactttgtgagacaggcaaaattatctttttgctgacttggaaactgcaagagttaaaagacttgcttggaatcacacatggcagatagaggataaggaaaagatggcctttcagttcctcatcagtaccttgctactacagtgtctgcagattggtgtcttacattcagctatgatttgttygccaaggtaccgtgtcttcttactgaagttgttttggctggcgcttgcctccgttcagagggaactgagttacctaactttatgatgctaagagccaggaaggtactgggatctgggatgctaggcacctaaccagtctagactgaactccatactaagctgtttttctgtgttaaggcatcaagagtagatggtggtcctgattttctgagatatattatctctgaattatctacataaataactgaaacttttatgtaattttaaaactagtcaatcatgttaccacccttttgaggggcaccaaatttgagacccttacccccaatttattaattaatagctgttttaatcacctaatagctgatcacctaatgactaacagtcattttcatcctggaaaatgggaactaactttgactttgaaaagtgctgttattaaatgtgtgattcataagaactgaacatattttctttattattttcsttcaggattcaactttaattgactccaaatgatgttatggtcattctgtttttctgatacgagaatagattgttctgagaacctagaatattcattgcctttatgaatctagaattgactttaaatttaggttattgtgtttgtcatttgcgctaaaaaaaaaattgccctggggaataccaaacttctcggtacattcgtgtggtgtgaaagtcaaaattgccaattaggttctattttgaccaaatagttgaatgttgtagacagttgtaaattttgaacctgttctaatttgccttttgccagatggcgcatttaactttgtggcatatcatcgactttcaaggaaagatttacttttcatcagattaaagttgaggaaggattttctttctaaatactgaggctctgaatttcccaagttggataccccagacagctagagtgatcttaaaagtgactctgagagttgacttaggaagtgtagacatttatccaaaatctgtatttactcctgacttacattacaaatacagagttttatttttaaagaaaatttcaataaaaagcaccatttaattaaaatctactcaccatcaaactttttaaaaagaacataagccaatgtcaggagttggagaccagcctggccaacatagtgaaacgctgtctctactagaaaaaaaaaagaaatacaaaaattagctgggcatggtggtgcgtgcctgtagttccagctccttgggaggctgaggcagtagaatcgcttgaacccgggaggcggaggttgcagtgagcccagatcatgcccgtgcactccagcctgggcaacagagagagactacgtctcaaaaaaaagaaaaaaagaaaagaaatttcaataattgcaggctgggcatggtggctcacaactgtagtcccagcacttttggaggcccaagcaggaggattcctgagcccaggagttcaagaccagcctgggcaacatagcaagacctcatctctactaccaagaaaaaaaaaacaaattagctgggcgtggtggttcatgcctgtgatcccagctacaaaggaggctgaggcaagaggatcagttgagcccaagagatggaggctgcagtgagctgtgatcgagtcactgcactccagcctgggcgacagagtgagactctgtctcaaaaaaagagaggaaaaaaagaaaatttaagtaacttctgtttagaatcctaaatattggagatgccaaagaattctgcagtaagtgttagaaacagtcgggaggacagtatgattattatcctcaacctgtggattatctcttcaggtttttcaagaaacactgagtctgtgtttttgatggggagaagaaactattaattaaatgcccattttgtgccagttaccatgctaaagattaatgtctgtcttcagaaatagcacagtatttgggcccyggttgtggtaattctttttgagatggggaaactgaggtgcagagattttgctacttttgtatttgcaaagttgacaacctgtttcagaataccaaggttatcagaactttcttcatgtgtttctcagtccttttaatgccctttaaaaacagattatcatctcattttttgctaagcttactgttaattttattttagtggaataagaatatggatacctgtctttaagaagagagtaagcaagtaaacctagggaaagtatcaggttgtagaaccacataccgatgatccttgccaaaatcctggcataggaatttgaaccctggtgtatgaaaagtctgccctttgcatactcaggtttcgcatcccgtgaatgctgtatttttgatycgagtactgtattttttaatctgagtttgattgaaaaaaatccaaatataaatggacccatgcagctaaaacctgggttggtcaaggaccaactataataacttttataagctggaatttatattgaacagcatccatgatactttagtattacaactaaagttgtacatactgagtaggtaggatgccttagtaactagataaaasgtataccacctagccatagtgataaatatagctgttttcaaactgtcattcacagatctctaccacagtacctgttacrtgaagttcctggttggttctcaaaattttatgttcgtatatacatagatacagatactgatataccggttaaatatgtacagctcaaatagctaaaattgtctttaagattttttaaattaaaaatattattggccgggygcagtagcttacacctgtaatcccaacactttgggaggccaaagcaggtggattacctgaggtgaggagttcgagaccagcctggtcaacatggtgaaactaaaaatacaaaaattagccgggcgtggtggcaggcacctgtaatctcagctactctggaggctgaggcaggagaatcgcttgaatccaggcggtggaggttgcagtgagccgagatcgcgccattgcactccagcctgggcaacagagaccgggcgcagggggagggggagtgtctctgtctgcttctttctctctctctctctctctctctgtatatatatatagtgtgtgtgtgtgtgtgtgtgtgtgtgtgtgtaaaattgatatttagctccagacaaatgggaaattacaaggaaatgccagatttgatatctgggttctaagactttgcagcctaatgcatgtgtcatgctaaaatagaagtagttagacatgtggagttaaatatggtgatggtttctsagatgattaaaatgactgccaccaggttaaggtagttacaaagcagctttctgtaatggcagcagagataataaactgggcaacaagggaggaaccaatttaaagaaaaagaataatatacattttatatcatagtaatatggtttatgtcttcataggacagagtgacttgctcagtgaaacagactgtatacaattagctcagaaacaaatactgaggtttttatctgtttgctgtatcccttgagaaagattaaagagggaaggcagggtgcagtggctcacgcctgtaatgccagcactttgggaggccaaggcagttggattgcttgcgcccaggagttcgagaccagcctgggcagcatggcgaaaccctgtctctaccaaaaaaaattacaaaaaattaactgggtgtggtggcacatgcctgtagtcccaggtactcgggaggctgaggtgggaggatcacttgagcctgggaggtcaagattgcagtgagccatcatcgcaccactgcactgtggtctaggtgacagagcgagactgtctcaaaaaaaaaaaaaagcccagcacgctggctcatgcctgtagtcccagcacttgggaggctgaggtgggcagatcacctgaggtcgggatttccagaccaccctgaccaacatggagaaaccccgtctctactaaaaatacaaggaagttagccgggcgtggtggcgcatgcctgtaatcccagctacttgggaggctgaggcaggagaattgcttgaacccaggaggcggaggttgcggtgagccgagatcgcgccgttgcactccaccccgggcaacaagagcgaaactccatctccaaaaaaaaagattaaacagagaaagaagcaagccagtaatctaagatcaatttatgatttttcctctaaattctgctttcttcaacacaatttacttaatctgaaaaccagggtttaataacagtatgattagaatgtttcatttataaagtggagttgagattgtacgtagtataaaacatgctgttggaagattatctccttttgaggaatctcaaaatcaagtgggagaaatcaagtagtcttggtgtgtgtgtgttttgtttgtttgttttaatgagagacagggtcttaccacattgcccgggctcggttcaaactcctaggctcaagcagctctcctgcctcagcctcccaaagtgctgggattacaagtgtgagccaccacaccagcctcaagtagytttcgagatgatgccacagcactccagcctggcaacagagtgagactccatctcaaaaaaaaaaaaaaaattcagtttaacataccaagcttttggtcaaatttctagtagtttagaatttataataagtatgggtaattaaaataaaccataaacactttaaagtaagggaagattcatgagtatactattagaaataataactagggctgggcgtgatccttccacaggtagttctagctacttgggaggctgagatgagagtatgacttgagcccaagagttcaagactagcctgggcactatggtgggtccccatctcttaagaaagaaagaataggaaaaactaaattagtataagaactaattacttaatttgtataagttatgaatatgccaaatgcaatttagatgctttttcaaaagagcactggtactcagaaccctgattcaattttttaatcctcatagaatttttatataaagattttatgtttgtcaggttagctcttcatgtcgtatacttttttttccaaccttgtattttaatgtggtgtttatgtttattacacattttttctttgtcttttttttgtgtgtggatttgtagtttaatgaataatacctgctattagcattcgttctaaaaaacagcataataaagtgttccctacttgaattcattaacctatctttgaaacagggttaagtgaattttgtataataaagaagctaattttgagatacaaaatatttggcataaaattaaatactgtaggaatatttttattaaggtgtgacatacatgtgtatgtgagtttttgttgtttgtttgtttgagatggagtctctgttgcccaggctggaatgcagtggcgcgccatctcggctcactgcaacctccgcctcccrggttcaggcgattcctgcctcagtctccctagtagctgggattacaggcgtgtgccactacgccgggctaatttttttaattttttggtagagaccgagtttcaccatgttggccagacttgtcttgaacttctgacctcaagtgatccacccaccagcctcccaaaatgctgagattacagtcgtgagccatcacgcccaaccagtgtaacatatattttaaaatatgtaataggatgggcgtggtggttcattcctgtaatcccagcactttgggaggccaaggcggacgggttgcaatgtcaggagttcgagaccagcctgaccaacacggtgaaaccccgtctctactaaaaatacaaaaatkagccaggtgtggtggcacgcacctgtagtcccagctatttagggggctgaggcaggagaattgcttgaaccctggaggcggaggttgcagtgacctgagatcgcgccactgcactccatcctgggcgacagagtgagactgtgtctcaaaaaaaataaaaataaaatatataatatatctaaaaaactattgggcagtagtaaattatggctgtggtaggtactaccttactttaacaacataatgctataaaaggaaagacttaaactggtattacccttttatagtcccttagcaacatgcgtaggatrctacttgaggtcattatatttctcttcaccctttatggcgacatcaaatgatttgaatggctgatcagcttttttacgagggaatttgtaaaaactacccaataactctaatratggaagatgttaacaaaggaagatctgggtacagagtatataggaactctgtaatatctttgccacttttttgtaaatctaaaactattttaaaattgtttatttaaattctaattattcaacagtaatttagttcactaataaattgatttgaaagagtcagtattttttattcctactttcactggaagaaaataaattgaacttgttttccgcaacttttttttttaggattcaagatgaccaacgaagaacctcttcccaagaaggtatgggttttggttttgggtttttttgttttgttttgggttttttgggggcttttttaagcactttaaaaaaaaatagacttgaagggattatcgttgtttgcttatttttcatttctttgcctttataacaataatagcattggagttgtacagtgtgccagatattgtatcttatatccagtatattttttagaatattttcagattttggaaaactttagttataataatattcccatggtctactcttaatgttcattatgtgaatatttccaggtctactcttaatgttcattatgtaaatatttccaggtacatatatacaaataatgtcaaaaatggacattatgagtatattattattcttttcctagtgtaaatccctttgattgtaattaaaaactactttattaaaaaaatggttatagctaattttcaaattctacctttttctctgaagttttgttgtctagtctcaaatctccccctgttgtgcattcctaccttgagtttaattactcttacatacacacacatacacacacacagtggctgttataaaagaggtaacatyrtctctaggaggaatttgtgattcaattgggaaagcttactaaacttaatatttaagtgaataatttagatattacagaagtttcctattgtggagtcagattactcattaaatgaataaaggattgtattatgctttcataatctgagaattactgtgtgctccctctggtaccctttgattttcctcccttggaacagggtcttgctctcttgcccaggttggagtgcagtggtgcaatcttggcttactgcagtctccgcctcctgggctcaagcgatcatcccacctcggcctcctgagtatctgggggctacaagtacrtgccaccacgcccagctaatttttgtatttcttgtagagatggggttttaccatgttgcccaggctggtctcgaactcccgggctcaagagatagccacctgcctctgccttccaaagtgctgggataataggcatgagctgcctctggcagcctttcaatatgttacattataatagttccctcgttccattttatggtaatactattttactggttagtattataatttgaaacatttttaaggaaaaaaatttaagtgtcttgtaagggaatactaataaagcctttattttatttttattttttattttctgagacagagtctcactctgttgcccatgctggagtgcagtggtacaatcttggctcattgtggcctcataccccagcttatgcgatcctcccacctytgccccccaaagtagctcagactacaggtgtgccactacgcctggctaatttttgtattttttggtagagatggggttttgccatgttacccaggctgatcttgaactcccgagttcaagatatactcccgcctcagtctcccaaagtgcaggaggcatgagccacaatgcccagccaaagccttaattttatactgaggtaggagaggtatctcacctttacagcctttatttggtgtagtgaatatactgtttctcaatttttgaagcatgttagcttatgcccttctttcagctttttgttttgaaataattatagattcataggaagttgcaaataaatgtacagagaggttctgtgcaactttcactgagcctgcttcattgttaacaycttgcgtgactagcagacatctctaataactgtgaaaatcagggaattgacattggtacaatccacagagcttattcacatttcacgttatactagcactgttattgggggaagtggggaagagctatatgcactattatcatgtctagctttgtgtaaccatcattaatcaagatacatatctgarctatcaccataaagcttcatcgagttattcttttatagccacatctaccccgtccctctccatgcctgacccctggcaaccactaatttatctccatttgtataattgttacttcagagtgttatataaatgtaatcatgtagtatgcatctttttgagactattttttttccttccacttagsacagtttccttaaggcttayacaaattgtttcatgtatcagtagtcctgtttctttttattgcttaaagtgttccatggtgtggctgtatgatagttyaatcatttgcctgttaaaggacatttggatagttttcagttttttagcttttacaagtaaagctgcttgcatgttttcatttctttgagatacatgtttaagagtgcaactgctgagttatatggcacattcatttttagttgtattaataaaaggaactgccwtacttcttcagataccatttttatattctcacctgcagtgtaggaaacttcagtttctctgaatcctcaccagcgtttggtgttgccactaatttttattttagccattctaatcagtgtgtggtgatacctggggttttaatgtgcattttcctaatgatgatgcccattgttaagataccaaatagtttaccttaaaaaaaaaaaacttttgtaataaaatactttttcaaaaaatcrtaatatgtactgagccgtttaaatctcacacttgggagatgtttcataggyctcattatagaactttgtgtcttcaggaagaacactaaattcatattgtaattctctttataggttcgattgagtgaaacagacttcaaagttatggcaagagatgagttaattctaaggtaaaatgttctctgttcaaaaacaaagtctttctatagaacattatattgtgactctacactgtaattgtctttgtgccagatattgtttttaatgttgttctatcctcaaataatttaatgtactttttgagcatactatgacctatttcttatattaacaccgaggaaaacgtaacactttaaagaactactaggaagctataagtttaacaaatatatggcttgttttgtgtagtttttcctttcgtgtttaacatttgaaaaagaaatgtaatcctaaaagatgcacttatatttatggaagaaatacataatttactaatgaagtgaggttactttttcttattagtgtgaccttcaccagctcatataacttcatactcttcattttctcatctgtaagttgaagaggttgggttaagttattgttaaaggtgacttccagttctgaatttctgcggttatcttgtaaatgtcttacaaaagcagattgtcaagtacaacgtataatctttttagattgtgtaagaaatcaggaagtaggatgttctstgttttgtaatttaaatatattctttctgtattttattgctatggttagtaagtttcttgataacttagataaaaataaaataagtattttaacaggctgaaagcggaggagagaaaagakgttttgtgagataggctaacacagattttgttgtttcctaragtgkgacaatttcctactttcacctttggacagctactgtattatgaacacactttttaccykttttttttttktttttyttttttttttttttgccataatctcatacataggacagtttccattgcatacctttgtctttctgcacataaaatttaaatttttgttattctaaaacacttctgtcttatgctgaagtatatacttaagatacactactactcaatgctgggtttttttttgtttgttttaatgtgcatataaattataatagaggtgaggtgctgctcaggctggtcttgaatgcctggcctgaagtgattctctcaccttggcctcccaaagtgctgggattacaggcatgggccaccatgcctggccatgattttttttttccctgtctctggcattgtatactttttttaatgcyttcttacataattgctctggttagtctgtgcagtcatttttttgatttaactgtaggaggggaaaaatcagtaatcttaataaagaatcatagaaatgttttattttaagatacctttaaggtttctaaatcatatgcagtgtatttccttgaggtcagtttaacatctttccttagggaattcatgtaagacttttaggcgagttttttctctttgattcccttggagattttaaaccagctgctacttatttaactagtctgtgccttctatccttgtgatatacatgttcttgcttcagtttttatatttttctgtacttctaaaataaatcgttcttttatagcctccactgaagatctttctctatacatccccaaatatttggtaaactacgtgtcytaggttgtaagtgccgtaaaaataaagcatggccttggctgaacatcagtgtttacatagaaagtggattagtttggtattaggaaggttttttttttttcttttttctttcttttttttttttttaagacagagtctcgctctgtcaccaggctggaatgcagttgcgcgatytcggctcactgcaaccgccgcctcccggtcaagcggttctcctgcctcagcctcccaagtagctgggactacgggcatgcgccaccatgccctgctaatttttttgtattttcagtagagacgggatttcactgtgttggccaggatggtcttgatttcttgacctcatgatctgcccgcctcggcctcccaaagtgctgggattacaggcacgagcctttttgttcattatgttgtaatattaataactcatgacaagcctgtttttaagattataaaatggttttctaaagccaaattttaattaattgtacctgaagagcagcttgaaaacatggctcttaagtatgcaggatagcagacattcagggcagggtgctttccattaggaactgcctaataagactaggaaaaatctttattgctaagaggacctagcagtgtatatattcagggtagagaagtataatgaagaacaacggtccccttgtattctgatagcatatggcatttatgcaggtttctgacagttagatgtgattgttaaattacagtcttgaaaaatgttatattctccccctgtgtttacaggcagaaattgatactaccttgagaagagtcacatggtattttcccraaagagccaagataaagaaccttcaattctacataatgaggcacatttctaatatgccttttgttctaagtggacaacatatgaaagcagcagtgggatttttttttcagcttctataatccaggattatcctgaacatcagtgatatcaaagtgaatctggggtttgatctcacccagggcatgcttggcatgttctcagcagaaaaaaccttctctatatatctctttttacctgtttcctgtaaaatgggaaggaataatgagggactattttatgatcagttaaactagatttaggctgggtgtggtgactcaggcctgtaatttcagcagtttgggaggccagggtgtgaggatcatttgagctcgggagttcaagaccagcctgggcaacrtagtgagaccccatctctacaaaaaaatgagccatgtgcctttggtcccagctatacaggaagctgaggcagggacatcgcttgagcccagaccctgtttgcgccacgctgcactccagcctgggggacagagcgagactctgtctaaaaaaaactagatttaaaatgaaaaatccagaagaatgctcagtattactaaaatctgtgagtttatagatatcttctagtttatttaataaactattttatcgtaacaactaatgtatggatttttttttattagatggaaacaatatgaagcatatgtacaagctttggagggcaagtacacagatcttaactgtaagtttgagttttagcttcctaaagactgaataatctccttttgattgttaaaatcaaaaggatagttgtttttattaaagcaaatgtaatttttctcgtgttttattataagaactgtacataggcactgtgttgggtgcaagaaaatataaagatgaatgagacacagtctcagtcattggagaagacagaggtgtaatagtcatgtaatggcatgacttagcaaaattatatgcaaggttctgaatatagatgcagtaactcagaactacttgaaacttttcttacttgtccctaaccccttctgcataggaatttgacttgaagcatgagttactagtctagaagagaaataaacagaagcaaccagtaacagatttatgacagcttaaatcaatatatataacttaataatatatacagatttttttaaatctgctgaaaataacgtttatcattttaagccattttagtctcactttttactgtttgaatcacatactatttgttgagtataaaaaccaatatatattgttttgtaacttcagaagggttaataccctgaaattctaattttgcgtgactgtgttacccatagaagtcatgaacattgtgaaagtttaaggctaggcacagtggctcacacctataatcccagcactttgggaggccaaggtgggaagatcacttgagcccaggagtttgagaccagcataggcaacatagggagaccttgtctctacaaaaaaaaaaagagtcaggaggatcactagagcccgggaggtcaaggctgctgcagtgagccctgattgtgccactggactcctgcctgggtaacagaataagatcctgcctcaagtttaaaatayaaattgtccagcagttattactattttatttatttatttgtttgtttgagacagggtctcgcactgttgcccaggctggagtgcagtggcacaatctgggcttagtgcaacctctgcctcccaggttcaagtcattgacctgcctcagcctcccaagtagctgggattacagacatgcatcaccacgactggctaattttgtatttttagtagagacggtgtttcaccgtgttggttaggctggtctgaaactcctgacctcaggtgatctacctgcctcarcctcccaaagtgctgggattacaggcgtgagcctctgtgcccagacagcatttttatattaaataggttaaaacatactaatcaggattttgtgaatactgtataacacagatgttttctgtcttctgttgggagtagatgaaactataaaaacataatttagttagtagtcatggagcactatgacaccattgtctcctaaaggagctctcgtgaccaggaagaaattcgcctgttataaaagtagttaggatggaaactaaagacttgattaattttttgaccctagttcttattgttcttgacagaggtatttagaacttgatcttaaaattgtatttataatttttttttgaatcatcagctaatgatgtaactggcctaagagagtctgaagaaaaactaaagcaacaacagcaggagtctgcacgcagggaaaacatccttgtaatgcgactagcaacyaaggamcaagagatgcaagagtgtactgtaagtatttcaagttatataaatgtctttagttgaggaattggtttttagtccacattattacatgttaattttaaacatttaatgctaaatataagagcttatcttttataggtacgtatgctttgagctttaagaatactagatgaaaaattttgataatgtctcatttagactgttttttgtggccaagaaggcaaagttttaagttttttttgaaattttcatgccttataagtattagttcatcaattccagacatttttcagatatcttggtgtctgaggatgtaatcaataaaagaacatttgctctttattgctttactttcactgattaggaaagccatctgaggactttatctctgttctcttgtcccctctgtgtatagaactgtttttcctagtgtcagcaacctctttagtgtctcctttttaattgttagaactttgatgtgtactgtgtagtatttactatgtctacgtagatctgaaatctagtgacataattgatcatccagctctggtagtttaggctcaatcttacggtgtaattatacaaaataattagaggcagctgtatccttgtttctgattttaaaatctgaatgtttcttcaattctttgtgtactctcccttcatttggtacatatagaagtcttcttatgtgttattaaagtcttctaagatagtattctggtcattggagacaccaaaaatctatgggcacagtcctgttcctgtttyttttgccaatagaatgttccttaaggttcagtcacagtccttttacttcccttacagagattgtttaaatttccacaaaagcaygtatttactcttctttcacttgttactaaatgacttcttcacattttactttgctaaaggctggcttttatcattttctttacttttttttcccactaacccccccgcccttttcttgagacagrgcctctctctcatccaggctggagtgcagtggtgtaatcacacctcacttcagcttcccgagtaactgatttcaggtgtgcgccaccaagcgcagctaatttcttaatttttstagagatgaggtcttccctatgttgcccaggctggtcttgaactgctgtactttggcaatccttactccttkgcctcccaaaactgttgggattataggtgtgagccatcgcacctggcccattatcattttctctaccttcttaacacattttgtccttttgtttctatcagttttgttgtaattcttaccaccactgatacttctttctccatagttactaatgaatgttttaacaaatttccctttacacgagaaatggatcttacctttagactgctagcacttgggagatagagtgtgaatagaaggtgttgatggtaatatctcataggatcagaatgtcttgaattccatttctcttccggattcctactcttgacatcatagttgatgtgtgcacatcacaatgtttgtgctattcatgcacatctgattctccatctgtcctatatgcgctggcagttttgatcatattacgcctggtcaaggccttcggtgatacctcatcactcttgtctcctcgacctggattttaaggttatttcaactataatggaacctaaccttttccagcttttttttttttttaaaacagctgtcacctgcatacgccagctgaacaacttcctgttcttccaattataatacaagtgaggttttgcagacagggcagggcagcaggagcaaaatcacaaggaaaggtcaagattatatatggcagatgaggataaagtttcaggtgagagtgaaaaaagatgaggtcagcctggaatcttgggtattctagaagagaggggactactgaagaattcttcagcaagagatgtatgtgatggatcagatttagatttacattttaggtagatcactctgacttgagtatgaaagatagatttgagaggaacaggactttaagcaggaaaaccaattgtgaggctgttaaaatagttcagatgaaatacatgaagccactggtggtagcagacaggacagartaggtgttttggaggcacaatcaataggacttgtttagtttggatgctgttgtggaaggaatgaaaaaaatctagggaggaatcacagcttcaggtttgtcttgtttgactgagtaacgatgctactaggatagatcctacaaagatcaaattttaaaagaagagtagagtgtggtgttaggaaaacaggaaatccagcattccctcctccttccccaaaatacaaagtgattaaaacaaaggcatacataaagttctgtacaatacgaatttaaaattgttcgttagatttggcagttaagaggttgttggccaaggaagccaaaagattggatacccctgctctagaggaactgtcaagtgggaagtgagagaaactaaatttaaagagtagaaagaatgggagtgatgtactataggagtttggagggaataggttaagcgaatggttgaaaggattggccctgagaaggagggtttcttaccctcttgagtgaaaaatagtggaaaggtttgtattaggtacctgtcctttaaaacagagctgctgcatttacccttggtgtttcaaattaagctaagcttagaaaaaataaaatatacatccttaggaatctatttgtgtagatcttttgtttgtccagcatactaactcatccatttgatcttttaataataatgctttatttctttgtctacatgcagtctttgccaagtacatcagtagtcaatttagttagttttgagcgtaaggcataaattagccacgtagttactatattcttaactatatactgtattcttaactatattttattttgttggtaagtaaaatctgtcatttttgttcacctcagtggtatttctgtttttcatttagtcttttgccaatcaactcaaaatagatttaggaataaaactaactttgaaaacactttactcagtgttctcttccctagaacatggaatttattctagtctgattcacctctcttttcatgaatgaaagtgttgactattgggtctttgtaaagctaaatagtaactgagtctcagtcagtgctgtagactgttttaatcagtcctgtcagtacatggagtgcactgtaagtcatggtttattctcgctctgttatcttagcagctggcttcacattgactatgcagttgtactagatttttgctcagtgaaacaaatatattcccaaaccacttagtatatttgttccttttactaaatttatattagaaaattttaactgtaatcctayttaagccttagtatggagttagatcttgggccagatctactttgagtatgaagaaaatgatgaatttaatgctaataactatatttcatattttagaaatgtatttttagtgtgctagtaaatagcacaactgaagtcgaaattgaaggtttcatatgtaagtagaagggttctggtatggtggaaaaagctctagactgggaatcagaaggccggagaactagaattgtagtcccgctatggcactgaactaaacagttgggttatttaatctcaaaataagcagtttggattaggtgagttactttccagctttacaattctatgattcggatctattcagaaggggaaaaatatgaattatactttattttggcttaaggtcctatagagttttgcttttataaagctgtaacagcaactcttgtagctataagtactgtatattttttcctttagaaattcaaatgtgtattttaagttataatcttgcacctgatgtatttttaggggactttacatagaataatttccacaggtaaaaaattaagcaaaccaaagacttcattaactcttaggtaattaatattttaaactttgcttttttccactgggttgtcagcatttttagtaaatataatgttgattttcgtttgttttttggtaatgtttggattgtaaagtaaaatgtatgtagccwctttaagtcccagatttggagatgtaatcaaatggcctcaattccwaagtgagtaaccttaaataawgttatttttttaattgacaaataagttttttacatattcaaggactactacatagtgatgtttcaatacatataatgtatagtgatcagatcggggtaattagcatattcatcaaatagtttttagtctgtactttttctagaaagttttaagatttttctagagaatttcaggatcaaagaggggaggagcttaatgaaagagttggtaaatcaagtgaatggagggagttttccccaccttcttatgtatgtttcctttgatttggtcgtaattgtttcttttgctttgcacagactcaaatccagtacctcaagcaagtccagcagcckagcgttgcccaactgagatcaacaatggtagacccagcgatcaacttgtttttcctaaaaatgaaaggtgaactggaacagactaaagacaaactggaacaagcccaaaatgaactgagtgcctggaagtttacgcctgataggtaaacaaatcatactccccagtcaagacttccctgacagtcccactacgagaaagctgtggtgggacagccaagtactcgtttccacaccaagactcagactttttgagccaaaaaaaagccacattcttacactgtccagcttgtaatggttaatgtaaaacttaccagatgaaccttgtgtttcagcttttttcttttccccttccccttgcttcagaggcctgatggcgtcggactattccgaagaagtggccacctccgaaaaattccccttctagaacatgtagacacttgagaaatgtttctgtttgaagaaaatagagggagaaacagaagtcttaagtctgtggcacactgtgtcttcagacagtttgaaggaatgaaaacctagagattttaaatyatgaattgaacatgtaaaattccagtaaaatgtaaaaacggaatatgcatcgctcttaaccttgagcatagtgacttagagacactgtgtatcagttttgccaataagactgtggacttcatgattgttgttgaacttctgggtcaaaactcaaatgaggtgaattttgcctttaaagggtttatttgctgagaaccaactttcaatagtcatgagagaatcaaataatagatgtccgtacaagtagcgcatatatttaaccatttagtttggggctctatattacttgcttgagccttaatcaatgtggttttattcaatggtttgttctttgaatggttgcaaaaactgtagatmatcttactgaggactgtacaaacatgaaggtgtggtatcaaacttcaggttgaaactgtttgaagcattataaacattcatttcacaactagattgtataaggatattagctgtgatgagactcactgcattattttttttagtgaattttatgaaatccccgttccattcaacaggcacatgtttaaaaragctttgtcgttggtgttaatgggggaatgtgttccttcattgtatttgggccttttgtattgcactcttgatattaaattaaatgtgccttgaaatagttggtttttttttttttttaagttcaaagaatattatgatgattttgttgtactctttaacattttaatttggggcggggagggcctgttgagagcagattcattttggaaatactgttgctgtgctcttcaaagtgaaggaaaaggcgctgtgcctcatttttaaaagacctacataaaagacaaggagacttgacacttgttacttttatgacactttgtcccagggtattgcagtagaaagtaatgtgggacagcttcacagggtgtctgccagaagataatgtgttggaactgtgggctggcctaagtaagacattttgtgaattgaaaaaaggtatagtgatcatttctagcaaattcatttaatcatttagataaatgaggcattattttcttcatgcttccatccaatcctggaggtgaattttttccgtcagatcattctataagtcaccaattcaaattttcgcttggtgataatggagtctaagatgagtggaagataaatgttccagcttgtcccaacgtttaagtgcagttttaacaagggtgacttaagttctctcttaatcattcaaatcaattgtaagtatcatatgtttgtgctttagggaactgattgtggggcagagggtgggttgaagaagtggtttgtgtgacttttcagcaagaaatctgcttctaaaattctcactatttgtgagggttggagggtaagtaaccagatctgtttgaaattagcttatgtgcttgcattaaggcttttgtaaatattttatgccatttaagttcacagtagaaatggcctaagtatctttttagtagattttagtagaagagtaatccataaaatgtattattaacatgtactcaaattgagcaggcatctttctttgacacttagataacagtcatgagttctatggtttttttcttgtcattgttaaaattttctcttttaataagataatacatgcttatgtataaaattgaaatactgtagagaaagggggagatgaaaagtgagtgtcactcccggatgtgaccttgacatcctcattctcttctccaagagcagtaactgctattactttttcttgggtatcatcaagataatttctatgcatatacagttattttatgtatattgwtttaaacaaatgtgatcataccataaacacagatgagttgcaccttgtttttttttacttggtctctttggcatttttccattttttaatgtatctagacaactacatttttaatgcttacatagtatatttccgttatattaaggaatcataatttatttgaatcacttataaatggatttttttctataaaattggctgtaagccagagtatatcaggtactataaatacatcactaatttgaaacaaataatggctcaggcaatcccctgtctggaatatttccagtggtggaatgggttttgctttgggttgcgtgcacgcgcacgcacgtgtgtgtcttcgctttactgtttttctgttctaattttgaggaagaaagattcccagaaataacctgtccagttcagttaaaatatttcattcatgtgagaatgcacacattttagagtgtttagaggtatatctttcaaagtgctttctattatgtttgtgggttaatcgattttaggaatgggttgatttttttgtttgtaattttaaaaaattatttcaaaaacaactacttgtaattaaattattttttcaaaactgtgattttgttaaaatttattttactaatcactagttttaaacgtgatatgactatcttagcttagacatttatttattaaaaggtatgactttttaaacgaaaccttttttgcattagaatttgtgacatttttatatggggttaagtcaggtcacagattaatgtatcttacagttgtctttttctactctttaaaattcatatagtaagaaggttagttgtaaacaccaatgaaatatatatactttgcaagaagacagttttgagagcataggcagtaaagtggaaggaattccattgtttttgacaatcttgcatatctctcattttcccattgtttaatttctaagtggatgttcagtggaggctaacgcctgagagtgctgatgggaaatggtggaaatctggagctacagtagcagtgaacaagaacaccagctaataaagttatcatatcaaagaataaagcctttaccacatgctcactggtggctttcaccctcgggctcctctgagcagtagtaacccaggttgaactcttcaggtattttctggaagaaagcttaattacaaacttttccttgaattacattaggttagaaaacatgcagccaggcacggtggctcatgcctgtaatcccaacactttggaaggctgaggtaggcagatcacttgagcttaggagtttgagaccagcctgggcaacaaggcgaaaccccatctctactaaaaatccaaaattagctgggggtgctcgtgcacacctatagtccccaggtactccggaggctgaggtgggaggatcacctgagcctggggacgtcaaggctccagtgagctgagatcacgccactgcactccagcctggcaacacagtgagacccccatctcaaaaaaaaaaaaaaaatgctgtaggtgaaagaaccatgcaacacttcaaagattgataaaatatttacaaaatgctctcatttttaaacttataaggcatactgaagtagtgtatcaggcaagtgaaagcctcactagaagaaggaaagactagaatttaaaaaatgttttaacccataaggtcatcctggacttaccccaaggacaagaatgtcacactgtctttatccaagtctcaaaggtaaatatcacaattatttacttagatccctttaaaagtgatcatttctttttttttcttttttcataaataattacaagaacaagcaaataatttctccttttattgctgaggctaaagaaaagcagtaaaattttattgggaaacatttgagcttttcattacatatttgcaattgctatgtatgtgcacataggttcagtagtatgttgcactagcatttggaaactataatctgtggaaagtgtgacactcctagattggcagatatttgcgtgtttgaattgtgatacgtgaccactggtcttatttttgtgtcaaaaggatgatcttttccaataaagtcttaagtctttaaaaaaaaaaccttaactgctgaatgtgcctcaattaatataatagataatattcttgagagttatggaagatggatgtaccagaaaacttccctctctcctcctcttttttgagacagggtccctgtttccgaagctggaatgcagtggcatggtcacagcgtcaaccacttgggcttaagcagtcctctcacctcagcctttccagaggctggcactacaagcatgtgtgcctggctactttttaaaaaattttttgtagagttggagtctatgttgcccatgctggaggacttcctgttaaggaaaatccttattaaatgtttttctagcaagaataaatactctcattcatttttatttgtaggtactgattttcataaatatttgtgattgatgttgcatgtaccttttcaagaacttttctgataaagcgctagattccttagtgtaataatactggtatagccaaggtgtgtgttaattaactggctctgtttccatttcaaatgrtaatttgagatgaaaatagatggatttcagaattgattattgatgtaatagaaacaaggtgtagctgtttgggcactttttgtttagggtttatttttrctgctgtgttggcaaaatactgaaatgcagaagatggatgtgtcccagaaaagaagatggtaattatggggaagcatctgctgtgatatagttatgtttgtatgtgttacatctatcactgtaataattgtaagcaaagacagagagttttgkcttcattttgtgatggatggctctttcctttgcagccaaacagggaaaaagttaatggcgaagtgtcgaatgcttatccaggaraatcaagagcttggaaggcagctgtcccagggacgtattgcacaacttgaagcagagttggctttacagaagaaatacagtgaggagcttaaaagcagtcaggatggtaaggggtttgtttctttttggaacgttgtctcaactttgcattggctttttaaaactgccagtcatgaatattataggttagattctgtacattgttaacctctgccctatgattgtatattattgtgagtgaagcatttttagttgagtccgcaaacaaagccatataattttagtttgtttatccccaccctcctaattctttattgttcaaaatttcttacatttttgtttttagttgggggtaggatttggtaaaagataaaagggtgttgtattacttaacaagatggacaaatttgtattcattgtttgaaagggagaataagcatttctcgttaagtgtaaatcttagaaacatgggcagttttcagcgatctgaaagtaataaagttgattgtatctgtgaaggttttattagtgaataagagatttaatctttaaatttgctgagataaaacttgtcagcctccatcctttttagtgcaagtgtagctgtatctctgtttctcttctttgtaaggtgcattattaataaggaaaatatccaaattctttgaaattttaaattgaaaattagtgtctctggttaattgcaaagatgatcagtagccaagtaatttcttctgaactacctaccttttcaaaatcttcaggaattatttcctgtgacttttgtccttttatrtgtaacagtccttggttgagaacatgggcctctttggagtgttatagaggaccacactatccttaaggatcagacttgctatggaactaaggcactggatcaggaataaggggattggccatagtgggcccataggtaaacgtgagtcaaactttggggctgtaatcaggcatatggcaagatggatcaaaacaattttaacttggttgcttaatacagttgccctcggtatccatggtggattggtgtcaggacctcccacagtaagcccctcatataaaatgatgtcatatttacatataaacctatgtacatcttcccctttgagccatctctagattaacagtacctaatacaatataaatgctaggaaaatagttattttactgtattgtttgggggataatgacaagaaaaaaaatctgtacatgttcagtatagacccagttttttcttccttgaatattttccttctacagttgsttgaattcattgttgcatgtggagggccaactgtatattattttaagtatctgacttccyccaaaacaaactcagtcatattttaagattccaagcaaaatttttaaatgtagtgtgattttagaattgtatttgtttacttgagcgtttattgactcccttgctttgtggcaggcactaaagaaacatttttcaatgttataaacgatattaaagttggtctgactctcctttgcacagaactgaatgacttcatcatccagcttgatgaagaagtagagggtatgcagagtaccattctagttctgcagcagcagctgaaggagacacgccagcagttggctcagtaccagcagcagcagtctcaggcctctgccccaagtaccagcaggactacagcttctgaacctgtagaacagtcagaggccacaagtaaagactgcagtcgtctgacaaacggaccaagtaatggtagctcctcccgccagaggacgtctgggtctggatttcacagggagggcaacacaaccgaagatgactttccttcttctccagggaatggtaataagtcctccaacagctcagaggagagaactggcagaggaggtagtggttacgtaaatcaactcagtgcggggtatgaaagtgtagactctcccacgggcagkgaaaactctctcacacaccaatcaaatgacacagactccagtcatgaccctcaagaggagaaagcagtgagtgggaaaggtaatcgaactgtgggttcccgccacgttcagaatggcttggactcaagtgtaaatgtacagggttcagttttgtaatattttttcagcaaatttttatacagtgtcatttaatttgggagaggatactgtccagaaaattaatgcatacttttgtcacaatttgcctttttgtgggtgtacgttttggtttttttttgttgttttttttctttgttttttttttcttttctttttttttttttttttttttttttgcttcaatacttctgccgctttggaaattgtaacagttaattactttgaatgttgctaaaaggacattttgtgtagggtcaagttatttttatatgagttaatgtgaaattgtaaatggaaatttttccttaaaatacaacacaatgatgtctgtataaatctgtctgtttaraatctgtgctgtgtaagggcattcgtactcatgctgttactgtacttatgcaccattcaracttgttagagtagatgtgggtttatgactgccaagtttgcccagtacagtagttttttatcactaaaagttggactcattgatggagtcctgtagtagtttcagtgttagatacagttttttccaccatacatctgtgcattttctctttaggtgactgtttaagaaatttgtgtgcatagttactcagtttttatgaactgttgtatcctgttaatgcatattgctctgtgactccagtatatcttacctgtactgaccaaacctaaataaagatttttattgtaactccttaattagcttttttgttttgttttgggtgtatgtttagcatttgtcattttcattgagtcattgaatttctactcattatccttcaagtaccacaacagtcaaacttaagaccaagcatcgattacgattttgcacacaatttttaatttatgccttattttgcaaaacggagctggagtttagggctacacttaaaattttttcttgacttataattgttacaaaatattttaaaatacagaaaagtataaagaaaatagtcatctatttcttaggctttttttttttttttttttttttaattgaracagggtcttgctttgtcacttaggctcaagtgcagtggtgcagtcatggctcactgcagcctcaaagtcctcgactcaagtgatcctcccacttcaggcttccgagtacctgagactataggcatatactaccacacccagctacatttattttaattttagtagagacaaggcctcgctatgttgcacaggctggcctcaaactcctggccccaagggatccttctgccttggcttcccaacgtgttgggattgcaggagtgagctacagctcctggccctttttgagttttaattgaaaagcagsgttggttttttgtgacctgatttcaagtagagtatctttgtagtyagtgatgtttgttttaaaacgctggccagcactactgatttttactaacaacatatctggtaatattatatgagtaaggggtgttagaatgtaggtaggagaaaatgtttttaaggtggaagaatgtcaaaatttgctccattttctcagaggtaattaagtataaaagtatgatattgaatggccttcaaatgtgtagctttcatatatggttgaaatgaaattccatttctgttaaaagcaaagtattgttttagacataacttgtaatacaatcaaggaaccttgggagtggagttataatactcgaaaactgaggtacaacttatttgaaagtaattgctgcttttgcttgtttagctgatacaggtatatccggtcttcagcagtatgttaaatactgcactgtctcttgattaaccttttcttttttttctttttctcttttttttttttgccgagagtctcgctctgccacccaggctggagtgcagtggcaccatcgtggctcactgcaacctccacctcccggattcaagtaattctcctgcctcagactcctgagtagctgggattacaggygtgcgccaccatgcccggcttatttttgtatttttagaagagatgaggtttcactgtgttggccaggctggtctcraactcctgaccttgtgatccrcccacctcggcctcccaaagtgctgggattacaggtgtgagccaccgcgcccaaccttgattaaccttttctacagtctgctcaagtgagtaaaaaatcctatacgatttttaatttgcatgtgattaaacattttggtgtttgatatatcagatactgtgtttggcttttgttatgtacatccttcaacttgaccaatttaaacaaaaatgtaatttctctgtcctgttggtgtaatgtaatcaagagtttgtgataggaaattaatttttcaaccagtgatacaattttatgactgaatttaatatggacctgttaatgtgacattttcatgtttctgttgagtctgccttgatgaataactcagagcacttattctgtggtacacagagtcagtatttctcatttctggaattggatgctttattttctggtatgcctgtgataagagaggtgatagagtggcttytgcatctaattggtttgaatcctggtattacacttaactgatttgggcaaatgtatcctcgaggctcgatattttgttttgtttttctcccctgtaagagcactcactgctgtcttagcttgggctgctgtgaaaaaaaaaaaaaaccacagactgggtggctttacacgcgcattcctcactgtttttggaggctgggaagtctaaagatcacagtgccccctgattggtgccccagtttggttcctggtagtcctcatacagagagcgcaatagatgtcagtttccttggctcctcaggtgtattggatacaactgactactccagtttttgagacacttttgcaaaacaatgtaaagccattccttctgacaacttwctttctcagatgttccctctttcatgagtagttatgccctgtactcaaatcattgcctgctgctctacgtcactgtcttgggagttcacctatccctgtggttatagtgaacactttcataatcccaggtaatgtcattaactgatctggacccatcatggggtggctgtgctgagggagtgttgagctagcccctagtggtaaggagtacactgctgaccttcatcctatgrcaattccactttggtgattcactgttcccctcatggagaccaaggaggaatttgctgcatggtaggttggtgaatccagcctgtagcaaagacctggcttggactcctgcaactctttatgaaacttaaccaagaatgattgcatcttccagcgggggaagatgctgagaaggccccttcaggataaactggctccatagcactgctgtaatgatggctcctcatgagtaagcacttggagatttttgtggcttcctgcccactcaccctgctcaccagtccaggtagtttatgatttgagatctagatgtaattttattttatttctttttttttttttgagatggagtttcgctcttgttgcccaggctggagtacaatggtgcaatctcggcccaccacaacctccgcctcccaggttcaagcaattctcctgcctcagcctccctagtagctgggatttacaggcatgtggcaccacgcccagctaattttgtatttttagtagagacagagtttctgcatgttggtcaggcaggtcttgaactcccgacctcaggtgatctgcccgcctcggcctcccaaagtgctgggattacaggcatgagccaccgcggccggccaagacataattttaaaaattatcttccagctggccgggcgcggtggctcacgcctgtaatcccagcactttgggaggccgaggtgggcggatcacaaggtcaggagttcgagatcagcctgactaacatggtgaaaccccgtctttactaaaaatataaaaattagctgggcatgatggcacgggcctgtaatcccagctactcaggactctgaggcagaagaatcgcttgaacccgggaggtggaggttgtggtgagccgagatagcgccactgcactccagcctgggtgacagagcgagctccgtctcaaaaaaaaaaaaaaaattcctcttctttccttcattcattattcttagtctctgtctgtctcatatgagtagataatcatatgagtagctataatgaggactcctcaggggacagattctgtttggccactcagcagaagcatgcaattaccttctcaagattggctcctaaacttactctagatagagccttcaggcaggaaactctatatcccttggctccagaagaatatattcatactcattcaaatgtgctaggcactggccataaagaatattggtgttcattcataactgcctataatgtgctaggagctgtgcataaagcagtgtaacaggatcatcttggaaagcttatgtagtcagtagaggagacagataaactaggaattacatggtaarttgaaagaggaagttaggggtaagatgctgcaccaaatgcaggagattggaaggtttttctggaagaagtgatgtttagggggagtttcagaggtaaatttctggtttggttaacagaagatagtttcactgctcactgagattacagaagaaacaggctggaagagtttggtttcaatatgtcaaatttgatgtgcttataggaaattttatttatttgagacagtttctctctgtcgctcaggctggagtgcagtggtgtgatctcggctcactgaaacctctgcctcctaggttcaagcgattttcccatgtcagcctccccagtagctrggattacaggcgcacggcaccacgcccggctaatttttctattttatggtagaaacgggatatcaccatgttggccaggctggtgtcaaactgctgacctcaaatgatccgccctcctcggcctcccaaagtgctgggattacaggtgtgagccaaggtgcccgacctgatgtgcttgtaagaatttaaatgaagagggtcagtcagcttaggagacgaggttagatgtaaggatttcagacttgtcagtatacaggtggtgattgatgccgtaggaatgactggtattacccagggagctsgtgcaaagtaggagccttggggaacatgttaaggggatgwgagagtaagcccacaaagactcagaagtggccagggagtaaggggaaaatgggatagaatagagcaaaagccacgggaggcattccttgaattccttggaytcagatatgttaggggacaggaaacacattgaagacaactgaagagacttcagtgtgctgctgagttcttagcagagtagacagctgatttcaccactattccagaccctaaagatttctcctgaaattgcactgttatgcaatttttttccttctctattgccccacctctggggcctacactctttaccttctctgatttatctgacccatccgcrtatctctgcaaagtcttaatgtaggtttccaggatttaatgattctttcaatcaactttaaagttcttcaggaagattctccaggtccgtcaacagttttccccttcatgactttgtgacaaagctttcttgttccactatccaggtgttcccaacaagttgctgtaacggtggcccctcataagcttgcctggaaaccctagaaagctcagaaaaattatgaactttgcccagtaagaggctgggaagtcagaaagggttttaaacaaaactgaccccacttgttacatgctcctttcactgtccaaacgtcaaccaaaggaacttttgtgacgctaagacgctcccggcgtcctcacccgttcacagccagagttgatcttagaaggcagggggctcgcaccgagacgctcctagcaagcccctcacgcgagcgaatgactggcgccaggagaaacgcataggacctcccgaagccgccgagagcaaaaggacccatcagagctgtgctgagacccgcygcgggccgggctcgcactcgagattctcgcccgtgggattccagtcctgagctgaacgagagataagtctttgtcaccccccagtctttactgtttcgagaaaccctaagattttttaaaaaaaagcccaaracgtcaagtcggggaactccaacattggggtgtccagaaacactggggtttcaggcgctctgtaaatgcgtccgaggtccgcggttctgcccgcargcccagaccccggcctcacttccgccccgcgccccgcgccccggcctcacttccgccccgcgccccgcgccccgcgccccgcgcgcctccgcccgcccctgctccggccttgcgcctgcgcacagtgggatgcgcggggaggtggtgcgcggggaggtggagggcgaggggcggggctacctcaggtcccgcccgcggcaggcctgtgggctgcgaggaggagctttgcctagcttgcaggcagcgcagggcagacggcggcaggagaagcaagatgaatgcaggctcagatcctgtggtcatcgtctcggcggcgcggaccatcataggtgagtggccggcgggagccgcgcagagtccgaggcgcctgctgcttcggcaggagcgccgagggccggacttgtgtaggagaggggcgtatgtggaggaagccggtcaggccaagccgcgaggagccgcgggatccctggaaccctgcggctcccgcgttccctgacctggt

SEQ ID NO: 13488 - DNA, 20991 bp, Homo sapiens
cttaaaaggccaaaaataatctctcaacatacctctgtctaatttggtccagtttttcagggtctgtaatgaccacctgtacaccaagcttcatttttgttttttgcaggctgaagtcaaggcaagcaatttttgcatttacgattctcttgggcatgcctacaattgaacataagattaagttaatacgtctatccttaaaagcataataaagagtacctataatcgattgtatgtaaacacacaaatttagactaattcattgcattttatcttagaaaaattttatggcattaaatgcaygtaatttcttttaattcacattccttctaccatgttgtatgtgctttaaattacaaaaagatgtactgcacataatccacaaaaaaacattttttatttttttttttttttgagacggagtctcactctgtagcccaggctggagtgcagtggtgtgatcttggctcactgcaatctccgcctcccaggttccagtgattctccttcctcagcctcccaagtagctgggactacaggcaggtgccaccatgcccagctaatttttgtattttttagtagagatgaggtttcaccatattggacaggctgctctcaaactcctgccctcgtgatccacctgactcagcctcccaaagtgctgggattacaggcatgagccaccgcgcccagccaaaagaaaagctagttttaatctgtagcaatctcattctataaaccaaatcccaaaccttaccctgggatcccaccacacagttgagtgcatagccactgatgagcatactctccatttgacttctcccatgggctttcaaaatattaacagagttgactggatagcgtggctggcctcttatgtctgtgtatttaatagcaagtacagcatctactaccatgttagcaaagaaatcaccatttctacgccaaaagttaaggacagtaacaggtttggaatggacaaagggtacacacgtgaaaaatcaagggtaatttcaagggacttccttttagtaatctaatctattaaagmagcaagcattacttgtcaccaaaatgttacaacattatcactatctgcaattcatatcacttttagacatgctttttattaccttttcaccctaaaaaagcagggaaggcaacargtaatttcmatacagcattactcctcyctattgatatcaatttgcataaaattggttattcaaaattttattgcacaaaattgatactgctgctactacgcacgcgtgcgcgcaacacatgcgcacacacgcacccactcccgagacagggtcttgctatgttgcccacattggactrgcactcctgggttcaattaatactcctacctcagcctccttagtagctgggactacaggcacataccaccatgcccatctcaaagtcttatgctttaaaaagtctaaattttatctgacaaccacaaggatacattccaatgattttggaagacatggatgtcttagcagcattaatcaggcaatctcttcccagttcatctgtgttaacaattaggttttcattgatataacgcactgcttccctgtttaaaagtgtgggggagaaaaacgcttataaagtcactactcaaactctttgcattcatcatgcttaacacagagccaaaatgtcgtaagtaataatayccgttcagccatttcatataggaggaggacatgaaaaaaccctccctcttcagatcatggcaagtttaatctatcccataagcayagccactaaaatctattattaggagaaaatgtggtagtcaaatgagaaaaaagatactggtccaagtttttaacttcaaatattactacttaaatgctaaaacatttaaattgaaggttttcaaattaaaatttagttattaatcaaaacgttaagacaacacagtttacaactattacatcaaaaaaaatttctctgaatgcaaacaatcttacttgcaagcaagtcgatagccactaataactgatgtgggatgaattttctgtttgactaattcatctgcattttttaggagttctgctgcaataataacctgttgagaaaacattcacyggtctgagtgtgccggatattcaacatgtgcaatacatatggaatgacactaaaatggccatatattattaaccaaaatggtagtgatgaaatgaattaactggttattagaaacctgggcgtgaagggagaagaacgctacaaaacactccaagtcctccacgttactcataaattcttggaaactgccactttaagcaaaacaatggacagcaatttctcaaatacagttgtttattgtaacgctgatggggggaggaaaacttgtttttttatacatcatctttcctcttaaagtcagtttccatgaagccactgtggatgttcagtgaggtcttattgtattataaatgcaaatggccaaaactgggtaggagccagaaaaatgttctaagaaactagttcagcaataagaaactagttcatcaatacaaccgtaaaagacaacacatctattacctttagaaaaaatgctcaacagaagctaaaccgagtgtgactattcatatgacctatattargctattattttatttaaaaaagatagttcttcaagttgataaaacactaagaaatatttttaaagcaaaaagactgtcagcttcttatggaaggaaaactacatttgttaaatcacattatcgtaagttagacaaagatcatattcatattttaggagtagattccattctttcatggctaaagtttaatctagaaatacattttccccacaaactatctagtttctccagaattaacatctttctcaccaaacaatagtgtttctactataccrgcatgctggatgatctatgaagagtttatactgtgtatcacatttactgactcggtaagatcacactgtcatatcatgatgtatttattaatttctcacactcccattttgaattcctgagattacctgtcaggatttaaaaaatagaacaggctgagtgcagctcatgcgtgtaatcccagcactacagaggccgagaagggaggatcacttgaggccaggagttcaagaccagcctgggcaacatagcgagaccctgtctcttaaaraaaaaaaaaagaggtttttaattagttgcttgtggtggcacatgcctgcaatcccaagcactctgggaggctaaggcaggaggaytgcttgaacccaggagttccaggctgcagtgagatatgacagcactgcagcacttcagactgtgctacagatggtctcttaaaaataataatataaaaacattgtttctcccccagattggtaacattttatcctccaaataatcagaaaagttgagagctttccaagtctcaaggggtgatgggggaggaaacaagacttttgagagaccataaaaaaatctgtgtgatgtctgaatactgccataaaaggaaaaataagccctcaaaacttgtgaataccaacatttaaaacaatggggctatgtcaaatgaactcaaattctttcctacttaaactgtacaaactagctgtaactatcaacttacaaattttgtttctgaatctgtacctaagaagcttatttcccctcttaaatgtgtaacttcttttgttttttcttcttgctcaatcttctgggcattcagaatatgtaacttatttctgacacagcacaaatgacccacttatggcttcaactttctgaaagtcggtcrtttttagaaaaatgatcattctttagccagtctacctaccactgaagtagttccatctccaacttctttgtcttgcagatcagccagctcacaaagaactttagctgcaggatgttctacctccagtaacttcaggatggttgcaccatcgttagtaatggttacatcctaagaaattcgcaggaaaaaatatgaaccacttatagaaatcaacacagccccattataatacacgttcacctttaatatcaccttccagtacgtggattctgataaagtcaaagaaagaacatagcaaaacactgaagatagttttactttaaggaaactaacacaacagttatgtgtacttacaccaatatcatccaccaacattttatccaagccaactggaccaagagaactttttacaatattggcaatcgaagctgcagccataactgtagacaatcaattaaaaataaaaaagaaatgaggataagccacaactctgaaagacagtaatttcagcctaaaggtaaatgacatccaacagcccccgtatttcccaaatctacaaatctgtgttaattatttaaaaaccacctactaagagtgtaaatggggccagacactgtggctcacaggtgtaatcccaacactgcgaggccgaggcaggaggatcgcttgatgccaggagtttgagacccctttgggcaacatagcgaaacccatttctacaaaaaataaaaacaaagccggatgcggcggcgcggacctgtgcttggagaatgcagtgagctatgatggcactctcgtctgggcgacaggtgggaccctgtccctaaacaaagcgagcctatttggcacagctttgatgcggggtggaatctgatggcggggaaaaaaaaaaaaagtaataaccaccaatttcaygctctgccacttcgtacagctataccagccttttccttcagattctgcaagttttttgctcattaaaactctctttatctgtgaggagagaaatcggtagtcaacggggaaggtggtgactttcagatttgtttacgaaaaaaattaggartctatcaagaaacagtaagctctgtaggtatccaaaggcctgacagcaaacgctctgctaagttagcgctgccgtctcctggggtcaatgcactcgagtggcgtttcctgggctaactctactgtaagaagctgtcaacccggatacggctggacgccggacgcccgacctcgactgcagctgcgggcggacagggcaccgggctcatccgagggcgcgcggatggacctactctttttctggtaaatggtcctaaaatraaacctggcgtttaacatggacactcagggggtcgccctgaaacaaaagggggtgcgaggcgtggcccgcacgtgcgagcccgggaggcccgctttcccgcggagggcgcgtttccaacgccgcmccggacaccacatccacgcgttgccggtctcaaaaccctgccgcgcgcggcggggctcctcctcgctgtgggaaaagtggggccacagcgccctgccccagagaacggcgggtgggctgggtccggctgcggggccccgaggccctttctgcggaggtaaaggagagaaacgagggcagccggggtccggtcgcggtgggactcggccctccccggccgcaaacccgacccaggcccggcccgcccttaccgttttgggagcggatcgtttccccagtgctgcggtcaccgaacacggacaaaggcccctccatcttgacggcagcgatacacgtcgaattctgcttacaccgcgggcaaccagtatcgcggcccctcggscgaccggcgaccacagcagtggctgcgacgrygtggagcgtacccgagcgatgtcccaggagmtactgggtaacacaccaccccacccgcttcccggctgccccggcccggccgcggggcacggcgggaaggaaaaagaggcagggacaacagggagagaaacaggactgtgacggaagtgaggctccggggaaggggcggggtcggcatttttgtccaattagatagccgrtgggaagggcgcgaaagcggagaacggaagtcggatgttggaccgctgggaagaggttgaaccttcgcctcaaacgatgttgcgcagacgcagtsggccattctagtgccttctagaaaaggttgtaagaagggtggagcttggagctggggtgtaactggaggggcgggcccttctccaagttagagttggggttctgagcgagtcgtgcgttttaggtttagtgtcttttccttgtcyctgctcggggagcgtgaggcagatcggccggctttgctccaggcctcaggagtgtaagtttaagggcgcgaacctgggtgggacggggcagtttttccagcgggccatacgggaaaatttttggttcgaggaagacaaccaccctttttaaggagaaaactgcatcttgccctgcsttattcctacgcggtgcccaggtggggtgtgtgtggaccagtcratgaccgcccaagctctccgagtagaaaacccaaacatggttttgtggggtgtgtgcctttgaccccggacttaagcaamaagcgtggtcttgggcgtagctacgaggtggttggtgggctccagggcctgcgtgcccctcgacgtgagcgatgattggcgrtgmaggataacagatcgccttctyggccactcagtggcaggggacttgctacttccgggtcggyggcgtctggcgtggagagtttggggatctacagcagccaaaggcttgtccctgactttatatggctgckcctggcgagcgactgagtcgtccgtgagraaaaagaggcgaggcttttccgagatcgtctcagcgatggcgcttcggtcgcrgttttgggggttctcggtttgcaggaaccctggtaattagtcttgccccccttctccyagstcactcgcctgggcttgcacagtacatkggaacgtgcgggttctattttgtattcgacgtgccggatcgaaatagagctcgcggcactgcgaagaccacagtaggaagttaaggacggggtcagtgctgactccaccctgtgggcatacgtatttttcgtcccctcgggcctaaagattgggggtgtaaaagcggatagacgttagagcgggttcgtgcgctgtccatatccgtcatttttaagccctgtgcggtttttcccgttgcccagggtgcaggttcgcagccctgtcaaccagctccgagccggcagcgaaacctgaagtggaccctgtggaaaatgaagctgtcgccccagaattcaccaaccggaacccccggaacctggagcttttatctgtagccaggaaagagcggggctggcggacggtgtttccctcccgtgagttctggcacaggtaattaaatctgcttgtgattgacaagggcagtgcaccctacagactattttcattcattcaactccaggcactctcccaggtagctgccatgcggcgggtagaggcarggttcgcggaggggctggaacaaacaacaaataggtgtgatgggggctatttaaagaggatgttacagtagcggacaggatacctgcctgtctgaggtgacatttaagaaggtgagatctgaaagaggaagaagcctagtcatctgccagaaagagcagtcctagcaaaggaaactgctggggtgaggaactgaagggcttgtggatctgaagctcaatgggcagaggatgaatggcccaagatgaacatggaggggtaaggaggcgacagatgattagctttgtaagtcaagatgagcactttagactttcttttcattatagtgggaaactacgagaggatttaaagcttgagcccgaattggtttttcaagatcattctggctgggcgcattgtctcatgcctgtaatcccagcactttagggagccagccgaagaagscggatcatctgaggtcaggagtttgagaccaacctggccaacatggtgaaaccccgtctctactaaaaatataaaaattagaggggcgtggtggtgcacgcctgtaatcccagctactccagtggctgaggcaygagaatcacttgaacccaggaggcggaggttgcagtgagctgagcgcctgggcgacagagcaaaattctgtctcaaaaaaaaaaaaatcattttagctgctttttggaagattaaatttttgagggagcaggacttgaagaaagaccagttaggagtctagtatgacttgagatactttgttataaaggtggttgtttaatgaacacttayatttgccaggaattatgctacttgctttatatgttttttctcatttaatccttaaaattacatcatgaagcagttataatttcccccattttacaggatcaaagaaattgaggtttagggagacatgattagtaagtgccagagctaagatttacatatgttttaactgacctcagagccaggacrctaggttattaccactatactacagcatgtaagtgtttatcaggtttatctgctgcttatctgcttggtgaggattttttagaatttcttaaggacttcttaagtactatgtaaagttgtaagagtaaattggaaatcattactgtgtgatgtattatttatttattgaacaagcatcatacctgtatcacttgmtaggcattgcgttagaggcaggagttacaaagataaagtagatgttatccctgtcatcaaaagtcttaagtttcatagtggaaagtggaatggggataatgatgtgttacagttgctgtaatacatttttactcatagaggagggagtccaagaaagggagtaggcagttcactttttaaataatctggatcttaaggctaaaaatcttttgaaacacccaacctattactttcttttttctttgtttttgagacagggtctgggtctgttgcccaggctagaatgcagtggtatgatatctgcttactgcatccttgacttccctgggctccagcaatcttcccacctcagcctcctgagtggctgggactagaggcgcatgccattactcccagctaatttgttttgttttgtttgagacaagctctggctctrtcacccargctggagtgcagtggtacagtatcagctggctgcaacctctgcctcccaggctcaaacgattctcccatctcagcttcctgagcatctgggactgcaggcwcacactaccatggccggctaatttttttctttttctttttttttttttctggtattttttgtagagatggggttttgctgctgcccaggctggtctcgagctcttgagctcragagatctgcctgattcagcctcccaaggtgctgggattacagrcgtgrgccactgcactcggccccaacgcattactttgatttaatatttggatcattaaaaataactaaagatgtatttcctcattttttctctgtctgccttactcgcaatattaaaagtagagaatttcagaatattatagtaggaaatgacctttgacataatgaatcgggcccttcattgaacaaatggttcaagtgtcascaaactacggcccgtgggccaaaggtagattgtgagctaaaaacttgtttttactttttttaagttaaaaaaaaaatcaaaagaatattttgtggcttgggaaaattaaatgaaaatcaaatttcgttgcccaggttcttagaacmtagctgtacctactctcatttgtttacgcatcacctggctgttctagcactacaatggctgagtcgaacagtttcaacagaagctattggacctagaaagcctaaaatatttactatctggcactttgtggaaaaagattgttgactcctggtttaacagattgtgatttttggccgggcgcggtggctcacgtttgtaatcccagcactttgggaggtcgaggcgggcggatcacgaggtcaggagatcaagaccatcctggctaacacggtgaaaccccgtctctactaaaaatacacaaaaaaattagccaggcgtggtggcaggcrcctgtagtcccagctactagggaggctgagacaggagagtggcgtgaacctgggaggcggagcttgcagtgagccgagatcgcgccactgcactccagcctgggcaacagastgagactccgtctcaaaaaaaaaaaaagagattgtgattttttactagagccaccaggaaaaccaggagtagactccatatttccaaatctaatgcctcttctatttcacattgagaatcctagtgagaatctaatgatttgggtgtgttttctttaacttaaacttgactttttaaagggtaacatatacgtatgttataaaatccaaagggagtacagtttcttgtgtgtccttctaaagattgtctatgcatataagcaaaaactgttaaaaacaataaatcttagcatacgataaacacttccgcatctttcttcaccaccaccctcaaccaccccaagcacgcacttaaaaatacatcttggagattcttcatggtagttaagagcattgactctggagccagacactgggacttaaaccatggctccattacttactagttttaatctttttcaagttacttaacstttctgtgttagtttctgcagctaaaaaaaaatatagaaaaaataatagaattgagacayaagctttatctataaaccgttaagacaggcctggcatatactaagtgctcagtaaatgttaactattatcttcatcattataaagcattatttcattcatttcagtaactgtatggaatactattgcatggattttacttaactcgctcctagagggtgattatcttttatgattacagtgttgcatcgaattgtcttgtccatgcattttgttagtgagattgagcatatttttgtgaatttgagtcattaatatttttcttttctgtgaacagtctgttyggataatgctttgcctattaagttatgaaggggtgggttgcccctcctcacctgtgggtgtttctygttaggtggaacgagagacttggaaaagaaaaagacacaaagtatagagaaagaaataaggggacccagggaaccagcgttcagcatatggaggatcccgccagcctctgagttcccttagtatttattgatcattcgtgggtgtttctctgagagggggatgtgtcagggtcacaagacaatagtggggagaggattagcagacaaacatgtgaacaaaggtctttgcatcatagacaaagtaaagaatcaagtgctgtgcttttagatatgcatacacataaacatctcaatgctttacaaagcagtattgctgcccgcatgtcccacctccagccctaaggcggtttttccctaactcagtagatggaaygtacaatcgggttttataccgagacagtgcattgcccagggacaggcaggagacagatgctttcctcttgtctcaagtgcaagaggcatgccttcctcttatactaatcctcctcagcacagaccctttacgggtgtcaggctgggggacggtcaggtctttcccttcccacgaggccatatttcagtctatcacatggggagaaaccttggacaatacctggctttcctaggcagaggtccctgcggccttccgcagtgtttgtgtccctgggtacttgagattagggagtggtgatgactcttaacgagcatgctgccttcaagcatctgtttaacaaagcacatcttgcacaacccttaatccatttaaccctgagtttgacacagcacgtrtttcagagagcagggggttgggggtaaggtcatagattaacagaatctcaaggcagaagaatttttcttagtacagaacaaaatggagtctcctatgtctacttctttctacacagacagtaacaatctgatctcttgcttttccccacaagttattgatcattttcttgttaattataggaggcttttaacatattgtgtaaattagctctttgaacaatatatgagtttaaaatattttttctttttatatttttgtgacagggtttcactctgtcacccaggctggagtgcagggcattatcacggctcactgcagccacaacctcctgggctcaaacaatcttcccacctcagcctcccaagyagctgggactacaggtgcacaccatcacgcctggctgattttttctattttttgtagagacagagtgtcactgtgttgcctgggctggtcttgaactccttggctctagcagtcctcctgcctcagccttccaaagtgctgggattacaagcttgagtcacatgcccagcctaaaatattttttgtttcattgcttttcttttgacttcatttyactktttttttttttttttttttaaccatgcagcaaattttgtccatcatttcttttttatgccatatgaggggctgggcatggtggctcagcctgtaaccccagcacattaggaggctgaggtgggtagactgcttgagcttaggagtttgagacgagcctgggcaatatggcaaaccctgtctctacaaaaaaatacaaaaattagctgggtgcagtggcatgcgcctgtagtcccagccacttgggaggttgaggtggaaggatgacttgawcccaggaggcagaggctgctgtgagccaagttcgtgcctctgtactctagcctgagagacagaggcagaccctgtctcaaaaaaaaaaaaaaatggccatatgaagctggacacagtggctcatgcctgtaatcccagtgctttgggaggttgagaagggtgggtcgcttgaggccaggagtttgacaccagccttggcaacatagggagaccctgtctctacaaaataaaaattatcttggtgcagtggcatgcacctgtaatgccaactacttgggagactaaggcaggagrgttgcttgagcctaggggtttgaggctacagtgagctgtggttgcactgctgtactccgagctgggtgacagtgagaccctgtttctgaaaaataataaaagccatatgacatggtttgatgtcatatttaaatatgcataccttgagattataaaaaaawttctcatgttttcttctagtactgttatgatttcagtttttgcatttaaatttttgttccrtcttatatttattttggtgctagctataaataaaagcaaagagtaagtatatccatrtcatgcatatgttcagtaacttagctctgtctcttcaaatctctttgaagtagatctgtaaataaaactcagctcttcagaaacaaatttcttcatgatacttgaactatttagtttgttattattgaggatattctcataaaggcggaggaaaaatacttttcccaagcaaaatccaagttaaatatgtdaaatkaaccaaacactggattgttgraaaatatttagtcatttattcacctcaattaatgtaactttaggatacagattcttctgtgattttattatcttctcaccccatttaggttgcgagttataaggactcagcatcatgtagaagcacttgtggagcatcagaatggcaaggttgtggtttcggcctccactcgtgagtgggctattaaaaagcacctttatagtaccagaaatgtggtggcttgtgagagtataggacgagtgctggcacagagatgcttagaggcgggaatcaacttcatggtctaccaaccaaccccgtgggaggcagcctcagactcggtatttttgttttcatgtayttattgaaaaggtattgtgttaattcttggcattrgataacttacataataataacagtttttacttaccaaatactttccatgtgtcagaccctttggtgagtactcaacagtgttacttcatttaatcctcacatcagtccatagggtagggactagtactctcattctatacagaaataaactgaggcttacttgcccagagtcagtgtatggtggatttcaaacccagggtgactgattctgtagtccatgatgtcagccactgtatttcctgttcatatattgacatcttgtccatataatattttgaaatgctgctgaaccttgacatctctacatttcctttttacttacatcattattaagatcactttctgaaaaacygttgtaggctgggaagttagcaagaacaaatcaatttatttctgtcttttggaaggtgaaagtattttcagcctactygtgctgctgacttaatcttttccttttttwtctgattttcaaaaccagatgaaacgactacaaagtgccatgacagaaggtggtgtggttctacgggaacytcagagaatctatgaataaatggaagcattaattgttttgaacatgtaaatataaatctgtcagccactacagccatcaaaagagagcatctggaagaacagccagcttggaagttttacagcaataatgttgcagtggaatattatttgtagttaaggtcatcctcctcccctttctgtttttttaaatcaagaactacrttctgcccctctcttgggcttcagaagcatctaagaaaagcagtcatcaattataattaactttcaaagggcaagtcagaagttgtttataaattacaaaataaaggcatattatgaactcttattttctggttatatgacattgtctgagctcactgtggcagtggagcacatatgaggttgatgtaaagcacttattactgtgtctagttcatggcgagtgatctcagtgaatgacagttgtttgctgctcggagtgtgggktgttttttaaaataggaaatgtcagtatcaatctaataytatagaacagtcagwatgtgaaaatgaaaggaccaaatgccaacctcacttggactcttggttcccaacagtaagagaaacaaatttgaaagaggaaggaggtggcatcaggagctgaaagcagaggtggaaatggttggggttagtgggcgctcaatttgccatgaagtgaacattttattagataggagatgaaacttgaaatgcatgcaagttaatctaaaatttgagcttgggtagatgggaatcatggcagttctctgaaaggagctgattaaggtgttaatttttggctatttgataaatgtgagaaaaaacctgtaggcagttaaggtggcttctagagcattgttttccagtttttttaatgtataccccaattaaatgtttgtttagaagtgaaatatgttacttctgccaatttgagtattcaatgtgttattttaaatggaacacatctgtatgaagtatgatttgttctgagaggtcttcagaatcaaatggcttaatagtccccttttgcttaattaatgtcccggagaggcatttaaaagtataattgaagatcggatgcagtgcctcacacctctaatcccaccactttaggaggctgaagcaggtggatcacttgwggccaggaattcgagaccagcctggccaatacggtttaaccctatctctactaaaaacaaaaatgagttgggcgtggtggtgcatgcctgtaatcccagctgttcrgaggctgaggcgggagaatcgcttgaactcaggaggtggagattgcagagagccgagatggcaccactgcactccagcctgggtgacagagtgagactgtctcaaaaggaaaaaataaaaaagtataacggtaatgttttctccgctaaccttaaagattgatttgagcacctcactttgaggaccatagttccaaaacsctgttcaagtagaagcctagaattcaagggaggacactgtaaggaagaccatggactagttgcactggaaacagtaacaaaagtaaaaattaagctcacatgtatgtgatgrtgtaggtagggatttccgcaaggagtgagtgcacgagataatccctggggaccaaggattccttcaatttaatgggcagttcttgaggctttgcaaagtttgattgcaggtgtgaagacagtggtaaggtggacagcagaatgaggaaaaagatgtccaggggcgtgggagagggaatggggacagacatactggcagtgatggagaagttgggaagaggtgatttagaagaccgtgagccgcagcaaaggatctgcttattgcagttgcgtccggtgttgttcctgctccgcttttctgatttcaccctttctggactctgtcttcstctcctgccacgcctcttaacattctaagtccatgtaaatgacattctcacgttaagggctgcaaagaaattgctgaggagccaggtaaacaggctttgattgcaattgcaatcaaacctctgtagcaaatcgtacaattaaaacacccgcaggcaggtgtgggcgacgccagcrgcacacggggaagctgggcacgtggggcggaggcagctgcctggtttccatgtgtgcgccctttaagacccggcggcgcgacggaagcgcgtgggcagcacgtgggcagcacgtgatagcgctgggcgactccgcggagctgcacggccatggacgtgggcgccgacgagttcgaggagagcctccctctgctgcaggagctcgtccaggaggccgacttcgtgggtgaagagcctgggattcgcggctgtgccggacagagccccttgccccgggcgagcttgrggagggggtggcgggacggttgccaggccacagggcctcagagagggcctcgggaaggacaggggggcttccttctccagccccrgggcggtgggactttgagcagcaagtacactccgagccccacgtcccttgttggccagagccccgtgcgcccaggtgcctggctgctccttgccttggttcctccattttcccttcctgacctcacttggcttgagcgcagaggtgagcgcgggtgccttggccgcctgcagatctacagtgtgaggagtgctggcgatgttctgcacccgaggactgctattttttgccttcctggcaggtctggacatagagttcacgggccttcgttctaacctgtctgggccccagcagatcaggtaaaactaaagctgtgtcccctctgtataagagcctggccagaccagcactgtttctggccagcagcctgttggcatttgsggggcaggacgttttgtgtggcttgctcctacgtgttggaggaccttgcttttttctgtccactaaatgatggtagtgctccctagttgttgtaacaaggaaaaaatcctccccggttgcgagtggtggtcctgccgcggaggccatagtgccgggatgggatgtcattgctcgtggaatgagatgcctgtttgttcacagtctttttgatttgccatcggagtggtatctaaagacccgtcagagtgttcagcaatttacagtctgtcagattggtgagtttaatatcagctgttagagtttttcaagaaggtatttttattgtccttggatttcctactgtaaaaacagctctgagatttttcaaggatattgagtatcgttttgtatgcttgttttgtgttgggccattgtatacatatggaaatcaacacttcggagcaaaccaaatttagcagcattgtttccgtgcttaaataagtcagtattaaggaacactcactgttactctttcaagtaaaactgtgtgtgtgygatttttattttattttttgagacagggtcttgctctgtcaccaagrctggagtgcagtagcatagtcttagctcactgcagcctagacttcctgggctcaagtgatactagcacgtcagcctcctgagtaaactgggactacaggctcaccaccacacctagctaatttttaaattttttgttcagatgggttttcgtcatgttgsccaggctgktcttgacttcctgggctcgagcaatctttctgcctctgcctctcaaagtgatggaattataagcgtgagcaaccacacctggcctgtgatttttttttcttaagaaaatttacacacaaaaataatttttttaaggtcatctcagtttcagaaactttttttttttccttgatgggatttggagatctttctgtatcggttcatacagatctatttgttgatttagttattagtttattttctgagatggagtctcgctctgttgcccaggctggagtgcagtagcgcgatgtgggctcaccgcaacctccaccacccaggttcgggtgattctcctgcctcagcctccagagcagctgggattacaggcaattgccaccaggcctggctaatttttgtatttttagtagcgatggggtttcaccatgttggccaggctggtcaagacagagctgttaacggttgcgtaatgctgtttcttttacagctactcaatcctgcttttgtaatgtgaaattagctgtagagaatacatgaacaaatgagcatggctccattccagtaaaatgttattgtatttacagaaacagaccctgggccagattttacttttctgggtttgtctgtgccctctcccgcaccattgggtttttgctgtgttgcccaggctgggctcaaacttttgggctctggagatcctccagtctcagcttctgaagtagctgggagtgctgccacgcccagcccctgcttttactatgaatgatgctgaacgtgtgtgtgttttcctctctatcctgatcctttgctacttttctgttatggttttttttttgttcgtttgtttgtttttaattataagacctctttgagaagtataggaaacagttgtagttatgtttccattgttgtacccaaatttgkttggggggaagggggacagagtcttgctctgttgcccaggctggagtgcaggggcacgatcttggctccctgcaacacccttgcctcccaggcccaagcaattctcctgcctcagcctcctgagtagctgggattacaggtgcgcgccaccacacctagctaatttttgtatttttagtagagacagggtttcaccatgttggtcaggctggtctygaattcctgacctcaagtgatccacctgcctaggtctcccaaagtgttgggattacaggcataagscaccgcacctggcctgaagtcttttttttttttaactttgcatatggttttctttgaggggggaggaatagacattttaaatgagttaaatatataaatcttaatggtttttggtattttctgtggatagttttaaaactatgagaatgtcattttaatatttacttctgtatttgaagaacaggccacaattagattttagcaaattcagtgtgaattacaatttgacatttctcatgcttccagtctgtcttttcttttttgtcattaaagatgttatcctgttgtacagcccacatagtatctgtgggcgcaaagtactgtttgagttgtttttgtctttgtagtgaaattcaggttgcttttccttggcattcattccctctacggtcattcttccaggattgtctgtgttttccgctattgaaggagaggcaaacaagtaygtatcaagagcttctgcaaacataggtgcttcccacctatgttccacagctgccaccttcaaattctgcctcaggtgccccgatcacttttgccctggatcttccgtattctctcctgtgtctgttcctccactcactctgccctctgcggattccagcttgtctttgatgtctctctggaagcagtacctttcccrccagccttgctctgtaccttaagtgctcctttccccatttccattgtctccagtgtgcacctatattaataaaagcgcctgacacagtgtggtgtaatgaaagtgatgtttaaactacctgacacagtaggcagaaaggatgccccaactatcaggatgcctccccaccccccatgagcagttgagggtgccagcctgcacgccctaacctggcatccctgggcagcttgtggaggggctgtctctgtggtataygctggccctgaaggcaggctctctgcctttttcatttagcacccccagtgccaatcatagctcctgaaacacagcagacactcgggcacactcagattcttcttgcctaaaagaaagagcccaccctgaagccagccctgggagccagagttttttaaatggttgtggctttttctctgtatgtttgttttattataggtatatagcccattcktgtaacttctatctcttccctacaacgtttgggattttggactcagaattctccttccaggcttccagtgttcagtttttgaatcagtatggcttcaactataacaaggtatggcattggaggaggggaacgggaatgtcttttgtttgtttctgagatggagtctcgctctgttgcccaggctggagtgcagtggtgcaatcttcgcctcccgggttcaagtgattttcctgcttcagcctcccaagtagctgggattacaggcacccgccaccatgcccagctaattctttttgtatttttagtagagacggggtttcaccatgttggtcaggctggtcttgaactcctagcctcaggcaatccacctgcctcggcctcccaaagtgctggggttataggcatgagccaccgcacccggcctgggaatgtcttacaagtgatctagackaactggcttatacagcccgtctcctttcccctttctacctgtcctcgtgaaatcaggcacagaggatccctctgacttgtctccttgttctgtttsttgttctgtttctgtcttaagtttctcaaaaacggaatcccatatatgaatgaagaacaggagaagaaaattagacacgatatcctgactgggaactggagagttcgcaggtatggcctgtttctccaggtgcctttttgtttccttgttgctgttgtctgcatttcccgtgggcgggcgtgccgtttccaggagtgtggtgacctccatccatgcttggcggggatggcttcagctgcctgtgcagctggcgctgctctccctgtgccccaactgagaatggctttcacctgtctccatcatgttccactccctaatgaacctctcactgcgttgagtgtgagtttcagtgtttaaaaagaaaaagaaactgactcctaatt

SEQ ID NO: 13489 - DNA, 195998 bp, Homo sapiens
  misc_feature (1)...(195998): n = A,T,C or G, or insertion/deletion polymorphism (see Tables 1-2)
cccaatccccattgactattgatgttattttcaatgtcctaaactcttttagcaatggtgaaaggcaagtttattttctctggacatatttctgtggctactgctcttgagtacaatttaattaagtcaccatcagttaatagctctccttgctttactaacaaatgagcctctaggacacttactttgtgaagaaattttgctgtgattagatattctgatttcaatttttttttgagatggagtttcgctcttgttgcctagggtggagtacaatggtgtgatcttggctcactgcaacctcygcctcctgggttcaagcgattctcctgcctcagcctccctagtagctgggattacaggtgcccgccaccatgcccagctaattttttgtatttttagtagagacagggtttcactatcttggccaggctggtctcgaactcctgacctcaggcaatccacctgcctcagcctcccaaagtgctgggattacaggcgtgagccaccgcgccccgcttgatttcaatttttaaatttttctggtcattcctttcctctcagttgggaaaattgttgatgagtgcttactctcgtgatgttgacatatgttctcttagcataactgctgttgttgcatactaaacacaacgctttgtcacctaatttgctaataaaataatccatacttcactgtgccttcaaagcacaaaattcatagtctactgatatggtttggctctgtgtctccatccaaatctcatgttgcattgtaatccccatgagttgaaggaggggcctcgtggaggtgactgaatcacggggcagggggaccttctttcttgctgttctcatggtagagttctyacgagatctggttgtttgaaaatgtgtagcgcttcctctctgtctctctctcctgccaccatgtgaagaagtcgcttgcttccccttcaccttctgccatgactgtaagtttcctgaggctttccagtcatgcttcctgttaagcctgtggaactgtgagtcaattaaacctcttttcttcataaattacccagtctcaggtacttctttatagtagtgtggcaacggatgaatacatctacttttcttttcttgttttgacataatggatatgccctggtaataaaaatttaaaataaatgtcgcagtacagagatatgcatggcactgaraacactgtatcaccgtgatttgtggtgtactgagcagcagtatgaagtgataagagcatatactgtccctgttgcaactacagtcaggcaccatataacaaagttttggtcaatgagggatcacatacatgatagggtcccataaaattgtaatactatatttttactgtgccttttctatctttacatatgtttggatacacacgtaccaatgtattrcagttacctgcagtattcagtacagtaacatggtgaacaggtttgtaacctaggagaaacaggctataccatatactctaggtgtgtagtaggctataccacctaggtttgtgtatactccatatgttcacagagcaatgaaattgcctatttctcagaatgtatccctatcattaagcaatacatgtcctaaactccatcattgttttgtgaaagcagccattggcaatgtataggctaaggagtatggctatgttccaataaaactttatcaacactgatatttgaatttcatataattttcatgtgtcataaatattatccttatttttatttttattttttgggacaaaatttcgctcttgttgcccaggctggagcgcaayggcgcgatctcggctcactgcaacctccgcctcccrggttacaggcatctgctaccacgcctggctaattttttttttttttttttttttgaaacggagtctcgctctgtcgcccaggctggagtgcagtggcacgatctcggctcactgcaagctccgtctcccgggttcacgccattctcctgcctcagcctcctgagtagctgggattacaggcgcccgccaccacgaccggctaattttttgtatttttagtagagacggggtttcaccgtgttgaccaggatggtcttgaatttctgacctcaggtgatccacccgcctcggcctcccaaagtgctgggattacagccgtgagccactgcgcctggcccttatgatctttttcaaccacttaaaaatgtaaaaaaagcggccgggcgacgtggctcacacctgtaaaaccagcacttgggcggatcacctgaggtcaggaattcgagaccagcctggtcaacatggagaaaccccgtctctactaaaaatacaaaattagccgggcgtggtggtgcatgcctacattcccagctactcaggaggctgaagcaggaaaattgcttgaactcgggaggtggaggttgcagtgagccgagatggcaccattgcactccagtctgggcaacaagagtgaaactccgtctcaaaaaaaaaaaaaaaaaagtaaaaaaaaaaagtcttagctgagaccattcaaaaacaggcagcaagctgtagtatgctgctctagatggytgtttttggtttggcctctatgcctggtgctacaaatcaccaaattctctgaggggatgaaacagcagtgaatacaaactcgcttgaatgaatttcccttctggtattttgactcctcacgtcctggctgacttggttgacagtgatgccttcaactcagctgggttttgttgttttattttggtattttatccagtttatagttagttgttcttgatgaaggagtcaatcygacatcaataccccattagaatgggaagtggaagtctacatgttaattttaatttgctacttttgcttaccattatgagcctccttctatattgacaaatatatctccacaatgtcataacattccattagatgaatgcaccatgatttaacttaataattccctataggggacattgaaattgtttctagattttttcactgtgatgaacacacttctacaggtttatttttgtacctagttgtttccttcagataaaatcctagaagtacgtggataagtcaaagggttcacacttttaaaggtatttcacaggtattaccaaacttctctttagaactgttacacaatggcccagcatctatgtgcttcttagtataggggccaatgctgggtgttaccattcttttcttcctttgccaatctgacagatgaaaactggttatctcaatgctgtttccgtttgcatttctggtttataggtgtggcaggctgataatggcttactcccaaagctgcatctatgacctaatccctggaaactgtgaatgtttaaggaaaagaggtctttgcagatatgaagttaaggattttgacatggacaggttatccaggtggtccttaaatgctatcacaagtatcacttttttttttttttttttttttttgagacagagtctcactctgtcgccaaggccggagtgcagtggtgccatctcagctcactgcaacctcctccctccaaattcaagcgattctcctgcctcagcctcccaagtagcggggattacaggcgcctgccaccacrcctggccaattttttgtatttttggtagagacagggtttcaccatgttggccaggctggtctggaactcctgacctcgtgatccacctgccttggtttcccaaagagctgggattacaggcgtgagccactgtgcccggccacaagtatggtttcttacaagaagggggcagaggaaaatttgtcacagacaaaaaaaggagaaggcaatgtgattacagacgcaagggtgrgagtgatgtggtcacaagcccccagaagctgcaagagacaagggtagattcttttcggagcctccagagggagcatggccccgtcaacacctccatttctactcagtgaaactgacagtggacttctgtcttccacaactatgagaggataaacttctgttgttttaagccaccaagttttcrtgatttgtgacagtagcagcagaaaactagtacaataggtttttcatatatttatggaccataaacatgaaaaatmgtctgacttttaaatcttataaaaataaaataacacacaataatacaaagagtatgattctatgtatgtacatcagaatatctgtaaatacgtttacatatgttcataactgcctaggaaagtgtctggaaggatatataccaaactagtgacagtggttaaccagaggcagttaactgaaagtggttaattagaagggtcctgtgtcctgagggggaaagaggaacttttacttgttactcgatactgctcaagatacatctgttatttgaaaacgctttatgagactgtactcatgtattgtgtaaaaaattagaaaaggcatatctgcttgttataaagttcatagaaascagaaaactatctcctttcacttatcctttcccagaaatagtcattgataataatttgcatcttctcagatttttttctacgcagaaataaatgtgtataatttttttaaaaacaaaaataaaatagtgagtgtcatatatagtgtttcatttaaagatgttcctccaaaatcaatcttggtccatgtgcctgtgtgtgtgtgtgtgtgtgtgtgtgtgtgtgtgtgtgtgtatgggtggggggaggggcggggacactgcatagaactggccagctgcatggactgtcactgtaaagaaagatgaagaatgcatgtcaccaagctctctgatgctttgaacctagcatatgtggctttgcccatatgtgcgggcacctctgtagaaactcttctgccagttgggctgaaaatagttttacatagttccatactgccttccaagctgttttcaaagtttatgctctaatagttccccacggaggataacacaagatattcattttcctcaaactttcccgcacaggttggagagaaacgacatcttaatgtcattgtaacaggcatttctttattaaaaaaawtttttttttggagacaaggtcttgctatgttgcccaggctggtctcaaactcctgggctccagcgatcctcctgcctaggcctcgggagtagatggaactccaggcgcgggccgtggcgctcgcaccacaggcattacttaggtatgaggctggttgagcatttttctcgtgttcactggctactcacgcagctttgtgaatggcttcggagatcactggacaggcaattttccctctcaatgaaccaaatccaaattcttttggaacccaagaccgcgatttttcgatttaggacctagtcccaaacaatgaagaaaaggtgatcttcaagatttcagcagggaaatctgtatatctgtacaaggttgaaaacctgggccgggggtcgcgttggaaccccacaggaaaaaggcgcggaaagccgccgggcattttccggggttccatagatgtccccagtgtcctagtccgtgcatcagctcgcgcactcggagggactctaggcagggggagrgccccgcggccagtatgtgcgtccgaggctttcccgcagggggcagtgccgcccgcccgcgcgccgatacggtgggagggggtgggaacctgcgcggagttctggaggttctttgggagaaagttaggggatgcggaggggtgggcgcaagacttccaggactccagggaggccgtggggagggccgccgagggtgcagtgtgaggcgcaggagggggttgggggcggtgcacgttgcagggagacgcagcccctggaagatgcgagtgtgaacgtgtgagtgtgagtgcgtgtgtatgtgtgtgtgtgcgcgcgcaccgcagctctccgggttccgcgaggcgcgcgggtgtcagcttgcagccggggctcctccctccggcccccctgcccagcccggcggtccctcctccctccctccccgctcgcccctccccggcgggccaggggctgggacgccccggcggagcaggcggcggcggtggcgagttggggagccctaggctcggcgctgccggaggggcccgagccgagccgcctgcgccccggccgggcagcgccgggcccgcttcccgcggggccacgccctgtcaaactttgttgcggcggctagcgcagcgggcccgcaagcgggcgggaggggcgccgggccgggccgggcagggcgcgggcggctaggggctccgagagcggcggccccggcccgcggccccaccatgccccagctcggcggcgggggcggcggcggcggcggcggcagcgggggaggcggcggctccagcgccggggcggccggcggaggggacgacctcggggcgaacgacgagctgatccccttccaggacgaggggggcgaggagcaggagccgagcagcgatagcgcctcggcgcagcgggacctagacgaggtcaagtcgtccctggtcaacgagtcggagaaccagagcagcagctcggactcggaggtaaggaagcaccgcggccacccccgggggatcccggccctgcgkccgctcacccgctcttgcctttgtgtctcctccgcaggcggagaggcgcccgcagcccgtccgggacactttccagaagccgcgggactatttcgccgaaggtatgtgcccgctgggacagccccccactctcgattcccgctgcgctccgctgctcagcccgggcggcccaccgtcccccttgcttgggtggacgcacccttgccctccgcctttattggcggcagcccccgtggggcgcgcgtggggggcgctggggtccccagctcccgcctcgagccccctgccgcggcgctgtcagtcccgggggcctgggcctcacctcgccttggtcttgttcgcagtgagaaggcctcaggacagcgcgttctttaaaggacccccgtaccctgggtaccccttcctgatgatcccggacctgagcagcccgtacctctccaacggacccctgtctcccggaggagcgcgcaccgtgagtgcccgtcgggcgcgccggggagggtgggaggccgcggcccgcaggatgcgcccccgggcttggccatggagtgggggatggggccttctgcgccgatcccaagcagaacttgtttgcggagttgaactactctctggcggccgagcgcgaggctgcgctggccagtgcctggatgaaagtaaagttactttaacttttcccctcttgcgggttgaggttttggagtccacctmtgggatcttccttggcctccagaattcttcgcctgcaccraaggaaacttggatttgtgcccgctttgggggggtctcgctttccttcttggaaatcggtcagctttctctggcagtggggcaaggggcctagggagctgggttggcgacgttgtcctccgactccgggttcactgggcggctgcaggctggttcctaagaaacccagttttcgtggcgggttattcacagcccccgttcccacccccagccctcgcaccggggcctcagcttttctgcggagctagctccgaattttaaactcgcgtagatgatttcgaggcgacccaaggcattcttcaagttgaggaacttggctttttcccccttttgtcgcctgcttttctcatttaaagcgagcgctgcgacactttaaacctgttaatgggcgcgtattgtgtgctgcccgctggcatttagagcggtgattaagcaaattgaccgggccccagacgacgtgcaaatgagggcggattccttcgccccctctctctggctctaaactcccgccccccgcgttgcgaggggcgcagctgggggctggcgaggcctttgtgtcccccaagccgccactccacccctaggctccctgcccaggtgctgggtccgatgacagatgttgggtgaacgcctacctactgtgtgccaggttcccgcgtgctgctgcttgggcgcgatgtgaatcgtagtagttctttgcttcccgcccagattcccattgcctgccacttcgctgtcgacggtgggtaagggggcagggagtgttagcctcttaggagcagggtcccagcaacacactttatgctaagactgccctaaaataacgacgataattaaagggtgctagagaaaggctaggtgctgaatggccattcctgctgtcattgtacagcggtcggtggagagccaagtcctccacatttggttcagcgggggcgctaccatcaccagatgggttggagggggattgacggggggcggtggaagagactctgactgagagagaggggaatggggagtgggactacacagacctcacagttttgccccgagagggagggaggtctcttgcagctttggccckgctggcctggagcaccccaggaagtcctgaatgtaagtgtcagttttgcagtgaaaactggatgtgggtctatggctgttgctttttctcattaaaagaaaagaggtgcgtgccaatcaaagggggggggatcaacgagctgctgcggtcttatttaggttttcagtgattcccaccagtgcccacacatgtagcttagttctgcaagttttgttgggattcgtgtaactttgcgtatgggggagagttaatgccgctaaagtctcaggtttccatttactattaggatatctagagagaggggtctgggaggcactagcatctgtgcatcagccctcagccaagtcctgatgcagttaaagtcaccagaaatgactatttcaccatcaaatatgactatggctccctcaaggctatttctccatgcacccatttctctttagggcattttgattcatccaggctctgctgtctgctctctctgacagtccaagtgagacagatttttgttagtgtcccctccttccttccttctatcacattatgtgttctttcgcctaagaacttccaaaggctgattcttgctgatcctggagattcctgattactaaatccaggcccgtgtgggattttggagcccctccttgaggcagccaacctttcgtctctgcatgcctctctgactgtccttgttcatctctgcagttgttccctgccctggcccaggcaccagcctcctttcaagcctcctaggacatgtactttcttggggacttagtatgtcccatcccacccccatacctacatcttgtctccctggtgacttgcccttacagaagttagttcagttcccagtgtttctgtgtctctgtgtgcctttcgctgtgttagttcacggatatactggggaagtgtcctgcccttaggtcagcacagttaaacctaatttgaccctgttcgtttgctgccagtaagtaaagcaagtgaggaaacacttaagcacttggttgtctggactatagggtggagatgatggttttctgctgaacgattctattaatataattaagataattgtcactgtaggcaaatggtaggtacagacaaagtggccctctgttggtttcccagcctggtaaaatgaatgtggatagataygagtggggagggaggagggaggaaagtgcctgggatatatgatccgatctctctgacatcttaggtcttttttattgtttggcctctaaactgcaccactttaggctttgctgctctaaggcctagaggtagtataaaattaggtgaccccagttatctgctgstctaacacttcctctggaaataccaagccagatgcagaagtgggaattgtctggattgttttcagggtgttaatgaaccctaggaatagcaggcaggaggcttcagcagcctcacccactggcataattcctgctgagaccactgggggctggcccatcctacagtctggccatctctccccatgagccatcacccttgccctccactctggtttggctgggatgctgggaagtggctttttcctgaggctctttagagaagaggtcccctcagcatggratgtgggccaagtctctgtgagctgcaattgcttcttgtctggaggccctgggaccctgtgaagagaggaataactgccacaaaccatttttcaaataatcacctcaaaattatacattcatttctgaaaaggcttcacggtttactaaactactttggggctgttgcctagaattttgttaggaaaatgtaagttggctgggtgcggtggcttaggcctgtaatcccagcactttgggaggccaaggcgggcggatcacctgaggtcgggagttcgagaccagcctggccaacatggtgaaaccccatctgtactaaaaatacaaaaattagccaggcgtgctggcgagcacctgcaattccagctacattggagactgaggcatgagaatctcttaaacccgggaggcagaggttgcaatgagctgagattgtgccacttcactccagtctgggcaacagagtgagactctgcctcaaaaaaaaaaaaaaaaagaaagaaagaaaatgtaagtcaacacattagaaagtgaatgccaaaaatggtttaagacaaagaagagccaaaaagaaaatgttgaatgtggttcagcaagccagctacaatgtgatagaaagtaatttgactgtgaccatgaagtgagggctgatgacattttggaaagaaacacttctaggtagtattgctgagggagtctgtggtttttgtgtccatcttataaattacagaacctctttcgttcagcacaagcacacgaaaggctttgctttattatttctcagaccatctcatctcaggcttgtgtatgaaattgtcctggtcctcaaaygcgtgctcatttttaagtcctttatatcccactgcttcccatgggcagtcttgctcatatcctgggagctcctgttctttcagacccaaaggaacccaagcagaaatctttgtatgtatatgtatgaagargttgtctgtttttaggagttgtatgtaaaagctaaggaaaccttttcttttggaagatcagtataaacatgctgcttttggtaaaattcttttgagccatttcatctaaatataacttctgtttcatttttttttctaaatataactcagagtttaatgagggcttttcacatggaacaagcttttgagagggcctgtgttgctgaagttttcgcccttggattgctggggtgatattggtgacaaactctgtagggaaggactgggaacctgtcaatcttttttctttggttgggtggattgggcagggaatagctgacttgatttgttataagtttggaaggttatagtttggtcacattcttcattgatcacacttttagggattcttgaagaaaagggaagcaaaacatacacacacacccccacccaatctaacagcgtattccagcctttacagtgatgtgcagtgttactaaaataattgggaaataaaaaagagtataaatgattaactcgctggaaaatcttttaaatcttctataataggaaggccctacttacattctaatttagagacaccttttacatgccaacctagggaaatttagatttacacttttctttttttttttcttttctttctttttttaracagggtctcactctgtcgcccaggctggagtgtagtggtgtgatcttggctcactgcaacctccacctcctgggttcaagtgattctcctgcctcagcctcctgagtagctgggattacaggtgcgtgccaccacgcccagccaatttttgtatttttagtagagacagggtttcaccatgttggccaggctggtctcgaactcctgacctcgtgatccacctgtctcggcctcccaaagtgctgggattacaggcgtgagccactgcgcccagcctagatttgcactcttaaaactaattcctaactcttaaacttcttcaactgaagtctattggatacctatcatgggcaatggctaagggaccatgggaaacaagataagacccaggctttgccctaaaggatttaaaaattaagtaggaaagaagtcatggtagcactgtaataagaagttaagaggtagtaaagtctggagaagcattttcataatagaaattgagaaaaattacttcctgggtgatccaagaaggcaggtcgaagaagtaggtttaaactggtccttaaaactcagtcattctttaatccaggtaattcttgttaatttagaagaatgtaaatagtaagaggaggcatttagagtgaaaaagtggaagtcttccttcactctcatcttgaggtgggagccaggaccaggagagtgaagacatggaggaaggaaaagttcagggcgatttgggggtaatgcagcttatttcagttccatttgcctggaaggagaaggggccaggacatgggctaggggacctagaatgccakggaaggaatctgatcttatttaagaggcagcagagaaccatcagaagttaggctgggaagtgatgtgacttgtacacatggctagaaagataatggtggattggaggacgaggacctggaaggggatagagcaattagactcacaggagtcaggggtgaggtgaaaagggcttcagagtagcagagtggaaaggaaaggtgggatgggaggaaataggattcttgtctgtacctctttggggaggggaggtaccagatccagaaagtggctgatgtcacagttaattcctggtgtccaagctcaggcacctggagactgacttctgtgggtggggaggcctccccagtctctrcctccccagtggtggacagatgcttactgaatattttggcgatgacagagcccacacagtctatgagaggctctcattgggaggaaccctcggtttcattggagacacgttaggtgtgaggggatgttgaggggatgattgaaactggctgatgtaagagaggtatagaagtaggagaagggatgcttagagcagggacagaagtcgttggaggaggatggaagggagcattgggtaaggtaggagaagcacttagggactcccctccccctttcttttccctccatggtggaagctggagggaaagaaagtgggaggccaggtgcagtggctcatgtctgtaatcccagctctttgggaggtcaaggcgggtggatcacctgaggtcaggagttcgagatcagcctggcaaacacagtgaaaccctgtctctactaaaaatacagaaatcagctgggcgtggtggcaggtgcctgtaatcccgggtactcaggaggctgaggtaggagaatcacttgaacccaggaggcrgcacctgtatcccagctacttgggaggctgaggcaggagaattgctttaacctgggaggcagaggttgcagtgagctgagatcgcaccattgcactccaacctgggcaacaagagtgaaactccatctgaaaggaagaaagaatccagcctgggcaataagagcgaaagagagagagagacasagagaagagagaaagaaaagagagtgtccttggtgttagatgccacagagagagaggggacaagaagatcgaggagtcaagaggagcttttgagccagatgctgtggcttgtgcctgtaatcccagctactcaggaggctgtggcagaaggatattttgaggccagaagttcaagaccagcctgtacaacattgcaagacccaatctctaacaaaattttaaaacttgtccgggcatggtggtagctcaggagttcaaggctacagtgaactatgattgtgccactgcaccccagcttgggtgacagacagagtgagaccctgtctctaagaaataaataaaaataaaaaataagaggagcttttggaattcagctattaggaagttactggtgcccatggagggaagtgttccaggcaagtggtggtgttaaaggtagagagaagagacattagctcagtgcttcccaaataggatagccaaggcgccaagctgcagactgatctcaggtgtggcccagtgcctccccctcagctggaaccccagaccagactcctgcagtttcaagcagcctcctccttctatcccggtgtaccttccatatctcagtaccaccacggggaacctcaaagactcgacaacccatttcaaaagcctggctatggaaagaagaggaaagggaggagccgcaagtttgggagaaagtgtatttgggatgctggagtgggagcctgtttgtaggagccatagggcaggcttgaagatgaatgggaaagaagatgagaggaagaggaggtgagactgagagcttcaaaagcaggtaggcttcttacttcatccgtggagggtgctgtatagtaggtgtccccccagctttaaagacgagcccaagacttgaagatgaggttgtaggggaatgcagaggtgagttggcagaaatggatagtgtgcattggaggaccagatggcttcttggtattctcaggaaaaccaagggcaagttggctagagtgggggccttggaattttgttggcagtagggagactgcaggaacttcctctccatcctctcataaagcccaaaatgttgggaaccttttagctacatgttagataatgaaatgtttgtgtattgattgaaaggaagacatggcacacctgggaaattttccctccttttattatctggagctggctgatgttgaagagggatagagcatcaaaatacgctttgtgtcctggtgtggtggctcatgcctgtaatcccaacactttgggaggccaaggcgggcagattgcttgagctcacgagttcgagagcagcctgggcaatatggcgaaaccccatygctacaaaacatacacaaacttagctgggcatggtggtgggcaccagcttcttggaaggctgaggtgggaggatcacttgagcctgggcatggaggttgtagtgagccatgatcacgccactgcactccagcctgaatgacagagtgagaccctgtttccaaaaaaaaaaaaaatgtgtgtgtgtgtgtgtgtgtgtgtgtgtgtgttgtgtgtatatatataatatatatatatatatacacacacacacaacacagacacaatttgtgtgtagctaggggcagatattgagatattgaagtgataagtaactggggatggggaagtactggtcacttaagagcatatagaaaaccgtcccagattgtcttttctaatctatttttggaggaggtttttatatatcccatgttttatattatttctcccaaaccggattagatatagtgaacaataaaataaatgcagtttccaaaaccttggtgttcagaaatgaagggaaccatgaggggagtgaaggggacttgccctttgctctgtgctgtatgcactgcccagggaacagccccaggacacttctatagtttctttctgagactcacaaggtgttagcaatgctctgagctcactcaattgacagatacgtttaaggttctcaaataaatttcaaacttctaaatttttccttttcattgtgtgcataatgtacagattaggaaaatgatcttctaattgagaagtatacttcaaagtttggaaataaaatcataaaaatgttttcctaaacatagcctttttcaggagtttttgtggatatggtcaaaggcaatagctctaattatctggggtcctcaggacaggaaatgagctcacactcatgctctcaaactgtgtcacagcatttttggaaatattttcatttctattcaagaggaggaacaaggccccaagtgttcaccctaattgtagaaaataaacataaacatgaaattcacaaaagaacaactataaatggctgcaaatatgtgaaactatgtttaacttcccagggagtcaaaaaatactaattaatacaagaatcatctttggcccaccacattatgattttgtctgaataagcctcttcaatgctggcaaatatgaggtaaaatggctgctccggctgctctttttggctggtcttaaggggcgcaaatagctccaccccatttggaaagcacttggcaatggctgctaagactttagtgtttttcatagcttctaacctgctaagaagtagatacttgttcccattttgctgctgtgcaaacagacttgtagaggtcaagtatctcgtacaaggttacattgatggtgattgatggcgccaagatttgaacttggttgtgagtccaaagtctaggtctcccattctacccatgtgattttacacacatgcctgatataattagctcctcctcctctccagagaagggcagctgacctttgtttcccagttcagaaatcctggtgtgagttatcagctggggttgagggtggatagatttgttccaactttacacattggacctgagaatgtactttcctgaataaacagttgtagaagcgagtgacagttgtggttgaagttgttcccccagtgcagtgccccagaggggttaatgacctttcgtgggctgtcccaggaacttcatccgaggaaaaggtgcttacctgctaacatttgacctgtttggaaattggggattgtttttcctcattgaaattggtgagggttggaagaatacgcaaacgaatgtttggtgtggaagaacgctggaggagtaaacttactatactcacaatttggattacaacatagtttggttaacccagctctggtgaaccaaatgtacaagtattatttccttatggttcatcttataaaatattttataaattggttgctttctttaagctctccacaaatgaaaaatcagtcccaaaaatctataaaagactatttcagcgttaattgaccattaaggaaatacatactaggctgcatgtggtagctcacgcctgtaatccccacactttgggaggctgaggcagacagatagcctgagctcaggagttcgagaccagcctgggtaacttggcaaaaccctgtctctacaaaaaaaaaaaaaaaacaaaaaccaaaaaaaacattagccaggagtggtaacgtgtgcctgtaatcgcagctactcaggaagctgaggtgggaggattgcttgagcccaggctgttgaggctgcagtaagccaagattaccccactgtactccagcctgggtgacagagtaagaccctgtctcaaaaaaaaaattttttttgaacaataaagaaatacatactaaacatttacacagttattttgggaattgcagaggggatatttgtcttctttcccatccccctttctctctctctctctstgtgtgtgtgtgtgtgtgtgtgtgtgtgtrtgtgtgtgtgtgtgtatgtatgtttaagatggttagaaatcatgaaactccaccrggcacagtggctccctcctgtaatcccagcactttgggaggccgaggcgggaggatcacttgaggtcatgatttcaagactagcttggccaccatggtgaaaccccgtctctactaaaaatacaaaaaattagctgggtgtggtagcacacacctataatcccarctactcgggaggctgaggcgggagaattgcttggacccgggaggyagaggctgcagtgagccaagactgggcaaaaaagcgagactttgtttcaaaaaaaaaaaaaaaagaaatcatgacattccatactttttcytttacttcccaaattactttccaataatagcatggtggaaagattaacaaagggggcttatgatatggttgacagaagttgggaggcttttggggtcctacctaagccatcctagagacctgggtattgcaaggcactaaatcttagataaatatcttagacctcattaaagtgaatggggctattatatgtaggaatgtccatagagaatgtgtggagaaagcagaaaggtgtaagtttgagagatggcaactgtgattaaggaacagatggatctcattgataatgaggaagaaaaatgaagtaggaatgagtggtatgaaaagcagatcaatttacaagtccagatttgttggcagtagtgctttctgatgtttgggactacactcccctctgtaaattccaaaaaaggatatgtcagggtcattaaactcagccggatttgcaagacataccttctagaggtggttgggtgttagtccctgagattcttatcaaggaccctgcgggagtgtcctctagccctctgagctaggtggaaccatcccgcccacccaacaggtgaggagcacaagctcagggcagttgttgacctgcccaagggcaaacaattaggagtgatggaaacaggactagggtccagctgcactctacagtggtaaagcttcatcttctaccactcagggaagtacacagccagcagtgctccggagatgatgcacatctttttgmtatgtttttattttattttattttattttattttttgkttatttaaaaaaaaatagagacagggtctcactatgttgcccaggctggtctcgaatgcctgggctcaagtgatccttccacctcgacctcccaaagtgctgggattacaggcatgagccactgagcccagctgagatgatgcaccttgaaatacttctttatctaaaacctaacacctgactcataataagcgattcacttgttgattgttgacaacatgaatatttaaacatcaatattaaaaaatagccccataagcacctttagtgttccagggcactatatcacgctgttctaactcttcctacactgaattcttgtgcatctgatattatcacctcgattttatccttgaggaagccaagactttgacagtaaaccagaggcccagagtcacctccccagaaggtgatagagccagcattccagctgtgggggattctggttccactgggctgcaatttccctccactgaaaattgagagccaaattgacgtgacaatgcatgaaaatgccatttggggcaagattcaaagaaatggtgtgtagaagtaaaagatgagtaacatccctcagcatatattcttttcagtggcatttcttttcttttctttctttctttttttttttttttttttgagatggagtttcgctcttgttgcccaggctggagtgcaatggcacgatctcggctcactgcaacctccgtctcctgggttcaagcgattctcctgcctcagcctccygagtagctgggactacaggcgcctgccaccacgcctggctaatttttttgtatttttagtagagacgrgatttcactgtgttagccaggatggtcttgatgttctgacctcaggtgatctgcctgcgtcggcctcccaaagtgctgggatcataggtgtgagccactgtgcctggcttcagtggcatttctatccctttcacttaggaggcatttttagtacctgacgtagaatcagagccttaatagctggttgatttacagtctcagaggtggtgttaattgctatcttaatctttctttgcttttctgcactgtgcagctctattgattctgtttttcccaatctccaaattcccttgtgtttttcttatgatattttgaggtggtacacttggttccttaaatatcataggtgagatgttaacagttctaggtggagatacacrggcaatcaatctattcacccaacttctctgtatgtttggaaaagttcggaattaaaaacccaggataaataaactaaggcctatttcttcagccacattcaaagtccctgtagtctcmcatctggaaaccctgcagtctgcctaggccgtgtcctccacctcaggccaaggttgcagcaggtccttattctcttgtccatgatgaagcttttcgtggggrgtccgggtagcaaaatactctcaccctgtcctcactctgtggaatcttccatacaacccgaaytrgggattgcttgtgtgtccccctcccacctgtcactctttccccrcccctccccacgtgatgctgtgggaacccaaaccccagcacctcctagatgagggcagtggtagggcgctaggtggagatggggagaggaggaaagacagggaggggactcctggctcttggggtccaaggggattccagagaaagtgagggaggggagccccagtcccagagattgaggaggacaggatcttggtggtcccagctgggccaggggccccaggaccctagcattaaggtgtagcccctgtgycacttgtggatgaagctgcccttggggatccactcactggcagacgtggtggtgtctgggtgttaaatctatacaccatatgtaataatggtgggcatctgtttggtgccttagtttgttgcctcgctcatactcctgaccagccccacatcctcgtgcatgtgtgggtgtaactttacattggatatacagatgcgactggactttaaatgggcttacatcyggataaacccatcgtaaagtcaaaaaaatattaagttggaccatcataggttagggactgtctgtagtttttacttattaattatgttattgacttaaactatgttctgggtgggatgcatagaggagagktaccatgggagggtaagagtatagtaggagtattagagtgcatgagctgaaaacacttkgctttctactttacaacataagctttttttgttataaaatccttgttagggagagtgagacgctggtgctgaagctttggagtggaaaatgggtcatcttcacaagggtgttcccagatgatgcaaaggagagttaatgcaggaaggggctgggatggggagagtctgtggagtctgagacagccctttaataagcagttccttggaccttgcatggaaagagaggagaggaacttgtgtggaaagaaagaagcccaaggcttgagggatggagaatattctactaacaggccaccccttgtccctccaggtggcagtgtgtctaggggggtctggaacttgggttttgaccagggtttgcagagcactgaatcccagccgcrtcatgagttggctgtgtccctatgccccagggcccccctcagggagaatggggataatgatagtcataatgataaatggggacagataatgctttgagaagyactgaagtaacattttgtctgaatggactgtgttttaaaatcaggagttgttcgaggctgaaatgaaatatcagcatcatagaatctccaggatataaaaagaaattagaaatgttaccaaaataatatacagtattatcacaactttattaagatgtttagtagccaaatattttaaccagcatcttaacaagtggatcttttcttacagtatttaattttttttttttttttttttgagacggagttttgctcttttgtccgggctgaagtgaagtggcgcgatcttggctcactgcaacctctgcccccccaggttcaagcgattctctctcctgcctcagcctcctgagtagatggaattataggcgcctgccaccacacccagctaatttttgtatttttagtagagatggggtttcaccatgttggccaggctggtctygaactcctgacctcaggtgatccacccgccttggcctcccaaagtgctaggattacaggtgtcagccaccgcgcccagcccttaaaattttttttataggaaatgactaaatggagtcaggggagaggccagaaatgcataaacaaaagcaattagtatttagtgcgggttttgaatttacatggttgtcaattccctttgcaaaaacttaacaaattactttaacataattgccagtttgtgtgagttcttgatcaaatagctatcaacaagataatgtgcatatatatgtgtgtatatgtgtatatatgtatatacacatatacayatatatgtgtgtatatgtgtatacacacacacactaactttataaataagttgaaatttatatgtaggatatatgtaagcagtatagtatataaatataaattacattttaacttttaattttataataatttcagtcacagaaaatatacaaaaatagcacaaataattcccttgtactttcccctaaatttgccttctttctgtaacttttttttttgagatagagtctggctgcaacgcccaggctggagtcagtggcgccatctcagctcactgcagcctccgcctcccgggttcacgccattctcccacctcagcctcccaagtagctgtgattacaggcacctgtcattacacctggctaatttttgtgtttttagtagagacagggtttcactatgttggccaggctggtctcaaactcctgacctcaagtgatctgcctgcctcagcctcccaaagtgctgggattacaggcgtgagccaccgcgcccggctctgtaacttttttctgagccatytgcaagtaagttgcaggcgtaatgtccctttacttaagggggcataatttgttagattgcatctctgatactatagagcatatttgtgactctaaataagatgaagggacaagatacgttctaaaaacaaggacattcgccaaagtgtaattactgaaatcgggaaattaacatagagacagtacaattgtctcatctatggaacttattaagattttgccagttgtcttactgatagatgtcttttgtagaagaggaaaacatttttacttttatttattcattttttttggctttaggatgagttcaacatcacatcttatgcttaattgtctcttagtctcctttagtctggaagttcttcggcctgtctctcatgttcttgactctttttttttttttttgagacggagtctcgctctgtcgcccgggctggagtgcagtgaagcgatctcagctcactgcaacctccacctcccgggttcacgccgttctcctgcctcagcctcctgagtagctgagactacaggcgcccgccaccacgcctggctaattatttgtattttagtagagacgggatttcaccgtgttagacaggatggtctygatctcctgacctcgtgatccacccgccttggcctcccaaagtgctggtattacaggcgtgagccaccgcgcccggccatgttcttgactctttaaagattacaggccatttattttgcagaagaaccttgacttttttttttttttctggtgtttcttcatgagtagctttaggttgtacattttgggcaggaaagatagggtgttcttattgtatctcctcaggaacgttatctatttttcccattataggtgatactaattttgttttcttggttaaaatcatgtgttccagctttctccaagaaagttactacttttcttctttgtaattaatcagtactttatgggacatactttgagactatgtaaatatcccatttctcatcaaacctttacccartggttttagtggccattgatgattcttgccagaaacaatttccactgtgacagttgccaaattgatgatcagtttttaaaaattgacagtgtagggcaggagcaataattttttcagttgctagattgtttctgtgacactatagaacatatttgtgcatactaaataaggwgaaagtatgagatatcttggggtctctcatttttaaaaaataacaggtttattttctctgaagcttttatagtctttattatgtctggatcaaagatgatttatcaagaaactatactgcaagattttggagttttttccttacgaaatgttgagatagcaaagttgacattctgctcagcatttttcataggatgtgagtaacttcctaattaggtttttatcttgatgactcctgtggagtttttcacagtctggattttgctaagtgcaacctcatgatatcttttaacatgttgctctatccactgaagttcttgaaaattattagatttagatttttggtcaagattcagagtgtttctctctctctcccattccctctctccttttttaacttatttttgcaagactgcttcatataatagatgttgttttccatcagagatactgattatctctctgtgatgtcagcagctactaattatcagcacccacatcctttacctcatwtgcagtttcaaaatggtgatagtctatttgtatcattcccttgtctatcagttataatatttttaaaaagagaaactacccctcaccaactctttagttacctcagatcagaggtcagcaaactagagtctacaggctgagaccagtttgccacttastttgataaataaagttttattagaacacagctatattcatgcatttgcatattgtttagggcagctttggggmactacaaggtgcccagttaattagctgtgattgaagccatatgtggcccaccgagctggaaagattttctgtcaggccctttgcagtaaaaatttgctgacccttgttttagatcatatggggaaagcaatttaaatgcctcattctttccctttatataccagtttcctcctggtttcatggcaccctgtaaaggtgaccaatgaagcttaaaatattatgaaatagatttaaacctacttaatgtctttcaatccatttgcaattattatccttattgatacccaaactgtcccatctttagccagggggagcctcttcaggctggcttctgagtccttgtgacacaatcctggtggtcttggatgcttctctgcttactggtctggcaggatactccagcacaccttgtacatttcttgtcccaggccaggagctggccatttctagaagaagctctgtcttcttttagtggagaatgttacttacagaccactgtctgaaccctagggttgcatatatagctactaaaggttattgtgtttaatgttatgagtgcactaagcagttctgtagcgactagaggtagaatataatatgcctattgtaattttaaaacaataagcatttatttgctctaaaaggatataccattctctctctctytttttttttttttttgagacagagtctcactctgtcaccgaggctggagtgcaggggcgcgatcttggctcactgcaaccccagcctcccaagttsaagcaattctcctgcctcagcctcccaagtagctgagattacaggcacgtgccaccatgcccggctaattttcgtagttttagtagagacagggtttcaccatgttggccaggctggtcttaaactctagacctcgggttatctgcccatctcggcctcccaaagtgctgggattacaggtgtgagccaccacgtccagcctagtctctttttttaaatgtactcttaatattggtgattctgttcatcaatcccccyacttaatagttgtataattttacatgataattgctttctacataaaattaatatttttcatgcttatattttactctttcaacaaaaaataagcatatatatatttctaccaactgatacatttcaagagataagggycacaaggagattttcactcaagttgcacgtggaatgtttacctgtttttgaaagggcatgctcagataatgacagcagatttgaacaatgcttcgtttccttagttctcacattgctacatggatgggatatgttggtcayctatgtgattacatcatcatcaatcaggcagaagttcagtccttctgaagattcatgctaaagctggataacagatttccattgactagtataggctgaagccatactttgatgtattcccaggatctacctcatagttgcaaagattaaataaggttgcatataagcatgtagaacagtgcctggcacacacagcaagggttttgttaagataaactcattatctgttttagtggtcctgggtttcatgatcttgctagcctttataaattttttttttttttttttttttttgagatggagtcttgctctgtcacccaggctggagtacagtggcacgatcttggctcattgcaagctccgcctcccgggttcacgccattctcctgcctcagcctcccaagtagctgggactataggtgcccaccaccacgcccggctaattttttgtatttttagtaaagatgggatttcaccgtgttagccaggttggtctcgatctcctgaccttgtgatccacccacctcggcctcccaaagtcctgggattacaggcgtgagccactgcacccggctagcctcyataaaatttaatctctacactgcactattcctaggacactaacttatgtttaattttggattgctagttttctagaatacatattcttaagtatgttggctgtcatatttctcttttgatgatcattgtcgctaacaccattctttgcacacaaagtctgccttctttctgcatatgtgtgaatatctgttactgttgatttacatttccctcttttttatgcacagtatgtaataaaataaacagcaaaagctgtcttcctcttagacattttaggttaacaagggaaatcattgttcacttcgggtatctttccatgtgtaatttttgataagttgattactggtggttgttcatttttattttgctttttatggaagttttctcaattcgtcccagaattgaggctgtacatcctttaaaaataaataaagccgaggtctgtgctagagttagaacattgaatctggctcgctggtttgtgctrtggactttccttyatctgtgttactgggagtatgtgagcagttgtagaggccatatcgttttataggcctgtgccaaggaaaatacttgagaattacattagcaactccaaggtattttggctgctctgagaggacacatgatagttttccagttataygaacaagagcttttgttttatactgaagtttcttataggctatgagaacaatagtgcctctttaagtacttcccagagtaacatccttgggatgttattaggtagaacgtgctgggcttcatttctgcaggacttctcaggcctttaacatgccagtgaatctcacagaagggagtgtattatgcaggattccttgggtttgtttgaccaaggctttccttgtgtttggaatactacccctccacctactccccgtcaccccatgcgtaagtctcacctcatacttccctgcctcccagccttagatgtggtttccctgctgtaagttctcagctctctgtacttgagcacatttcactgtcggtaaatatgtggcctaataatgatctgatcctctggatcttaaactcactgaagaaggcaggcagtggatttgttttgttccttccctcctgtgttctcagcaccagatataaggaaggccgtcaaacaagtatttgccgtccaagtgagtgaggcacccatagaactttttttttttttgagacagttttgttctgttgcttaggccagagtgcggtagcacaatttcagctcactgcaacctctgcctcccgggttcaagcaactctcctgcctcagccttctgagtagctgggactacaggtgcgtgccaccatgcctggctaatttttgtatttttagtaaagacggggtttcaccatgttggccaggctagtctcaaactcctgaccttgtgatcctcctgccctggcctcccaaagtactgggattacaggtctgaggcaccacacccagcagaacattttttctccaagtagcatctcatggtgagaggtgaagccagctggacttccttggtcgaatgggtacttggagaacttttctgtcttacgagaggtttgtaaaatgcaccaatcagcactctgtaaaatggaccaatcagcactctgtaaaatggaccaatcagcaggacatgggcggggacaaataagggaataaaagctggccaccccagccagcagcagcagcaacgctctgtggaagctttgttctttcggtcttcacaataaatcttgctgctgttcactctttgggtccgtgccacctttaagagctgtaacgctcactgtgaaggtccacagcttcattcttgaagtcagcgagaccatgaacccactggaaggaaccaattctggacacagtgggacttgtgctccacagaacccactttgagaaccatagattggtctatggaactgctctagtcttcgtacttcattttcaagtacwaatcactagaatactatagatcttcataattctagttaatttacttcatgttttcagctaacagggaactgttaactaatttaaagatgaggctcagcacttgaaatagattgtcttagtggcccacagagaatcagccaggattaggacgttaatttcctgatacctgtcctagggccagttacccaccaggcccgtctgcaccccactctaacattgttagttacataaataggaaccagtgttttagactgttgggggaggggggaaatcagatgcccctttgtacactaattaacgcaggcagaacaaaaggcccagcttggttttcaagttcaagtttggctcatatgtggtcctcagtgaagattatgatcttgaataaattaaaaacaaatgttaaagaagtcataatgaggtaaaaaaaggagttcaggattctggcctttaaagactcagggtaaacagacttctctttaaagctgatgttcacctcccctcctccactttaccagtccctctttggaacttctgtgttccgtcttcgtgataattgttcatttttacttcagtgagccaagtgggtaggtatgtacgtctatggtctcatgtcggwgagcacaagcctcattcaccaagctctgctgaactaggaaaatagtacattgagaagtctggtcaaatccactaagtcaaagggatttgcacatttggcaaaatgccctcttcctcaggaatgaccaccgcagcctgctgccccagtccagcttcagcttccttttcctccagggtgctcaaggcgagtgttcaggaagggagcacacagaatccccctgtgttcgtctcccccaggccaagttcccagtacattcttgaccagggcagaccagatgtggggagctctggggccagtgcgtttatgcactaaatgggactctgtatgtatatgccaaattaagtctgcaggcagtctttacgagcacagtaaccgttttacagatgtaaagaagctcaaaagtcctgtgtatgtttgtagtctcattccctgtaaagtttccatgagcacatttcaaggcctctgtacacagaaattgagttcctctgctctcaccagcttacctcttcactgtatcaaagttcgcatcttattattctgtgtgtgtatgtgtatacgcgcatgcatgcacatgtgtgcatgatgaataagttctcagcttggggcagcattgctgcccaggagacatttggcaatgcctggagatattttggttagaaatattttggttagaaatattttggttagacttgggtggggctgggggcacattctactagcatctagagggtaaaggtcagggatgttgctaaccatcttacaatgcataggatggttcctcacaacaaagaattatctggccccaaatgtccatagccgaggctgagaatccctggtgtacatatacacatattatatatacacacaaataaaaacatattcagtatatatttatttactggaagaggccttagagacccatttgaattttagttatagttgaggaaactgaggctcagagaggtgaacagtgttcctaatgtcacaaagctcttgagaagcatagcaggcccagaacttgggcttctggcttctctgaacagtgctttttgcagtgataatagttctttccgaactactgctagattgagaaccctcattctttgggtgttctctgtgtcccagaggaatattgcatgcattactttgtttagtcctcagaatgaccctgcaagtaggaactggttattcatcctttactcaagaggaaatcaaggcccagagaggtcaagatccttgcctgaggccattcagcaagcctggggcagggactggcttggaaaccagattcacccagcccctgccatgtggcaccacctcccccagggccatgctgacagcttgtgtaagcctgagggacaaggcagtgaagatgctgaactggggacccatggggttccttccaatagttgcattctgaaactccagtttggaaatggttaataatgcctgaaccttgtccctaagaggccctgagctattgaacccatggggttttcgggtctgcagccattgcttaggaggcctctgggtgaagagcaagaatgatggtggccaatctacctgcaaggaccaggggagctgggtaggggcaggatggaggggccctgactggctctcctgccttcccctcccctcctctccctccttccctccttaagggaggtctcggggttaatgcgaggtgaggggcagttagtggtaattgttcatcatttgtgcagatgggggcatggcttttagaggtgccttctgggatggagagagcctgggaactcagaatgctacatggcggacagaggaaagcaggcatttccagggaaggaggaaggactggagttgctcctgggaaggtcagctttacagactcctggccatagtggtgtaaggtgctagctgagtgggcagaaggcggggcaggggctaggagagctgacagcaagtgtggtgcatggccctcaacgtccaccccagtctagtccaggactcctgctctggcttctgcagccaaacccaaacggactggtaaatgacttcatttaacttcccgtgcccaccagcatggcactttagaacataggagacccagtcccctctgggagtcctctctctcccctctccttttgggtctggtgtccaggagaccatgcacatgactccgtgtgaagctgaagccagtccagaactccgaggcccaaacccctgcaggctgtcttagtgcttattcaatgtattttgtcttggggtgatatgagcctgtttaaaaataatgtctgcccaaactcttgcctgagagaggttgggggcagaaagaaagctcacatttgagtcctaagaaaagtcattgtgtctctattgccaaaatcatgatagctcaggtcaggttagtttcggaggtgtgataaagtttttatctcttttggaaaaaaactcccgggattttctatcgtggacatatctttcatctacatgtccagctttaagaaaatgtgattatgcctctctgtaagtggataattgagcagaacagcatgctaatttctctctgtcaggccttggttgaaggccggccctttggaggtggtccaggccctgtggccacagctcacctactgaagggcctcctggtactgccacaagctgggacccagccacactttctgtttgtcctcggaaggtttgctccaccctaaggtagatctctgttactgaagaatgtgtctttaaatctacctgcatttccatgtctggttacaaattgtcttaaccccaggcaagttgctgtctcagagttggctgcgaggatgttgaagcataacccggctttgtggtagaggagggctttgtagcaccgtggacagtgcggttcagccttcgatcaataaatagaagcaggctccagcttcaggaaaaggggagtcttggaccgagagagattggcgtttgagacaggaaacacttcctggtgttcctgcagtgtctgcggcttcttcccagccttttaggcctttcctagggtttacagaccacccctcgagcctgtgttctcctcctgatggtgcccaggcgcccggggctccctgggcagaccattcacttcgggaacctggtctcctgctcagcctgcagcttctgtaggtttagctgtctgttggttgctctgggctactcagggaccagttgtgcaggcactgtcctcttttggcctttcttccggccttaccaagttgtggtggttgtctgcatgcccagtgaaaccttctgcagaaaggaccaggaagggcacacattggctgcctgcacttgggaagatctgagggaatgtgaaaggaaacaggttggcagttcctggtgccttccagaccagtgcctgccctctcctttgcttgtggtactggccctttgacctactggagatgggagaagccccagagaaattcaagatcgccttcaggcttccttgacccaaggcctgtgggaaggcttgcgccctgggatgcttagggtgaagtgtaacatctggccttctccaagtccctctcacagcaggcctggcctgacatcctgccggccttgctggtttccttctgcccttcacaaagtccctccttgctggctttctcgtgtgccagggggacccagcttcctccacaagcgtctctgttgcttccccctttgtttggccccctcctgtccccaggctccctgaccgatgcccactggctctgtaggtttcacaggcacctgggacactgtcacatggtgggggagttcacgccatgtcccatctccagccagtgcttttctcactctacctaaaggcttttttcctttcaaaaattttaaattagcatacagaaagattgagtctttgggtatacagtttacgagttttaacacatgtacagattcatgtaaccactgctatagttccaaattcctaaaatctcctgtgccacccctttgtagtcatgcctccttccccctggcagccactgctctgttctccaacactccaacagagatttgttggccgcattgtgtgcatcttctgagaaatgtccttggtaccttctgatgtaggataaagacatgcaaatcacctccactctcctgtagcctcccatcttccttgggatcacaggcatgtgtcaccacgcccagcaaattttcgtatttttagtagagatggggtttcaccatgttggccaggctggtctcgaactcctgacctcaggtgatcagcccacctcagcctcccaaagtgccgggattgcaggtgtgagctactgcgctcggccttattttttgaagtcttggtacacctttttttaaaaaaagaagcaggctgggtgcagtggctcacacctgtaatcctagcactttcggaggccgaggtgggaggctccttgcttgagcccaggagttccagaccagtctgagcaacagggcgaaaccccatctctacaaaaaatacaaaaattagccaggtgtggtagcaagcccctgtcccaactactcaggaggccgaggtgggaggatcactttagcttgggaagcagaggttgcagtgagcctagatgcgccactgcactccagcctgggggacagagcaggactctgtctcaaaaagaaaagaaaaaagaagccgcttagttttgttccagaagatcatttgcaatcatcaatgagaacccgcacatcattcctgtttaattggtgtaaaacaggggtggctgtcggggtctgtccgtgtggaggaatgaggaccacagtccactggcccacaggtacatgcatgcccttagtgggccgacttctgggaatacaccagcatccrtagagctaaggatttaccgtatgccttgtcctcagaaaaatcgcttcccctgcccatgtcgccctgattactgtaacagcttcaacgcatgaaccagattgttctcatttaatgaagtgttgactctggagtctccaggataacttgcagttgcccaatttcctggtgaattttcaggttctctagtggtttggagacatgaatgaactcaggaattttttaaggtaaataaagtctatgaagtgtgatttactttcttggtttttggcgcctgaacttgaagtgatgggccctagctagaggggcatggaagtcagtctgaaggctgcagttatctttgcagcagggagaagctgggctctgagctgtgagcaagggaggtgcttcggggccggtggagctgcttcactgagctgggagctctcctgccctccccgggcttgcttcccctgcctcctgggatggggatggctggcctcagaggaagggaaagattgctgttggcagaggatgaactcacccctgcggtgttggtctttggtctggggagccaggttaacacgtgaagctcaaggagcacagaagtccctgtttctatctttgtgcagttttggtccagggtaaaaggatgagagtgcctttccacactgtggcctgcgggtttgtggtgattaacttgtggtggggcctgcactctagggtcatccacttggtcaggttggtgccaggatgctggcctgagagcaggagccagggctggaagcagggctgggcgtggctgggtctttcgaggcagagctcagaggcttgtggtgatcaaacagagccggagggggagccaggggaacagtcccacatgggaaacagaggctgagggtctagcgaggcaggcccagcaaggcaagccaggtgttgggccacaggcctggtggtctgccctcaagatagaggtttggagagcagtgccctgaagttcccccaaaagttgagatttaaaaaaaaaaaaatcagaatacacatgcctggctgggtgtggtgatgcatgcctgtagtcccagctactctggaggctgaggcaggagggttgcttgagcccaggagtttgaggctkcagtgaagtatgattacgccactgcaccccaccctgagcaacagagggagacccttctctctcaaaaaaaataaataaataattttaaaaaaagaaagtccgcatgcctgacttctgtgcccagaatctctggacatggggccctggaacatacatttattcaaagctcacttttaaaagttggtacacaggtagggtggccacagtgggatcccaggctgctctgtggatccaggtagaaggcagcccctgctggaaggtcaggcactactttacccaagccaggccaccccttattaaacaccagcttcactcgagcagtggttcccaaattttcttggtctgtgaagacgtattttctctatttttagccaaacagaatgatttyagtccrtcatgggtcaaacyttctgatawtctttagtccccatggaagacattcttgtttctcctttaagaccatctctggggtcaccttcggttgccttgggggtgtttgagcctctgccgcagggacactgataaggacatgagttgtggtacgccccgttttgtgtagcagctgtcagtttgtttctggaatgagactgagcttctagaagtctgggcatttggttctggttcacctttgagctgctggcacggaggagctttgtaacacaagcttactgaattgatgttttagtgaaagggagaaaagtccttttcagctccctttttcccaccattccccgctgttcatccgaattactcatccacacatagccagtaaagggcgccgtagactgaacctgtaggaaaccagactccaggcagccccagagcacactccccagaaccactaaaataaacacaaaatgcactctcgccggattctgagaaggaaaggccctccaaggtcgtagggtccagtggctctcaaccctggctgcacatttgaatcatctggggagctttttagaaatggtcatgcccagcctccacccacaaagattttgattcaactggtctggggtggggctcaggctttgctggaattttctaaaagctccccaggggcttctaatatgcagccaagtttgcaaaccactgctctagttgaaagctcctcactgaatatctgaatgaaaggattaaacagatmcctgcctagtgaggtattggcccccctcccccataagaccatgggctggtggtagagttgccagcagttctttcctggattccctatgcccctccatcacccagtcacatcatccaacagacctacctcggaccatccctcctgcccgaccagaagcagactccgaacagaatctaatttcagatcgatcagtgggcaaacataaaggatgtgataagctccaaagtaagatttccttgtttcaggccatacgtttgattttgaatgttgtatttttgtattaatttgttagggctgccataacaaagtaccgcatgctaggaggcttaaacaacagaaagagtcattgtctcacagctctggaggctggaagtctgagatcaaggtgtcggcagggttggttccctctgaggctgtgcgggagggatctgctccaggcctctctccttggcttgtagggggctgccttctccctgtgtattcaaacagtcttccctctgtggatgtctgtctctgttcctgctttttataaggatagcagtccaattggattagggcttactgtaatgacctcatttaacttgattatctccttatgtggagacagggtctccacatagtacacatacatagtacaccctgtctccacataaggtcaccgtctgagatgtactgggggttaggactccaacataactttttttgttgggggtgtatgagggggattcaattcaacccataacaaatatcttccaagccggccactttgactgcagcctttaacgggtagctgcatatttttttttctttacayccactctcaccctcaaattgctcaaaacaccggagcccagggctggttgcctgtcagcgttcagcacgaacctgcccactgactggcgtctgctccctggcttctgggtacactcagaggatgattgtttgcattcaggctcctccagagatgaatataattcccctaatttcctcacagtggcagcagtggctgaagggagaggtgaactgtgagagatgggcccctcttgcctaagatgaaggctggggtcaggggcagtgttaaacatcagctggagaggattgtgaaaactctttggacaagaggggtttgttttaaagcgaggctactttggaatggacatctcattagtgaacaggttggggagtggcagggttatggagaggaggaggcgttccattcccgtagctattctgtatcaaccgctggggtcagaggctctcagctggagtccacccacagacagaattcagggaagctccaaaawcctgaatggaaagaaattacattttattttcactaactgaaaattggcattttcttcaattatgaatgtagactataaaccacagggacattaacagttctcatgactgtcaccagtagcaattgcaaartgcatttttaaaaaatgtttgtgggtacatagtacaccgatgtatttataggtacatgaaagcaaagttaattttttacagtgtggtagagtcattgtaaatgtcttgatatactgttatccttagcaattcttaatacttcagaattaaggttgttatgagattcgctgctaggtcttatttaatatgttaattaaatattaccatggtggaaaatwtaaaatattttgataactgcattttactgtaattggtttcctttgcaatgctgtgtatttaatttgtgcatttagcatcattctgtggaggcctctgtgggcttccctagcctaccaaggagkggtctgtggcattgaagaggatagggatccttggtttgcatttatagtaactgtttcctgttcccagtcagtgaataaatcctgtaagtggagataactctagattacagtcttgaccatcgcttgatttattaatagttaaatttacagctcctctttttggctccttgaggctgccgtgtgtgtgcacacatgtgcgcctgtgtagactacggcttgccttcttttcaaagacatcagagattaggtgattaggtagaagcttttgaacaagcccagccttaaatctgccctccagtcctgttagatccttcttgggaagctggtcccygtccctggccagtcagtctcaagtgagtggggctgagaggagctgcaggcaaaataaatacccactccttccagagttacttgccttgagacgtgaccttctgggtcactctggaaatgtgcaaagttccagtgcccgagtggcgtgtgttggagacgctgaggctggttggatgacaacactaaagctggggttggaagacctgtttggggcggcctggaaaaacatgtatggtgccagatcatgggccctggttgatgtgaaaataatctgctgtagatcattaggtttatggaacttggtttgttttttgttttaattcttatttttaaataatgatagacttaggttgcaaaaataggacataagattcgggagaacttcctccagcttccccagtggtgtcatcttatgtagctgaagttcaatatcaaaactagaacatcaacactgacacattactgttaactagactacagaccttcagccctcaccattcttcatgttttgtgtgtgtgtgtagtttgtgtggacaggtctatgcagttttatcccatgtataaatttgtgtaactaacaccacaatcagatacagagctgttttatggaacttattttaaaacttgatcgggaggcaaatggcagtgagtttgcatcagttctgttaaattgtcctttagcctcaggtcacagtggtggttgtaacatctgcctcctgagtcacctgtctggtcagccttggggctggaggtagagatttgactgtagggctgagccccagagtatttggagtccagtgctaggtgggctattatttacagggctcagcctggatctggagcactgcagcaggagtcttgggtgccagtggcctcttgcttcacaggcacaagcactctggggctagaccttgggagcagagtatgtttctctgggctggagagcaggaataatgtgagtgaggggcagggcacaagggcaccagctgagtcctcaggggttcagagaagagctccaggcctcataggcaatgaggggacaggtcaggaataaatagagatgccctgactagacctgggtggcgtggtaagggttgtagggtaaggtcttagcctggtgggcatgggggtacccaggagccctgccctatccttcccatgcacactggaactgactgtgctgagtacagtcagatcggacatcactgctgggcatggcttcctacagcctataatgtgagatccgattaccacagtagatgggaaggcatttgatacaaatcccagagcacactcaaaaactaaggtggtggttttgtcccaaagctggtcatgggttgattgtctctttagcacctctcagttgaccaggacatctgattaagtggaaagctacattctccaaccacaaaagataataatgttcatactgtgtctgggttttatggttttagatatctggcaatgctggtgcgtgtatttttttcttttttcagacggagtcttgctctgtcgcccaggctggagtgcactgacgtgatctcggctcactgcaagctctgcctccygggttcacgccattctcccgcctcagcctcccgagtagctgggactacaggcgccggccaccacacccggctaattttggtgcatgtatttctatttttatttttcgtttgccatttcttccagtttccttggttaaagttttcagctaagtacttacctttatagtcagagataacgcctactctacacctgcaagtatcattctcccaccctaccttttctcctggctgattccagcaatgtgggactggctggggggtaaggggctagcacatggtacaagaccagctcccaagagcaagtgttgagtgcaaccactatggaaaacagtatagaggttcttcaaaaaacaaaaaattaattaaaaattaaagaattatatgattcagcaatctcattactgggtatatatccaaaaaaattgtgaaatcactgtcaaagagacgatctgtacccscacattcactgcagcactattcacaatagccaagttacrgaaacaacctgagtatccgtcgacagatggatggctaaaggaaatgtgggctctgcacgcaatggaatatcattcagctttttaaaagaaggagccaggcatggtggttcatgcctgtattccccagcactttgggaggttgaggcaggaagatcacttgagcccagaagttcgagaccagcctggccaacacagtgagaccccgtgtctaagaaaaatacaaaaataagctgagcatggtggcacatgcccgtagtttcggctactcgggagactgagrtgggaggatcgcttgagcccaggaggtcgaggctgcagtgagccaagatcccaccactgtactccagcttgggcaacagaacaagaccctatttcaaaaaaataaacaaggagaaggaaatcctgccrtttgtgacaacaaatggatggacctggaggacatcatgctaagtgaaataagctagtcacaggacaaatattgtatgattctgcytgtatgtgggatcgaaaatagtcaaacttaaagaacgctggttgccagggaatgggggaagagggaaatgtgttgttcggtgggtgtaaagttacagatawgagatgagtaagctctgcagctccgctgtacaacatagtgcccatggtttagagttgggcacttacaactttattaagagggtcaatctcatgttaagtgttcttaccaaacacacacacacacacacacacacacacacacaaagggacacawggaagcttttggaggtgatgatgtgtttattaccctgaccatggtgatggtattatggatgtatgcacgtgttcaaactcatgaaattatctatattaaatatgtgcagttttttggtatatcaatcatacctcaacaaaattgtaaaaaacaaaaaaagagtaagtgtgggaacagtgaagatggagaaggaggggtaggggtggtttaaccaggcaggccctacactgtccctgagggggacacctcaggtggtgtgggggtgtcggggagtcatggagctgggtgctgccgagtctgagcaccatccacccaccgcctggtagagctgcgtggactgaacctgggacaggctatcagaggagggccacaggtccatctgtaaatacgactttttttttttttgagacagagcctcactctgtcacccaggctggagtgcagtggtgcaatcttggctcactgcaacctccgcctcccggaatcaagtgattctcatgcctcagccttctgcgtagctgggactacaggcacccgctaccacacccggctaatttttgtattttagtagagatggagtttcaccatattggccaggctggtctcaaactcctgacctcatgtgatccacccacctcggcctcccaaagtgctgggattacaggtgtgaaacaccgcacccagtctaaatatgatttttgaaactaaacttgtggcaggaggacagggttgctgcaatcccaggacagaataaatctgagaacctcctgcctctatttcctccattcaacttcccttgcccattagtgtcagtttcatcttccaaaaaacaccatcatttcataacttcatttctaggaaagccacaattgctccttttcacttcacacaccaagtctaaacttccctgtgtaactctcaaggctttccccatctgacctcactcggtcaggtcagccttccttctcatcagtccttcattcagcagtctctgaaccttccccactgaacacacctagtgcgcttctacctccttccagactctacccmctagcatgctggcctaacaacattggctttgatgacctgaactccagattcgcctgctgtccacagtttctttctttctttttttttttttaatgagatggagtttcgctctgttgcccaggctggagtacagtggtgcagtcatagctcactgcaacctcgaactcctgggctcaagtgatcctcccacctcagcctcccaaagtgcacattttctcatatgtacctcacaatcaaacacaattgcctttttataggatgtattatcttataacttctacctgtcatttatctatgtgtgattggtgaacaagacaaagcatattgtgttgttccctaattgtttcagtgcagaggccttgtctccctagccaacgggaggggagggatttttaaccaaggctgtattttttggtctgctctgggcacccgtgctgccatgtacctgcatctgtgcttgctaggtgacagtacaaccagctcccatgatgcagggccacacagccctggtctgggttcttccttggcagactcgtccagcacagactggagtttataattacagtagtcattagcctggaatgcaagggcctggcaatcaggattttttaagataatgtttaggttttacttgggcacaagatagttaaactcattttgagataattgtgaaagatccaaattgaaaaagaagagccaacaatactttcttgttactaaaagttgatatcgcataaacctgcgttctgcaaackkggatctagagcatgacaagatagccttgaaagatgaatatttcagagagaggaggatgagatcccaagggccagcagtgtgctcactctctggaatagctcctgcagcccagtgagtagagttgtgtaccccaccttcccttctttgtggagactggagctgactttgctctgctgggtcatcttagggttggggcagagactgtatcttccataggtggatttcattttcagaagcatcaagcctggcattttcaacaaagtgagcaatctcactttgtaaaatcaagtcaattttggaggagtaaaagtcatacatattcatcaaaagaaaattgagcaatatagaaaattgagatataaaaaaatttaaggagcaaatagctatgctcagggtttggagtgccaaatcatgggtttgttcctggtgccatgccactgtgttctaaaacaagccagagcctccaattataatcagtagctcttccttggttccttttgccactgccttcctgctgttatccaaagacttcttcccttattgtaaagggggagagttctctctgattcttcttcctctctctctctcgctctctctctttctgctaattggagaaacttctgtctcataaagatcttagtacccggacatcccaggaaagaaaaatggtgcccaggaaacccactcagagtggagttttgaaagtgattttttcccgtctgcccaggaagccagcacatagtaggtgtgatgcagtctcccttgctgcagccattccccgactggaaccacaacagaaagacaacagatgggctgtggacaaaagaatttccttggattttcctgcctagggacatcttggaaaatgcatatcttgaaattagttctgtagccgcttgtcaaaggaataatgaggctgttggttttttagactttgggaaggtgcctgttctcatgctgctaataaagccatacctgagactgggtaatttataaagaaaaaaaggttaatgaactcacagttccacatggctggggaggcctcacagcagaagggaaaggagaagcagaggcacgtcttacatggtggcaggcaagagagcatgtgcaggggaactcccctttataaaaccatcagctctcatgagacttattcactgtcacgtgaacagcatgggaaagacctgccatcatgattcagttacctcccaccgggtcccttccatgactcgtgggaattgtgggagctacaattcgagatttaggtggggtcagagccaaaccacatgagaaggattatgtcagaatgatttgggggtgctgttttaaaatgcacatcctgggcttcacccctgtaatttccgctccagataggacagaactgggaatccacaacaacttctagggtgattctgaccacagccaggcttgagagctttgtggtgtgtactgctactcacaggactgggcagtagacatgaatgagatgatctgcctttgtcagagtccttcagagcttctgttgtgggtaaatattgggaaagccaatcctcttcaatagggttcatatgaaattttataagccatttttataagtcagaaatagttgatggttagcaattctatgcagtttcactgatagagccaggaagtgaggctggttggggcttggagttgaccatctcctgcctgctagctttgccgccttggccaaataatttggactctccaagcctccatcttgcatctccagaatggggattgtgacatctcctttgccagattcttgtaaaatgtagagtttaccgtgtacatgtcaagtgtccctggtacctcagtagctactgtttttatcctattgtgataaccattcccatcttcccccctccccccacactgccctaaacacatcccgggttactgcctgagtcctcgtagaccttggggagaccagtttctcagtcttcactgctcctaggtgttctcccgcaccgtccaatgagatgtgcagtgtcctccccgaggcctgtttgaaatatgtccttgatgttgccaccagaaggccctgattgcagccacgtgtccaccaggggagccccgcagtgcttcccacctcacatcccactcagccaygtccagcttggtataccaacaagcatcagacaatgatgttagggccatggggtgccattgaggtaatggtcggccctcctctcccttggagagaaggcagaattcttcccastgagctgacctccccgtggcccctgtggccaccacccccacaccaactttgtttgatccatacttcttattcccaaactcacttggcacactcttgtcacacagcctttcacttgttctgtgcctccttcacctagaacattcttgtttgtttgattgtttgagacagtctcgctctgtcgcccaggctggagtgcagtggcgcgatctcggctcacagcaacctctgcctcccaggttcaagcgattctcctgcctcagcctcctgagtagctgggattataggcaggtgccaccacgcctggctagttttgtatttttagtagagacggggtttcactatgttggtcaggctggtctcgaactcctgacctcaggtgatctgcccgccttggcctcccaaagtgctagatttataggcgtgagccaccgcgcccggccacctagaacattctttatcctttcacaactgcaggcttgctccccacttcttccctcctttagtttaaccgtcacctcctcagtgaggcctcccctgaccaccctatttacaattgcagcgtccgccccacctccagccctcttcacccctctcctggatttatttgagtccagagcacccctgccatcattggtcattgcccgtctccactcgctaccacagcagcgccacaagggcttgttcactggtctaccccagcacccggacagtgtcagcacaccggaggtgcccaagaaacgtttctaaaagaacgaataaatgagtggcagcagtattttaaaagatcgaaatttcccgcctttgcccacacacaccttatttcctgagaaaagttaaacttgccaaataaatattcctttcaaaaggaaaatgaagataacaagcttgtcttctccccatcttttcctgctctgtctgagcagaggggcctcaccgggtgactgattgaaactattcattctgagcattggcacaagcacagacctgcccttgcacagttgagctgcaggggtgtggaggagcaggggagtgggtacggagggggtggggggctccaaacagcaggtaggtgttggcccacagcctgacagggagcactggagacaggcaggaggcagaaaaacagaaacagcaccatggggggatatatagaagcactctgcggggaggaggggygcatgattttgattacascacagggtacctattgattgaattattaataaagattaaattgaatcacacatatcctatatatgaaggcaggggaatcgcaaatacatttatgccagtttttgtttttcaagagacagggatatcgaagtctcctaaactcaaggggtcctctggcctcagcctcctgagcagttggaactataggcacatactacggtgcctggtttaagccagtttttaaacaacagctttactgagatttgcattccatagaattcattctttttttttctgagacggagtctgtctctgttgcctaggctggagtgcaatggcgcgatctcggctcactgcaacctctgcctcttgggtttaagcgattctcctgcctcrgcctcctgagtagctaggattacagacccgcaccaccacgcctggctaatttttgtatttttagtagagacaaggtttcaccatgttggtcaggctggtctcgaactcctgaccttgtgatccgcccgcctcagcctcacaaagtgctgggattacatgcgtgagccaccgcgcccggccagaattcattcttataaagggtacaattcagcagttttcaatatattcacaggattgtgcaaccatcaccactatctaaatttagaatattttcatcactgcattagcagtcactttgttctcctctcccccaacctttggcagccaccggccttctttttctatgttctggacctgtcatataaagggaatcgtacagtgtgtggtctttgtgattggtgtctttcacttagcctggtgttttcaaggttcctctgtgtcatggtgtgtatcagcacttcctccgtttttgttgccaaatactgtactgcattatatggatatactacattttgtatatccattcatcatttgggttcgttctacttcatggctaccactgagtcatttggaaatgtgatgcaaggctcaaggctaatggggtttcctcgcttccaaaaaagaggtgatgttgcccacctggcaggtgggtatgaggctcagcaatggtacatgcatctcatttaactggtcactgtcaactccaaaaatgggccttcccccatttctgtggctgttctgtgctggtgtgcagtgtgtaagatggtcagtgttcctgtgttttgactggtgagtcaagtctgaactcactagcctagcacctgagagcctcctcatgggatagcatccccctgactccgcctgacaaccatcatttctcttcagttttcactcctgcccaactggtttcttcgcagtctatgcccagggcctccagctttctcacacttgggccctgctggggcatccagcctctgctcytacatccttgggtcactgcaggtccctgcccgaccctacctttcttcctccggacctcatattagaccagctcctcaggcctttttggacatgaccgtctcaaagtgttactatgtttaagtgtgtggttttttgtttatgtgtgtggttttgtgtctttgatatcgttgatttgccttatggcctcaaccaaaccctcactgtaacatggcacaggcagcgccatgtgacatccttgtccctggcccgcccggcgcagctcacagtgggctctctgtgaatgctggctggctgagtgtctgggagttgtgagccctttgccatgtaactggagagggtggaagtgtgaatggagacacctgctcagttgtacaatgctctttggacaggggatcaggtttaaatcagtttgaagcctgctttaccaccccctgcccccacaattgttatttcctgaaagcatatggttggctgagctagctgaaaaattacccgaattttgataaaaatttgaaccatggatttcctttctgaccatgcctagctgtgtaaattccacaggatagtaacaggtgcctggccaccatccagcaagacccctgataacgtccatgcagtggggagccacgggggcaagtgcttcccctccctcctggtcataggcttgagcatgggtagccaggatggggggtgggtgcaacttgagataagcaaatcgacaacaatgaggtacaccctgttctttgtcctcttgtcaacttgtgatttcccgatggatcaggtaatccccagtagcagataactcagttgaattttttcactgtcgctgttatctgtattcattgtctgcctaaatagtagtgaacagagaaaaaaagaacattaaaataggaagctgggaatgacaggaagagggactgtaggcctggtaaacaaaagttggctgtaacatgagccaggatatggaagcgtgaccaatactttggactctctcaatgctggccctctgcggttcmtggctctcctccctttctcgctgtcaccagccacgtttaggtcagtctttgtttttggctgttgttcctgaagacgcatttatcaggtggatctcttaaaatcagggttagggattggaagtctagctgggacaattcctgtgaagacagacttccttctgatgaaatatttactagcttttgtaggaagccatctcctcctctttgctgtgataagaggtactccccacctttctgtctcatggcaagggtggaaactgatgatatttgtagggcatactggggtgagccaacaggctggaggcagccaaccctgggcatgcaaagaagcaccgtttggaagctctggtgtagctctcgtgcagcagcagtccaggccctgggacatctgagtttgaggcttcagtcctccgctgactgaccatatgtttacactgcagcctgttgtggtatgaaatgagatctggaagcacctgagctccccagtgtctgcaggtagatgattatttaataccctcttcccatacatcttcatggtcaggagactggaccttggcaattctgttattagrcagctccactcgtagggaatttctcccttatatttagctgttgttttctcctccattccactgtctggagtccccatggcaagttcgcatcctctttcatgtccctggctccaaaggctttggtgtctccaggtaagtagttctcacatgggctatgacccctcatccttcattatcctagaaaaataatgcttttctgaaaattgtatattccatgggaaaatcagtagattttggaagcctgacatcttagtccgttctggctgctataacaaagtgctggccaggcacagtggttcacgcctgtaatcccaggacttcaggaggctgaagcaggtggatcagttgaagtcaggagttcaggaccagcctggccaacatggtgaaaccttgtctctactaaaaatacaaaaattagcctggtgtggtggcaggcacctgtaatccaagctactcaggaggctgaggcaggagaatcgcttaaacccaggaggtggaggtttcagtgagccgagatcgcaccactgcactccagcctgggtgacagagcgagactctgtctcaaaaaaaaaaaaaaaaaaaaaaatccaaccacaaagtgccagagggtgagtggactataaactgcagacatttattctcatagtttgggaggatagagggtgagatcagggtggtggcactgtcgggttttggtgaggaccctcttccaagttgcagactgctgacttcttgcattcctcatacagtggaaagagaacaagccagctctctggcctcttcttataagggcactaatcccattcatcagggctccaccctcatgacctaattaccacccaaaggccccacctccaaataccatcacattggggattggatttcaacacaggaatttggtggcaggggtgtggggcacaaacaccttataatatttgccatatgttttaaaaaaattttaagtataaagtcaacatccaccacactatataaaagagagacctggagtggtggctcatgcctgtattcccagcactttgggaggtcgaggaagaaggatcacttgagcccaggcrtttgaaagtggcctgggcaagaaaacaagaccccatctctacaaaataataaaaaactagccaggtgtggtggcgcatgcctgtagtcccagctactcgggagtccgaggcagtaggattgcttgagcccaggagtttgaggctgcagtgagccatgattgcgccactgcactccagcctgggcaacagagcaagaccctgtctctaaaaaataaaaataaaaaaatgaaaaaagggaaaagacgattataatcctaccacctaacaaactgttttcatttgagtcttatctttgtctttattctgatgaattcatattttatatagttaaaatcaaagcataggtacacagtttttggtggtttcttcatttcattatataatgatttccctcaaagttctaggcattrtaagatgaagacgacagaacacagatatcatgtagctgcagtaagcattgggatggctgcacaccattctgtggaacggatatagagtcatttgttaaccagtgatactgacagagagcaagcagatcagtgaagacaggagcagggcccccgagccctgagaaaaagcagggaccttgccaggtgaggaaaaaaatggtatgaggtagggctacactacgctcccagaracgtctccatggacagtgagctctttagaggggaaaggagtaagcttttgaaccatttgaattatttagaagaaaaaaacacagtgcctttcttacacacttttcagaatttcctgtgttttcacctgccattagctggttactgtttgggcttcctttcatggtggtaaacacagtttgttttgtttagccatttccttccccctcaaataccaacacagatcaattcagtctttgcctgagtcatacatggttcatgtgtctctttccttccatctatctccccttaattcacactatttactgaactcctcctgtgcacccaagtctccagaaggagctggagaaggagcagggtggcaggggtgggaaggggacagctgtgtggaaggcagcggggctggaatcctggcatmtaggccctttcacgctcccactcagagggctctctcttcaggccagaaatgctgatatttaatgagcacttactagatggttatttgtccattttatagacagggaaattgaggcctgccagtgttaattgacctttctacggcctagaatctgaagttggtgcagcctcactgaagccctggctcagccatggttgccacccatcctgtctgagctttgagaaccacagagacaagacaggcggcagggctgtgattttagacactcttgtcttaggtgtctcaaggtgggggtcactttggagcctcagccaaccccactgtgattggatctcctgcctacagcctgtttcaaagggaagtggagtttagggagacagtcaagaggatggatggaagaaaggggctggttaacctgagaggagagaaagtaactacccacccgtcagagcctggggctgataagggagggctcctggaagacagagctggtgcttctctccacctctgagctgctttccctccagggccactggcttctgcaggcgttgttgtcttttgctcctaaacagcaaaaagagactaattgcctttattgccatgttaaaatcaatagagccactcaccctgagttcaaaatgatacgacctagggaatgaaattgggaccacctgtggtttgtttcctattagccaggcacagaacagtttcttgtttcccttggaatgaaacacaacctgagtcctggaggaatagttctcaaatgcatccggatctcctggagagcctgttaacacacaagctgagctccattcccagagtgtttgattcggggattctggggtggggccctgagaatttgtatttctaagttctcaggtgatgcagatgctgctggtcccagatgggactctgagaacctctatactaggtcatctctcagacttgggcctttgttctcatcttccccctccaaaacctaacataatccactacatgtggtagagagccatcaaaaagagagtttcagtcaaggggctctggctaagtcctggagctgagctgccccctcccttgctctgctcacacctttcacccctcagactgaaaccctccgttacctgctgctatgcagggattaggattagaacagggctgagtgggctggtacggggagggccctgctgtggtgttggtwtagctccttttagcacaaggaatttgatgagctaagcattttccacggcaagtgcataaaaaagatttcttaccattttttgaaagaaagaaatatatcctttctcttgagtcatcactattgttagttgctgaatgaaaaaaaaagacttaaagctctgttctttgaacacttttctctgggtgcctttctgtagctgtagaagatctcttgggttaaattttaataattgttaatggcttcacacatagggggtgtcttgccctcctgtgtagggtgtcactgcccaggacgtggcttagccgggtcctgggaacagctgcaaggactgttggagaaaggggcagggggcactggctggggagagggccgagaagatctcctttgagagatggggagggagatgtgaggctgagaatctagtattgagtttctaaacttctgatctgcaaagtggtttttttttttgtttttgtttttgtttttttttttggtagagacagggtcttgctatgttgtatgttacccaggctggtcttgagctcctggcctcaagtgattgtcccgccttggcctcccataatgttgggattacagatgtgagctacggtgccccaaagtgctctttttgttgaacagtgtgtgagcccagctacctggagggtgtgtctacctgcctgaccctcagccatcgcagcctcatgacggctacaccccgcacattatcatacccctcaaatgtgccttccaaccccacacagatttcttgtggttcccatcctggtgaatcttctcagttatccacattacagacctcagtggaatcttccacaccacctggctcatgatggtctctgctccttgcctttcacgttcttcagaggctagtgacttcctaaagtgaggattgaggaaataacaaccacgataagagttacagctgaccctggagtgtttcctgtgcaccaggagcccgttccaagtatctgtatttattcactcgtgtcatctgtagcagccccaacacataggttaggacctgtcactagtcccatttataggtaaggaagctgaggtgctgggaggttgcatgatgtgccgagcatctcacagccagcaaatagcaagtagctagaccgcttcctccctggcaggtctgaagcacatgattcctagccccagccttcctaagggcccctaacagacggtggccttcccctggcatccagagtggctctgctgactggagcagtcaactgtttctcctctgcagttcctgaaggaaggagaaaagggggaggctggtgggttcaggtttcgtagacctaagaggccagctgccctgtgacccctcctgagttggggcttctttttgggggattagggaggagagttataagagaaagaggtgcggagagcagrgagcacctgagagagggctggaagaagtggtaaatagatggacctgcccaatgagagtagccagcrtgtgcatgtgaggggcaggtagcacagagggaatgtattccttgtctaacttggcatatagccaaaagctaggtgtaagttagtaaactacagccttcaaaacagcccctgggaaaggcyctgctttggagggtagaaggacatataggaggctcccagaggtacgggtgtgcctccctgctgggcrtgggcccgcctgctgggggcagcagcaaaaggaagcaagtagcccggaggaaaaaaagaactatgtgtgtgactgtgtggtggccaggagagagggagagggttcagcacacacagggaaccccaggcagctcccagagcccaggggaagcattcctttttgtagttgaatgatcccaggggagcaaaaggctggctggaggagagggagaggaattctgcttggaggagaaggtctggggccaaactgccccagctaaggtgactggtccgtgtgtctgcatcttaaatctgagaccattggttcctttgcacctgtgtagtatcctcagggagggttcccagggcgctcgtctggtgttgcccctctttgaggcacctcactcattgaccattaagcaagcatcgagtgggtgtcagtttaacaagtgtcttgtgttcagtgccaaggccaggggcaggtacaaggcatgctgaatgcagcccctgccacaggatccatgtttcaatagggagggagacgcagaactttgcgtaaaactgaaaccttatggggcgggccctgtggtgtctaaggccacactgggagtctcagatcctgccaaaggacaggggaaaagggagcagctggtggacatggggaggaggcaggatggacggggcgcctgaaggaattaagtgggatttcggttggagaggaaaagcaaagatggcagggagagacgaggccctcaaaactgagcttgttcgtcagatgggagatggacatccaagcctctccatgaggtctggcacgtgatctggggcacggtctgttctgcagtcatagctgctggcctgcgggacctgcaggcagagtccctgatactcactctctgtgagttaaggccagatgcaggcttcagacacctttaactgagaagcaggtgggtgctggcctggggtgccagggagctgagggtagaaggaatgtattaatgccagcagctgctctctgatcctggccctctgtgacttcctcttcacccattgtagcataccagccagactgtgaaggaatgaatgaagtgggtagagaggttcccggtcaggctgttccaggcaggataagataaccctggttctctgcactccagagagcttgtgctaccagcttttgatgctagaaaaccccaggtgggaaatggccctctgagtagactggacatgaagctggtgatgattactgcttcagcagggacagaataaccactttcaaaataacaccccgaatggcttagcacaatacaagttgatttctctccccatcacggtccaatgcaagtctgcatcagcactgcctgttcattcaggaacccagatctccctgtctaagagctctgctgtcttcctgagtggtggctcccacttggagtgtcagaatcacctgaggacttgtgaaaatacattgctgggtccccacctccagaggaaaggtcctgagaatctgcattgccaacaagttctcagaggatgccgatgctgctggtccagggagcrcactgagaatccccrctctagggcttcgtggttcctcactagagcttctgcttcaaggggtgagagagcagaagtcagacacaatggccccacttcactccaaggaagcctgagaaatgtagtccttttgtgcacccaggaggaaaatcaaatggtattgtctgtgccacagtgaaaaggggcagcacagagccgggtttaacctggtatctgcctgaaatactagatatcaaaatgcatttcaaatggatgggcaagtcagccaagagtgtcactgactcataggcatacatgcctttcaagaaggcagatcatgaatggaggtcattactaatgtataacttgtcctattgtgctagcaccaaggggagtcacctaggacttgggttcctaggatggatggcccgtggtgtccctagtccaagctttatatcctaggcctagggaagaatgcgtcagacagtagtcagatcatcattggacctgatggactttgcttctgacatttccatgattttgacatgtctttcttggtgtctttgctgcctggtgtctctcagagcccataaccctgctggcttgaataaggcagtaggtgttttatattcagaatcttagccatggtgaataagcatgtcatatatagttcagccctgattttggggaaaatcatcgggcgagtcagcargtttatgtctgtgccgagcattctggaggatgtaagagaacatgactccaggctgtttggagaggcaaaagcaacccaaataaagtaagtgargacttagtgcagactgcaagtgtattagccagaggtggcattacagagcccagctcaggatayggaatggctccagcaactctgtactgctcaacccacttctggagcttcaggcttagttctaggagctgcagtttcaccaggacttagacaaacagatgatagcaagggtctgggaggcctctgcctggagaagagggaaagtcaaggggcatttcagccattgaaatctttgtaaagttgggtcgtggttgtgggaagagaggtgatacaaggtgtcattccaggaaggaaagctaggcctaagttctctcctcttctcagtggagtgaggttgttttttgtcttggggtatgtaggcaccagaactgttcacacagttyggcagatttcatgttaaggaaatgactttgggaagaaaaggaggtgtccatgtgggttagaaatctggaagggcattttccatggagcgagcctttagccaagctctaaaggccaggtaggatttgggtgagcaggaggagaggayrctscagtcagcagatgggcagtgaggcggggaagaaaggcggaaccaggcctggtatcagagctggggctggcaggggagaggcagtgttygggaaagtggartccgcctgaagattgtgggaccttccgtggggaaggtaacccggaagcrgtttcagattgggtattggaggagaatgagcggacaaggagcaaatttaagagccagctttcaggaaataggtctatagtccttggtggttctggtgtctagatgatgctggtgattatgaagtctctttgcagccccagcccttggagcatgcaggtggaaggccagattcctcacctggagagctccgcagaagatgatctcatcaacctacccttttcttggcccatcttcatggtgtgtaargacaaggctgcagcacttggaccctctctcaggggatgctgctgtgcttagactgaggtggccctgctgatgttccctgcccttggtataggggcgggacaaggctagggaaactaacggctgtgctcccctctcttctacctgggctaggtctttgctgttcagtttggccaggcgggctgggctgtcacatgagtgatcccttctgatcctcacagcacccttacaaggcaaagactcttagcagccaatctgttttgtttctgactgaaacaagctcagagagtcaagggcctggcccagggtgtcacagcaaagttcagtgacaggttctacctgtgtcttagttctctgactccacatctagagcttgttctcttccaccattcaagatcttttatagccccagatgaagaatttcatgtttcttaggaaagtgactacctgggcaaggacttagcgacgcctgagaaattagcttcaggagagtgtgccctagtaatgataagtgacgtaataaccagcctgtattgagggtctactctgtgccaggccagcgtttgaactcatgaatctgcatcacagcatttttttttttaagagatggtgtgttgctctgtcacccaggctggagtgcagtggtgctatcgtagctcactgtagcctcaaactcctaggctaaagcgatccccctgcctcagccaccccattagctgggactacaagcaagtgccaccacactcagcaacatcacgtcttacagaagaggaaatgggaggcacagagaagagagaggttaaatgagctgtctggggtcacacaggtagagccagtctcaagcaggagccagccgatagtctcacactgaaccacagggcagccagagctcctcatggaagctcgcttgtttatgtggcccagctccagagagggttgtcctgtctatctctgcttgtgggttttctggggaggctgcaytggagagagaggatgtgtctcagcctgacacaccacactctgctgaggttgtggcagtccctggcttggggttaggacatcttaggaagtggcagctcacgcctgtggcgggtttttgtgatgggctgatagagaggaaggtggtcagaactgggagggccctcactgtgcgggtagccccatgttggtggaggcctcctagtctgtttgtatgcactgctgcctcatttaacttgagacttagatcctcggagcagcctgccaggagatacgagtttacctcccagtcagragacaacacaggggattttttttttttttttttttttttgagacggagtctcgctctgtcgcctaggctggagtgcagtggtgcaatctcggctcactgcaagctctgcctcccaggttcactccgttctcctgcctcagcctcccgagtagctgggactacaggtgcctgccaccacgcctggctagttttttgtattttttagtagagacggggtttcatcgtgttagccaggatggtctcaatctcctgacctcgtgatccgcctgcctcggcctcccagagtgctgggattacaagcgtgagccaccgcgcccggccgcaggggactttattttagagcccgatcaaagtaacatggaaaagctaaaggttctctgagctgcagtggctcctcctttccatgagggggcgccatccagagtcagcgcttcctctgaacacatcccacttgaatgggacaggcagccatggtagccatagagcatatgggcccacactgcttgcatttaaattttcactcctgttgtttccatgatgagcattcctcaggttctatgccataaatttataatttgggaaatatggtcaccaytaccatatggctcccattgtgtcttctaatttagcaaagatgataaatttgtttcctgaaaattttagggttaaaagcattcaattggatttgattcgttgggagttggtgatgtgcctgatgtatctgtaacaggaatatcccattcttcaaccatgctgcacacagagttaggagtcccaaagaaggcatttgcctgaataattccataaaacgtgtatgtaaaagaagtcataaacggaggaaggaaaatactaggtaggtaataaagacatttttcatacttttatcctgtttggaatataaatyctttgttctcagctagatttgtactgtactaatgaggaaaggtmaacaacaacgaactgccaccctttgacatgtatatacactccttttctttgcatgtgagttggtggataccatgtataaatgtctgcacatgttggctgagtgtagtttggtgaacatactccrtcccctgcccccagccctgactaagatgcagcaccagatacacattttggaagaactgaccttattgttgtcaagtaggtggaacttgtcagaacgtcatctttttcctcttacccctcccaccctcattcattctccaagtgcccttttcatttcacttccttttagatcctcctctcagctgtcagctaaagaagacctgatactctgattcaccccaagattcaaagctctcatttcttatctctcccagaagaattttctggatgagcctttaagccaaaggtatgactgtctaatagcggaatttcagtcatctgggacagactagatggggagatgttaaggaaagagactcttcctggtgtacccagaattatagaactcagatgtcctcatgtgccctgtgtttcttgctaaaagttgtatagttttgtgttttacattgaagtcttaagtcttacatttaagatccattttgagttacttttcatataaggtgtaatrtttaggttgaggttgatttttttccccctcctgtagatgtccacttgctgtagcacactttgttgaaaggactacctctcaccattgaattgtttttacacctttgtaaaaaagcaagtgggcaatttgtgttctctattgtgttccattgatctccatgtctagccctctaccaagaccatgctgtcacagttactggagctatrtagtaagccttaacactgggaagagagattcctttattctttttcaaaatagttttggctcttctagggcctttctcttatgttcacaaggaaacttatacatgtgaatgttcataacaccttcattcaaaatagcctcaatctggaaactatccagatgttcttcagtggtgtatggttgaccaaactgtggtatatctataccatggaatacagcaataaaaaagaaaaaattattgatcacatgcaacaatataggcgagcctcaaggaaatgatgctgaacgaaaaagtcagtctccaaaggttatatactgcatttgccatttatataacattcgtgaaatgacaaaattatagcgagggggaacagatgagtggttgccaggtgctagggatgaggggaataagggataggtgttgctcaaaaggggtagcatgagagaatctggtggtaatggtacagtttagtattttgattgtggttgttacacaaagctacacatgtgacaaaattacatagggctacacatacacacacacacacgagtgtttgtaaaactggtgaaatctgagwaagttctgtggagtgtgccaatctcaatatcctagttttgatagcatgctagttagctatgcaagacgttaacatcgggggaggctaggctagatgcttggaacctccctgtacactttttttccaacttcctatgaatctataatcattttgaaataaaaagttaaaacaatattacattctgtttatgtcacatcaagaatggcaaacctgtaaaaatatggacatacagttgcctctgcaaaaggaggcttcatctgatttcataacattttatttgtttagaaaaacctggtcttgaagcaaacataacaaaatgttaacatttgtgaatttaggatgatggattttatttgttgtgtttttccctgtcctttattatgtgtttgaatcattccattatttaaaaaataaaataaatgtaaacaaaagcaataattatgccagggtatgtatctccctggtatcttggtccactcacaaaagtggtctgaatgtttaatatttccttagtaaaactgctacttggtcacaggcttctctccatgaattactaactccgggttgggaagcctaagaacataatccatcttttttattatgacaagctaatttaattttaattgctccttatagtattgcattatgaggaggaactatctttaattatctttttgggggggtgtttctaaagtaatgtgatctcagaagcagagcatcgtcccttccaaagtagccacctgactgtgaacttaaaatatttgtgtgcaacagtgtaaatagacttctctgctcctccaactggtggaggctgcccttccccccgaagcaattaaaagaattccagatgggtgattctccccttcctggtcctatttaaaaatacaagtgtcgcttcggggattttttttttcctggaatataccaagtgagtgacacaagaattgggactctccattcctgatttaaatattggccgtgtcctttcgagatcatttttcttggtgacatgttagacaatctcaggtcagtctgtgtccttaaagatcactgtgggtgtcaggaatgctgcttacagatgtacatgatgggcacatggaggcgcccttcagggcctttggctcagatccccatcctgctcttaaagaaaagggcattctgttatttatttgttggattttaatttctgcctctagccctctaaggcttctccatgtagtgccatcctctgctgctgttaccaccatcaggggtgggggtaggggtgctgtacagttggcggccagaggatgccattgaaaagtggagaagtcttcacactgctctttgtggaaggacggcctcccttcccgtgggcaaaccccggggctggagccctcccagctgcccagtggcttttgtgtgtgtgcagctttcagctcctgtccatcaggctgaaagggcccattcaggggcattcatgcgcctccgagaccccggccgcctggacacaatcagctgagaggggcgctgcgagccttgcacatgagaatgcgcccactcggcctgcctccaattgtttggagaagcccagggcccgggagtgagcccagaggaatgacactggacagccacttggggttcattcattctgtgcacttggagcctctggaagggaggggtgggaataccttgcagtgagctgggaatgagcaagttcagggctgctagggcttatctttggtcctgaccttcagcttttatctttgtgtacacctcttggagcccctgcttaagggtagagaccttgtcttctttatctttatagtcccacatacctgaggcactcagtaagtccttgttgaaggagtgaactacattgctgctcctttcatatagccccaggcacactgatgtactttactgtcctttgaagaggccacagaatattttgcctcttggggtgtgatcaccttactgaaaagactgggctcacctcttaggtcaaggagagtagactttgagatcttggagggacgaaggacattttcaaggtgggaagttgccgtagaacagagtgctgatggccagggatctgcatttggaatttgagaggctgagtaaggagcaccataggcctctgcagaggccagtcttgggtggctggtttgcaggaaagggcaggacctggtgctgacttggaaccagttggtggtagatgtggagatgggagaatggacttcatggacacttaccatatggcagccaacaccctgggaacctctggcacctgatgactgacctaggaacatgggggaatgaaaagcacaggccaagatgctaaggagcctttgtgtttcttagttttacaaaattgtgtttaaggatcacagcagcagcagtcacagtagtagccaaagagatagtagaatcttctatttattgggaacttactggactaagagctttgtacataatacttcactgacttaagctgttctgttgttatatacacccacgtatgagtggtaagtgctgcaggcattttaaggtaggaaaggttattattcccatttatggaygcaatacctgaggctcagaaatattaagtggcttcccaaggtgagtggcagagcttcagtggaaacgggggcttaggctcttagcaactgaggcgagggctgctgccagcattaatgactctggtgcagtgaactgagttatctttataatttctccttcaattttaagtgttaagaaagaaggaagaaaaggaaaaatacctctactagtctttaagagccttataacttatttggagaaacgcagcacacaatatagaaacacttgccaagctgccagtgccgagtggtggtatcagtgctgaggacagatagggaaaagctttcctacttgtcacataccctggggaggtgatcacaaacccactgcatggccttcctcccaaggaaggagttaggttgccccatggctaagggagggatgtagaaccacttaacatgacattggtttcaaaccctctggtcccgccagcttcttctgttaggcacaggtgctatgtgacatctcacagaccctgatctggtgccagcccaggccagatcaccaaaccctgcctggcctcagctccctgcactatgcaatggtatagaagtgggatggcacctctcatagggttagttagtatttgcatgctgtgtgctctgtactactctgtttagtgcatttagaagttgatttccttggcacgtgactcatgcctgtaatcccagcactttcggaggctgaggagggcagatcacgaggtcaggagttcgagaccagcctgatcaacgtggtgaaactctgtctctactaaaaatacaaagattaggtgggtgtggtggcaggtgcctgtaatcccagctactcggaaggctgaggcaggagaatcgcttgcagctggaaggcagaggttgcagtgagctgagattttgycactgcactccagcctgggcaacaagagtgaaactccatctcaaaaaaaaaaaaaaaagaagtttattttatttcctcattggatgtgaccaacttcctacaaagggaagaaacttcatcttcaagtccctaggataaagcttttcatagggaggggacaaaaatttaactccaggtcaccaagagaagtcattttgcagcatggaacttagtgcacttttgttttcactatggtcccagaatccatttgtcctctgacaaggggactctgtgctgcatagggctgggtgttccagctatgtagccctgtgcctgatggcaggtgcagccacagttagctgaggggcagtggtctccattcagaggtctgcttccttctaccctatttcaccctaatgaagatatgtcatcttgcaaatgactacatgttttctatcctcctcatttctaatcctgaatttaagcattggaaagagcttgagcaaatcagtcagctaccgcccctctcccccaaactcagtctagtcatctgcaaaatggagctagcagtgaaaacagtatgtattaaatgagatgatacatgtgaaacatgtagagctctaattttatttttttttwatttatttttttgagacagagtcccgatctgttgcccaggcagtggtgtgatgttggctcactgcaacctccgcctcccggattcaagcgattctcatgcgtcagcctcctgggtagttgagattacaggcatgtatgcccaactgatttttgtatttttagtagagatggggttttcagcatgttgttcaggctggtctcgaactcctggcctcaggtgatccatctgcctcggcctcccagagtgctgggattacacktgtgagccgtggcacctggcctaactaatctttttttttttttttttaagtgcactgcactgaagtgcagtggtgtgatcacagctcattgcaaccttgaactcctgggctcaagygatcctcctgcctcagcctcccgagtaagtgggatacaggcatgcactaccatccttggctaattttttttaaattttttgtagagaaatttttgtttctctaccaagtttttgttgcccaggctggtcttgaactcatggcctcaagcaatcctcccacctcagcctcataaagcaccaggattacaggcataagccactgtgcccgctctgtcttatctaaytgggtaatcactcaataaaattaagttcttattttttcatttgaatgaattgtatcgatacctgggagaagccaaaggttgctttgttagttgkaactccgctgactgaccacctttgctgkgcttgatatttatgtaragcactcaggctaaaatgcccatggcttccctgtccttttattctcrtgggtgatggcgagtagagcacagagggccaagtgacttgtccaatctgcgtagacagtaacagttccccatccatggctctttccacagctgaggagccaaagtctcaggcaggtctcaaagctggcaagtttaaactaagtgatatttagtctgggtgggatactgatcrtgcatttttctttcttttttcttgctctaaagggcattattagggccrggtgcagtggctcatgcctgtaatcttagcactttgggaggccaaggtggcaggattgcttgaacccaggagttcaagaccagcctaggcaacaaagcgagacctcatgtctatatttaaaaataaataagtaaataaatagagggcattatcaggacagctggcagcattygaataaagtctgtggattgagtgatagtattctaccagcggtagttttctgttctttgttccttctcctctaccactgctccacttgactagccttaaaaaataaaaagcaattaaaataaataagatggcaattttatgactaggtaaactggtattgtaagaaaaygtcttttttgggaaatacagaagtatttagacaaaaggggacatcatgtgtgcatcttactctaaaatggtttggggaaaaatgcatatagagagagagataaagtaagtgtagttaaatgttaacatttggggtatgtaggtgagtggtatgtggaagttcattttactattcttgcaactttwgtataagtctgaaattattttagtatttaaaagtttwaaaaaaaaaaggccctcctgtggctgargtggtaggagggttagtgtgaaaagatgggagaggggctatgggatggagaggggtggggcagaaccctggaaggtgaccccctgggagtggatggctgaagacatgtgaatgaagagaggagaaggggggaataaactgaataagaaaagtcccccaaacagagcaccttcccaccgaaacaggagggattaccttcgggaaatgatgtgggcagactctaaggcattgccaagttggaattacagaattcaggagtggtggctcacacctgtaatcccagcactttggggaggccaaggcgggtggattacttgaggccaggagttcgagaccagcctggtcaacatggcaaaaccccatctctactaaaaatacaaaaattagccgggtgtggtggcgcacgcctgtaatcccagctacttgggaggctgaggcaggagaatcaggctgataatgagccaagagaagaggagaaaccaagtctgccaggagaaatatgaatttggaccttggagaatgaaaattrtaggaaaagtaggcagggtagatgggcagggaaacccaaagcrtggtcagggcatcttctgaggatgatggggatcctgcaactaagccagccaaacttgagtctagaattgtgtgcccccaggtgcccttgagcycagggtaaatagctggtgtgattacagcaaccagcagtgtgtgccatatcacagtaaacactccaggagtgggttctcacagaagaatcaggaggaaacccctggcatgagattcagagcagaatcyccctcaagttcttggatggtggcagcagctgctgtggagtctctgttgcaagcttttagttcgcaggcacactggttcaagtttaatcaccacaaaaatactgctttgtgtgaaaataatacatgagtagtccttattgcaaaaggttcaaagcaaacagaaggaatacatcagaggcctctttcagctccaccccccagtcccacccccgaggtaacaggtgtggacagttcgtctccctacagtcctttttcgcagcatttgccctatggcgtagtggctgggactgtgggctttgaagcaagatcatctgggttcaccaactacctccactacctacaaaccttgtaaccttgagcaagttacctacccttttctctgcctacattttctcatctgtaaagtcaggataataacagtctagacctaatagggttgtcatggagactgaatgagttggtaggtgaaaagaaccagcacctggcacagtcagtgctcaagaaatgttaaygtgcatgggacgtggtggcttatgcctgtaattgcaacactttgggaggctgaggcaagaggatcactggagcccaaaaggtcaagggtgcagtgagttgtgattgtgccactgcacttcatgctgggtgacagagcgaggagacactgtctcaaaaataaatcaataaataagatctcattacatatgaagaccgattttcttgcttgcttgctttttgcttgcttttttgctttcctttctttttttccttctttctttttttgagacagggtctcactctgttgcccaagctagagtgcagtgatgggatcatggctcactgcagcctcaacctcccaggctcaggagatcctctcactgcagcctcccgagtagctgggactagaggggcaygccaccacccccggccaatttttgtattttttgtagagatggggtctcgccatgttgcccagactggtctcataatcctgggctcaagccatcctcctgcctcggcctcccaaagtgctgggattacaggtgtgagccaccatacctggccctattttctttctyaaaaaccatmaaaagagtcctactctgaatatttttatcagtagcattcttagttttgagcagtaggtatcagctgactgagatcagaaaaaggatttctttaaaggacattggggtggttcccagtcttgctgggatggctgtggactcaaaccatggagaccaggcagcagcccagtctgcacccacaatagtcacaaaaccagagtggtgaggacactgtgctgttgatgttgctggcatttccagcttccagagtgggaggtgaaccctgcgtcctgccaggactcatacgagaagcagggattcctaaactcgggacaggagttcagatgccaggggcaagtgtatccctgaatagtttatgattcatttgagccttttgtgcccacataaacgatgtcattcttcttctcttaaagacaaacttygctatattgcttaggctggactcaaactcctgggctcaagggatcctcccacctcaacatcctgagtagctaggactataggcgcaggccactgcacccagcacatgttattctgcacatttacctgtgccaggtgctgtgcagcagtgattctcagcccagcagcacattggaattacctggggagcttggatgatttggaatgtccaggccgggcctggtggtaggtcccagccatcaggactattttttttttttttaagagacagggtctcactatgttgcccaggctggtattaaacgtttgaccccaagtgatgctcccaccttgacctcctaaagtgctgggattacaggtgcaagccaccacacccagcccggactttataaggttccaggtgattccaatgtgtagtcaaggttaataaccacagcttctagaggatagtgcatttaataatcacctctatattgggtaggtgatgtttttctgaatttatacatgggaaaccaagcctgagaaagcattcctgccttgctttatgtcacccagtaagtgaggcattcccactgcccaaccccttcccctgactgcagtgactgytgctgcttgcctggatggggaggaggagcaagcctcttcctcagccccyggcactccccagccacaccaacctgccgcaggccatccaaactccacggtttcagggccttgygtgcaggtttctctgcctaggttggtgttacctcacttctcacttggacagtttccacttaccacccccagcctaagtaagtcctcctcttctttttcctttgtgttactaaaacagtatgtgattgtatatgtattaatatgtattaatccgagcactttgcagggccgaggaaggtagatcacctgaggtcaggagttcgagaccagcctggccgacacggtgaaacccagtctgtactaaaaatacaaaaattagccaggtgcggtggcaaacgcctgtaatcccagctatttgggaggctgaggcaggagaatcgcttgaacccgggaggcagaggttacagtgcaccactgcactctagcctgggcaacaagagcgaaactctgtctcaaaaaatatatatatatttcgggagtggggtggcacaaataggcagaatgtctgctaaggctccttgtgggacagtgatgaaagaaacaccaacaaacactgatgcgactaaaggctatcctaggatcaaaaggcagtctactaaaagtccattaattagcatttgctaccacttatctgtggaaattaagatttttttttggttctctgcaatcaaaacaaaattcaaaaataaaatattagctgatgtggctgatataagacaactgtcaatcgtcaccctgccttttaggatgcagcaaaacacctttgttcttcttacagattcatctgatttttgtgttggagatttgagattttgctcgttactgaaaatgtttcctctgctgagagtttgagcagcctcctggttgtgcagagtggccagggttgggctcagctggccaggtggcaggtgcaaagcagggttctagaagagagtctgcctgtggcctcataggggtaacttacttcagtgagcagtgttgggtgcctgagtgaggaagtagaggtggcagaggaggggtccagtgggctgtctgggccatgtgaggctgtctgcaggactcctcagaaaggttcaggactcacgttcagtgcaagggaagacaaagacctttattgctacaaagttgggtgggagactgaagtcctcagatggtctacaagcttgaaaaccaaatcaagttgaccaacaaccttcagttacagtcatgtggtattgctgcgacttctgaatttcccatttggggttttattagcttttagtaaaaggcgacattgtgaagaaacccagattagaattcagtttataaaacagctgagtgagaaagtgggataggggagccagggaactacatagaaaatcattgagcaattactcaacacaattagagcccaaacaccaccatctcatgtgcactccttgagctggcaagtagggaagggggtgcagagccggagctcagggagaggtgtccgtggctccctcacttctggtctcagaggcctggagtgtcctctgttctgagcattttccacaggcaggggctggtttcaggcccagacagactcccaaagctaaacaaatgagcagccctcgctggccatgactttgccatttagaagtggctttggggctccagaatgaatggggagcctaatgcagacccaactgaccaacttcggcagctttggggaaagtaataaaaatgagcccaggggtttgagacaagcctgggcaacaaagtgagatcccgtctctacaaaaaattagctgggtgtggtggcacacgcctgtggtcctagctactctggaggctgtggcaggaagatcgcatgagcccaagaggttgaggctgcagtaagctgtgtttgtgacactacactctagcctgggtgacagaatgagaccctttctccaaaataaaaagaaaaaagaaaatgagaccagtagtgatctaaataagtgagcactttgggatggcttcccagagataagtaggtgatgtaaacctcatcttcccagccctgtaaagaaaaaaggttttttgtgggggtaggaggaggctccatttcatcaaatctgaaggtggacttgagagtttatagttttcccagactgtgaggctccacccaggctttctgtctctgccagtgccaagatgctgcctgtcctaccacctgtgctgagagggtgtccctaaygtccatgatggttcaggctggagtaactagaaaaagaactcagtttccttcccaaggaagaaactgtaattcagtccctgcccagctcacaatggtgatctcagtatgtctcttagccattttgcatttaagattctctgtctataaaatggcaatctgctgatcttaaaaaaaatgtggaagagacaataaartaaaatcccagttctactgagttctaacagccagaaaccgtgagccatttaaaattttgtttgtctcatgtttatgagaaaggataaaataacagatatctaaaccaacaccagggactcttttaaaagctcaaattctagggcagtggttctcaactcaggctgcacattagagtcaactggggagcttttgaaaacaccagtccccaaactccaccccagaccaattaaatcataatctctaggaaggaggtccaagcgtctgtatgtctttaaaagctccccgagtgattctaatgggctgccagggttgggagtcattgttggggtatgccagttggatataaagattcagatttatttccagaaatattatacaagataatttttttatttctctaatagctgaaaaatatatcttatttatttattttattgagatataaatcacataccatgaaattcatcctcttattaaagtatgcagttcagtggctttagtatactcacggagttgtgcaaccatcaccactctctaattccagaaaaaacccttagctgttagcagtcactctcctttatctcctgacaaccactcctctactttctgtctccatggagttgcccattctaggcatttcgtcaratggagtcatacaacatgtggccttttatgtccagcttttttcacttagtctaatgctttcagggttcacctatattgtagcgtgtatctgtacttcattccattttatttttggataatatcccatcgtgtggatatcccacattttgtttgtcgattcatccattggtggacgttggggttgtttccactttttggctattgtggacagtgctgctgtgagcattcttgtacaggtttttgtaaggacatatggtttcagttatattgggtatacagttgacctttgaactatgcaggggttaggacgccaacccctcatgcagtcgaaaatccatgtataacttttggctccacaaaacttaactactaatagcctactctcgattaacaacttattttgtaggctatatgtattatatactgtattcttacaataaagtaagctaaagaaaaggaaatgttattatgaaaaccataaggaagagaaaatactgtattaataccataagtttacattgtctgtctacaagaggaattgtttgtctgaaatgacaggcaactacacagctgcagacctcaatttctggtacatatcaagcaattcaactttttcctgtaatgtcatgactcttctcttttcttgggagcactttcagcatcactagtggcacttcatatggggctcatggtattattcagggtttatggtattgcactaaacacgatgaaaactacatgagaaccgcaagagatcactttttactggaataagcagtttactggagagatgagcagctcacatagagatcactagcatctagctgttggatacctgcgacacttgagttacctgcgacacttgagttacctgcgacacttgagttcacggcaatagcaacaggaggtggctgtgaaattattacaatagtggccaggcacggtggctcacgtctgtaatcctagcattttgggaggccgaggtgggtggattacctgaggtcgggagttcaagtctagcctggccaacatggtgaaaccctgtctctactaaaaaatataaaaaattagctggtgcagtggtgtgcgcctgtaattccagctactcaggaggccgaggcacaagaattcgcttgaacctgggaggcggaggttgcagtgagccaagatcacactactgcactctagcctgggctacagagagagacttcgtctcaagaaaacaaaaacaaaaacaaaaaaattattacagtcatacagtatgcactgtatttaattttatgcagtgattatattgcatctttatgtttgtttacatttctctgactataaatggtgccatgtacagtctgtgtgtgcaaaagttttgataaattttaatgttttatgatagatttatggatatttgtggtagtaaatgataaaatagactagtatctacgtagatttgatgcattcatgacatacctttttcttaattttttcagcatttctaggctacatagtttacaagtttttccaaattgtcacaaatctccaaaaaatgttccaatatatttattgaaataaattcacatgtaagtggatctacaaagttcaaacctgttttgttcaagggtcaactgtatatctaggagtggaattgctgggttgcgtggtcactttatgtttaaccatttgaggagccgccagcctgttttccaaaatggctacaccattttacattgccatcagcagtgtatgagggttcyggtttctctacatcctcatcaacacttggcattattttctgtccttttgactatagctatcctaatggatgtgaagtggtatgtcattgtagtttggtttaccttttcctgatggctaatgaagttgggtaccctttaatgtatttattggccattgttaagtcttctctggagaaatgtctattcaagtcttttgactttttatttatttatttatttatttatttattttattttatttttttgagatggagtctcactgtcacccaggctgaagtgcagtggtgcgatctcagctcactgtaacctccaccttgcaaattcaagtgattctcctrccttagccttctgagtagctgggactacaggcacatgtcaccatgcccagttaatgttttgtatttttagtagagatggggtttcaccgtgttggccaggctggtctctaatcctgacctcaagtgatctgcctgccttggaccccccaaagtgctgggattacaggcatgagccaccatgcccgggctcttttgaccttttaaaattgagttatttgtctttttattgttgagttgcaagagctctttctttatgtattctgggtactagatccttattaaatacattatttgcaaatattttctctcattctgtgggttgtcttttcactttctttgtagtattctttgaagcacaaaagtttttaattttgatgaagtctaatttagctatattttctgttatcatttgtgctttaggtgtcayatctaagcaaccactgcctagtcctaggtcataaaaaatatgtctttaatttattctaagatatttataatttcagttcttagaggtctttgatcaattctgagttaatttttacatacagtgttaggcagattttatcactccaaaaaggtaggagtacagcttcattctgtgcaagataagttgatcatattagaatattagagcaggccacggggcttgggagctctagtcccttattgtaatggtgaggcacgtaaggtactgtgaggttcaattgagagataaacactgactctaaaggcctatttgaacctaaagtacctccgaactctttttctttttttttgagacagagtctcgctctttcgcccaggctggagtgcagtggtgccatctaggctcactgcaagctccacctcctgggttcacgccattctcctgcctcagcctcccaagtagctgggactacaggcacccgccaccacgcccggctaattttttgtatttttttggtagagacggggtttcaccatgttagccaggatggtcttgatctcctgacctcgtgatccgcccgccttggcctctcaaagtactgggattacaggcatgagccaccgcgcccgcccagtacctcctaactcttatgaaaggttaaagtgtattctccatagtttctctgttcagtcaattttaatagcatttctaacattgggaagctataacttatttctgaggtattatgtgtatcttaacaccagaacatgaccagaacattgcatggctctgtcacaggtgagttgccaaactcactgtcatatttttaaagatcttaattctttggtagataaccaagattagttgaaatgcatgttcagattatggatacatcagactcagctaaatggaaaatgtataccatagaagaaaatatattccaatcagacatggtggctcacgcctgtaattccagcactttgggaggccaagatggaaggatcacttaaggccaggagttcaagaccagcytgagcaacatagcaagaccctgtctctacaaaaaaaawttttaaattagccaggcgtggtggtgtgtgcctgtagtcacagctactcaggaggctgaggtgggaggatcacttgagcccaggaggtcgaggctgcagtgagccatgttcacaccactgcactccagcctgggtgacagagtgagaccctatctcaaaaaaagaaaaaagaaaaaaaaaggaaagaaagaaagaaaaggaaggaagggaagaagggaagaaaataaattctaaatagattaaaaagaagtttaaaaaacttaaaagatacctttaacagtattgaaaaygatgttgaagcatcctataaaagccacagcaagtgataatgatgtgataatagatgaaaagaacgcaagggaaatctcctaaacgactcaaactatacagggaggggcggtttggaagggggagttagatccctacctcatgccacactcaaatatatcaactgaatgaaagatttatttcattattctttttatatttaataaagagatgcttgctaatggaggtaaaaaaaatcaaacagtacaagtaaaatgaaattcttccttgattttcttttcccctctctgcctagctccacttcactcactgctatttggtgtgtgttcttcctggctggtttgaatatatacatatacaactactatgtattattttgtggattttttaacacaaagaggattctgttatttytatttgataacttgcttccccccccccccccacttaatagggtatctcaragacctttcgatgtcagtacatacgcgcttacctcattctaattagccactgtgtggtattccatagtagagatgtaccttgtaagcattcccatgttggtaggcatgttaagaagaaaaaaagaacatacttgaacacacctttgtgtgcccaaactagtctttctccagcatagattgctagtagtagatttactgggtctgatagtatttgtgcattttattttattttattttgtagaggcggggtcttactatgttgcccaggctggacttgaactcctgggcttaagcaaacctcccacttcagcctaccaagtagttggaactgtaggcacgtgcaccacgcccagctagcattttaaattttaataaattctgccaaaataccatccaaaaaaaggctttgtgaaattacactgtaatgaatagtatgggagtgatacccttgccaactttttaaaaatttaaattaatccaatgggcagaaattatacctcatttaaatttttttttttaataagcagagaaaatacttgtagaaggtattacttagttttgtttgttttttttctttagtctatacacagaaaactacctggggctctctttgacagcacataaactaaaattggaacagtacagagaagagtagcatggctcctgtgcaagaatgatgcacacatttgtgaagcgtttcatattttaaacaacatatttagagatagaaaagggaaaactacctagaagtggaatgagattaggagaattaggaggattagttagaattttttctggttagaatttttattttctaaattgaaattctagtttcaagttgttttaaaataatacaattttagtttcaagttgttttaaaataataaatgtatattgcttttggaacttgaaaaagaataaagatattttttaaaagaaaaataaagccctcttgcagcataatttacgttgcattttctctctcagtgctgagcaggcctagagttgaaggtcgtgagtgaactgtatattaaaagcctttgtcttccggctgtagcaataccatacttctgtatggccaattgtcaactaaagcctgtatcttgaaatgatggactcatgtgcagatagattgttgtgtgcatctacactcccggcctgttcatagaagacttccggggcagcaagcagaaatgcttgtcagcccacattstttttttttttttttcaatacagagtctctgttacccagtctggagtacagtggtgtaatcttggctcgctgcagcctctgcctcccaggttcaagcgatcctcccacctcagcctcccaagtagcttggattacaagcctgctaatttttgtatttttttttagtagagaaggggtttcaccatgtaggccaggctggtttcgaactcctgacctcaagtgatctacctgccttggcctcccaaagtgttgggattacaggcgtgagccgctgcacccagcctccataytctttattctagctgctcaagcagttttctccacacctgtgcttctttaaaacagtkgacttgatggaaaaattgaatgttaccactttagttggatcctggagatggataattcattgataaggactgccatccacttggatgctttcttcagagccctgtcaccaagaacagattggcagtccattctgtaattcacagcatacctttattgctgacaaagttccaagtgaaggtacctgttagctggggctattaactccctcttgttgggctcctgtaccctgtctgcaggggctagggccagtggccatgatgaraaatgagcacacgtggctcaagaacagagcctgtgatttgcccattggtactgagtccaccttggtgggaagtcagtggcaattcttccacccacacaccactgaccttgccttgttggtggccatcttgtgtgttggctcttgaccagagacgctctgcagtcactctgtggggctgtttgaccacaaaatgtgtcactgggttagtggttttatgccaaggtaagattctgatagaaggcagttaaggtggtagtgtaaaagctgcatgaacaatcatggttcttcttgaatacaaaacagtaatctctgccactaattcattgactgccaagtcccaggctctgggatgggtactctttgtaagtcatgatttcatttaatttcccaaaaagtccatcccatcacctgtaatctcacagctagcatgtggccgacactatattgagagtggggtttgtgctaatccagactcagcaaaatcttgactactgggaccctttcatctcatccaacatatttgagggatctcctgtgggccaggcactgatcctagtgctggaagtccagagataatgcctsccttcaaagagtttctagttcaataaagagagcctcatttaatcaaaagtgttgcacatactataattttaggagaaaattaatcccaggaaacaaacgtcttaggagatattttactctaggaaaaaaagataatccaatcttttaaggatttgtttttaggacaatacacattaaatcattctcctgaatgtgaatgttgacaccactctctggtcagaaatgtcattcagaacaacagtgttaaggcgcgtgcgtggtattctgtcacccaaaatgtgttagctatgtttactcctcataccaagatttttctcagacactcaagaagcatcttcactgatgcagaacaaataggaatttaaacccacattttcataattgattttagtactcttttataatcagtgtaggggcaaacattttaagtttgttcatcccttctataaatcttgtaaataaagttaatacttgcatgtcactgatgaattcacttccaagttactgcctgtgacctaccatgcacacaaarcagtggttgctggcaggtgtggcctgacccttgttgtctttcacaccactttgtccctcagtcacaaccaccaagctccgtccactgcacctgcccacgtcctgtgtgctctgcacatccctgattccctaatcatacacaggttcctcctttttyctttctcacagcacccttggcacttatctgaaacatagctttgtatttttttgtacacacagctgccggctrgctatccctccaagagcaaatactgtgtctgttctcttcacccatttataaaatggtcatcatggtgcctcactcatcattagcttttactaaagggtgggtagatggaacgtgaaagggtaggtgggtggatggatggacagctggaatagttctttcaccaagcagagatggcccctaacttatgatggtttgactgaacaattttttgattttatggtggtgcaaaagtgatacacgttcagtagaaaccgtacttcagtgctgtattcaacagattacattagatattcaacactgttattaaaaaggctttgcgttaggtgtttttgcccaactgtaggctaatgtaagtattctgagtgtaaggtaggctaggctaagcattgatgttcagtagattacgtctattaaatgcattttttttggggggcggggacagagtcttgctctgtcgcccaggctggagttcagtggcgccatctcggcccactgcaagctctgcctcccgggttcacgccattctcctgcctcagcctcctgagtagctgggactacaggcgcccgccaccacacatggccaattttttgtgtttttagtagagacagggtttcaccgtgttagccaggatggtctcgatctcctgaccttgtgatccaccagcctcggcctcccaaagtgctgggattacaagtgtgagccaccacacctggcctattaaatgcatttttgacttagtatattttcagcctacaatgggtttatcaggatataaccccgttgtaagtggaggaacatctgtacttgagtatggggtactttctagtactggcctgttgcagtgaatcagatgtcacctctcaagtcaccttctggcaggagagagagacatacgtatacagcgtgtcaggtgggaaagggcactatgagcaaatagagcagataaagcagagtaaggcaggtagagagaagaggtggggatgttgttgtccgtgtgtgtcaccgcatggagaaggtgatatataagcagagacccgaaggaagtgaagggatgaaccgtatccagttcatggctaaattctcaccattccatgttttcagagtgaattctatctgtgtgtctatcttgtctcatggtgcagttttagtttttgccacacatctaaagctaaatacaccaggtttagtggaagagggcctctggaaggatggaaatgggagctgcctctttttgtggaagggacaattccagggtgggaaaaagatatttatgggccacattttttatatcttcaatttactttttattatcttgaggaagtaatagatcrttgaaaatgtgaatttttttacttctcctgttgagagacaatatgaagttaataagaacaagattactttacaaaacattctgggcttggcaggttcagcctcatttgtatgtcattgatttctttacatttttctctgcatctgttgtaggattttacaggagtcatagaataacggggtcaaatatttctcttaatctgaaaggcgccacattaaaacagggtggtctggttgtaagcgtttcctccgagtgggacagacgaatgttacatatccagttcaggtagcaggcaagctgtttccgattgccaggaaggcccttagaaccagctggccttcgttaagttaggctagagagcgaataaggcagtatatctctaagcagtagcccaaagaggaaagtgattgctgtctccaatggagggatcacaaaggtgtggaggcctgagtgacctgttcaccttcctttgcctgcaactgtggacacagttatatgtgaggtggtggcacttgtcctattcgggtacatgcatgagatggaaaggcttagctgaccattctgcagccctttccaaactaggtgtttcagtggcagtgccagtacttgctgggaatcctgctgcttttcctgtggtctgcccgttgcttatgctctgaaaaggcactgtttgaaacctcaatgccctaaggagcatcttgggtgagaagagagattgggaaactacacagaggatgctcaggaacttcaaacctggaaaatgccagggcagtaattctcagagtgtggtccacagacccctgcttcagaatcatcacaggtgcttgtcgaaatgcagactcctgggcccattccaaagcgcagaaggtgcagcactggaattaaggggctgtctcccaggggtgacaggcacatacacccaggcaatggggagcgacacytttgcacagaaacccaccgaggcagctattgcatttcctgattatgaggtgatttatttcctctaaaaatgtatcctatagccctttcccagggagtctaatttagcagatctggggtggttccagacagggaaatcagttagaatattaatgaattaggaaactgttttcattttttagcagggatctctgtttgagacatgggtgtctcttggtaaactctaaggcaattggatctccatattcttagaatcctggcaaaggggagaattcagaagggccccacctaggctgtgcccatgatgaactggatatagtcttcacaggtcagtgttgattcagcagtatttcttgagaccagccctgggtgaggccccatggggaacactcccagccatgttaccattaactggctccttatagtaacccagctgtgcctttccccttgcctcctctgagaggcctcgctcctgcctggccccttccccacacacatgggcatccccatcttcattctaccttctgccctgctgggkaggctgagggcccagcrcagctatggcccctggctggagccctgtagtttctccccttggcaggcatctccactagtgccatagggttggtgctaggtagacaagtgtgaagggctaggagaggaggacaggggttttgcattggcacagtagccaagacagcaaaggttggaaaagaacaggtaaaactatcacagtttgcagattgtctacctggaaaacccaagagagtcaagtgaaaacaccatagccaagatttgtccaggggaggaagaggtttcaccaggccattgaaggaagtttcagacaacagtgcggagggagggctgggttcatccaggttgttcccagccctttgtccttgtctgttagggcctctttcttccatggggcgtggcaagggaatagcgacttagtgttctaaataataacatggtcatttccggagtacttgccatgtgccaggcatcattctaaacatgtatgttaactaatttaatcctcacaacagccctgtgaggtggygatttcggtcagcatcatctcattacctccacatgcagggagggaaaatgaagtgtggagaatcgcagcaacctgcctaagggtcacatagctaacaagtggcagagcccaggaacctgcgcgaggcaccacccactctgcactgcctcccgtcacacagcaagatgggtctatctcccagaggcaccttgacttctgcactcataaaataggccacacagtagagattcagtacgcattgttgaatagctttcatctctagggcagttttctgtcttcaagacaaacagtggcctgagagctctgagaatttaggtatccagggatccaattgctttcttatttactgagagataggcatgtctctggtgagatcctgccaaacataaactcctccttattaataaatttaggaattgtctggaaccaccacgatggagactatcaacaatatgtacatcagttctctgagttgaaaggtgtgtgcacagcactgcccctgatgtctgtgactttcggtcagagacttaacctctctgatctttagatcttcactggtttaaaaagaaagagctgggtcagtattaccaacctcaacaggtcattatgaggattaaatgagacaacacatgggaagggtctcatccagtgctggctcgtagtgggatctccatgaaggtaagtctatccctgtgccttccaggaggggcaacagctatgtgggatttcataaaacgatgcattataggacctgctccctgccctcacctagcttataatttaggcaagaagagtttctgaaaccacagacatagaaatcataattccaggccacagcaggggagaccccacatggcagtgcctggtctggtctttagagcaggcatgacctatgcccgtgggcccacatcccttgtagctgtgatttggggcaggaacagtgattttacaaagttaaaaaagkcatgtaaaaatccagactttcggccaggaatggtagctcatgcctgtaatcccagcactctgggaggccgaggcgggtgggtcacctgaggtcaggaattcaagaccagcctggccaacatgatgaaaccccatctctagtaaaaatacaaaaatcagtcggatgtggtggcacgcgcctgtaatcccagctactcgggatgctgaggcaggagaatcgcttgaacctgggaggcagaggttgcagtgagctgagatcaygccgctgcactccagcctgggcgacagagcaagactccatctcaaaaaaaaaaaaaaaaaaaaaaaaaattccagacttctagcctgtctcaaaaaatcaggaggtatggcaagaatgggctcaaattcctacacggtaacagtcagcagcccccagatgggctgtggccacccctcctgcagagctctgtggtgtgtctgggctgagtggggctgggttcaaaccctggacccaccacttaccagctggcatgacctcaagcaggttacctgacctcttctgtacatctgggcagtggcagtacctgcgtcctgatcttgttgtggggatttgctgagcttcagtctgtgtaaaagcccagaagcacctgataattattatygtggctgctgttattatcttgactcctctatgcccaaccctgggaagcattcatgtgcttgctctgtgggtcggaagaaggaaaactcatcacagcctggggattgatggactttttagaggacctgtcttttgaattgggcctgaactgcgagagggaagagccatgctaggcagggggacagcaagagtaaaagcgcagaggtggaaagtgtgcaccgtgtcaagtggctgtcagcagggtccttttatgactgatgagttttcttttgtttctgtgtgagttgcaaatgggtttgggtcttggtgcacgtcagtrtcttggacccctgaggaaggatgtcatcacccccaggttgagcatgcacagccttcttcaggacggtgagacgaacccgctgagcaggctgtgggcaaggtcactgtggggtccaaacagagacatggggagggtcagaggacccttctgtgtcattacgggattgggaagtggaatggccctaagatgtcccctgggactcgaatgtgacaaaaccttgtccctcagcagaagagaatctagaaaatctgtctggtggagtcctggaagtgggtgaggtgtggggtggggtgagaaggggttgtgcaagactggactggtgacccaagggaggcccagaaaacgccttgaaggggagcacaaagatgggcaggagaaacctccagtttccctgtggctggggtggggggagggtttgggggccaggtgcatgaatggaccccagctcctttttgggtgggagcagccatgacaaggaactgtattaaacttcgaaatgcagaactctagagtagcctgtgtctacrctgattttaagttatgaattttctagtggttcttattataggtaatgagacatattccctacaaatcaggaatatcctataattctatggtttccacctcccaatgacacctctctgattgtctcacacttagaagtaatacccaaaaatagcctttgaggaatcctatgccccagtgttttatttggaaggtaaggtcactgtatttatgtatcagccataaatacttgaatgagagtgaaaattcctaaggatttgccatttccggctgatggcactagatcccttggaagtgtcccatgtcataatatgccaacacatttagaattttcaacagtcatggaaacaaacaggtgcttggggcagctaaaaataaccaccctgggaagtgaaactgtggcagtgccaaggagctaaggtgggcagtactgcgcttttgggtgaggtcaaaactctggagggaaggccaagaaaagaaaattctgcccatgcccctcctcccagcacccaggagtgtgttttctcttctcagaatctctgtctgatgtgctagcctttttgtgtcatttcgactgaaacgtctcacagctccaacccactgcccccatatcttgcatagctttctgtccagatttctgaattaaaggctggatccagagggtgtcccactgtgcatggatggggggcttcctcccaccccagtgggatgctcctgctgccattctcaccccggaacgcccctgactcagccacctccggggcggtgagaggtgtgagggatgatcggggagtgccatgctcagcagcctgaaccgtgtcagggaacccaggcattccagcctgtgtcatcctccccctcccgtgaagagccacagccacatcctccatgccctgctgcacttcctgaggagtgaaagatggtggctgtcagcgtgtcaaggatgacgggtggcaagaggggtaaacacagcttgttactaccagattcgattaccgggtgrtgctcgaagacaaatggcctggggcctttctgccccttgagggcaggggcagtcttagtcaccaggagcagggtcctatgaggaggagttagggatgttgtggaattgtctcccaaagccagtgccagccgataggactagttgtgttatctcgagttttcgttgttggtagttttgaattgggagccttgatttgaccctgagaataaccaaaactgtacaaaagacatgtgtattcaaaacaagacacaataaggctcaaaaacaaaactgtctatggtgataaaggttagagtaggagttaccttgggggcagaggaatgttggctgggacaggatatgcaagaacctctagaatggttctggaatgttctgtatcttgatctggtggtggtgacacaagtttatacagatgtattaattgagctgtacatttaagatgtggggaatcgctctgaacctattctggtaacaggggctccccgagttttaaaaaagatgtgtacattttactgtatatatgctatatctcagtgaataagtaacaataaagaaaaatatgcataaaggtggactgtgaacagaaacaccttggcaacatttgaataacctagcttttaccatatttggagtttgctgtcccctggtcctaggtgctaaaaacctgatttggttcagtccagacatttaaaacaccagccagctatggagagtaaaataatggcaagtctcttcctagtttgaccatcaagagagtaatttggaaactccagccctgtgccctgaaaccagagtctgtccatccctctacaattagatgagattcctggggcatcaaggtcaagcagatccagctttgaattgctgttctgccactttaacaccgggacsttctgaaaaacagttgccctctctcaggttccgtttctttgtgaattgggtgaactcttgagtgttctttagcaaaggagtacctgtaacgtgctccacccagtggtgagtccgtagcaggtgatcaataaatgctaaagatgctgattgtcattgtcaccactatcacgaaattgtgcagcgttcgagggaactccrgggagccacataccctcgccagtgatgtacctctacaatggcttcaacaaacagttcccacacaacgcaacttttcctacagttgggtgggctccagggtgcagaggccccccgccttgcttggcaggttggcttggctggagcctttgctggttctcagagcgggaacatggtcgagttggccaacagtgtacccacgttgaagcagctgtgccgaacatctggctctgattatctggctgggaatggccgggggtgggagcactgtgatttatagattgctcctttggctgtaaatcccatctgtaattgtgacttctctgtccctaattgtttgcagagaagagaggagctcaatggcttacaatccctggcagagcccaaggctgctggggtgggggtgggggggggtgaggggggtggtgaggtttgttgctaggacacggctgtctttgttttggtccctgctcagcagtgtttttaaggccctgtatacatttctctgtattgttaatgtaatttgttcaggcagtgaacagccaagttcagccgaaggaatccgatactcataacagaaacaccagaggccaggtttttgtggtcaaattagggttttgaggcctctgaagagaatgaaatgttggcgctgggcgggggacaatctccctttctcctcttgtggtgatgctggcctgggttcagcttccttgaggagcttggctttggggcaccaagtccactgcattcagggctgtgttaggtggggagcccggctgcccttctccgagaaagggaatgcagattttattcaaaagggaagaaaaggcactaacaaagtatgagcaagtttgggccctgcctgcccagcctttccttccccrtggctccgggcagcttttttccccccatcccccaccctgcattacttgactggtgaggaaataatagttgggctctgctgagaaggtatgtgactgtgcaaaatgcaatttgcccgtttccgctgcccatgaagacccgacagcccacttgccatctgggaacctcgcgccctgctgtgcttggagttttcggaaacgatggattccaaacaacttccagtgagcaattggtgatattaagttaactgagttcatcttaccctttttattttgcctcagaragtaaaataagatagaagcaaacataccagcccacaaacatgtccatgcttccttttgcttctagaaggcgtatgttgggaaattaatcagaccaacgttagccccttcctcccggccctggaagaatgcctggtgtgtgtgcatccccctctccagttagcaattaccraacaacttctgtggctaccaaggagagcatgatagggtcccagccctccagagcttacaatgtaagagaacaaacaggaacatgagtctttacaatacctgcartgagcgccaacaaagtggaataaaatgtcacctgaaatacctgagaaaggggcttctcaagcttggagaaggcagaggctttggagagatgtttgatctgagccttgcaggagaccgtccaagtgtgggttctagtactacctggatgcaagccttcctccgcctgtgtcccagcaaggaagagttgccttcttaatgaccccattcattgtccctagaacgtggtgatttaccagaagtcttcagaggcaagccatcttcaattcagaaggggaatcccacatgtgtgttgaatatgaggcattgtttaagacacctcctgccctcaccacattggcaaactgacagcgtcaacttgaaacaagtctgcacattgtggccattttcactccacaacaaatgtttgtaagtggccacctaagcctgtgaacttcctaactttgataattacaaacacgaggtagataagattgaagcaaacctggcaagttatactgacttgcagctgaagcactctgagaaacagaacaatttgttcacagaaaaaggaaattaaggtgtttctacactctttaatttccaaggtctttgtttaaagtgaatgagttcaaatgagggaagacacattctgctcacgtttgatgtcactcactactcatgtcgcagcatagggtgtcacagcctgtgtcccagcttcttcccatgggcaccatgctcttcagccatacagactcggacattccactgccaaccagtatcctcaccaatgaccccaaggtgctgttgaggcacttttctttttcagagtttactgacatcctacccaccactgagtagcatgttccttgcccatgattcccttctgtactccctcccccaataccctgtataggccaagtatcccttatccaaaatgtttggggccagaagtgtttcgcagttttggaactcttattggatttgggaatatttgcattatactgaccagctgagcatctgtaattggaaaatctgacatgccccagtcagcatctcatttgaktgtcatgttggcactcaagaagtttcagatttttgagcattttggattttgtattttcgattttggggttagggatgctcaacttgtactagcattaaattaggtctaatcagtttttatcaaaataatttttttcttttttgtctccttcactagaccatggaattccttggaatcaaaaatcatgtcctcttctcccgtgcctagaagaatgcccgagaggtgttcactatgtatttatagggtgaaattttcctatatatgtcttatatcccttaagaaatttttttccagacaataaatgctcccttttcaaagcactataattaactctaggtgtttttgatttaaaatgttctgaaatgcatcccacacttttctaactttacttattttatttatttatttatttatttatttatttatttttgagacaagatcttgctctgtcacccaggcctggagtgcagtggcacgatcttggctcactgcaattccgcctcctgggctcaagcaatccttctgcctcagcctcctgaataactgggactataagcacatgccaccatgcctggctaatttttgtattttttgaagagatggggtttcaccatgttgcccaggttggtcttgaactcctaggttcaagggatttgcctgccttggcctcccaaagttctgggattacaggcgtgagctaccacgcccagcgttatctgacttctagtggttccaaacatctatattaaaatcatgaactaggaaatatttagttaaaatatctttttattccaatgggggggggaaaactggtgatagtgttctttcctaaagcttttgcattttttcctctaggagaggtccttggatatttacccaggctttcctgacttgataaaagaacactgcttgattatatagtgcagtcatctgcagattaagtggcagctgaccatctaggcaggggaaaatatgagaagtaataatataaaaggatactctgtgatggacgggcataatggtgaataagatgttcagagccaggagcactgggtcacacctgtaatcccaatactttgggatgctgaagcaggaggatcacttgaggccaggagttcaagaccagccaggtcaacatagccagaccctgtctctacaaaaaataaaataaaataggcacacacctgtaatcccagctactcaggaggctgaggtgagaggatggcttgagcccagaagttaggggctgcagtgagccacgcttgtgcccctgaactccagcttgggcaacagagtgaaaccccatctcaaaaaacaattttttttccccagaaaatgctgttgtatgctttccattgaaagaaagaagcaggatcagagaaatgcagactaaaacaatgagacggcaaaagttaaagtctaagcatactggtgttggcgaggatgtttgttaataaatgacacatttgcgtattatattgaggaatgatttggcaatatctagtaaaatcaaagatgcrcatatcttatgacccagcaaatctactacacatgagcacaagggacatgaacaagaacgctccttgctgcattgtttacagtagcataaactagaaacaacatatgtggccatctatgtattaaataaataaatatagtcatctagtagaatatagtgaattaactcagatctacatgtattaacatgaataaattctaaaagtgtaacactcattagaaaaagtaagtggctaggctgggcacagttgctcacacctataatcccagcactttgggaggccgaggcagtgggatcacttgaacccaggagtttaagaccagcatgggcagcatagtgagacctcatctctttgaaaagaaagaaagaaaaaataaggggctaaaaaatacctaaaatgtagtgccatttataagaatgtttgtaactcccaagagaatgataattgcatttggttatacaggagaatgccctggtgtttaggagatctgggctgaggtatttgagggtaaggtgttacaatgttgacaactgactttcaaatggttctgcaaaattaaaatgtgtttgtgtgaatacatacataggggagggaggtaagcaaagccaatgtgtgaacatgttaacgatgattgatctggatgaaggacagatgggtgtttattgtacttttcctataactttcctgtaaaatggaacttttcaaaataaaaaattgaagacactcattgaacctataaattgtggataatacatatgtagtgaaatatattcaatgaaaaacatgcagrggtatgacaagcagtacctttaggacaacattacttctgggagggcagataaatgaatgacagatcggatacttgagctatatcaataacactttatttctttaagaaaaaaaagaggtggggagctctagattaatatgggaaaatgataagctattcaatctggtgtccattagtgtctctacttactttctgtacttaaaaaaawatatatatatatgtatatatattttttgagatggagtctcactgtcacccaggctggagtacagtggcgcaatgtcagctcactgcaacctcctcccaggttgaagcgattctcctgcctcagccttccgagcagcttggactacaggcacgcgcctccatgcccagctaacttttgtatttttgatagagacagggtttcaccatgttggccaggatggtctcgatctcttgacctcgttctctacccacctcagcctcccaaagtgctgggattacaggcatgagccactgcacccagcctatagttttataactagatgatagtttattccataactataaayaacatttttaaaacttcagaaaagtgggaataaataatttagttttccttttaaaattaaagcttattttgaaagttattttggtgcttaaaagagagagaatatatattttgtagctctatccactggaaaagattagaaacaatgattatctcaatagcactgaccagctccagtgctcagattatattcaccaaatcccatttcccagttaaaataaaaccaggctcctgggagaaggagctgattcgatgtatgaagttagcctagaatatattgttatacaagaaagcatgaaagctattgaagaccattagagacccaagtctattgttacgcactcaggtactagggctgctaggtcggaaggactcagcagccaaactgagtaagacggaaaagatgaaataattagatcatcaagaatatattatatttattaaaatccttaagttcacgctgacaccaagaaaacacaacaaaataaacacaacactggtctcctttggaggacaacagggagctgagtcattattttcaatatgttaatagaaagaatcacgcatttgtcctgcctgtgctgtgtgctgtttgccactgggccactagttgaggaaagtttttctttacagaagtatttcagctaataaatgaagaagaaatagtcttgttycctgtcttagttcattttgtgttgctgtaacagcacaccacaaactgggtaatttataaaggaaagatatttacttggctcacagttaaggaggctgggaagtccaagggcatagtgccgacatctgctcagcatctggtgcaggccttcttactgcatcgtcctatagcagaaaggcaagagagtacgcctgtgtgtgcacaagacggcagaatgggggatggggggcaaactcatactttaatcaggaacccactcccacaataagggcattaatacatttatgagggcacagccctcataacctaatcacctcttaaagtttccacttctcaacactgttgcattatgcattaagtttgcaaaacatgaactttgggggacatattcaaaccatggcattccctctcccctaaataaaataaagtaaaataacattgaacctgaatttgatcaagcctctagatctaattattaatttaccagaaatacaattcagaagaacatgttagattgacaccatgaggatatgattagcaaaatccagacttaaaaaaaaaaaaaactacaggaacaataacttggtttcctccacgaataatacaggaggcgtgggcagggtggaaatagggaaagagaaagactcctaaagattaaaaggctataaaagactaaaggtggccagatgcggtggctcatgcctataatcccagcacttctggaggccgaggagggtggatcacctgaggtcaggagttcgagaccagcctgaccaacatggtgaaacctcgtctctactaaaaatacaaaattaagygggcgtggtggcgcacgcctgtaatcccagctacttgggaggctgaggcaggagaatcgcttgaaaccagaaggtggaggttgcagtgagccgagattggccattgcactccagcctgggcagcaagagtgagactccatctcaaaaaaaaaaacaaacaaacaaacaaaaaaaaaaacactaaaggcttggccaggcgtggtggttcacgcctgtaatcccagcactttgggaggccacggtgtggattgcttgagctcaggagttcaaggccagcctgggcaacatggtgaaatccctgtctccaccaaaaatacaaaaaattagcccggcacaggggtatgcacctgtcgtcccagctacttgggaggctgagttgtgaggattgcttgagccagggaggcagaggctgcagtgagcctasattgcactgctgcactccagcctgggtgacagagtgagaccccatctcaaaaaaaaaaaaaaaaaaaagattaaaggctttaaaaaagaataaaagacataaattgaccaatagcaaatgtatggaccatgcattggatcctgattggaataaactgtagggaaaaattatttgtaagacataatattagaaaattattgttaacccttaaaaacattttttaggattttaaaaaattttctgctttctagagataacacacagaaatatttaccaatgaagtgataggctatctgggctctgtttcgaaatagtcttgggcttaggggtggatgagcaaggagtgggtgggggatggatgaatggagacgggccatgagctagtaattgcagaacctggtggtggcttaaccagattcattatattgttctctctacttttgtgtacattggaaattttccaaaatggtttgtttttgagatggaatctcactcagtcgcctaggctagagtgcactggtgcaatcatagctcactgtagcttcaaactcctgggcccaagcaatccccccacctcagcctcctgagtagctgggactataggtgtgtgccatcaygccctgctaatttttctaaattttttgtagagacaaggtttcgaaatcctggcctcaagtgatcctcttgccttagcctcccaaagtgccgggattacaggcatgagccaccacacctggccacaaaataaaaggttttaaatatttcatttttattcacctggcagaatcccaggtagaagttagagtgtttggtggatggttgagtgtctgagcaggaccccacagccaaggggggttagagggaggggccggcaagggtagggaataaggcctgatcaagtgagctgctggaggtggatgtatggggtgtctgcttccccaggtggagctggatagatactggtgtgctgagaatgagaaggaggatgaagaaagttgcaaaacccagcaaaaagtacccaaaagcaaccactcacagcaaaaattgggggaatgagtgatttaaccccrcaaggcatacactttctaggactttacaaataagaacacctttagtccctacagcaaccctcccatgaggtatgtgcttgctgttctttgtccctattttacctttttttattatactttaagttctaggatacatgtgcacaacgtgcaggtttgttacataggtatacatgtgccatattggtttgctgcacccatcaacttgtcatttacattaggtatttctcctaacactatccctcccccagcccccactccccaacaggccctggtgtgtgatgttcctctccctgtgtccatgtgttctcattgttcaactcccacctatgagtgaggacatgcagtgtttggtttcctgtccttgtgatagtttgctgagaatgatggtttccagcttcatccatgtccctgccaaaggacatgaaatcatcgttttttatagctgcatagtattccatggtgtatatgtgccacattttctttatccagtcaattattgatggacatttgggtcggttccaagtctttgctattgtgaatagtgccacagtaaacatacatgtgcatatgtctttatagtagcatgatttataatcctttgagtatatacccagtaatgggattgctgggtcaaatggtatttctagttctagatccttgaggaattgccatactgtcttccacaatggttgaactaatttacactcccaccaacaatgtaaaagtgttcctatttctccacaccctctccagcacctgttgtttcctgactttaatgatcgccattctaactggcatgagaaatctcattgtgtttttgatttgcatttctctgatgaccagtgatgatgagtattttttcatatgtctgttggctgcataaatgtcttcatttgagaagtatctgttcatatcctttgcccactttttgatggggtcatttgtttttttcttgtaaatttgtttaagttctttgtagattctggatattagtcctttgtcagatggatagattgcaaaaattttctcctattctgtaggttgcctgttcactctgatgatagtatcttttgctgtgcagaagctctttaattagatcccatttgtcaattttggcttttgttgccattgcttttggtgttttagtcatgaagtctttgcccatgcctatgtcctgaatggtattgcctaggttttcttctagggtttttatggttttagggcttacatttaagtctttaatccatcttgagttaatttttgtgtaaggtgttaggaagggatccagttttagctttctacatatggctagccagttttcccagcaccatttattaaatagggaatcctttccccattgcttatttttgtcaggtttgtcaaagatcagatggttgtagatgtgcagtgttatttctgaggcctctattctgttccattggtctatatctctgttttggtaccagtaccatgctgttttggttactgtagccttgtagtatatttgaagtcaggtagcatgatgcctccagctttgttctttttgcttaggattttcttgcctatgccggctcttttggttccatatgaaatttaaagtagttttttccaattctgtgaagaaagtcagtggtagcttgatggggatggcattgaatctataaattaccttgggcagtatggccattttcacgatattgattcttcctatccatgagcatggaatgttcttccatttgtttgtgtcttcttttatttcgttgagcagtggtttgtagttctccttgaagaggcccttcacatcctttgtaaattggattcctaggtattttattctctttgtagtaattgtgaatgggagttcactcatgatttggctctctgtttgtctgttattggtgtatgggaatgcttgtgatttttgcacattgattttgtatcctgagactttgctgaagttgcttattagcttaaggagattttgggctgagacgatggggttttctaaatatacagtcatgtcatctgcaaacagagacaatttgacttcctcttttcctaattgaataccctttatttctttctcttgactgattgccctggccagaacttccaatactgtgttgataggagtggtgagagagggcatccctgtcttgtgccggttttcaaagggaatgcttctagtttttgctcattcagtatgatattggctgtgggtttgtcataaatagctcttattattttgagatacattccatcaatacctagtttattgagagtttttagcatgaaatgctgttgaattttgttgaaggccttttctgcgtctattgagataatcacgtggtttttgtcgttggttctgtttatgtgaaggattacatttactgatttgcatatgttgaaccagccttgcatccagggatgaagccaacttgattgtggtagataagctttctgatgtgctgctggattcggtttgctagtattttattgaggatcttcgcatcgatgttcatcagggatattagcctaaaattctctttttttgctgtgtctctgccaggctttggtatcaggatgatgctggcctcataaaatgagttagggaggatttcttctttttctattgattggaatagtttcagaaggaatggtaccagctccattttgtacctatccctattttaccattaaggaagctgacacacagataaattacttgcctaagtcagtggcaagtcccttaagtcactggcaaagccaggatttgaayctgggctagcctggaacctggcttctttgctgctgtgccacactgtgcttctctatgtcagtgcaacttccaagttttggtggaaatctaccaccataaagtagcttcctctcccaacttyattctcttagttcccattctcctaatcacccaaacttggtgacttcagctcttctctccctcctgtcccataataaccactcactcctaggtcctatgtattctctaaaactgtcctgtgatcccagagccatctctcagaacacagtttgtggttttccagcctggatcactgcagtagtgcccctgactccagctcttccctttctgtttatctccccccgccttttttttttttttttttaacctcccagtgcaccactttctccatgtcattctcgtgcttgcaaaccttcaaggcatcctcattgatcataaattgaacacaaggtcttgcttctaagacagcgagaacagtcagggcttgggttcaaatagcaccgctgccgccgttttaccctgtgaccctgcaggatggggatgggactcactcagagaggctttaagatcagatgtgcaaaagcgtacatagagtggctgagaaaatacaagcacttggtctccagagtgagttggtgcttaacaaatgttcactcctatgctgttttgctgtttttccggcatctaccttgtaacaactctaccaaatccctttatctttggacttctcttcctgccctcacccctttgcacttagctccgctcactgcattgctctgctctgcttacactgtcaaaccccctctgaactcaactaaaggagcctccctctccctcaggccttggcgacctgttcttcccatgaactactagagtggttgccacttgaacaacgcctgggttttttggaccattcgaatttcagaaaacttggtggggaaaagggactgtcagagtaataccccctcttttttttttttttaaccaagtaagaatattaagagaaacaacgatcctaatttcatgtgaaaaagaatattttaataataacaaaaagggtgggtggggggacaagctcaccctagagcaaaggacagtcttttaaattatataagcttagctttagttaaaaacttgactcttcagtcttgtttctaccattctaatagaaaccagtgatgcctgccacttatttgagtgtatatggctcatttcccatcctccttataagctctggattctgggctgggcacagkggctcacacctataatcccaacactttgcggcccaaggtgggaggatctcttgaggctaggagttcaagaccaggctgggcaacagagtgagaccctgtctctacaaaaataaaaattagccaggcgtggtgccgtgcacctgtagtcccagctactcgggaggctgaggtgggaggattgcttgaacccaggagtttaaggctacagggaactatgatctccctactgcactccagcctgagtgacagagcaagaccctgtctccaaaaaaaaaaaaaaaaaaaaaaaattagtcacaaacattttcrtgttgtttgggtatttgtttttccattcaacatttaatccttgagtaggtcctagcagtctgggcagtgtcttagggactaaggtattataaaaagataggagactgggtgtggtggctcatgcctataatcccaacactttgagaggccaaggcaggaggatcacttgagcccacgggttcaagatcatcttgggcaacatagcgagacccagtctctacaaataattttaaaaatcagccatgtgtggtggtgcacgcctgtagtctcagctacttggggagttgaggcaggaggatcccttgagactaggaggtcaaggctgcagtgagccgtgattgcaccactgtactcctgcctgggtaacagagtgacacaaaattctgtttaataaaaattaaatgatagggttccagccttagagggactgcgtttcaagtgagagagagggatgaatgtccagtcaccagtggggacgttgtgctgaggaagggcagcctagaccttgaaagggagcgaagaggtgggttggggctccctgcaaagtatgccacctgacttggggttcccaaggagttcagaatggttggaatttagtcacaggaagcaaggaaggagatgttgagagatgggctagggaggtaacagagaccagccctcaaagtccttctttatcattyttagaaatttgaaccttaggctgggctcggtggctcacgcctgtaatyccagcactttgggaggccgaggcgggcagatcatgaggtcaggagattgagaccatcccggctaacacggtgaaaccccrtctctcctaaaaaaaaaaatacaaaaaattagccggggagggtggtgggcgcctgcagtcccagctactcgggaggctgagccaggagattggcatgaacccaggaggcggagcttgcagtgagccgagattgcgccactgcactccagcctgggcgacagagagagactcygtctcaaaaaaaaaaaaaaaaaaagaaaggaaaagaaattagaaccttgggccaggcgcggtggctcacgcctgtaatcccagcactttgggaggctgaggcgtgcggatcacaaggtcaagagattgagaccatcctggccaacatggtgaaaccctgtctctactgaaaatacaaaaaatyagctgggcgtgttggcacacacctgtagtcccagctactccgggaggctgaggcaggaaaatcacttgaacccgggaggcggagcttgcagtgagctgagatcgtgccagtgcactccagctgggagacagagcgagactccgtctcaaaaaaagaaaaggaaggaaggaaggagattggaaccttattctgaaggaaacaggagctattgaaaaggtgtcctataaccccaattctgctaaagagatggagagagaaagaactggaatgataggaacatgtgtacaagtgcagctctattctgacaggacactaggaagaggcacaccagactgagttacatacagagaaggggggagcacattcagaggggtcatcacctcgtctgtcttgagctactagagagagagagaagggaaggtgaaagtgtgttgattaaagaaaatttggagattgggggaagatttttttaaattttacttaatcatccagccaccaatatatatcagttttaaaatgttggtccagtttgggtgcagtggctcacacctgtgatcccagcactttggaagactgaagtaggtggatcacttgagctcaggagtttgagaccagcctggccaacatgggaaaacctgtctctactaaaaatacaaaaaaatagccggacgtggtggcacaggcctagagtcccagctacatgggctgctgcggcaggaggatcgcttgaacctgggaggtcaaggctgcaatgagctgagatagtgccagtaacactccagcctgggtggcaaagtgagaccctgtctcaaataaataaattaaatgttggtccactttctgccagacctttcttctggcatgtaagttttctgcttctttctctttttcaaatatcgttgtcttcatactgaggtacaatttggtgtccagcttttttcacttcatactttatcctaagcactttcttcagttgactcccctgtttccttgtttttagaaactcgggtttttctggtgctttactctcataaacaatagtgcagtgcatgattcttatggattaagctttttctgaatttaggattagtaccctggagtacaatcctagatttgggctcattgagtaaaaggctagaaacatctttttttgagacagagtttcactcttgttgcccaggctggagtgcaatggtgtgatctcggctcactgcaacctccacctcctgggttcaagtgattttcatgcctcagcctcccaagtagctgtgattacaggcacccatcaccacgcccagctaatttcttgaatttttagtagagatggggtttcaccatgttggccagggtggtctcgaactcctgacctcaggttatccactcgtctcagcctctcaaagtgctgggattataggcrtgagccaccacgcccaaccttagaaacatcttaaagctacatcatatcaccagatttccttgcagggggctgaatcagcttataccgggggcaaccatagagtgcccatttctcctgcatccctacgtgacactctgctttctgtggggcagccttgttattgcgaagaaccagtactactaacgtgcttttttaaaaaacaaaaattgtaatrgcttcaaggctgcatacacgttgccagaggaaaagcctgaggggatgggtggatatcgccttttaatttgctgttagttttccataaaggaacaaatgcctraaactttccaaaacttagtctaagtttggacagatccctgtgtcttgaaatcttggtcccctcaggaataatgctctatttagagaggaagaacatataaatgttcccagaaacattatagggtacttgaaaatcctttggaacatctgcaagtatcttgcagatgaacgaggttactaagctggccagcaggaacagccaggtctaatgtgcgcccccaggaagccaggcctgttgaggtgggtctgttagagagccccaggctgtagggttgcccacctgactcagctgcccaagcatctctcctctgtctggcgcttcctyctagcatcctggtttgtattcctactttgagttgaaactgggcttttcactcctgagtagctctagaagacctaagaaccacttcacatctgagaatgatcaattgttggctgagatgacagagttatctggtccaactatttgttgcctggcctctgcctgaacacctgcagtgatgggggcagcctagagcaaactgaattcctcctcgtccacgtgacagcctttcacttttcagatcaccttcctcacactgatggtctcatacaacatcattttgaatgtcctcagctctctgcaccacccacccaactccactctgggccaccgctggtgtatccaagatcaggacaccagtccctgggcaccagggagtatgctggccactgaagcagcttcgtttttccggcacccatgttgtaaaatcgactcccccaaaagttattgtccacatgtgtaactgtccctcccaccatgtccccttccacacactatttcccacccctggcatgggtataggacgtcatttctgttaaccttgtgttggtgggtttatctcttttttctagcgtagtgtagggattgagggtgcagaccctttggtcagggtaggtttagatcccaccctgggtgagtcagagagcttccctgtgcctccgtttcttcatctgtaaaatgagaccctcaacagcccctacttcagatagtgctcaagaggattgagttaatgttagcgaaggacttcggatggtgcctggtatgctgtaagatgggtgtcatttctcattgtcacaccgttgagagtccagatcttcatcatgtttcctctgcatctgactggtgagcctcccagatcagcagcccacaaggcgatcgggtcagggctgagtagctgccagcagaggctggagacttgaggctgtcgtgcaatccattctcgcctttgtctgctttctgtcttttgttttctgctctgtgtgtgtttgtttttgtgattgttattttaagtctctctcaggaatgcttcgtgatgctcagcccggtcaagcgatctgtatacatcctccattatttcttctccatttctttttaatcatatttcctcctctgaacttctaccctcagatttattcattatctaacaaatactgatggtgcagstccatggcccaaagctgttctgggggccacagcagtgatatgagtgtcctggggaagctgacattccacggacacaagcagccattcgtctgtctcattccgccaagacctctgtgaggtcttgttgacccctttgcatgatkatcttaagtttgttcaccactgttcagcatatgggcattaaaccctatttttgcattctccttcccactattttctcctactgattaagcggtatctcctccactgttatttttcttccagtgacatattcaggaagagcaagatctcaaaaaatataaatgttgatgttccccatccaatcccggttgtcattagartgtttatacttatccacgcagtgcttcagttctggaatatattcatctttaccttaccctggttagcaataacagcaacaggaattaaaaccagtgggctactgttacagcttggcaggtgtaacttcagagaacaaaggggattcttttttgttttttgtttgtgattttgtttattcatttatttatttttttgagacagggtctccctctgtcacccaggctagagtgcagcgaaatcacagctcactgcagcctcgacctcctgggctcaagagatcctcccacctcagccttctcagtagctgggactacaggtatgtgccaccatgcctggctaactttttgggttgttttgtagagaagaggtctccctgtgttgcccaggcaggttttgaactcctgggctcaagagatccaccctcttcagcctcccaaagtgctgggattacaggtgtgagcccccacacccatcctggagattcttcttcattttctcctgacctgaagagtcagcacactttctttttgtgttctctaaaaaggttaaattcagagattttttttttttttttttagatggagtctcgctctgttgccaggctggaatgcaatggcgtgatytcggytcactgcaacctccgattctctggttcaagtgattctcctgcctcagtctcctgagtagctgggattacaggcacacaccaccacgcctggctaatttttgtatttttagtagagatagggtttcaccatgttggccaggatggtctcgatctcctgacctcgtgatcygcccgcctcagcctcccaaagtactgggattaccagcgtgagccactgcactcagccagagaattatttttaacatgctataaaattaacttttggggttttaacaaattgtaccaccacaatcatgatatagaacaattccacccacccccaaatttccctgggcatcccctttgtagtgagccccaaaccctggcaactgctgatccactctccatccctctggttttgccttttccaggatataagtggattcgtatggtgtgtagccttttgattctggcttcctctgctcactaatatgcacttgaaattcatccacattgctgcaggtattagtagttctttttcattaccgagcggttttccgttgtatggatgaacccgtgtttgtttattcattcatctgctgaagaacatttggattgtttctagtgtgggaagattatgtatataactgttataaatagtcacgtaaagtttttgtgtgagaatataatcttctaataaggcatttcacttttcatctctcttgttccactctgcttttttcatttcttttcttttttcttttctttttttttttttttttttttcgagatggagcctcgctctttcgccaggctggagtgcagtggcatgatctcagctcactgcaacctctgcctcccaggttcaggcgattctcctgcctcagcctctcgagtagctgggaatacaggcacctgccaacacgctcagctaatttttgtatttttagtagagatgggttttcaccatgttggccaggatggtctcgatctcttgaccttgtggtccacccacctcggcctcccaaagtgctgggattacatgtgtgaggcaccacacctggccattccactctgattttaaaggttgtggaaattttggtagaaactctgcctggtaagttacagatggtactgcatcttttgaaggaatgcccccattctttcaaaagattgatttcacgaattcccaaacatatgccaaagaatttctcacctcttgagaagtcttggaccacattccccatctgctggaatttatgttctgcccgaagtggatcgcctacttaacttttaattttttgtctgtgggttgatayctttctaaatcacaaaatcaccatgatgctaagcaaaagatgaagacgctaaaggtggtgaggtccaggaaactcagaatagggctttgtcgtctcatggacacatgggaagaaaggtgaggtcagcttgagtgtgcagatgttggcatcattgaaggtgaaagggtggcttggattgcagaggctctgcaggagagggttgctggggatgggccgaggtttggggatttaacttgtttctgaagggtgttctcaaatcctgctctggataattccccaactaccatttaatcagctccattaaaccctgccctgtctagcgcactgtgctccagacagggctctcctgggctcccagtaatagctcaattgtgtgtaagtggctgtgaagaggctctgtgtgctggatgaataggcctcatctccatggaaaccagagcttactgaggggctgacctctgacccacttgttgccaccatactgttaaccactggtacctcttgggtggagaaagaaagcaaggaaatggctgtcagaattgttttcattttcccttagtttaggcctgggtccccactaagtacaaataacacgctcatattaatccaaagcacttggatgtgagtttggcttcattatggactttgtctgtccctaccctgtctccccgaagccatttctttatcctacaatctaggatgcagtggagtgagcagggttggtttatcaccaccctctggggatgctgggaatgtggttcctaaggggcagtgtggaaaagaggaaggcccygtgctgggagccccaccccctaggctcagggctggctcccttgtggtgtgaccatgggcacatttcctcatctgtaccatggagctaatccctacctgcagcccagaagcctcgcggagctcaactaggaagaggcagccaatgtgttatacctgtgacgctctccactarccaaggcattaggatcttaagggcaagggcaaaacaggtacctttttagcaatgacataaataaaaacttggctacaccttataaggggccaggtgcggtgtggctcatgcctgtaatcccaacactttgggaggccaaggtgggagcactgcttgagcccaggcattcaagatcagcctaggtaacatagggaaagtctgtctctaccagaaataaaaacccaccaggctgggtactgtggctcatgattgtaatcccagcactttgagaggcggaggcaagaggatcgcttgagcccaggagttcaagaccagctaagcaatatagtgagacctcgcctctacaaaaaaaatcaaaaaattagccaggcatggtggcatgccctcagctacttggggagctgaggtgagaggattgcctgagccctggaggtcaaggctgcagtgagctgtgattgcactgctgcaccccagcctgggtgacagagcaagaccttgtctcaaaccacgccatcccccccccaaaaaaaacccaaccttgagactcatgccaagatggctttaacaaccctgaagtgagttattcactcaagcccggtctgtatcagtgagtatttcagaccctatggcactctgtccatacaggcagatttttctggactctgttctttgctttgagatgacctgggtcaccatggttgtcctggactccaggagacatcacaggcaaaatcaggtccatacttcccccgtttgtctgcagagaggcctctggtgtgggtcagatccaggggctttccttctatgtttgcagctggaggcctctggatgcaattgtgtgaaccccctggtgtgtccctggagccccagaatgtaagaatgaattttcaagagaaaggtgagagacaggtgctgggcttgtcagatttctggctgggaggcatcccataaggtaagtcaggtaatttcttggaaagagagccttgccggggatcagttatatgtatctacccatgtatcatgctctgggggctgtgttgggggcaggggcaacataagaggtaaacagagtcccaagtctgagctcctgggagaaagtcagaatgcaaagtaacaatttcattttagaggagcgtcaaaagtctcatggctttctaggaattgccgagtaataggaaccaggaggagagaaggagggactgcagggtcatttgcagtgactgagatttccaaatgctttgttccctaaacctgtctaccaccacggggcgagggcatcagctctttgcatccctcagaccccaggtcactgtcgtaagctcttttcttggaactctgatctcagataacctgcattagtctgaaataggatgctgagataccaccataggctcaggagaggtgctttttagacctttctggttgggttttcccatctgccctgaagtatggtccaggaggtggtgatcatttggagcacgtcttaggactggagaggcccaaaataccttcaagccttttgttatagttctaaggtatttgttagaactcctggacagtttgtctagtggtttgttgtgttttttaaaatttccagcaacttgcccacacacttggccaagctttggactgagaaggatgcagtggtgcaatcacagctcacagttataacaaggatccttcactggatccttgttataactgtggcccctgattggagccctggtgactccgaggtctgcagtgcagccccctctcagcctgtcgcttgctgtctggggcttccacagtgtggagcagctgctcctttcctgggctacaggaaggctatgtacaacctgcacaggcatccacaggatcactcactctaagtggttcaacatgcttttccatcctcagaaaatgtcactatccatgtaccaactatttacaggagattgggttgggggcagtgttccctctgccccaagttgtggggagccagaaatacacatatattaaccctgggcttggagagtggagaagagagcatctcttcattctgcagctgtgtaaacagtggggttggggggtgggttgcaaagctaaggataatgggggagggaggaggggcatgaagaaggagggagggggctggtgggggsctgccaaatcaggcagggtcagggaggagagggtaagaacaggaggcctaaagcggggttcgcgggctccctggctcttcacatatggaggacatgcctccgcagaagcgggaggcatgcaagcaaagtgtgagcggacaaagaggaaagtgacgcagggggaaggtgatgcgggcaggacccaacaggtggtggcattccaggcgaaggaggcttccgccctgggccgccagggtcagtgggaggaaaggctctccctgcctggctcagttgaagcagatgattattaggttcctgctgtatacccagagcagccctggcgcagtggcagcgagcgagggaggtggagattcagttgtgtaagacataggcactattcactaacagtccataagtgcatggggaagaaaggccagcacacagacgactccaggcttcggcactttgtgtcctgtgaagggttttggaggaaggggaggagccccgaagtcagggcaggcagcgggaggcgggcttaggagcttcagctggggcagggaaggccgttctccaggtactgggggaagggcacaagcaaacagagacacggagccttcagctgccttmtctgcaaggaagatgactactcttttggggggattcagagcagcatcttatccggcacatggcacccgtggtaggaactgagtcatcccgcacagccggggccgtgattccttcattgattcttccttcaacgcttccttatggattgccttctgcctccagtcactgtcctaggagctgaggatggggcagaaaaccacacaggcaaagtctatgccctcatggatatcacattctgctggggggaaacagagagtgaacagatggaaacacccagacagtaatgatacaccatacagaggactgcgcagcacagtggggtagtatctgaggggctactttaggttggatggacagggaacaatcttttggagcattttatttatttatttatttatttatttatttatttatttatttatttatttatttttcttgagacagggtcttactctgtcgcccagactggagtgtcgtggcgcaatttccactcactgctgactccgcctcccgaggtcaagcagttcttctgcctgagccttccaagtagctgggactacaggcgtgatccaccaccacaccgactaatttttgtatttttagtagagatggagtttcatcatgttggccaaactggtattggagcattttaaacaggggtccaggggtatgactaaatctgatataaaatttaacgtaattccttaactgtgtagaatttaactgtgtagaaaagagatggaaggaagggttaagagttgggtccctgttttggagatgtatataccccacttccctcactggaccagcccgccaggctgaggctccccctgcagtccctgtatgctccttcctatgcagtcggaggccttccctgtggtcctttgccctgcttctctgctgctgtgagggttgctccctgccctccagacccctccctgccctgccacggacacagaccccaggcagcatccctccccctcatgctgggcacagtgtggactgtttctcctctatgtgcaaactcatcacagtgtggactgtttctcctctatgtgcaaactcttcccaacccatcatgccctggaagatgccatgcccccaaacgcagtgggascagtggatttggcccaggtctgtccctggcctgctggatgactttgcaccaatctctccagggtggtactgtccaataaaaatgaaatataagctgaagcagtaattttaaattttcatgtagccacattaaaagagaatgaagatcgggcgcagtggctcatgcctgtaatccaggcaccttgggaggctgagacaggcagatcacttgaggtcaggagttcgagaccagcttgaccaacatgrtgaaaccccatctctactaaaaatacaaaaaatktagccgggcatggtggcacgcacctgttaatcccacccactggggaggatgaggcaggagaatcacttgaacctgggaggcagaggttgcaatgagccaagatcgcgccactgcactccagcctgggcaacagagcgagactccatctaaaaaaaaaaaaaaaacmaaaaaaaaacaagaatgaaaaggaagcaagtaaattaattttaatagtatatcttatgtaacccaattcatcaacagtattagcatttcaacatgtaatcaatttaaagactgattactgagacgttggatgttcttttctcgtactgagtgttccgtgtgtgtttcctgtggcctgcatgccatttccagggctccatagccacatgtggcaagtggccactgcactgcatggaccacgttgcacagagcagctctgggagcctccctttcctcctctgcacaatggagatgattatgtccctgcacctccctctctcacaaggctgttgtgaacacagaggaagccgggggactgctgtggagatgaaggatgttttaaacctcaggctgtcatcgcagagggtgtggatggcaaaccggagaggagtcaaagggctgatatgggaacttccctcctgtttctaacagttcccgtgttagaggtgaaggagataactgagaaacacacagatgataaaaccattggctgggcatggtggctcacacctgtaatcccagcactttgggaggccaaggtgggtggatcgcctgaggtcaggagtttaagaccaggctggccaacatggccaaaccccatctctactaaaaatacaaaaaaaaaaaaaaaattagctggacatggtggcgagtgcctgtaatcccagctactctgaggcaggagaatcgcttgaacccaggcggcagaggttgcagtgagccaagatcacaccagtgcactccagcctgggcaacagagcaagactcttgcctcaaaaaaaaaaaaaaaaaaatcagttgcctgaaatagtgcttgtacttacagattaagtcaccaaggggcagaattttgtgcctgctgaaatttgaaaaaatartcttgcagccaaaagagagaaaaatgtgtttctttcctaaactatggtaatagtaaaagtatgtgatgctttttgttaagttttattttaatggaaatattaaatctgtgccttttgtttttgtttttaaggaaatggagaaaggaaggaagctggagggtttaaattcattatgctagctttagattctgcaaaatcaggaaatcaraaagtacaagttctcagagttagtgacatttaactcaattgggaagggcccgcccaaggtcacccttttaaagggtttgtcttccttttcaacattttttacacagcatgtcttttggagctcagcagtttttgctctctttctttctcagtgtgggaacagaagttggcacacgagtattttcctcatttgactcttgaaatgccctgtcctcagtgccttctacatggtggtgcacagtagaagtttgttgactgactcattgagtctagaggatgggagcaggggaacagcagggaagagcctctttgcactctttgatccagaggactggatgcactttgtttttkttttttttttttttttttttttttttttgagatggagtttcactcttgttgcttaggtgaatgcaatggcaccatcttggctcactgcaacctctgcctcccgggttcaagcgattctcctgccttagcctcctgacagctaggattacaggtgcccgccaccatgcccagctaattttatatttttagtagagacagggtttcaccatgttggtcaggttggtctcgaactcctgacctcaggtgatctgcccaccttggcctcctaaagtgctgggattataggcatgagccatcgggcccaacctgggtacactttcaagcagtccttgttcatgcatgataattcaggccccagatatatttttattttattgacttccttagaaacttaaaaaaagaaattaaatacagccactgtttatttttagtattttaactaaactgtctgttggactctatttgtatttccttaggacctggataactccgtgagtccaggaatagtttgctttttggtaaatattcctttcaggtttctctttgcttgcttgctttttttttgggcggaggggggcggtggtgcggggggggcaagaatagatttttgaatcatgagaacctaaaaacatctgtaagtctaagggaccatcttaaagaagccagtgagaacttcttctattatctggatcacttaaaatcaaaccaagcatttacctacaaggccccaggggctctgacatttgtgatctcataattcttccattgataccatgaggctggaaaccctatggttgctggcttccctgggtcacttggctgcctctgggctgccaacatagaacccacgtcacataaagccccggcccaagtaaaatgccaacatccaggccaaatccacacttttccatttgtgaacatgtcgcgcttaagaattacctcccttctttctgggatggctcaaataatggaaggaatggtcctccatcaccttgaggttttgtcagcttgacgtcctcatccaagcctgaccacagccgttatgacagcatgaatgcaaacaccacctctcctgacctagacgctgcacccggctgtgcccgcttctgctgtagggagagtcagtgaggtccatctgcagccttcctccttttccttgaatggggcttggcattgaggtttgtgcacaccctgtatagaaggcaaatgttgaggccagccttgtccccaggctcagtcttcctgaagactttgtcactcctgctcacagcacccactttctccccttccacacgggatgtgttgcttcctcctgtttcttctctttgcagatctccagttttctgtctccttcaagaaatctccccagggcctctatatccccttttctctgcctccctattgaagcagatgttttacctcagcctttyctagtacactgtactgttttaaaaactattgaatgaaagggcatgttttcctttcctttccccatttagattacacacctctggcagtggggcctccrgcaagtcttaaagatctygacgcaccgacatcttggcacatagtagttaacaataagtaactgttcaattggcttctagttgaacctcatatgtcttggttaacatgtgcaggattggtaggcattcagccccaattattccgcccttaactcatttttgcagtttattaataatcagttggcacgcagtttcraaagaactaattctgtaataacatgttatggctactcctcggcgccattacatgcctgaggtcccttgctgtccctttgtgtttttgatgaaaggtaacagcctggtgttcccagccrtcacccagaggtgggagcagatccggctgctgcagcttattgctaggaatgggtgaggctgagtggaagctttagtaactcaggtgcggctcttaagctttgttttgagtttcaaaagggctgttttgtcccttactcgtgaagtggccttgtgtgacataatggccccctctgtgcagggttcgaggggaagggaaggggaacatgcccagcgactccacgtggggaagttgcatttccacaccattcacaggggatccagtgttttcggaattgtctgggtgtgaacagcataagaggtgctagaaactcagcaagggaagggggagctgggccaggaggagaaggctggggatgggctgaggagagagagcttcctggccagaggcagccccaggcatgggtcttgggttctgagtgggcaggattctggctcagggtgagaggtgaaacttcgttcaggagatatacgctgagccatccactacgtgccaggcaccttagaaagggccgggtattcatrttgtgacttcacacggctccctgcagagttgacgttgggagctgccctgctagccacggaccacrttgtgaacagcaccccctgggggtgggagatgtggtgggcggagttcaggatccagccacagggaaagaacgaacaggcaaactgtgggatcccggcctgccagggagggttcagggtaaagccttcagtttgcttgttcattcatttattcaatatttattgaaggcctcacagggaggtgacaaactctatagacacatacacgggggaagagcacgccaggcagagggaacagcaggtgcaaaggggatggcgcttggtaggttccaggagcgggcagaacagagtggctggagcagagtgggcaaggctggggggcagcactgaaggaggcacagtcagaaaggggacagggggctggtcacaggggcatgcagcccatgatgaagccttttgactgagatggggagtagagaggggtcttgagcagaaaggtgacgtgatccaacctttgttttaacgtagcgccayggctgccatgatataatcatagaccgaaggggtcaagggtagaaaatcagagacaagttgttgggccagtggggcctggatggtggcagtagaaatggggaaagttctcagattctggacccattttgaaggaggagtgacaggatttgctgatggaacaaatgtggggagcaagaggaagaagagttaggaatgtctcctgggcagtgggaaagaagaaagtgtcattgacagaaatggagaagactgtgggaggggcaggtttgggaggaaataattaggagctctgtttgggacatgttgtattggagatactttttggacatccagtggggagagtgataggtggggtaattgggtctagaagtcagggatgaggtctaggttagagacagagactttagtcatcagcatgttgatggtacttcaagccatgagactggaggagatccctgagactgaagctgagaaaaaaagaggtcaagggctgagccgtgggcactacagcttttgcacactgragagaagagcaagaactggcaaaggagactgagaaggagcagccagagaggtaggaggagacctggtgggcgccrcattcctgcagccaaggaggggagtgtacgaaggaagaggggctgctgctgaaggtcgagtgagatgagggctgagaaacaaccattaggtttagcaaatgcaggtctttgctgtcctcaaaatatagacttggcactctgcccgctagcaggacagattccagaatagaatctggtatcaagacagataccagggagaggaggctcttcaaaatcccaggcacgtctggccccctaggagactcaggaaaaagtctccagacttggaacctaagctggactgccttatctgagaagattggtgtaatcaatggtttggtgtcaggctcccatagagaatggggtgaagctgactatggctcagcacttgcttaggatagtgggccatagggggttcccttcttggatggagggccgaaggcaagcctcttcactgggcatcagtcaccagtccctcttccctctaagatggggtaggttggctgacaaggcttcccactggcacagtgcaaccagaagtcccagatggggacctggaaccatgtggctcatctttgagctacaaggtcagagccaggggcctctttaaaacagaccgggccaggcacggtggctcacatctgtaatcccagcactttgggaggccgaggcgggcagatcacgaggtcaggagatcgagaccatcctggctaacacggtgaaaccccgtctctactaaaaaaaatacaaaaaatgagctgggcatggtggtgggcgcttgtagtcccagctactcgggaggctgaggcaggagaatggcatgaacctgggaggaggagctggcagtgagccgagatcgcaccactgcattccggcctgggcaacagagcgagactccatctcaaaaaaaaattaattaattaaaaaaaaaaaaaaacagaccaacagttgcccatagaccaacagcagtttgtcagatggaaacagttaaaggatggccatgtccttcttgggcagtgcagtgccggttttggtcacccggtgactgaccagctctcctttgcccagaaagatctccaagtgaatggcagtcaggtgtcccccatgaatgtggtttaggacaggactgtccacagtgctgactcaatgcaatggtgttatttattgcttctgctagtggtggtggttggcttggttctgatctccagatgtaacagtgccatccmggcaagtgaaatcatgcattgggaaaaaatcgaggatggacatctcaacacagttgggtgtagtttccacttgcaattactcataagcttcacaggcttagtggaatcttaaactgccctcaaaggaaaactcaattagatcaaaatggatttaattacttaatgaattctaaatgtgtcaaaattgacaggcaagcttatttgggggcctgggagagggaagtactatgaagagtgtcacatgcctttcatgacagagcagaagggagctcacctcccacacagctccacccacatattcccagattgacatacttaacgactcacatccattatctcatttcatcctcaaaatagttctaagaattaagtgcagctggtataatcactcctatttaatagacagtgagttgaggcttattgaggtgatggatttgcccctggcaaggcgaggctctccacgcaggtctcctgacttctccatctggccgttgctcggtgggggaggaagcagcccctctgacaagtgtactcatggatattgccaccagcatttattaataacagatgagccaagtgctcagcagaattgcaatcctaaggactctcaagcatttctctcaagatatttttttcttatctcatgaaatcatgcagtctagtcattatctgatacatgtacccccatgatggttttgaccaccaccctccttccctcttgtccacttgtaggacaggagaattgctctgtgcctgatgtcaccataggtcctggctacccaccattctctgtaaagagtgagtgccaagagctttcagtgaggtacattccactggagtgggaggttttagcagctctttccttcataactgaaacagttgattgattgtgctgttaccaggctctgtttgtttgccccactgggtttgcatccctacaagaagccccctctgtctttttgcaggtgcttgagcaagtacaccatgctagtgagcagttcaacagaatccattttcttagaraaactggtgaagtgaacacagcttaccaggatacaatatccaaattagcacactaccttttattgttattaatatcaccatgaccgctattattaacctctccctcttatacaaacacattcactcatatgcatcctatttcagaaggtttatcttcttaaagactgatataattttcacattttactttaaacagtaaatacaagtgtaggaggccagaaagcaacagstaagttagaccctagtccgtaaattccaatcccttataagaaggaatctcttccaatgagaccttttgtttttcctgccccaaggtgaatgttttgagaacctttgcatcaaatcaattcagatacttgtctttaacttgcaaaacttaaacaaatggacttttttctgctagcactattttaggattcacagaaaatccagtctccttaagcagttgaattgaggtttttgccaaaattgtgagggtttgaaaatcggctttaaatttagagcatgcccatggtaaggttgcgcgggtgtcctatggctctgtagaattaagcattaacgttgcagctggattccatttctttgtgaacatgcaaattaacatcttcagtggcttcctctgcctgcatacttatataccagcctccaaatgtgttatttgttattaaaatcaccgtatttatgtgtgggggtttgcggtgactttcccagatgcagtgatcctaattgtaaccatacaggttattcaaacatagcttggatatttaaaacagaagcgaatctaggccagcatgcagttagttgagtgtaatgtagatgtgaaaagactccttgtggccggtagtgttcggttctgttagctccaagaatatatcttcctatggtgattgaataatgtgcaactgacctgggtccttccaggtacctacttttaaaccaggagttataatagatttataaatctttaggctttactggtatttgctttctgtgaacaggaaatctagggagctaactgcccccctgcaatatgaaaggcacatgttccccaaatgtgactttgggggctctctggggtttaataacaaacacttgcttggtttttgggactggygtttcttcaactcacccatgcatgggaaccgtctgaagagattgtgtaaacgcagattctacttcagtagggctgtcgtggggcctggaactctgcatttctaacacaattccacatagtgctgatggtactggtccagggaacacacttggagtagcaggatctgcagccaaataaatacaacccagtctccaaactagagcggacaggcccccaggaggctgtttccatgggccctgggttttgctagccttcccgtcccacttatacacacttacatttgcagaggagaaatggtgaacacctgacaacatttgtttaatttttatcgttgtggggccttttgggagggaggaagaagagtatctcagccaaccaccaactcccaccccctaaaccatcaagattgctagcgttgtgcttgtagttttccaaaaatgtacatgaacatagctgatccacccactttggtggataaccttgccaataacagaggcagctcagccaggagtgagtgattggtccagaataaacccacccaggtggcagtcagttcttcactgccctgtttagacctggcctgaggattgacatttcctttaactgtctcaaatgagagctatcctgggcttcttccagcaacccgtgcctcctcccagactctgcaatcctgtgggtgctccataaatacttgttgactgacttgactcattcccttggggagggaaaaaaaaaacaggaggaagtagggaaagggggagtgaacttggttttccgtctctygtaagtatcataaggaaatacctagcctaatgtctgttggcagactatgactgtttgcattctacaaagtagcatttgaaattttagtttttgcttttcactagttgcagtttttctctgtgtgctgaatgcagaaagtagttccctttggaatttccatctgggaacccagcaggagaaccagctgctgccactgccgctactgctaaggaaaaagtggtccctcgctggcctgtgctggtgtgggccccgattctcgtgcagttacccttgcatgggtgagcagagtcctgggtatttgctctggcgacaccagtttttgattgtttacaggctgggttttccctagttgttcagctgtgagaatctgaggatatgtttgttctttcctaattgcatcctgtgcctctttcctttttttccctccagaagtggaaggcatttttctgccttgataaagtgtaccaggccaaggggcctgttgtactccaaaacccctcttctcaaggtgaccccagttgccactcacctgcttttctgggggtctgcggaaccttcctcacagcctgcacaactgtctcccttaagaacccttcctggtacaaagcctccataaaactcatttgctcttgagtcttagttctggtggaacatatccctgagtttttgcacactgggcctccatccaggccttttcctgggagagtagaaaacccatgggctctgtggggtggggaaaagccctcagttctgggtctggaagcatcatcagttgcagccatgagcaaggttttgccattctgtgcctcagtttcctcatctgtgaaaaggtgataacattatttctttatcccactatgttgttctgaggattaagtgagtttgcagtgtaaagacatagacaaagacatagggacagagaaaggtaacatttgttattgttgtttttctgtagcatttgtgtctaatgcagtggactgtgtgcccaataaatgagtcctttaaattaatgatagaaagagaagtggggaaatgggttataagcagtgatgtactggtaaatatttaacagtcagctcctggtggggaggattgtgctctgattagtgtttgccaatttccatgatgtaaatactctccctgtggctgatttcaagctaccaacgtgacatcactgaacactgagtttgaaggagatgccagtacaccagtgccagctgctctggtccactactggaaggcatctgcaatagaccaaagccataaggcacccatcacccctggccttctcaccttgccacacacaggaattggtaactgggccttttaaaaaagcactcggtaatatattaaatattaaacatagactagctcaaaagtgagaattttttttttttgagacagagtctcgctctgtcgcccaggctggagtgcagtggtgctatctcggctcactgcaacctccacctcccgggttcaagcgattctcgtgcctcagcctcctgagtagctgggattacaggcgccggccaccacgccyggctgatttttgtatttttagtagagacagggtttcgccatgttggccaggctggtctcgaactcctggcctcaaatgatcacccacctcagcctcccaaagtggtaggattacaggcgtgatccaccatgcccagccgaaaaatgagatttttaataagcctggctagctttgtattacactattttgtgtttcgtgtatgttaaaagctcccaagttgtgccgtcccctgcaaagaaagccctgaatgcacagaattaggcacatcttgaggacagataacctttgagagacctttcagagccactaaagaaaggcaaaggagaaactgtagtctcggagaatgcttagtgttcagactgagcagcaaaaaggtgttaaataagtaattaacagctggattctaaatagcagctaagagttagaggcctgagaacatggcctgaggccaccagaaggtgggagagagataaaccagcctatatttaggagttaaacagatggcaggatcagggccctactttgtatttaggaggtttgtgtggtttgtttacttgggttttgttttttgctgtaactaatttaacaatttaggagtggaaagaaaaattaaccaatttatcttgctgtctgaataatgttttgcaataaccaagaataggtcagtggaccaagtgggtaggtcactgccctgcttaatgacccatatccggatattattatgtctaaatgataatcagcactcatttctatgcacacaaagagaagcttgtgaggaagaaataaaaagcctttgcctttattgtgtacagtatatagtgtaaacagtaggggtctaatacatgtttgtttccataaaggctttttctagcagctgtgatcagcaaggggaaaggacctgcctaaagtcatcacactgctaattggggtcgagttagaacccaagtctctgggccccgcttgaggctgtttacctcttcaggacagaagggaccagctggatataagagctgaaggagagagaccagaccagagcatctattcaggtcactcttgtaaatcgccgctttttgatagttccctgtgactggcatctgattgagaaaatgtgacaagaagctacctactgcttgccccttaaactagctgacagtttcccattcaaattccgattgcaattcagagacactctaggctaggtgcagtggctcacgcctgtaatcccagtattttgggaggcggaagcaggcagatcatttgagtctcaggagtctgagaccagcctgggyaacacagcaaaaccccatcactacaaacgatacaaaaaattagccaggcgtggtggcacgtacctgtaatcctagccacttgggaggctgaggtgggaggatcacttgaacccaggaggtcgagacttcagtgagctgtgattgcgccactgcactccagcctgggtaacagagtaagatcctctctcaaaacacacacactcacactccagatgcttctctgctgctgtgtgtgcattgggtggtacagtgacaagagggctgggggaggcaggtatcacagaaaggactctgagggaagtgagtggtgcacccagggaaactgaggctatgggtggtcctcccacatcctccccacaggctagctgatgcctctggcctctcagttgttttcatctaaggaaacttattttgaagccatattcatggcagctgtagtcctgagcattcgcaggacttgtagataattcacctacgtggtctcgggcagttataccctgtgataatttatagccacccgttcaggcagacaattccacatgagcatttgctatcactctactaccctgacccaagcctcggtgtgacccaagcctcggtgtgacccctctgcatggcctctccaaaagagatcccttccctgggagtttggggagcctctgactcccaggagagtagcaaagccaagaagggggaaataaaagaccacaaaagagcggtgtgttttgaaggaatgaatgttttctacagcccatttccaaagaacagtctagaaatgcttgcacacaaacagtgtcatcagagtagagtaagtgtgtggtttccaagcagcccctaccacaagctccccgaggcctgtgcctgccagggagcccaacctcagcacctagtatccagctccccagggaaactgttctgagcattagtcctcccttctctgagcccagaacggcaggctgcaacttctagggttgaatggatggcagctcaaggaaacagaatggctttctggttttaaaacctcagaaaacctaaaaacttgatctctattgctttactttaggaaattttaggccctttctcagacggcctaaaattagaccttcgccactcccaaccaaagcatgtcatgacatggaagaaggtggtccctggcctaatgacccatttctgtaaaaatgaggtaggatgtgtaaacagtgcaataagactatggaacaacagaccgtgagccagtgtcaccttaaatgtaaacgttagagatctaggcttctgaagaaatgttggaaagcctattaaaccacataggtttgggatttttcattgtgtagcagacatatggcttagtgtttgatttaaaaaataggaagttggtggccattttcatgaatagtttgacagccagtcagaagygtgattgtcgttttacctaaacgcaactgctgttgttcgtaaggtcagaaacctgctcacaggggcgggggcggggaggtctggtctgttggctgtttgacccatttggttacgacctccatgctttgtcctgagtaggctggttcatgctggcaagtcaatgcagaaatattgatcaggttcctactaattgcaaggattgggttgaacgttgcagtaggtaagtaaaagatgagtggggccatgaccttatataggaactgtctgtttcctggtccaccagagcaacaacacaagtagtggaactgatctcaaggcagggaaaggttagtgtcacaacagaagaacagtgagctttggagcctcaaagaaagaggggccatctccctgtcctkaaaagaaatcttcctcctttttactaccatcgtaagagtttacctactccaggccctgtgcatgctaagcgttcactcagttaaaccaccacacaatcttaggaactggattatactaataccttttcaacatgtgggagctgaggctcagaaagattaactttagatcaaggtaacaactggtaaggggtacagtcaggattcagtcctagctcagccagaccccactgtcatgtgtgaccttgcagtggggcagggagtggcagcaggagactgagtgggagcccttgggtctttgggatggtttcacctttggaagatccaggcccctcttgccatgagagccccatgaagggctcatggcctggagcgggtgggagggcaggaagcccagctgggcacggggcagctggaggagtgccttatttgaggctgctctcgcatcatctcattagggataatcatttgtagacttgctgccactgcaaaccatcrgccccgctcaaattttccctgcagcagtgatgatgaagtgattccttagcagaactgctgggtaacacaattaattcagacttggggtggatgttagtgtgaattagggggtcttctgaattataaaacctttcaaaaggagcacaggtttattgcttctgaacttcaccaggaattgaagccagactggcaagggggctccctggacgaartcctctgtgtgtcccttgtaggtcagtggtgctttttcctgcattgggggggcttgaaggttgtttcatagccatttagatattccccttggagtcttgcttgcaattaatctgtactgtctgtaaaaagggtttgcctagcaaaggtaaactccagcaccccgatccacattaatgagttttgcctgtgtaaaccacgttaattgtggttgttgctttttaattgtccttaagtttcttgtatgttaactgctccaggctagaactctggtttctgtttccgttgggggctctattctcactcctacccaaatagcctcgccaatctgcactgagatctgctcccctgcccccaccctgtctggcattagtactaagaagagaatgaagctcagaaaaacagcctcactggcctagatgaggaggcacaggtatgtggggaaaacacgagtggaagccacaaggtcttctgagggtctggaactaccaggtcaagagaagaaagacttcagattgtcactgttggatgtcttaatatgaggaaggactcaaacagagctgtccgcagctgcaactggctgtcttgagaggtggtgacctttctcgagaagggtggaaactgtagccagacaactacttggtgaagcagcatacagagagatcgcccttctgatgatgcgcccagtctgaggcctcactgagatggcctcaagagtgtgtcttgagctggttagaaacttaccatcctgggccccacgacacacctcttgacccagactgcatcttaacaggatcctcagctaatgcatgcgattgttcacttccagggcctctggttcaggaccagggtgcatgagcatcacctggaggagatttttaatacaaatgcaggggctgagctgctggcctaggacatagaaggaccattcccatacctcacagtccagctgtctccccattccctcccccctacatgctgttgtgtttccaagttcatgcctgtgtgcacacctgcacacaagggaataggaaaatggctttgatgtatggaatcatgtctacaagctgcttcagtcaggggcccttcttgctgagagaccaggcagctttcccagggagccccagggcaggggcctgaggcacctgcttcctgttctgtcccctgagagctccgctttgccgggagaaaggagaagcctaaacagggtgggctgggtctgcgaggcctgcctaaggctgccctctgccttcccagcccttcagtccctgatcctttcgggcccctcctaggccagaatgtcccagattagatggggtggggaggatgtcttctggttgctgtaggcctgcattaggggagtatcctctctggtcccacgtggggcaggtgcccagagccaggaatgagccgcctgtggtgattcctgtgtgtctggagtccaggagtcccttgcactgttggccagtggtcactgtgcrgtgattgactgggctcagtgtctgtagcttttgtctgagccccttgcacccctccccggggatgattgtctgagttggtggatgttaatctgcagcccctgagaagctgcctggcaaatgggaggttaatgtgcaaacagcggggagcattgtccatgtgtgaggctggacagcaagtgggagggaaatagttaaaaatcctattcatggctcaggaggggaggaggggtgggcgcaggagcaggcccggccttgtgctaatcttgctggaatgtaactagttcgggcagtttctggcttcgatgtgctttggggccggttggcgtcccccccgccccaacccagtwcatcgatggtgcgtccgcgcgccgaaggctgctctttgtgttctctgcagccacagcttagaagcgtccgagtcagaccgctttcagttgtaaggatggggagggaggaagctcagcgaggcagttgtgttatccaaatccacaggctctttctctgttggaggatttgggtgggggaagggaatgggcagaagagaatgttcaaggagaaagaccctaaacctgttgggtcaggctgctcagctgcctagaggcctgggaatgcctagggggaagcccctgcttccggacacacaatcaattacatataacagtggggccttgtgtgtgtaggcgggacactgggaggggtcggctcacagctcatgttttaatgctttacaaggagagtgtgttcatgcattgcttctgcaacttataatcaatttaaaacattctacatcttgatctaggctggtggttacattgatatttacatattgggccaggtttggtggctcatgcctgtaatttgggaggccgaggtgggtggatcacctgaggtgtcaggagttcgagaccagcctggccaacatggcgaaaccatctctaataaaaatacaaaaattagccgggtgtggtggcgggcatctgtaatcccagccactcgggaagctgaggcaggagaatcacttgaacctgggaagcagagtttgcactgagctgagatcgcaccattgcactccagcctgggtgacagagtgagactctgtcttaaaaaaaaaaaattacatattaaaaattcactagagcctgggcaacgtagtgagacccccatctctacaaaagttttaagaattagctggctgtagtggcacatgcctgtggtctcagctactcgagaggctgaatcaggaagattgcttgagcccaggagttcgaggctacagtgagctctgattgagccattgcaccccagcctgggcaacagaacaaaatcctgtcttaaagattcattgagccgcacacgagatttgtgtacttgcttatgtatacatattacaccttagttttaaatattttaaattaatttaaaaaaagaaaaatccctccttcctgacctaccaaggccttggctgtccagcacagctgcagggaggaagaacaggttccccggcttagctccagggcatcctcggactgcccactggagtgggcgctgagctcccacaccgctgtttggaaacagaatgaagttgcacagcagccagattctggggcttccccacccaagtttgccactttgctcatgggatttgaagaaagcatcaaaggcagcagctttagaaaatagctccaagggccccccttggagtgaggtcaccttctcagctcacagagggctgtggtgccagctgctggccacacatgcccacggggctgctctggccctgcctgaccctgactggcttccccttgcatcccctgrggagcccacgcccactgcacagcatacccaccaggtgctgctgccctcctgaactctgtgggacacactgctgcccacgtggggactgccccggaatcaggaccctggatttctcctctgctacctgccccctcccgccaygtagtgagggttccacattatgaatgtcatggttccttccggctcttgattttccatgattcgggatcaggaaatgattttcctctgagtatttttaggccatgagactcagtataacagtcaaatcctggctccacaacccctagctgtgtggccttggataaattaaaatctctctaatcttagtttcctcatatgtgaaatgggaataacaacaatactaaactcagtagggctgatgaggattaagtggaaaccagactaatgttgtattcattatctgggataaaggttagcctgtatcatcataatcaaaaccacacgacacagtgtgcctcacagtccagtgagccaaatccttgcctgtgcacactgtacccttagacctgagcagggggggcctgcattggaccctactttggagggccctgctctgaccaccctgaccacttccttcctgaccaggccaggaatccacggagctgaggatccaaagaatgggatcctgaggcttgagagcctgcctgactcttccctggacgtgcaccaagccactggtgtgcacacctataggttgagatagggggctcgcgtttgcctggggctgagctttgatgggggtgctgagatgtctgggatgtttccatgtgtggtcccaagacctcataggacaagatggaactgggaatggtgggggtgccagatcaggctctcttaccaccaccgcattctggtacagaacccaggagtctgggaattctaaattcgagcctggccttttcgtagcattcatatttgtcaagggaggaggagagaatgtatttaacagtttgtcagcttgagttataacttttacatgtgtaagcgtatgggcttgcatctatgttcttgtcccaaaccctgcagatattggggttgggggggctgtctgcatgcccttccttccccagtgggtraccatcactgacccctgagacttaagacaaattgtagccatgcccgcctccgaaggcgtctttaggaaaacagtgtcgtaggtcctttcagttcaaaacccttgcttatttattaacatgaatacgttggttctagaatagagccttgccctgtggaaattgccatctgtactcttcgaggtctacctcagatcccacctcttggcctaactctgtaatacccccacactcggtgacacccccactctatgacatttaccatttgggacagaagccctgtcctccctacctatagctgaggccacctcccaagacacattgtcattctgtcccccacagcaccacacacagtggctgcgcatggtggatgcacagtgagtatttgtggaatgagcggccgagccgctgcagactgatgagtgttctggggcctgtgttkgttttctaaaactgctctgtcagtaagcgccccgccaatccccgtgtaaacatattcagatcctaaagaagatcaggcagccaccctttaaaaagcccgataaacccaaccttcatttgtattatctttgggcagggtttgcttgggaattcgtatctgtaggaaatcttagtgctcgctgctgggaggcaaattgttcgcattcatttgttctttcagtggtttggccctataaagcagagggctggcctgagggaaaattgtgaaagaatctgagtttgtctttggggtagaaattaaacagcttctctaggccttgccctcaaacttcagccctgtttactattgaagattgtgtgtctcaaggggtaaagagagccgtgggataatggagactgaaaaaatgttgcgatttagccattttgttttcttttttccttggagaataatcttttgggaaaaacttggatagagaccctttgagccatacaattttttaaagttgaattcaagcctctagtcatggcttgattcatttttttctgaacaatgaacaaagaaatgctggtagagagccttgaaatgcggggatgttgaatgaggaaaggaaaaaggagggccgtgagtgttcctgagcactggctggaccctgcagaagcttccgatcattctggaggtctccagaacttggtggctgggacaccagatactgtgcatatgtgaggggagggcctctgagaactcccaagaggcccccagcagcctcccccacaactgacctttcacagttggcactaaactgcaggcttatctcctttctccatttccaggactgcaaattgcagcacctggaactaagacatccctggagggcaggccttccaaactcgcccccattgattaaggcaaacactgcttcatccacaatgttacagtaacatcagcaagaagaaatgatgatcatagctgatagctgtcaagtgcttacagcgaaccagatgcttctgggtgcccttctctatttaatcttggtatggcagtgtacgttggcaggggactggaatttaagcaaaagaagaaatactgatgtttccaattcatcatttaaagagaccttgtacgtggccggacgcagtggctcatgtctgtaatcccaacattttgggaggttgaggcgggcagattgcttgagcccaggagttcgagaccagcctgggcaacatagtgagacctcgtctctacaatacaggaaaaaaaaaattagcagggcatggtggtgcgtgcatgtagtcccagctacccggtggggactgaggtaggaggattacttgagccctgggaggtcaaggctgcagtgagccaagatcgtgccactgcactccaaccccggtgacagagtgagaccctatctcaaaaaaaaaaaacagacaaatagaccttgtacgtgaggcctggccatttgttaacccgtgtgaaagatgtttcggtggccatttaatgaacatatgttgaataatgtgctgtactgtrtaccacagatacaaaggggaaaaagatacagaaggaaaaaagaaaactcagtatcacatactcagccccttctgatagaacaggtgtgtccaagcagcaacatcctaaaatagttgtcctccactctgggatgtaaaagaagttcttctgggatttggttttattacaatgactgagaatttgctctccctcagttatcatatctactgtgacaggccttgcacacgtcctgtgagatcctacctgccaagaacctgtctgccatttctcattagtatctttgtggtttgcagtcacctgtgtagaatttgcacatatactcaagtgttatttgttttcaattacttcctcaattattgctggkgtgtgtgtgtgtgtgtgtgtgtgtgtgtrtgtgtgtgtgtgtgtgtggtatttcatagccaaagctataaaatgtatttccaataatattagtagaattttttcagcccctaaaacccaccataaaagttaactataataacaaggcccgtaggcctgtacacaagggcatggtttctatcgaagtgtattacacaggccagacctctggattctccacctccagtggctgctgtttaaagcaggcattaaaaggaagatcattttcatgtttgtgatttgaagcatgtgtgtgctcacgaaggatacctccctggacaatgcctggaagaggactttgtgaagtggagactgtacatgattccaccagcaagcatgtgtcttgacaaaggttgttaaggacaagaagttgtgccttagctgtaaccaaaacccagcctaagcaatcaggtgagttgaagtagatgttgtcaaagctaaaaagaagccaagcgtggtggctcacacctgtaatcccagcactttgggaggctgaggcagtgggattcttgaagccaggagtttgagaccagcctgggcaacatagcaagatcccatctgttaaaaaaaaaaattagctgggtgtggtgatgtgtgcctatagtcccagctactcaagaggttgaggtgggaggatcgcatgagcccaggaggccacagtgagccatgttcgtgccactgcactccagcctgggcaacagagcaagacagcatctctttttttkttgtaagacaaacaatcccatagcatttattgccatcttgtaataacataagggtaatcaaaacaatatgaataaatgttcatattggacaaaggacagctaaaaacaaactgtatccttctcaacaatttctcacttcattgatcatttctagctggagacactttgtagcagaggaatacctccttttagcatgatccgacccagttgttttcttgactttgttttagaatgaatctcttccgcatcatctaataacaaggttcgtrtactcattaaaaccaawgatacagccttctgtccgcatattcacttgctcatagagccacacctgaatctgcgatctattttgtaagtatctgaagatgaggttgatgggcgcatcttcaccttctgcactttctggccctggccatggtatgccatggtggaatttcacaaagagcacacccgcacgctgcctctgagagcaacttccagaatcaagacaccgtctcttaaaagaaaaaaaaaaaaactaaaaagaataagatgtaggcttagggcttcctcccctgaggaattcttttggatccctctggcctctgacaagccaagcagaatatggagaaaggagtctgtagaggctgctgtcaagtccagggtaaaaacacgagcatttccaagcatttcatcaaggacttgttaaagatccaggtttgaagtctccaaggaagactttttttaaagatgttgcccaaaggaaaagagatcaaaccagcagaatgaattccccatcatatacatgggggatacccaggaactcacagggtctctccggaactctgaaagcaattagagaacaagcatatgggttgtggtccctagagttggagcctgatgccatcctccaataagttctccagcagattccctttggaaggctactcatggacccgggaagaaatgacacccaagagcggggaactagaggctaacacagggtacttgctactgcagtggcttcagataccctacccctaccccaaacttgggccaggccagtggctatggaactccagaaagaagggcctcagagagagagagggagaaggagagagwgtcatctacatcatgacagttgcaccttttccatgtgcaactggggaaagctgcggtccctcagcagccctttgccttcacttgggccaatgaccaaaggtacccagggtggtagtccagtcactggcaaaagcatggcagccttttggcaaaagacttgggggcataaatagtgaaacactcagagaatggaatgattggctggctagaaaatggatggagggtgttgttgggaataggcagttggagatgggaagggtaggccagggctttaatgcccactgagcaggcatcgggaaccgctggagcttttgttgggggtagggtggagggggggaagtaatgcaatcacaggaagggtgggctggcctggggaggggctgccggcaggagggcagctcagagtctttacagaggtccagggcagtgagcagcagagatgaaggggaacaattggagagacagtccaagttagaatgacaagacttggtcccctgtcagttgtagagagtgagggaaagagaagaggccagaatgatccccaaggtttgtacaatactcagggtgaccgcatgtcctggtttacatcatccatcataattgttaaaggtgttccctttcactttcaaaggagccttggttgataggatgtaggaaacaggatcagggctggattttgatgagtctgtgtgggattgagctgcctgtagcacggtgtcaaggaagcacttggagatgaggaggaaggctggagccagctgcagagatgagcgtgatcaccgcgtgggtgccaacctgcagggggaggaggagactacccagagaacaccagctttcgaggcataggccaaggttctgaggagcggctggaggagtaagtggaaaaccagccgaaagggtgccccagaagctgaggggcctcttaggaaaaagacctggaagatgacattgggtttggtagttaggaggtcagcagtggccttagcgaaaacagggccagtgacgtggaaggcaggtggcagtgggccgaatgattggagggagtggaggcattgacagtgggggtttgacggttttgtaaagagcttgtaagggagagacggcctcagcacagggcccatccaactgtgggtctccagccaattgcactgatttttcctgcccattcttccttctttgaagggaaaaatggaaattgaagaggaagaaatcaatgacccatttgaaccatgacttggagtttaattcagcgygtatctgagtgactacgtgagtactcctgacctccaggaatggatagaatggaayatggaaaatcaaggtggatcaaatgagaatttggccagtggacttacaaaaaagtattcaaatgggccacacctacccagtctggtgctgtgcatgcatcacaaatcctcggacatgagatggagttgtcacctggtcagtgattgggtttcagagtctggataggaactgggggctcaggaaggaagtggcaaagatgtggaattttcaggtcatcatcaggcctgaacaagacctgatcaccacccagtctcggtcctcaaacagctgcttgtgaaagttaagttctgtaaccaacttcatgcacaggctatgcctagaattggygttctactaggtcagtcaggaartgacaggggatttgagaaatgtttttagagcctttgtgctctgaaatgtaccctcctccctaacccaactagcctagcctggatgcttgaaattccataaagaccaagccctggatttgattggagagttgggggaatgtgttgcagcccctytcccaacccagaaagaaggcatgtaatgtgctaacgccgttaggagtgtttatggcatatgggttatgatattgaatttgtccaataaaccatcaggaaacttgtgtgggcatttcctgtctcactttgtgatggctaatttatgagggctgctgtcaggttatagattctccatttttaccagaaacttccaccttgagccttataatggatccacyggaatgaagatatgtattctaggcaaggatttaggtaggggagaaccatgaacctggcacacagtagcactaaacagtgtttaatgggtaagtgggtggatgcttgctctgggctgtgaaagaagagtgtaaaagagacaggaccatagatccaggaaggtcatctttgaaagagaagcccaaacaatgggtagaaactacagaaagttatggaggggtaggtgtgagcatttggggaccactctgatckcacattaatattacctgggagcttaaaaaaaaaaaaagtagatgcttaagccccaccctggaagagttaaatcataatggggaacgcagacaggaatcagtgtttttaaagctcctcccagcagccctggtgccagtgagatctgagaactagcagactgggttgtctcctctggttgaattggcgcccagaccttcccccagaggggaatccctctggaagggaaagagtggaggagagtgtccagggcggggctgtagagtggacccttcctcagccaaggaaggactcgtgcagctggcagtcacagcacttactggccccagcgtatgttgcccaggaaccattgaaggcttccaaacggctgaggtcacatttttccaggccctaatgggaacggttgggaaggttgtcaggggcaagaccccattcaaaataaaacagcactcagaagttcagaaatgagaggctgaagatttgaatatagactttactgggttttttttttttgagtgtttttatatatttaatttttttaattaaaaagtgattcccattgcatatatttgcatttaccttttaaaatcaatgtatgtttagccaaaagaatnaaataaaaacacccataatcttgtctcccagagagattaagttcaactcacctcttagtgtatattcttccagatttctcaacacatacataaagatacctgttttacaaaattacaagtaaaagtaggattcaatacatgttttttctttttttaagcactccccattacacaggtggaaatacatgtttcgtatcttgctttttcacttaacagtgtaaacacctttctgtttctgtaaataaccacctactacataaattcagatatcataattgcagcataaggcatttaatatctttcagctattataaacagctcttcagtgaacatccttgcagctatattttgcttgcatccttaattatttccttaggatgcattcctagagacagtaagccttcagaagacttgatacatacttccaaattgcacaagacaggatttactaatttactttcccaccaccagggtattaaaaagtgcctgtggtaattaaagggggaaaaggccactgccaacatgagagactaaaagtagttaactcattactgagttcataacttctttatctcaaattctgcaaacaaatgggagtggaacccagagattttccttgacggcttgatgcccagcccaggaggatctttgttgtctggcccaccaggtcaccggctcctggggttttcagtgcagcaggtatccttgtccagggcctttgtttcccgctggtcattggtccagcatgcttccggtggggacttgggaaccaccagggggcagtgtggagctgttgagcatgctctgcatgccttacggcttatccatattgaaactttcaataatacaagtattcttttgttgtgttttatgacttctcagattggtatttataatattgatttgcttacattagtatttcatccccttccaattatttttatgtttatgtgttgtaaaaaaaataacctgatccatcatagctgttctgtagctggcggccaggacacctgggttgttctgatcccagctctgccagtgtcctccgtgaccttggtgggacagctcaccccatgggcctgactgcccttatctgaggagtgccaggatgggctgcaggagtggtatgttttcttctcttccagcactagcataatgaaaggattgagagttggccttggccaggtgtggtggctcatgcctgtaatcccaccactttgggaggccgaggcgggcggatcacttgaggtcaggagttcaagaccagcctggctaacgtggtgaaaccctgtctctacaaaaatacaaaaattagctgggtgtgcacctgtattccagctacttgggaggctgaggtggaagaatcacttgaacccgggaggcggaggttgcagtgaaccaagattgtgccactgcactccagcctgggcaacagagcgaggctctgtctcaaaaaaaaaaaaaaaaaaaaaaagagttggcctttggggctgggcatggtggctcacacctgtaatctcagcactttgggaggccgaggcaggtggatcacttgaggtcaggagttcaagaccaacctggccaacatggtgaacccctgtctttactaaaaatacaaaaattagctggtgtggtggcgcacacctgtaatcctagttactcaggaggctgaggcaggaaaatcacttgagcccaggaggcggaggttgcagtgagccaagatcgcaccattgcactccaacctgggcgacagaggaaagactctgtctcaaaaaaaaaaaaaaaaaagagttggcttttgggtttgggatagactggggcaagttagttaacctctttgtaccttaatccctccatctgttaaatgaggataataatagcatcaacttataaggctgtgggggttaaacgaaataacacatggagtatctggcacaaggtaacgcatcactaaatgttttctttaaagaaatctgtttatccaagatttatgcagacagtttcctgtccctggctttggcacatacttatttgcttatctgaaatgatattaatatcaaacagagtatgaatttcagaagtgctgtattccacagtggggctgaacagaagaatcccagcatcaaggcccccagctacaaaagattagaatgtttttgtttgttttttaataatgtattaactgtaggggaaaatataaaaatagaagcagatatgatattggtaaatgttttttatttgatcactttaggtaaatggagtcttactcacctgatagggtccccagtggcagcggactttcccattccctctatccatcattctcccaaaaggtgatggtttctctgttctcaccctaggtcagctaaattagggtctgtggcaacaaccccaggagtgtgaccgctaattgcctttgcagacaacatttccactagagctgcctgggaggcagcacctccagagagaaggacttgcacctctaatttggttaatcctagaacaccctgcaatagtcatcaagcacctctcacaaatgatatgctgtgcttaaggccgtggggacccaaagggcgaataagattggatgcctttttttttttttttttttgagacggagtctcgctcacgtcacccaggctggagtgcagtggcacgatttcggttcactgcaacctctgcctcgtgagtagctgggattacaggcgcccgccaccatgcccggctagtttttgtacttttcatagagacggggtttcaccatgttggccaggctggtgtcgaactcctgacctcaggtgacccaccctcctcggtttcccaaagtgctgggattacaggcgtcagccaccgtgcccagcctggatgcctttctgaagcggcaggttaaaaaaaaaaaaaaaagattggatgcctatccccaaagagcttaggggaagctaagcgaggaaatgagcctggctgtgagctggaaagtcagcgggcagcagggtgtgtgaccgacctggaggaacgagtgtggggcaaggtgaatgttagggagccattgcaagacagtggtagttgagattgaaaaaacacaggacttgatgggctagatgacaaagtgaggaagaaggtggaggaaaagatgtctgaggttttgaccctgcaggtacatgagaagagagagatggtagatctcggtgagaagcaatttgggaagacaatagtggtgtgtcctgggatgctctgacctttgagtctgtgtgcagaacctctttctccaattcctaggggtgccctcatccacaactggcagtagcccctggatggccacaaacatgcartcctacaaccatattccctggatgtcacttcctcacataatctttgccacataccacctatactatttacataattatttttctttgaattgattcacttttttccactttttaaaaatggagcttcactgtaagcaacagtatccaagatatcaaactttgcctgtaacaygcatgtgtaattgtgtatacgtatatacatgtgtatacacatacataaaaaatacacatacatatgtatttataattttgtttgtttggctatatatacatttttgttttgttgtgttttgtagagacagggtttcaccatgttgcccaggctactgttgaactcctgggctcaggtgagcctcccaaagtgctgggcttacaggcgtgagccaccacacccagccaaaaatactggcttaaatacttaaatattttaaatacttaaatattttaaggccgattaatgtaaatattttaggtactaaaaaataggaggtgttgtttaatagtattgagatgggaacttctcagcccttccactgtccgtcataacttcctgcaccctcccttcaatatggacataaaatcgtgttgttccctgagatatgtaagccacatgtgcacccacatttgcatacacactagtgtagggtgcaggaccccttcttcaggctcctttatcaggagcaatggccctgtatagaggtggctggtgtgacccttattctcctgtgttcttgttcacctgtggggtcggagagctctcctggaactgcccgtctatggagaggcctcctcagacatttcccatctcccggtgcccaggagttgttgactttggccagctgctgggcctgcaggagccgcggggaagggttctaagagacccttgaagctctgtggctggaaggcagctccaggctgcctggctgttcttttgtgttgagtatttcactggccccagataagcgcttcctgttcctcactgattatacacagatcctgcttcctttctcctcaatacctgggatgctttccagcttctcctcccataggggaaagtccgtaaactttagaattctcaggcctgcttttggtcaatggactttctgcaaattatgactgtttttgccatctagtcacattcttggtgaagccttcacctctgtctaggagctgagttccgctttgtgccagccaggagagatgcttctatgacctggtttctgcccctccttctcaccagacagaacatctgtatctacctcctggcgtaaatcagagagaataaatagattgcaccttacaggtcagttttaatcaactgttagtagctgcctcagtgttgaggattctgaggtcttacccacctttagcaagaaagagtgccatggtctactagcagtgtctgccacaagcacggagggatgggactgctcctgtgccccatatttgctatcccaagattccgagatcagttggaagtttctttattttttatttagagacagagtctcactctgtcacccaggctggagtgcagtggcgcaatcacagctcactgcagcctcrarctcgagggctgagtcgatcctcccagctcagcctctcgggtagctgggactacaagcgtgcgccaccacacctggctaattttttttgtatttttgtagagacggggtctcatctaactttgtttcccaggctggtcttgaactcctgggctcaagtgatccacctgcctcagcctcccaaaatgctgcgattacaagtgtgagtcccattcccaaccacaagtttctagaaggcagaaatcatgtccttgtacccttagagttacaacataaacgcccaaagtcctatattctagtgccagtgtcgaggaaatccaacagcctccagcaggctcaatttcctttgtttttttgattcagagtctccctctgtcacccaggctggagttcaatggtgcgatctcagctcactgcaacttctgcctcccagattcaagcagttctcctgcctcagcctcccaagtagctaggattacaggcacccgccaccacacccggctaatttttgtrtttttagtagagacgtggttttgccatattggccatgctggtcttgagctcctgacctcgtgatcctcctgcctcggcctccgaaagtgctgggattacaggcataagctaccgcgcccggcccagtttcccattttttaaatgaacataataatatctgctttacctatatccaggagtcagtaatatcaaatcagataattcatatggaatgctttaaaaagtaaaacaactgtagaagtatatcctgcctgcaggacccagcacagatgccacctcctctatgaagttttcagttgtaacacgataattcttgcccattgccatccctgtcttatctgaacctgtcatttataggcttatagtctagttrtttatgtactttaaaaatctctcctgtggtatatcatgcatataaacagccaccttttatatgagatactcactaaactttgatggagggctctgtacagagctgtcactgcatcttgatcatctggtaggcagtcctgtaagaatgagtagcctcctgctagctttaaacagcacagttttatrttttagaaagatatttctagaggtaagtgaagggtagactggaagagatgaactgagaacaggagcactgatgactcaatggagagaggatttgggatcccttcatttctgtcaactaccctattcttggacaacagacattttgtcaatgtgaggcaaagcaacctgccgatgtggtttgcagcccactaccacccctttcaaaccgggttgccccccacccccgctgccttcctcctgggtgagaacctgcaggagctcaagcaaacccagaaggctgctgcaggggctcctcctcggaatagggttcaaaaaatgtccagaagccatataattgggtggcccagagcaggttagggaggtaactaaagtcattaaagtggattttgaggtttctggttaggtacactgaaggcacaggattgaaaataattcatctggggttacttttaatagctttgcttactgttgctatgatataagacatactgattgtaaaaatttcaagtgaagaagaaaaatatgaaaaaggaactaataaaattgcctgaaatgttaaaaatccagcgataacatttgggtgactatgcttccagattatttaattggctttwctcactgaacagtttgtccagcacactttattcaggtcaataaatgtggatgaccgggcrtggtagctcaaagctataatcccaagcactttgggaggctaaggcgaaaggatcacttaaggccaagagtttcagaccagcctgggcaacatagtgagaccctgtctctaccaaaaaaaaaaaaaattagccgggtggtgtggtgcttgcctgtagtcccagctatgcaggaggctgatgtgggaggattgcttgattccatgaagtcaaggctgcagtgagctacagtcgtgccactgcactccagcctggctgacagggcaagaccctatcaatcaatccattaaccagtatatcaatcaatcaatcaataaaaaaatcacccaaaaggcatgcagaacctgcagccacagggcaggagcggggagaggcttccccagagctgcccatgtcatgtggcagttcaaaagccagttgcctttattttcttcctaaagtcatccatggccttgcaaagacaggagagtgtctacagagacagtggagggagtggaacagaagccagccttctgggggctgagaagtacctgggaggcggggagggcatgtaagcagcctgtgtacatgcggggaagggaaagggggagaaccagaaggggcagctgcccaccagcagcttcctgggctctcctcccrcctcctcctcactcacaacagcgcacagactcagcctcagctccttctctctggcctcttccacctgagtgaagatcaagtgcaggagaggttgcacaggctgtgccagctgcaaggaacccacagacccctcctgtgtttcacctgcagtgactccatattcgtcctcccccatccccgccatccagcagattatgtgccccacttcctctgtgccacacacatcttttttccctccttcaaatcatcacccatacagaggacaattcgcagcctcactcattataagagtaatggaaactccagtgagggacttttttacctgtcagtttggcaaagtttaaacagtttgataaccttgtatgggcaagggtgtggggaaataagccctctcccaggttgctgttagcagtgtcaactgggagaaatttaataacactcctcagaacttaagtgtgcatatctttgacctagtgattcccctcacagctggaaatgtgtcctcccactatagacatacatgggcgacacggtgagtgttcaagggtgttcactgcagcagaagcctgggaaacacctccatgtctgtgagcatgggccccttgagtcggttatggcacctcctgtaacccaggaggaggcagctctgtggggatggctatgggaccagccctactatgccrgcgaatggagtgggggcagagtggcgtgggtgggtatgggcaggccagagaacaggctgcaggctgtgaaggagaaaggcatttgctctttcagcccagtctgagctcctgrtcagaggccagcaggtggactctgcatcctgtgggggccagggcagatgttctcacctgagggcctgaggggagggaagcgtgtcagtagattcccaggcacacagcgacaggggagagacagagggaggggcccagcagggttcacctcagggaaaggaggactgggcctccaaagccagtttccacgaagacacttcctgcagcacattggtggctgggcagtgagcatagacactgcacagacactgcccaggcccagcaaacccaaggtcacagccgatgggagaggcagcttgcgactcagcaggmccagcrctccaggctgcagaaatgyggactcgaaagcaagttgaactttgacattgtttgaaagcctaggrytctgtcccggsgtccccctggtcagggccaccacagaatggctgtgcctagtgctctgggagcagagttttccctcctccagagcatgcagctgtcgggggacatacctagccaagtgtccggctctccatcaagacctcaagcaggcccacgtcagctgagaaccatgtgtgtctcagctttccagccatcccagcaagtcaggacacatctgagaccacccctccaacccagctcttgcccacggtcattggtgtgcctgagccagctggcacccagccaattggtagcatctcttccgcgctgagccttcagtgactcatcgtggtaccttgaaatcagcgggagtgtttacaccatgaataccagcaaatgctttggtttttcactttgttttttgcttagagagccagttgttaggcatttaccaacacaccaccgaaccagacctgtctccccaggtaaagcgcaggtcacaggctcctagaataccaataacttacacatttagtgactgaacacagatttcttacaagctccccrcatgccccacactctgcctggtcctctccagtgtgagaggacactcacacttgagtgtgacagccacacgtgagataatcactctgccaggcagtaggtgttcttattcctattttacatgtggaaaccagaggttctgaaaggtgatgtacacaggcacacagcttgtaagtggggttcagctaggacccctgattccgtatttgttgaacacctcaacacggtcggcactcccagtgccctctgtgtttagacaaacagctgmatttgatttttccttccaaaggagaccatctagtccaggcccctgcttcaggctgatgaagtaaaatattcccattttaaagatgagacgatggagtccagaaaggttagaaagagcctggaaccctgatctcttgcctcctgtgctctaaaacraaagcttggcttctgcgggggagccagtttttaaaaacaaaccttaggtcaaatctaggaggcaaaattgccaggttctttggaatgcgaggggaagagaatagttttgagatcatccacaaaagaaagaatcatttggggaaagcagaggaaagaggtgtttatggtgaaactgacacctaattgacacactcttacttttgagtttactattcagttatgaaatgcttttggagcccctctgctaccagtgcatgggctttaaagccatttgttgactaaatgctgtgacaggtgctagagagagcaaagtcacttcattggtttaagaccagtgtaggccaggtgcggtggctcacccctgtaatgccagcagaattgggaggtgaaggcgggcagatcacttgagctcaggagttcgagaccagccagggcaacatggtgaaatcctgtctctaccaaaactacaataaattagccaggcatggtggcacatgcctgtggtcccagctacttgagaggctgagatgggaggattgcctgagcccaggaggtggaggttgcagtgatytatgattgcgccactgcactccagcctggacgacagagtgagactccatctcaaaaaaaaaaaaaaaaaawaatacctcaagaaagaatctaacctaccctcaggtaaaacaaaaaatgtgtttgggatttagtgccatccacaaagttaakcaaaggcataaatgactcattcttaagaaagaagggataagagtgtaaaacttcttttatacttttgcccctggaactctttgtctaatccatcttgtttgggaacaagttctttacactttcgttttctcttaccgactgctgaaaactaaaaatgttttcccaattgggaaagcttttctgtctccctattcctgagttcattgctcagtgtcagtgtattttcaaacttagatccatttgtgaactttagtacagaagatagaaacaggtctccaagaactggccaagttgggcatcccagcctccatgctacatttacgtattctcggcagactaagccagttactgtgagaagcaggcgttgcccatgagtgaaatgggctcctgtgtggcggcttcccaccacagtgacaatgacattattcmaaatgctctccttgtcctcttagaagctctatgtaacasgaacctatactataaccgtattataaatgaaaaatgtgaagaagcgatccgtgtctccccgtctccmttctgccacagttgcagtcgtttctttcctggactacggcaaatcctaccagagtcagccttctaaacaccagtcacatctctcccctgctctaaaggcttcaggcagaggctgttcaacccctcgttacagatgtggaaactgggcctaagctcacggcattaatacagcatgggacagggtttcaacacatcatgattgccgggttctgggtgaggaattgaggtgcagcatgacccttgaggagcttaccgtcccaagggcagacagagtgtgcaaatggggaggagtagcctggtgagtgctatggaaacaccgtgtrccgcttctcgagagcgacagactcatggaggcttcatgccagggagggtgaccttgggaggaaatgggttttgaagaagaggggttaaagtttcccacgagtgaaggatgcagtaaaggccgtagcaggccggggagcagcagggcagcatggtgcgttcagagtgcagtgaggactctgtgcagctggggtggrgggcggtgagggtggaagccagaaggatagggtggtgtgggattgctggtgagtttgggggctttatctcttgaccccagaaaccaaccagggaagtgttctgagcaggggagagatgtgactggtgtttagaaggctgactctggtaggatttgcagtagtccaggcaagaaacgactgcaactgtggcagaatggagacggggagacacggatcgcttcttcacatttttcatttatagtacggttatagtataggttcctgttacatagagtttctaagaggacaaggagagcattttgaataatgttattgtcactgtggtgggaagccacctgcacccggagtttgggtgtagccttgggttctgggtggcactgggactttacatctcccgaaaagcctgggcaacccttgcttctctatcaaaggggatcctggctctaggtccccaaagtcactgtttaccataggggtccagagaggcaggaaggaccggtcaccaaaactggraccctttgtgtctgctgatgggcaagtggccaaaaatgggcgagaccatggggctggagcaaggggcgctttctctgcctactgggcctttcctctagaagcagcggaaggcgttctctgggctggagttttctcacctgtgcagtttttggagctgacttgttttccttgcrtgcaactgtggggagctgtggattctgtaacatgaagctttgtttcctctgttgcccaggccctgcttaaaggcttttctgtgagaacgtgcgaacagggagaatgtgggcrttcccccgagccctgtagagtcctgtccacactaagcaagtgtgggacagggtgaggacggctggggcggggccctccctaccttctgggagccggagggttaatctccgtagctcattggcagtcctgcctctgwacagggcatgctgggatttcctcccagctgttttacatcacgaagatttgtgtgttggggaaattccagggcacagctgcaattaatctgctccatggctccaatcaaagcaaggattctgtaggatggattctccgccttcctgcaggaaagggggctctagctctctagtgacagcatccttcagagggacccttcccgagatccacgttgagcagaaacagcccgcctggccaagtgctcgccccaaggagggctctaaggaggggcccaaaacattgagaaagagaggagcagagcccctctgaataataaagccacaaggacactgatggcaacactcgataaagatgtcacccaaagaaaagaaaactttgttcacctttacttaggaatgtaaaagtcaaaaatttaaaacatgactagcattccacaayacagcgtaagaaggaacaaaccaccatgaccaaatagggyttacctgggaaatgcaaaaatgccttcatgtaagaaaatctattgctatatatacatctcataaatgagtcaaataagagaaaccacatgaccattttggtaaatgccgagagaaaaatgcaacaactgctccaatgaaaacaatgtaaaaataggattagaatcatccttccttaatgaggtaaagacatgttttaaaccacagcctcagtctacttaactgtgaaccacagtagcagaaccccagtccccagaaaagtgtttctcagattcagtgagattggaaaactgtgtatctgtcctgtcttagatagtcayaacatatgtaaatcgaagacagtagtacctgccgtttgggtttggtgttttcctttctawttttgagcatccaaaagcgrgtatttaacccatagaaagcaccccagaagtgggagcgatcgctattgccaggccatcagttgcattgatgccattcatcaccatttcaatgtgttacattccrgtgggcatcccccaggagggaggtggctggaccagccygtgtacacatcttcgctrtgggmtgaagcccagccacgacacactggtcaggagctgggccttgcagagccagttaaatgtagcctagactgggcatggagaaaccagcagttttaacctgcccacataccattaccatgcaaagaatctaagcacagtcagccatcacttacttccccaaggacatgctcccacccatgagtgattgccctcagggtgatcgtggggttggccttacagctaagaagagctttattggctgggcatggtggctcacacctgtaatcccagcactttgcgagagcaaggcgggaggattgcttgagcccaggcgttgaagacgagcctgggcaacgtacgttgcaagacccccatctctaaaaataaaaaataaaaataaataaacagaagcactttatttccactctagttgggctaggcctgaygctaggaattcagaactacctggccatcttcaaatgtctagtactgcagtggaagaggattacaagggttgtcactggctcctgctgccccaattcacggttctgggaagttcaactgtcctttcctcagagttgtgatgcagaggccgtccatggccaagctgtaggggctccaaagtcttagagctcttcctcctccccccgtcactcatctccaaaacttaaaaagacaaatagaaaagggaaagtcacgatcctccacactcctgcctcccagagtgagtccctccctacacaccgcccctgcaccaccccaggcatggctggagcagggtcagtcccggtgagatgctcactgttcccaggaccacctctcccttctggtcttttccctcacactgcctgacttgtctgtaaggggccaggtatcagtggtaggcacgaccagtgtggtctcctcccagcagaagccaagacttcttgttacatagataaaacaagtacatggtcagacacccaaaagagtggctgttactgaaaacccttactatgaatgtgtgtacaaaatacaagcatacataaatgtacctgtaccttgatatccccagcaccaaggcagacaaaccctcatggagcttgcagtctattgggtgccagctccttggccactagagcagtgattctcagttgcgggagggaagattctctccctcagccccaggagacatttggcaaaatctggagayatttctgatgatctatatgggagtgcatcggcatttagtattatagttagaggccaaagatgttgttaaactttccaggacagcccaccacccccaataaaaaaagtatccagcccaaaatgtcatagtgctgagcctgagaaaccctgcactacagtcctacaagccgactctgccagacaatctataaggtcacttgagaggattatttaagacccaaaactctagcaccatcccagactagggtttacatttctttggaccacccccatatgatctaaggacatccctggtaagccaacaagaatgaatgtgtgtctttrtggccctaaatagggggcagatgctggtagagttgatggatttttaggtacccatctatcctgtttaatattagggggtatagatttgggatacttctctttagcacctggtagttgttattgtagtttawtttttaaaaccagaaatgttcaagttgttgcttctagaaaaacgagtgtggtgtttaggcttcaagtgcaagctctgggcaccttcagcatccctccaggagaacactgacatgcatggacccattctgtttctgggtggccagccccgtgcaagacagagaaggagagagaaaacacatccgagcaaagagaaggctgcgggtggagagttgaggaagacagtcttaggaaaagcttcgtgacttggtcttgtgcaaggtgtgggatttgaagtcmagagacctaggctccagctccagctgtcttgtatgaagttggggaagcgtttagcctttgtttatgtccattagctccttttttttttttttttttgagacaaggtctcactctgtcacccaggctggagtgcagtggtgtgatctcggttcactgcaacctccgcctcctgggttcaagtgattcttctgcctcagcctcccaagaaggtgggactacaggcacacgccaccaygcccagctaatttttgtatttttagtaagagacggggtttcaccatgttggccaggctggtcttgaactcttgacctcgaatgatttgcccacctyggcctcccaaagtgctgggattacaggcatagccactgcgcccggcctagctccytttaaaatttgggatagtcacccctacttgtcattgcagggttgatgtgcagattacactgggttttgtgtgtgaaaatgctttgacaagtgcaaatgtagcacaaatgttattcacagtgaaaatgagttttaactattgataccaatatttgcccagtgcttttaacttgccacaggcattgaaatcccagttaattcatgtcgggtgtgtgggctctgggtagggcaagggatgggtggtggtgggaagggaggaagaagatagggtcagcagaggacagggacagaggtgacaccccatttgagggctgaggggtgggggtacagaggtcgcaaagtgaaaagactgtcctaattcatagggcttcrttcccacttcccaccaggtctcccrcgccaggcctgcttggcccatcccatgtgctagtctggcctgtggcacgtgtgaccttaagttgttgttcctgcccatggacacctttttgaaagcccagtcagtccctgccatcttggtcaagacttatggtgaatgaagagcaaaggggccttctggggctcttcccatcgccctcctgctcctgtacacagcagagccagattgtgattgatttttcctgatattacatgaccagagtgagggatgattcaaaggcttctttttttttcttttttgagataaagtctcactctgtcgtccaggctgtagtgccatggcacgatcttggctcactgcaacctccacctcccagactcaagcgattctcctgcctcagcctcccgagtagctgggactatagtcctgcgccaccacacccagctattttttgtttttttagtagagacgaagtttcaccatgttggccaggctggtcttgaactcctgacctcaagtgatccatccaccttggcctcccaaagtgctgggattacaggcatgagccactgcacccagccaaagacttctttctgtgaaacttcctggggccaccactttccgttacagctttcattctcaaaggagtctcaagaattctgcaaagaggctgcttgcgggtctgttgcccagaagcaacctgtcagcgttgacactaagacaacatgtgtgcttttgctcctggcaaagactaatggtttgcttatggaaataataggcgtcatttatcaaatgtctcccatgtgcgaggcactgtgttcaatatgtgacaccgtccctagtccgaacaacctgtaccgtgagtgataataaccttgccttacagatgctgaaactgggactcagagttgttaatcactcattcagggtcacacagcctatgttggcagagtaagagcctgaacccatgaatgcagggctccggagcccagaagggcccttcccagtgctcctgactgctgctccactcaactcattctttctaggctcttggcaaggactgtgccatgccagagagagagagagattgtgtgtgtgtgtgtgtgtgtgtgtgtgtgtgtgtgtgtgtgtgtgtgttggggaagtactgtttggkttgggttttttgcactgacatgagaaagaatggggtgctgggtaatctttttcagggttgagagacgctataatgaaggaaagctcagcatccttgagttggggtagatgttgcccatgactctgtgtcaggcagatggcttttattcattcattcccagatacttctggatggctgtttcgtagggagcattgtgtgtggatgtcgtaagtgatggaaatggatggggcaggatggccatctgggagcctctgcctccttggtcagccctgcgtgtccatgactacagcatagggaggggacttgagcstcactagtaggttctttgaatatgttgattggttgtgctggaatggatcggttctctccaccacttaaagttcagcttagttgtcattcgtgtccccccccccaraatgacataggrcgtggtgaggctrgtagtgattgtaaatatatgctcgctcctgttataatcgtttggaaattgacccagtacagggcatgtggcatgaaaatgcaggccaccccaatggcctgccccggtgccctaacagcagagcccagcaaactttgagtacttgtgaggcctcatctcaccaacagctttttcttttctgttccctgtgcagtacctgcagatgaaatggcccctcctcgatgtcccctccagcgccacagtcaaggacaygaggtcaccatctccagcacacttggtaagtctgtttcaccttaaagcaccaaagggccactattagtggcctcatcccatgccactgccttctgccatcrcgctgaagcagatggggtccaacagtgtttcctcaaatgtgtgagtacagtgaggaagagctgagtgcttggggctaacaattgggttgtgacctcaacacacacaccacaccgcctcagatgttttgtaattggaatagccgtcccccaacccccatggccctggctgctcaccctggttcatcacagaagcctgcctgcgatccttcccggctgccatctgaacccgctgcccacttcacgtgggcaagggtggcttctctgtcctgttgaggcttacccagaattgcctcctcttctccctcatagctgccaggcaatagttgaagaggctcttctgtttttgtttttgtttttgtttttgtttgttttttgagacggagtctcgctcttttgcccaggctggagtgcagtggcacaatcttggctcactgcaacctctgcctcccaggttcaagcgattctcctgcctcagcctcccaagtagctgggactacaggcatgtgccaccacgcctggctaatttttggtatttttagtagagacggtgtttcactgtgttagccaggatggtctcgatctcctgacctcgtgatccgccagccttggcctcccaaagtgctgagattacaggcatgagccaccgcgcccggccgaagaggctcttctgtacaggatgttataggaaagaattcaataggacgtatgcaaacaaatgctcctcagggcagccgagcctcttctgccaggccctgtggcaataccagctggaaaggagggtctggacaatcctgggagacaggagcagtggatccaagcagtacctctggcctcctcaggacatgcaaaggactgaaacccaaagctgataagagatgctcctggaacagaaccagatatcctactttcctgggcttttcctgggtgcttgggtcaacacttgccttaagatgcactcaccccacaagctaactggtgctcgccgactgtacagtgagcctcagaatcagggaatgcggttagaagggaccctcatcctgcatgacctatgcattttacagacgagcagacataggacttcactgttactgccctgtactaggtattaggcgttgggcttctatgatgtttattaaagtttaattacagaaaattttaaagatgtatcaaagtagagagaattacataatgaatccccatgttcccttcacccagaatttccctcctgctacataggggatttaaagtgaatcccagacattacttcatctcataggacattttaagagatactgatagctgggcgcagtggctcacgcctgtaatcccagcactttgggaggccgaggtgggcggatcacgaggtcaggagatcgataccatcctggctaacacggtgaaacaccgtctctactaaaaatacaaaaaattagccaggcgtggtggcgggcgcctgtagtcccagctactagggaggctgaggcaggagaatggygtgaaccccggaggcggagctgatagtgagccgagatcgcgccactgcactccagcctgggtgacagagcgagactctgtctcaaaaaaaaaaaactgataattcttattcattaaaagcttagagtctagcagaagagaaagaagatatgtgcagaaagctaaataaataagggtgcagggagcctgtatgatttccagtaatcaggagacctgctcctgtggagcccttgggagtttacagtgggatctacagtgggatgccacatgcagctctcaggtgattgtcacagccatcaccagggagtcaggcaaggatgacagtggaaggaaccgtgagtgcgggaccagccatccgggaaaggcagcaggttctgcagccagtcgccaaggcacaagctgcygttgaacaagcactccacacctcaggcataagccagggtagtggctttggcccagagtcccacttgggatagccaagcacgaggcgcgggtgccctctagtggtgccagtcagccctggtggaggatgtgcggaccacatctgcccaccctagacctggctcgtgccctgcacctccccccagtgcagccatctctgtttcagatctgtgccttcctctacctctcctgtgccgtctgccagcccactcctgaagacctgagatggctgggtcctctgtcttagtktctctctgcatattgtcgcatctccatctacttttcaagaatgttatttccctttaaaaactaacacatgaggccgggcgtggtggctcacgcctgtaatcccagcactttgggaagctgaggcaggcagataacctcaggtcgagagttcgagaccagcctgaccaatgtggagaaatcctgtctctactaaaaatacaaaattagccaggcatggtggcgcatacctgtaatctcaactactcaggaggctgaggcaggagaatcgcctgaacccgggaggcagaggttgcagtgagccgagattgtgccattgaaccccagcctgggcagcaagagcaaaactccatctcaaaaaaaaaaaaaaaaaaatcggcgtggtggtacgcgcctgtaatcccagctatttgtgaggctgaggcaggagaattgcttgaacccaggaggtggaagttgcagtgagctgagattgcaccactgcactccagcctgggcaacagagcaagactctgtgactcaaaaaacaaacaaacaaaaaaaaaaactaacatatagtggccaggtatggtggctcatgcctttaatctcaacactttgggaggccaaggagggaggattgcttgaggccaggagtttgagaccagtctgggcaacatggtgagatctctacaaaaaagacggagttttgctcttgttgctcaggctggagtgcaatggcgcgatcttggctcaccacaacctctgcctcctgggttcaagcgattctcctgcctcagccttccaagtagctgggattacaggcatgtgccactatgcccggctacctttgtatttttaatagagacagggtttctccacgttggtcagactggtctcaaactcccaacctcaggtgatccaccctcctcggcctcccaaagtgctgggattacaggcgtgagccactgcgcctggccaaaatttttaaaattagccagatgcagtcattcacacctatagtcccatttactcaggaggctgagctgggagttcggagctgcagtgagccatgattgtgccactgcactctagcctgggtgacagagtgagaccctgtcgtgaacaaaaaaacaaaactaacacgtgtactctgagtttcccattcttccttttgcacagagcaatcctctgagaaatgaaagaaaaaccctgtgttcagccttcctgttcctgtgagcaccgtcctgtttcttttttattgtttaccgcctgacttcccacacctctgtcacctcctttattctgccactccactgcagcccggcttagcgcttcagtcaccatcgaataactaactccactcattttcctgcttttttgcaacacagccgacagccaaggcctgactactctctgcttcctgtaaatcttatcattgactccaagatactgtattaatacacataatcagttgtttgtctttttgaagcttccattttctttctagacttttattcaaataaatcaactcttcatcatcacttattcctctcaatgtttgtgacagaaaaaatatataaaatcccatcaagagagctgtagaactctcaagaaagttctacacccgtagttccaactgccaaacaaacatctaaccattgcagatgtgtgctctgcaaataataactcagcattgtggtggagcaggggtcccttattttgtctaagggcagagaagcatgaaccgttgccacacatggcattatagatagcaacrtggatagttttctagtaaattttatattaccgtagtctatattataatatagcaaagcagacacaggcctcaaaaacttaaggaacatttatgggagaaaatcttaactgggaattcaacagatggggagaagaccatcattctcagtttttgaggcagagcatctcattccaacgagaggtgtgtacgtgcaggagcaaaacctgagacacccrgggaggagggtatatgagtgggaggctgtataatacacttggttgcaatcccagatccacctctttctatttatgcagctccaagcaaattacctcatctctctttgccttggtttcctcatctattaaatggggattagaagagactgacttcatagagtcgttgtgcgaaaatgagccagtgtattgtaatgagtctagaattgtgcctctaccacaaaataagtcctcaataactattagcttactactcccagcgtcaccaccaccactaccgctacctctactattattaaatgagagggaaagaacaacgaaaatactgtttaattagcaaaactaagaggtaatgagggcctgaattaggtgccagaacaaatggacagattgcagaggtaacagagataatgagcctatagaatttagcatctaatcccccaaggatatgatttaattggtctggggtgcggctggtatcttagtttttaagctccccaggagattccaaggggcagccagagtcgaggatcattgttgtaattgcaaatcacaaaccagaggcggagtggaaggaggacctagagacatcccagtttactccatgcggctctccaggctagacgtgtgagcagaacttgaaggtttttcggagggagtcacagaggtttggacaccggcttttttgttaaaatacttgagattatgaaatgtattttagagtcaggagtaaaatatttaaggtgaggtttgccctgggagtagagcaagcgaaggaaacagcctgcatacttgcagagatttagtgagtcatgtagaagctgcctaacaaggaagtatgtctaagcaagtcacaactgggcccgggtgcgggatgaagttaagtgcttaataatttggactttacaccttcaaaacaagctctaaagactaacagtaacattgtataagcaactatttgtaagatccgatcagtgtaatttcatcacttgcagattattatccagacccctcaccatggccccacatgccaggtgcctgtcttccctccagtgtcccccaggagcactgtgtccagccacgcaaaacacatatatgcccctctagaatataagcaacacgaagacaggaatcgcatctgagcgcctgttgtaatgctcgggagcatttgttgaatgaatggaagaatgaatggtctggtaaaaagttaataccccttctctacccacatttacccaagatccaaccccttttttcattcagaactgttttttaattttaaaaaatctttttttgaaaccgtaaaagtaatgcatgcactgtgtagaactcttgggaaaatgccagaaagcacagaaaaagatctataatcccacaacccacaaacattttgttaaatagtatttcagtctggagtgtgtgtgtgtgtgtgtgtgtgtgtgtgtgtatacttataacttgctctctgatgaccaaaatgcttcctgtccaggtagatgcctaataaattctgctgagttacaggcaaatggggccagagacccagagaccaggagacaaataatccagataacttggaaatggttgcagttctccaaaactttagagtgacttaatccagctttttggaaaatggtcagatattcaggggttttttaatgcaaattttagctgttaggctgagcatccagaatcagaaaagggacctagagagtaaggagttgagggatagaggaaggtgtagagaaaaatctagatgaggttagtgcaaaggcagaaatatctaccacctttgaaactttgccacctctctcttcctggttgccttttatttaaacattttaaaaatagatagacatagatggtttccagttgtttgtttgttttgagacagtctcactgttgcccaggctggagtgcagtggcacaaactcagctcactgcaacctccacctcctgggttcaagagattctcctgcctcagcctcccgagtacctgggattacaggtattcaccaccacgcccagctaatttttttgtatttttagtagagacggggtttcatcatgttggctaggctggtctggcactcctggcctcacgggatcygcgcacctcagcctcccaaagtgctgggattacaggcacgagccaccacgsctagcccagtttttttttttttttctccgagacagagtctcactatgtcgcccaggctggagtgcagtggtgcgatctcagctcactgcaactttcacactccgggttcaagcaattctccctgcctcagcctcccaagtagctgggattacaggcgcctgccaccacacatggctaatttttgtatttttttagtagagayggggtttcaccatgatagccaggctggtcttgaactcctgacctcaggtgatctgcccgccttggcctcccaaagtgctggaattacaggcgtgagccacctcacccggccccagtttttaagctaaagttagcatcctgtgcatatatttgtatacgtgtgcgcttttccccccatttaaaaaaaattagagttagggtctcgctatgttgctcaggctggccttgcactcctggcctcaagtgatccgcctgcctcagtctccaaaagtgctaggattacaggcatgagccatcaygcccaacctccccatttttaagatataatttacatatagtgaaattcacatgagtatatagttctgtgagttttgacaaacttttgcagtcatacatgagttcaccacaatcaagatatagaacagttctcctagtcagcttagcttggtatgaaaagtaaaaataaaaaagatataggacagttctgtgttagggttctccagggaaacagaaccaaggtgatgtatgtatatatagcgagtgagtgagtgagtgtgaatgtgtagagggagaaagatttaagagggtaagctggcaggctggagactggcagggaagagttacagtctaagtctaaaggcagtctgctagcagagttctattcaatttaatgctcaagaataatcctctttggcaccattcattctctgtccttccagcccaccaggatgggagctgggagctgtgcccctgaggccctgggcggcagccacaccttgtgaatcccctcttggggtcattcttccctcttcttgaaagataacaaatgtttgcagccacatcactgtagcccattctgtagaagtctgacagccttccttccctttgtcctgtctttgtccattttaatccaaaagggcagtatttctgctgaggtggttggttgaatccatgcttcacagccccagtctcattatctgatcgtccagccacaccattggtgttctcttaggaacacaccttctcatttttttgcaatgaggctaggctgagaattttctaaattttcaagttctggttcctttttgcttaacaataatttacttctcacattttactacaagcagtaaggagaaaccaagccacaccttcagcactttgcttagaaataacttgtgctgaatatctaaattcatcactcacaagttctacctttcacaaaacactacaaaataactcagccatgtttcttcccactttgtaacaagaatcgcctttccactagttccaataacatgttccccatttccatctgaagcctcaccggaagcacctttaacatccatatttttggggttttgtttttgtgtgtatgtgtttgttttggttttagttttggttttggttttggttttggttttggttttaggacggagtttcactcttgtcacccaagcaggagtgcaatggcacatgatctcagctcactgcaacctccacctcctgggttcaagagattctcctgtctcagcctcccggattttggttttttgtgctttgttgagagacaggatctcactctgtcacctaggctgtagtgcagtggcatgatcatagctcactgcagcctaaactcaagcattcctccctcctcagcctcccaagtagctaggactacaggtgtgcaccaccacatccagctatttttattatttgttgtagagatggggttccactatatggcccaagctggtcttgacctcccaggctcaagtgatccttctgtctcagcctcccaaagtgctgagtttactggtcatatgtatttttaagggagaatgggaacatttcaatggtagctgcctttgggaagtggggaggagcataagactggtggagtgtttaagaggatttaactttctgtgatgttttatttaagaaaaaaagaacaaaatttaaaagctataaaaacaatcccacatggcaggttttgggtgtggtatcattctttatacttttctgtatttctcaaaaaatatttttgtagactttatgtcttaagttagctatttctctctttttgttttttaagacagggtcttgctctgtcacccaggctggagtgcagtggcacaatcttggctcacttcaacctccacctcctgggctcaagtgatcctcccacctcagcctcccaagtagctggaaccacaggtgtgcaccatcatgcccagctaattttttgtatttcttatagagacggggtttcggcatgtttgccaggctggtctcaaactcctgggctcacccaatctggctgccttagcctcccaaagtgctgggaatacaggcatgagccaccacacccagcccaagtcaactatttctttcataatgctgtgtaacaaacaattcagtggcttacattagtaaacatttctttttccactgatggacctgtgggtcacttggagtggctgttttagcttgttaagggggaggttcaggtcttctccacatggctcttatcccaggaccagtggctatccaggtcatgtccttctcatggcatgtggcagatacaaaagaagggaagcagattgaaagcttcctttcacttcatttcatgtccactaatattccattggtcagagcaagtcataaggtgatatggtgtggatctgtatccccacccaaatcttgtgtctaactgtaatccccaatgttagaggtagggcctggtggaaggtgactgaatcacgggagtggtccttcatgaatggtttagcaccatctcctggtgccattcttgtgatggcgagcaagtttttataagatctggtcatttaaaagtgtgcaggacctccccccactctttctgtcttgttcctcctccaccaagtaagatgcgcctgcttcccttcacctttctccatgattaaaagtttcctgaggcctccccaggagccgagcaggtgccagcatcatgctttctgtacagcctgcttaactgtgagccaattaaacctcttttctttataaattacccagtctcaggtatttctttatagcaatgcaagaacagactaatacgtaggggcaagtctaatactgatggggcaagggaaggaaagagaattataaataaatagtaaaagcaaacacatggctacatcctgacctattgatcttgtttagcatttgagattcaagaatgtagaacatactctaaacagaaataaattattgcaagtgttaacagtctcgtgtccaagtacttcctgtcagagtttagcatcttcagtaggatcaaaattagaatttctcttggttgtcgtcttctcagtattagaaggaccctaccaatactgtttagacactggcagcatcttccttatcatccggttggtgggtctcttgagcaggcatcggagtcatctggggaacttgttaaaacaaagattgctgaaccccacmcctagagtttctgatggaatttaggtgtggcctgaacactgggattttttttttttttttttytttttttttgagatggggtctccctctstcgcccaggctggagtgcagtggcacratcttggctcactgcaagctccacttcccggattcacgccattcscctgcctcagcctcctgagtagctgggactacaggcacccgccaccacgcccggctaattttttgtgtttttagtaaagacggggtttcaccatgttagccaggacagtctcgatctcctgaccttgtgacgtgcccgcctcggcctcccaaagtgctgggattacaggcgtgagccaccacgcctggccgagcattgggaattttaaaagctctctggatgatttcaactctgggtgaatcacactttgcagrrtttgattcagtgggtcgcggtaggtcgagcctgaraatttgcattctaacaagtttccaggtgatgcttatgctgctggtctggggactgagctttgagaaccactggcatagggacattgtctgcactagtaatggtaaacacccagttttagcattgcaaattgggtcactctcagaagcaaactggagagtttcatgtcaaattattgattgctgagccagtgctggatgctctctgaaagaacatcaatagctctgccccagctttgagctgagaaacctgacgctgcttaacatgccaattctcaaaaatattcattggaatttcccttttacaactgtacatacagccaggcacggtgactcacacctgtaatcccagcactytgggaatctgaggtgggaggatcacttgagctcaggagttcgggaccagcctgggcaacatagtgcgacctcacctttactaaaaataaaaaaaattagccgggcatggtggcacatacctgcagtcccagctactcgggaggctgaggtaggaggattgcttgagcccaggaagttgaagctgcagtgagccatgatcaggccactgcactccagcctgggtgactgagaccctgtctgaaaaaaaaaatttttttaaataaaattctacataacttctccatcttcttaccagtatacctgtgtagatgcagaaaactccaaaacccatagcatatcctgttggtgctctgtactaccctcaatactgattgtaattcttaatacacagtaataacttttgttttgttttgctttgttttgttttttgagacggagtattgctcttgtcacccaggctggagtgcaatgacgcgatcttggctcaccgcaacctttgcctcccaggttcaagcgattctcctgtctcagcctccctagtagctgggattacaggcatgtgcccgcatgcccggctaattttgtatttttagtagaaacagggtttctccatgttggtcaggctggtctcgaactcccgacctcaggtgatctgcccgcctcggcctcccaaagtgctgggattacaggcatgagccaccgtgcctggccacttttgggtattattttaactcccagaaaagtttcaagaataatacaaggaactcccatataacctttatccagattcacacatttttcccctgggctttgtgcttctctttctctctctctctctctgttttttcttttctgaaaagtttgagagtaacttggaaacattgtgaccctttacccttaaatattttagctatattatctaagaacaaaggcattctcttaaataatcacagtacagtcctcaaaatgaagaaagtaacatttacttttttttttttttttttttttttgagacagtctcgttctgtcgcccaggctggagtgcagcggcacgatctcggctcactgcagcctccgcctcctgggttcaagtgattctcctgcctcagcctcctgagtagctgggattacaggtgcccaccaccacgcccagctaatttttgtatttttagttgacacaggatttcgccatgttggccaggctggtctcaaactcctgacctcaaatgatccacctgcctcggcctcccaaaatgctgggaccataggcttgagccatcatacccagccagtaacattaacttttcatrtcattatcttactcacaatatagattgaacttttggccgtgtcccaataatgtccrtgatagcccatgtgtttctcctggtcccrggttccacctggcatcatggattacatgtagccctcatgtctctttagttccctcgaatccagcagaggtccttagcctgtctttgtctttcttgaccttcacattttttgagaagtacaggccagctgttttgtagaatgtcccttagtttgggtttgtctgatgtttcrtcatggttagattcagattgtgcatttttggccagaatgtcactgcactaaagttgcatcctcgktacctcatttcaggaggtagccctacagtctgcctttgtcccagtattagtgatgttagcatcaactgtttggattaggtggtatctgacaaacgtttccaccctagggtaacaatttttccctttgtaattaataagtgttttgtagggagaggctccaaggctatgccaatgccctatttctcatcaatttttcacccactagttttagcaggcagtgatggttttccacctgcatcgttccttctgttcatttctgctgttgagcttcagcgtctttgaaattcttactcatgtctcccagcccattcgtctttgtatagactggagttgacattgtggcaagtcacatttgtgccatttgtaactgtgatgagaaagtcgctgatagatacagagaaaaaaaattaaaaaccattctacaaatagtgtttctaaagaagagaccaaactgaaggaaaagaggcaattaagaaagttaaaatgggctctaaaaacaaaaacttgaatttatggattgaaagagctcctttgaattctataaaactcaatgaaaattgacattcacctagacatatcctaaaaacagttcaaattgcaagggtttagaaatgttttccttcaagcacccatgcagaagagaaaaaaaggcaaatgccaaaggaacaaaaataaaggtaaccttagggctgtcttttgccacccttaatgccagcaaacagtgggaaaagaagagtttgggtaaggaaaggcttatcccaagaatgacaaatcctgtcctacttgcaaagacctcagaaacataccattgctcagaaggacctgaargcacattccaggtcccagagtcttttctctctcctattgccctgcagagactcttgacttaccttcacatttttcgtagcctgcagcacaccactttcaggagctcagaaagtatttgttgacccatccgtacagaccctcattctcctctctgctgcagcccactggcctgccgtgggtcctcacacgtgctatgccaggcatactacactagtgtttctttggccaaaatgtccttccccacaatcaacgtgtccagctccccacttctttcaaaatgtgaaagtcatgctctcaggccaggcgcagtgcctcacacctgtaatcccagcattttgtggggcccagacaggcagattgcttagtccaggagctcaagaccagcctgggtaacatggcaaacccccatctctacaaaaaatacaaaagttagcccggcatggtgggaagatcccgtgagcccaggaggcagaagctgcagtgagctgaggtcacaccactacactycagcctggggggacacagtgagactgtgtctccaaaaaaaagtcattttctcattgacaccttccctggtcatcctgggaaacatcctgtttaacctgctcaccccctctatatttcttttctactttctcttagtttttcttcttagcattttaacaytgtattaaaatattttaataaacttatttatctaatattttttattttattttatttttgtttgagacagagtctccctctgtcgctcaggatggagtgcagtggtgcgatctcggctcactgaaacctccacctcccaggttcaagcgattctcctgcctcagcctcccgagtagctgggattataggcatgtgccaccacgcctggctaatttttatatttttaccgagatcatgccactgcactccagcctgggtgacagagtgagactccatctcaaaaaaaaaaaaaaaaaaaaaaaaaaaagtgcaggccaggcgcggtggctcacgcctgtatcccagcactttgggaggttgaggtgggcagatcacgaggtcgagagatcgagaccatcctggccaacatggtgaaaccccgtctctactaaaaatacaaaaattagctgggcatggtggcgggtgcaygtagtcccagctactcgggaggctgaggccagagaattgcttgaacctgggaggcggaggttgcagtgagtcgagactgcactccagcctggtgacagagcaagactctgtctcaaaaaaaaaaaaaaaaaaaagcatgtgagagaggacacatggcttcctagggagaccagagtttaaagacctttgtcttgtaccaactctagaaacagactgaaatagacgggaaacacctgagctagaaagagctggcttgcagcgcttgcctgaaggatttaggtctgaggtggctctcaggggctctttggatgcatctggattcagcttcctggccatgcacacccatgcccacgcttgtgtgttttgtccctgttggggttatccacagaggggtgtgcggtggttccctacattcctagtcctcggtttgggtatatgctgtgaacatcctgcccctgggggcagctgaggagagtaatgagcaggaacttttattgggacagaagcctgcaaggagaaccttccttctaggaggccactatctacttaccgccttccctcccggttcattttctggacaatgatgccacctagtgggaaacggtaagaactcacacagcatttcgacaactatacatagatcttcaaataaaaatttccctactttgtattaggttggtgcaaaagtaattgtggttttgccattaaaagtatggccaaaaccacaattacttttgcaccaacctaatacttaattctgttacccattgagtcctgtttgctggtttctccccaggccaaatacagcacatgagcaatcaggatttgctaatactatcaccagtttttaagacagctataaatgatgtaaataaatgtaaatttaaaactgatgcagaggctgggcrtggtggctcacacctgtaatcccagcactttgggaggctgaggcagggggatcgcctgatgtcaggagttcaaaaccagcctggccaacatggtgaaaccccatctctactaaaaatacaaaaaaattagccggacatggtggtgggtgcctgtaatcccagctacttgggaggttgaggcaggagaatcgcttgaacccaggaggcagaggttgcagtgaaccgagatcacaccacttgcactccagcctgggtgacagagcaagactctgtctcaaaatagaataaaattttattttgagccactgagcccggcacagtggctcacacctgtaatcccagcattttaggagaccaaggtggatggattgcttgagcgcaggagttcgagaacagcctgggcaacrtggtgaaaccgcgtctctacaaaatattagcgaggtgtggcagtgcgcatctgtagtcccagctacttgggaggctgaggtgggaggattgcttgagcctgggaggyagaggctgcagtgaaccgagattgcaccactgcactccagcctgggcaacagagcgagaccttgtctcaaacacacacacacacacacacacacacacacacacacacacacactgatgcccagaaaggcttaatgaaaggagatatgccaaaatgaccatagcgacagggttaggatggtgcagttatgttgtctaaatgctttgtgatacaattatgatatagtttgcatttctttcttagaaagtttgtgttattcatagtatatttttttaagtagtagatcatggkgaaagtaaagttggaaaatatggaaagagagacaataaagacaaagttacccatagtttcaccactcaaatataacttgtttacatttttggtgtgcttctatttagcctttttttaaattacagagtttatgtattttttaattgtgattatgtattttcacgctggtaataattctattggatttattttactaaaagtcaccctttagacaaagctgtttccagaaactatcattaagatgcattggcttcctggaaatctgatcttacaataatttttaatatttttgtgttgtatgttcatgtatatggagatatcttcaaaaacgagtaattggacaggtgaaaacagtaagaagacagtactttttaaattcatgatgcaacatccagtgagcccaccagccaccagcagggcccagctgtgtgctggcgccacctggtggtcatggttataaacggtttaattctccgcctctcctctctgcttggcacactgaaaaggaacaaggctgtggtgagctcaaggatacccaggaaatctatggattggagtttgcattatgagtaccaaataggcaccacatgaaaggaaagaaaggtctcatggaatctacgaaatgaaaaattcaaagaggaatatagccatttggagttgtagcccttgggttacctccaaatcatcttttttacaaatctcttttttttttttttgaaatggaatcttgctctgtcacccaggctggagtgcagtggcacgatctcggctcactgcagcctctgcctcctgggttccagcaattctcctgcctcagcctcctgggtagctgggactataggcacacgccaccatgcccggctaatttttgtatttttagtagagacagggtttcaccatgtcggccaggctagtctcgaactcctgacttcaggtgttctgcccgccttggcctcccaaaatgctgggattacaggcatgagtcatcgtgcccggccacaaatctcttttaaaaagaaatctcttctccacttgtaactcacttatcttattatcaaaaaacataatttctgtcctttctctgtgacagataagttttacgttttgagaaggttctgggagagacaggttgtacaagagaaaacattcttgtttattagagccataaacagctgatatgaatcccagctctgccacttactaaccgtgtcccaggctaagtcatgtaatctttctgggctgttccctcatctctggaatgggggtaatcacagcttcttttctaggttataaggagtagaaattatgcctggtgctgtgtttgtaatgcagggttcagtgacctgtagatgtttttaaaataaaaagccttatggataagtcagattaggtttaaacaattaaaaagttaattctgtttaccaattgtagaacgcacrggtttttcccatgttaacatctctgaagatgtgtctgtggcgtgccagcgtttttcycaatagctttataaaataatggtgctccttccatttggtggtgttttacacagaatgtggtagtgaggtcagcagagtaaagtgttacagagagaagtgtttcaagtgctttagggttgtgtctgtaaagcctgaatatgagacttggtagtatgaggtctaatgggggcaactctccccctgccctgttcccagtcccagacttgaacctgagagcaactgtttctatgaagtttatttgaaaaatgtgtgttaaaccttttcagggccgggcgcagtggttcacacctgtaatcccagcaccttgggaggccgaggcgggtggatcacctgaggtcaggagttcaagaccagcctggcccacatggtgaaaccctatctgtactaaaaatacaaaaaaattagccaggcgtgatggcagacgcctgtaatcccagctactccagaggctgagacaggagaattgctggaatccggraggcagaggctgcagtgagccgagatcatgctactgcactccagcctgggtgacagagcaagactccatctcaaaaaacaaaacaaaacaaaaaaaaaacctttttagattcaatgagatgacacagcgcagatcatccctcagcagcctgtagtgtttgagatgacacagcgcagatcattccccagaagcctgtactgtttcccacacacagtgcacgtgaggggagcgatggagggtgggtgtgatcccttctcaagtcctgctgctctgctgtgtccactgctgtcatctctcagggactgttttgaggactgaatgggatgttgcctggaaaatacctggcacttacttgattccataaataacagctggtcatactctccatctccttggcaaccattcctggtcttttttgtctctttcagtctaataaagttcctgtcgttcagcacccgcatcacatgcatccgctgactcccctcatcacctacagcaatgaccacttctcccccggctcccctcccacccacctctccccagagatcgatccaaagacaggtaagtcgtctgccactcaggcagtgctgctgcagggcaggcgggcttctcttttgtgggaacataacagcccttgaatcaggctgacctgggttcaaatcatggctctttgtctcaggagtctttggaccttgtctgctaactttagccttgtcattttttttttcatctgtgcctcccctgtaccttctccaccatagggtcacgataaggcccacaggaattaaatgcagtaaagcacrgggcctggctccataggcagtgtgtggggtggctctgcccaagtctagcccagctgtgggccgtgcttccctacaccaagacaygtttgccmtaaactgaacatttttaaatagattcatcagtctaagcagacacagaagtgcaaccgtaaagcagtgaggccaaactggcttttatttatttatttatttaagacagtcttgctgtgtcgcccaagctggagtgcagtagtgtgatctcagctcamtgcagccttgacctcccgggctcaagcagtcctcctccctcagcctcccgagttgctgggaccacaggcgcatgccaccatgcccttgcccagctaatttttgtatttttagtagagatgggtttctgccatgttgcccaggctggtctcaaactcctggactcaagcagtcaactcacctaagtgccgggattaccggtgtgccaccatgcccaacctgaactggcttttttttcttttttttttttttaacttgcccaccagacctgtccattccagggagccactgtctttatagcattcacacagagttgccaggggaaggcaaagcrtttttggagcccctctttggagaaataacagtcactacaagttacagataatgaggaagacacatgtggaggaggaatccaaagtttatttctccatgaatgaggcgggctttctagagacttggttcaccagtgactcttgtcattggtcttgtgggtcctgtccctctcttccaggacgctggcttctgtatcacagccagctggaagatactcttcacagagatagaatccgtgcagctagagagggggtgcattagtcctgcctcccctgaatatgtccttgactgactggtgagagctgctagggagttgacagagggcaaggacaatgacacaagcacctgctaggctccagagcaccagggacatagggcaggatgctcccatttgatgttcgttaaggtgctctggcagggcgagggaacagtctgacatatctctctttggaagcaggaatcccccggccccctcacccatccgagctgtcaccgtattacccactctctcccggagctgtcggacaaatcccccaccccctcggctggctcgtcccacagtaaggaacccacagcctctcttccccctgctccctccttgcgctgagctctgcctctgtgccctgcgcgccctgcacagtggagccccctcagaggcaagcccaggactaggcctccctgcccccgcccrggcagcrtgctcccagcattaccttcccgcttccttcccatatttctcatcccttcttcccaagtgcctctcttcctctgccctgagctttcccaatatgctgaccagatttcctccccctcacaggcaaggccagcccatgtactcccttcctcccggtggcttccggcacccttaccccgccctcgccatgaacgcctcgatgtccaggtgagtcccggggctggggctgtccgcatgtttgtcttagcaaccacgccatttctgaccacgaaacagctttttcttgccagttaatgagcaggcacagggctcaccctccccccamctctctttgatcaagcatcttctcacgtcccgcgctccccacccccaggtcagaatggagaccacaggatcactgtccccatctctccaacagaaggattgcaaagccctagcactctgcctcctgccatgggctctggcactgaagcattttgaggacagatgctccccgacttaggatggagccgcgtcctgataaacccgtcgtacattgaaaacacaactttcmccttagaatatttgcaacatatgatggttttatccagacataaccccatctaggtcaaggagagtactgaattaatatcgtttttgcaccatcgtaaagtcaaaatatccyaagtcacggactgtctgtatatcacactgaagctagggactgggagaagatgaatttttcctgaaatgatgtcaggagaggagacggtgaaaggggatttctgtctcagggaccagctctacctgacagtggaacywctgaggacagaggaaagctgcccacagcctaagcccttcttttccccagtatgcccgggcctctgaccctcctccccttttgtgtgtttcatcccacctgcttccagcaccagatgggcagcctgggtgttggtggggagaaggaagagscattaagcatctcccaaacctggttttctagaagacgacaaatagccttctagtcctgagactctgccccacggacatgcctgtgcccttaaggcagagagccaccgtgtcctctgctgggtggcaggtatccagcctgaacccctctgttgccatttgtttctatccggtgcacagcctggtctccagtcggttctctcctcacatggtggctcctgcccaccctggcctgcccacctcagggatcccccaccctgccatcgtctcccccatcgtcaagcaggaaccggcaccccccagcctgagccctgcagtgagcgtgtaagtaagcggcagcctggattcaggtgggagggtgcaggctgtggggaggggtggcsacactctgagcagcaaatgtcatgtactcttctctcttggtgtcactcagcaggcatcacagcctccccagccaggccctccctcttcctcgggacttactccctctgaccttctgggtccctgtcctttcagggacatggtgcatcttctctcttattaaggaaagttttactgtcaggtctcagaggctgaaagagaacctgagaaagcttttaacaccccaccgtaagatatatgaaaaggtgaggcccagaaaggagacagtgttttcttaaggacttgtggtgggctggtggccgagctgagatgagcaccagggtccttaccttgcccgtgtaccataaagatggcaggaagccaaagtcagtgctccctggagatcccaagagaaccccctcccaacttggttctgcccagagtgccccacactgtgtcctgtcaccgccgccagcacctgccagctccagtgagagctcatctcagcaaccccaccatgctctgttcctctgtcaggaaattggagagtagattttcaaagaatctggcgtggagatcgttcaaaggtgggaaactacgggaggaaggtactcaggtgttgagtgcagccatggggccacttgaattagcatccaggcagcccrcgcccctccccagagacaatcagcggtgtttcagtgacaggtggggattgatgagttgtgtgacacctgacatgctaacctacaaccacgtgccttcccaggaaatcaccagtcaccgtgaaaaaggaggaggaaaagaagccccacgtgaagaagcctctgaatgccttcatgttgtatatgaaggagatgagggccaaggtggtggctgagtgcaccctgaaggaaagtgcagccattaaccagatccttggaagaaaggtaagacctgccctctccctccaggccagggaggcagcgtccctgcattgatggctccgtgtggtctctgaccctctctcccscagtggcacaacctgtctcgagaagaacaggccaagtactacgagctggcccggaaggagcggcagcttcactcgcagctctacccaacctggtcagcccgggacaactatgtaagtgcacactctgggcagaggacgctcagaccccaggaacagcctctgcaagaggaggaagggtgaaggaaagcaactgcatttatttttatttattttattttcttttattttttgagacagaggctcaccctgtcacccaggctggagtgcatgcagtggcgcgatctcggctcactgcaagctccgcctccccggttcacaccattctcctgtctcagcctcccgagtagctgggactacaggcacctgccaccacacccggctaattttttgtatttttagtagagacggggtttcactgtgttaaccaggatggtctcgagctcctgacctcgtgatccgcccacctcggcctcccaaagcgctgggattacaggcgtgagccaccgcgcccggccagcgactgcatttatagaggactcttaagatcagggagaagcccatacttctctagaaataaggaaggtgttttaattctcaggaggtcaacaagtcctgaggacggacttcagttgatgcatttccctttgaactggactctgccctcgatttcataacacagggcacggggttagctgtggtaggaagagttgtctccagccactcctaacccaacccagggctcaaagaccagtgtgtgagcctcagggggcgtgtctctaagctcccggaaaccaagccaattttcgcatgcgtgttcttctttgctttttttctggtaagaggacccacagttgcatcaaactttcaaagggacctgggacccctcagaaaagatctagaagcactgttctagggagagaaacagaaaaacagagtctgaagggcagtggagggaggaggccttccaagaaggcctggacacccgacctggaggggaaacgcgtttgtaggggaggaagggctccctctgtcctcctcacgggctcccacggctgtgatctgaattatctctccacactctccctgagggatcgagagcagtaaagggcaacgtcctgtcttctctctgatytgggagcccctgagaagccagcattcttctctcccagcttacctcttcctttggctgtattttccagggtaagaaaaagaagaggaagagagaaaagcagctgtcccagacacagtcacagcagcaagtccaggaggcagagggtgcgtctcggggcactggcctcttctcctgcttttccttttgtcacagccacacctgcccatgctgtctctagctccctgatgggtcagggcttctgcctcggtattcrcgggcgggtattattacccctttctcgaggtggccacttaagaggctctgagatgtgaaggcattttcccaggcactctgcttcagtggtggtggtaggatttgatcccaggactttgtcacttcaaagcctagacaatctaattccattgaaaagtgaatcatcctacctgagggttaatggaatgaggttgaaattgtctttgaaatacccttaggaaggcagcacatgagcccytgacatcccacctgtcagtggatccaggggagcccgggtttccttggatgtttctttggttgaacaccagaaaaaattagtttgcttgggtttaggaggcactttgtgtcaaaaccatgtataaaatctctatattaccagaatcatgcctagcacagaaagatgctcacactgtgacgattattattaatatttaggtcacgccccccatctcatgctcactccaggacaagtgtatcgctgcttgcacgatgtaaagtgctttcaatctctcttcttcattcctccctccctccctttcttcctccctccctttcaccttccctcccattctccttccctccctttccccttccctccctccttttctccctccctttctctttccctccctctctttccctccctctccccctccttccctcccttccccccctccctttcttcttccctcgctttctccttccgccctccctttctccttccctccctccctatttccttgcctcccctcctcccttccttccttccttccattatacataggagcgcacatgagtggaacccgtacctgctacagaacccgctgtctggcacgctgttcagcaggcatgcactctctctgactgtattaataccataaaccaaagatttcaaagcaaactggagattcatcccaaaagttaccagctttaggaaaggagggtggtcctgtgagacactgagccgtcttctctccgatctgatgctgggtggatcttcatcagtttgggcgttgcctcttctctgtgctctgggtatttgtgaatgcagtttcctagtcttgaaagccttggaagtaatgtcaggtcctcgccaaaatcatccctgtgtctccaaagcacatgtatcgccagggctgttcctcagcctcctccyctcacagagctatagctgctcactctttcttgtattttccccctaggtgccctggcctccaagagcaagaagccatgtgttcagtacctgccccccgagaagccctgtgacagccctgcctcctcccacgggagcatgctggactccccggccactccctctgcagctttggcctcaccagctgcccctgctgccacccattcggagcaagcccagcccctctccctcaccamcaaaccagaaacccgggcccagctggctctccactctgccgccttcctgtcggctaaggctgcagcctcctcctctrggcagatgggcagccagcctcccctcctgtcccggcccctcccccttgggtccatgcccacagctctgctggcctctcccccgtccttccccgccacgctccatgcccaccaggccctcccggtgctacaggcccagcctctttccctggtcaccaagtctgcccactaagctccccccgacccctgcaggctgtcacatgactcattgagtagtaatgattcagaagaaaaagaaaaaggagactttattggtcaatatttgaccactctggactgttctgtaaagtggctggtaacaacagcactttacagtttgtagatgtaaccagtagctgatcttaaggcttttttaaaaaacaaaacaaaacaacaaaaaaaaatctttataagaaagagaactgaaaagtagcgtgctattcgtcctgtaggtgctgtggtggatggacctgggcagagggcacttctctctcttacctctcttgcactttctgtctcctgtctcttctcgcccctgccgcctgccccagcttccccgactccatctgcagctctgccattgtgacatttcctgttacccagcccaagttttcatcgtctgctcaataccgtgggttcttcttcgtcctctgtcctctgcccagtgtgaggccatcaccatgtgagaagacatcttggcctgatttgctgccaccagcgtcccctccctcagtgggcccgaactcgccagccccagctttcagtggagaaagcggtcctctgaaatggtttcctcccaacccccgcatttaaagggactcaaggtgcctgccacttcctcagcgaagaagtctgtgttcctccccgtccttgccagtggcgatcatcccttcacaatcccagagtggcaggcgggaccrgccccatggtctggctcctgtcacctgggtccgtgccagcacaatctgccaaagttctasagaccctgttcccttccccatcacctcacatgcttcttctgtgtgtatttctttttgtttttatggtttttggagcaatttaaactcccagttgtttattttcacaaaagaaaataaaattgcagttgcaagaccttttctgagtgtttctttagtgcttttgttgaatcaaaccacctgtttgtttcactcccaaaccctgtgttagactttcgcagatatgcaaaggaagattgccacttgccacaggggaatgttaggcatgcctgacacccttagaaaacctgaacccagcttcctgtctcaaatgtgcatgggccagtcagtgtccatgactgagctgcaaagggggtaatcattttcacagctgatttaaatgaatttgccgcctggaatgacattcagcttatgcttctatcacccatttgactcgtaattgccaagatgtgaggaagcatcttttggatactttccatagtatctagcaccacaattaattttttgtaacagctttatggagatatacttcagccatttaaagttacacttcacccatttaaagtatacagttcagctgggcagagccgctcttgcctataatcccaatgctttgagaggctgaggcaggaagatgacttgaggccaggagttcaggactagcctgggcaacatagcaagacctgatctctttaaaaaaaaaaaaaaaaagcaactagctggggatggtggcacacaagcctgtagtcccagcttctcaggaggctgaggcaggaggattgcttgagctcaggagctcaagactgcagtgagttatgattgtgccactgcattccagccttctcaacrgagtaagactctgcctcaaacaaaaaaggtatacaattcaggctgggtgcgatggctcacacctgtaatcctagcactttgggaggccgaggcgggtggatcacctgaggtcaggagttcgagaccagcctggccaacatggcgaaaccccgtctctactaaaaatacaaaaattagccaggcatgatggtgcgcacctgtaatcccagctacttgggaggctgagacaggagaatcgcttaaacccgggaggtggaggttgcagtgagccgagacagcgccattgcactccagcctgggcaacagagcaaaacttcatctcagaaaagaaaaaaaagtagacaattcattggctgtatgttcagagttgtgcacctatcaccagtcaattttagaaagtttttgtcagtcccaaaggaagccccatatcctttgaaaatcactccacattttgcccatctcccccagccctaggcaaccactaatctactttctgtctccaaacttgtctattctagacatttcatatacagtcatgcatcgcttagcaactgagacaacgttctcacaaatgcgtcgttgggcaattttattgtgtgaacatcatagagtgtagttagaaaaacctagatggtgtacacacctaggctatatggtatagcctattgctcctaggctacaagcctgtacagcatatgctactgtactgaatactgtaggtgactgtgacacagtggtgagtgtttatgtatctaaacatagaaaaggtggctgggcrtggtggctcacgcctgtaatcccagcactttgggaggccgaggcaggtggatcacttgaggtcaggcaggtggatcacttgaggtcaggagttcgagaccaacctggccaacatgttgaaaccccatctctactaaaaatacaaaaattagccaggtgtgtggcacatgcctgtmatcccagctacttaggaggctgaggcacaagaatcacttgaacccgggaggcagagtttgcagtaagccgaaagcgcaccactgcactccaccctgggcgacagagtgagactctttctcaaaaaaaaacagaaacaaaacatagaaaaggtgcagtaaaatctggtgtaaaagataaaagatgggccgggtgcagtggctcaagcctgtaatcccagcactttgggaggccgagcagggtggatcacctgaggtcaggagttagcgaccagcctggccaacatgatgaaaccccgtctctactaaaaatacaaaaagtaactgggcgtggtggtgggcgcctgtaatcccagctactcaggtggctgaggcaggagaattgcttgaacccaggaggcagaggwtgcggtgagccgagatcgcaccgttgcactccagcctgggcaacaagatcaaaattctgtcttgggaaaaaaaaaacaaaaaacaagataaaagatggcatagctgtatagggcatttcccaggcatggagcttgcaggactggcagctgctctgggtgcgtcagtgagtggtgagtaaccatgaygctgtacacttaggcaacactaggtttataaagaaatattcttctttcttcaagaataaattaaccttagtttaacttttttactttatcaacttaaacactttttgactcttgtaataacacttagcttaaaacgcaaatacactgtacagctgcacaaagatattttctttatatccttattctatgagcttttttctaattaaagtcttttttggggctgggtgcagtagcttatgcctgctaatctcagcattttgggaggccaaggtgggcagatcacttgagatcaagagtttgagaccatgacctcaaaaccccaactctactaaaaatataaaaattagccggacacggtggcgggcgcctgtaatcccagctactagggaggttgaggcaggagaatytcttgaacccgggaggcggaggttgcagtgagctgagatcatgccactgtactccagcctgggcagcaatgcgagactccctctcaaagaaaacaaaaacaaaaacatttttttttttacttcttaaacttttttgtttaaaacwataaaaatatagcaaatacataaaccagtaacatagtcatttcgttcattaaaaagtactataggccaggcgcggtggttcacgcctgtaatcccaacacattgggaggccgagacgggcagatcacctgaggtcaggagttcgagaccagcctggccaacatggtgaaacctctctactaaaaatacaaaacttacccgggcatggtggcggccgcctgtagtcccagctactcgggaggctgaggccagagaatcgcttgaagccaggaggtggaggttgcagtgagccgagattgtgccattgcaacccagcctgagagacaagatcaaaactgtctcaaaaaaaaaaaatactgcacataattctgtgtgatagacttctttgtatgactggcagtgcagtgggtggctccaccaatgccagcctctccttcccctgccccatgtggytgggtctgcagcckgctcggcctcccctctctcagaccgggggagctgagggggtgaggtagagacggcccaggggcagagcaggggggtcgggcttggtgcacagrcagactctgcctttgctacttcctgcctctctctctgtgaccctgacctcccttctcccctgtcccaggacctctgggaactgacactgtcctggccaggccccagcatctcacccaggcagcccagctagagccatctgtccctcttgccctccatctgtgttcctgtgtctcttcctcctgaacacaacctgagggcctcacaaatayttagttacatgaacgaagcaggccgggcacggtgactcacgccttcaatcccagcactttgggaggacgaggcaggcagatcacttgaggtcaggagtttgaaaatagcctggccaacgtggtgaaaccccatctctaccgaaaatacaaacattagtgggtgtggtggtacatgcctgtaatcccagctacttgggaggctgaggcaggagaatcgcttgagcacgggaggcggttgcagtgaacagagatcgcgcaactgcatgccagcctgggcgacggagcaagactccatctaaaaataaataaattttttaaaaaatggaaaaagcagaggagccagggacccggcatccctctggcacgggaatgggaagacagcagaagaatctgtgggggcagtttccggaacaccrgtctcaggtcatctgctgaggagtggggaagcccagctgtttaggtctggggaacatcaggtgccccacagtggctgtggcctctgccatagtgtagttcttccctcctccctccagctgagtcctgagatgccaagtaccagtcaggctgcctgcctttgctcacatgcattggcatccctctggaggccttgtgttctgatgtcacactaagaatcatgcatgttcactcactccgtgactgcataaaagttcatcctgaaatcaggctggtaatgagctgctgttcatgtgtrgtcttcatggggggaacccagtcatgtgctccacacttcaagacacgaaggggaagatgggaggcagtaagcttgaccttcctgcaggtgctgagccagctcatgggggctgaggaccagggctgggctttacctgcctctgaaggggcttggagcagaggcaggggaggtgraagaataggaacctggggcagtgtccttcccaggcaggaggacacagaagagcaggcccctgccaacatcaagttgaaacagctgtaaaagtggcctgggcacaaagctggcaactgaagataaggctcaggacacagcgagcggtcaccctgaggctctcctgggagcagggagtggctgtctccggccatggtccacaaaggcaccaaccactcccctttgcaggtgtgaagcagcagctggggacagttcagcccggcttaggcatgacctctgttttcatctgcctgcgaggcaccaaggaggacctgcatctgccgtccaccaactactatgtttactatgacacggacatggaccaggcgtaaggtgcacgtgtgtgtgtggcccgtgcctccctgcttgactcagagaacgagcagaagttatggaatgggaggaagtaggcaatttccaatttgcacctggaagtttgtcacaccaaggctgtggctcagcttcacccctgtggggagtccctagggacgagcagtccttgcagtggttctggggttttgaggacaaaagcctggagatcgcaccacactcttgtcacacgcaggatggagcgctacatctccatgcccagggaagaggctgcggaacacatccctcttctcttcttcgctttcccatcagccaaggatccgacctgggaggaccgattcccacggggggctgcacgtcctgggtgagggggtggagggagaggccgggcagtagtaatatcagctctgatccccaggccggtccaccatgatcatgctcatacccagcacctacgagtggtttgaggagtggcaggtggaactgaagggaaagtagggcagtgactatgagaccttcaaaaacttctttgtggaagcctctatgtcagtggtcctgaaactgttcccacagctggaggggaaggtagggggtaaagtatttggggtggtgacggacctcatggtgctatttctgccctttccttgagacaggggaattgggccccaagacatgagccccagggaaggacagggcacccaaccccggagtcagtgaatgggaaagagyggaagagggaggggagccaggatctcacatgcctgccccaccctttctgccctcaggtggagagtgtgactgcaggatccccactcaccaaccagttctatctggctgctccccgaggtgyctgctacrgggctgaccatgacctgggccgcctgcaccctygtgtgatggccttgaaggcccagagccccatcaccaacctctgacaggtatactcactgccccatgttgtcaggacctgagaccctgggcccctgtcgcccaacgtcctctgttcctgccctcaggccctgctgtcccctgcagcctcccatcccctgagcagggctgcctgggcaggctgtggcccctgtctgattggagccagctctgggtggccctcatgtggagggaagagcaccaaggccccaccctcccctgggcctgcctgggtgcacgctcaggggcctctgctcttgcctcctaggccaggatatcttcacctgtggactggtcggggccctgcaaggtgccctgctgtgcagcagcgccatcctgaagcggaacttgtactcagaccttaagaatcttgattctaggatccgggcacagaagaaaaagaattagttccatcagggaggagtcagaggaatttgcccaatggctggggcatctcccttgacttacccataatgtctttctgcattagttgctttcacgtatgaagcagtctaatttgggtctgatgcctgaagagaggcctagtttaaatcacaattcccgaatctggggcaatggaatcactgttttccagctggggcaggtgagatctttcccaccttctataatatgccatccctactaataggatattgacttggatagcttgatgtctcatgacgagcggcgtctgcatccctcacccatgcctcctaactcagtgatcaaagcgaatattccatctgtggacagaacccctggcagtgttgtcagctcaagctggtgggttcagttctgtcctgaggcttctgctctcattcacttagtgctacgctgcacagttctacactgtcaagggaaaagggagactaatgaggcttaactcaaaacctgggcatggttttggttgccattccataggtttggagagctctagatctcttttgtgctgggttcagtggctcttcaggggacaggaaatgcctgtgtctggccagtgtggttctggagctttggggtaacagcaggatccatcagttagtagggtgcatgtcagacgatcatacccaattcatatggaagtcccgggtctgtcttccttatcatcggggtggcatctggttctcgatgtgccagcatcaaggcaccttcagggagctcggtacccgagcctcaatcaagccttatcctccaaatatgcagggaaaggtgacacagggcagggaagggtgacgtcaggagtcagggcatcgactggtaagattacttcattgtgttgaggcaggctgcagggcattccacacaatggcacagcagaggacagcacagggaggcaacagagtgttcccagcaatggcccagctactgaaagcaacacaggcagccaggctgggaggagtcaggtggcaagagagttggtcaggagcagaacatggaaagccagagaaagtgtgcaaagcccagaaatggcatctgcaatttactggtacatgtgtgtgttggatggaaggtgaaggaaggctcaaaaggcataaaaaggacctttcacttatgttaaactgacatgccaaaggtcttattggagttcatcttaatataatattaataaatttattggccgagcgtggtggcttacacctgtaatcccagcactttgggaggccaaagtgggcggatcacgaagaagagattgagaccatcctggccaacatggtgaaaccccgtctccactaaaaatgcaaaaattagctgggcgtggtggcacgcacctgtagtcccagctactcgggaggctgaggcaggagaatcgcttgaacctgggaggcggaggttgcagtgagccaagatcataccactgcactccagcctggtgacagagcaagactctgtctcaaaaataaaataaaataaataaataaataaatgtattaaatccattgctttaacattttgaaatttattttggtttctgttcaacaaaaccaaaccacattgggatggcatttacagaagctcaraaaaacattatgcactgaaaaatacttctcattagaccacaacaagctttaaaaaaataaaattaagtaattatagttaagttacaaaaagctgaaagtataaaacattgtggaaacagtgaccatctattaactgggaaaacacaaaagaagagaaacaatttcaaccattaatcatttatcaaacatgaagtctggtgcattaaaggaatatctatcagagggtgaggggctggcttactggcagtttgacatactayacagctcagacccaaacccttcacagagagactctaagtgtacatctgacttgcakaactagacgagttgagtcactgttagctctggatataccgttaaattaaacctcaaaatctctccccaggactcttgctcaagcaagtcacgccaaatccaaccttcctaacaggggttttcagaaaatggcctgcagaagcacaggatctggtgcctcacagtttcctccatgctgcaatgctctagttctcatcacgcccatagcatctggcatcaggttaccctgtacagtcaacggccatagaagtcgccagcagggaaattccagaggtttagaattctatcagcacatgtgtcactggaagccatcatgggagtactatgtcagagcgtatgtaactagctgtcaggtctttccccgttgcctcagcctttctacacagactggccttcaacttcccctragtccagaagtagactctttcagcaactctattcaggaatctgcagcaggaaaactgcttcctctattaacatctatgactgaagcacagatgtgtctartagaaatcacccttcacccaaaagctgggcgcagaaagggaagcccttagctgactataggaggtgcctcttgtggctccacgtgcttcttacacaccaccccccagcttgagcgatgcctcagccagctcaccctcatycacacaatcgctagaaaacatgcttcaaatattctatctttgaaaagacaccatgcagaaaataagctttcctctgatgtgcggtattttcttcaatgctatttctttcttttttttttttttttttgagacggagtctcgctctattggcaggttggagttcagtggcacgatctcggctcactgcaacctccgcctcccggattcaagcaattctcctgcctcagcctatctagtagctgggactacaggtgcacgtcaccatgcccggctaatttttgyatttttattagagacggggtttcaccatgttggccaggatggtctcgatctcttgacctcgtgatccccccgcctcggcctcccaaagcgctgggattacagggggagccaccgcgcccggcctttcttcagtgcaatttytaaagagaaacttaaatcctgttgtattctttcaacacaagcaatgatacttctcagagtctgctcaaaagctcagctctgtggactccgtgacaaaatgtacgcgtccactgccgaccctcttggtttctgaaaccaacctttcttcctgctctcctctttaagagcaaaccccaacatgtataaggtcacagcaagtggtagccaggaaaagctgtgggacccctcatttgagtcacatccatatggcatggagaaagaaaacctctctgccagaaggaactgaactctggaagtcctaaggaaggtcaccatgmtcagcagataggaaagcattgccaagggctgtccctcaagagcttagttttcttagggagaccagaaagacatcagatcctgactgccctgttttgctcaagttctgaaatgagtggcatgatgaagagctggtggagctgagggaaagagtcaaccatgtggggtggggtagtgaggaaggtgtatgaggaaacaaactgggccctgacgaaacaggcggattggggaaggagaaagaaggaagggagagaaacctaaccaaagaaacatgggaagctggaaagtcgagggcacagccggaataaaggcacagatgggcaccccacaggaggggccttggccaggttgggatgcagagaaaaacaggcaggagggtgtcaatctatagcatcctgaaccccaaaaggtctgtaactggattctctaagccttgagaagttcasaccaaagcttcagaccagggaaaatattttggaaagatcagtctttccaagaktgagctcctttccaagaagctggacaggaaacccaataaatgtggatctgaaaaaacaaaatccaagagagaagcaaaatgggctgggggtgtgcaataagagaagcaaggaaaatggaaagactgtagctgaggatcttttattaaaaaaaaatggatgggactttggtgatgagagagaaaaagggcaaaagtctgcagttaggaatttaggtgaccgaagactgtcctagacagttgggagggacaggctgatggacagaagagagaaattcctttcaatgacaaccaagctgaactattcgataccagcagaactgggttctttagggattaagccaagacaaagacttgggaatcactcactccgaggatgaagaatgggttaatggctgaggagacagtcaaaggaatagagaggcctggctttgagggcctcttcaccaccagcacaagataaggcaaaggaccatttgtcagagacaccaagaaaggggaatttccatttggatggtcaatagtgtccagttctgycaaggacaagactaagctttgagaaaaagccatggatttggtgattggataactggtaacctttagaaaagtttagttgacagacagagaccgaagtgagttagtaaagtcatgaagagaatgaatggcaacttaagggaagcaacatactggagaagttgagcagcgggatgaataacaaataggacagatgggaacagaaaaatctgggtgcatacgaaggtggatggaaaggagctggtacagatgggcacaaccagaaaacatgaggaggggaaaggaagggaaaaggaaggcaggcagggagagagacgtgaaatagccacagtcttaggggatgctagagaagcctagaagattcctcaggttggtgcaaagtattataagactaacgcatcagtacagagaatgacccaagaagggtaggagttcattccttaccttcataaagtaggctatccgccaagaatgaaaatgtcaactcaaagctatgggctgttttaagcaaggtggaagataatataagaagcatggtcctttcttcagacttactgccttgacagcacagaattcatcttatttccctcatctcccaagttatttgtatttccctgagatcagctcagaaacaactctctttaggctctctacaatgcggtagagcatgattagaaragataaaccttcaaacaatagtgttgtccaagacactaccctcacttatcccaggggaacccacggaatttcttcatttgtattaactcctgacatggcatggaagaagaatttttatcaaatacccttggcatcttatatcagattaaaggaccattaaatacactgaggtaaaattggcagagagtatagtttctattaataaatctaagtctattttgtctgttttaggcaacaaaggcaaaatggactttgtgggaaatgtatctcataaaagccctttggaaaaactgcagaccaaaaccaaaaccctccttcatgttttctcgcatgaaacataaacttgccctatttcaaaaagttcctactgagtatgattgtgtgaaagatcacactacttcaaatcatatttattttaaaaatctgtgatgggacagtggcctcactgccaggaagcccaagttctgttttatgctcggtacaactaagtggaagttgattcactttgtctcaagctacataaaataatcagaaaatcaagaagatctcatgctagacaggttagacttgcacccaaaaaagcatctttttttttaacctgctgtttwggtttgctgctgaagtctttgaagagaattatgtattcaaagtagctctttgcccattggcatttccccatcttctatgtcttctgtagggcacatcccccccaaagtaagaggccttagtagaaaagcacttccacctgcagttttcccctaggtctgcagagagaaacagtgcagagtgcaatgccacagtcaaggaccaactttcctacagagcccgggccccagggagggtggtcagcagcgcagsctgcccaggctgggatctccctttggtcayagccgtgtttccatataccyctccactcaccctcagaggaggaacggatggaagccaccagcataaataaagggaacacagaagaacaatgtcaccaaagtgcaggtgcaaagcccaaagcagccccctacctctgccagcccagacccgccactaaattctagaggagggtgtctctcaggtcacagtacttttttcttcatttcttttgatttaraaacaaatcagcagggaggacaaggttctcaaggacaaaaaaatcaaagctgaaacgagagcagcacaatccattgrtgacgttcatctttttccagaggaatataccattctgttaggacttrggggaraaaagatcttttaggaggtgcagggaaaacattcagaattaagacatactgacccaccaccacagaaacagcaattaattaaaatagcacacaaaatgatttttaaagtttgaaatgaaacctaacactagaaagatatacacttgatggagagagaggaatcctggcttctgcttcatactgttctgtactgttgtgaattatttacatgtgttttttgttggtggtggttttcttcttttttgagacggagtcttgctctgttgcccaggctggagtgcagtggcatgatcttggctcactgcaacctctgcctccgaagttcaagcgattctcccacctcggcttcctcagtagtagctgggattaccatgcccagcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtgtggggctcacgcctgtaatcccagcactctgggaggctgaggtgggtggatcatttgaggtcagcagttcaagaccagcctggccaaaagggtgaaaccccatctctactaaaaatctaaaaattagctgggcgtggtggtgggcgcctgtaatcccacctactcgggaggctgaagagggagaactgcttgaacccgggtggtggaggttgcagtgagccaagattgtgccactgcactccagcctggacgacacagcaagactccgtctcaaaaacaaacaaacaaaaatcataaaagggggaaaacccttaaagtcaattatctgaaaaggcagtagtccagagctaaattgtaaagctagcctactggactagttagcaaagatattctgagctcagtggctcgttctgtagctaa

SEQ ID NO: 13490 - DNA, 65885 bp, Homo sapiens
ttcaagctatccttctacctcagcctctgatatagctgagacacaggccaatgccaccatgatgcctggcttttcttttttttttttttttttttacttttgagacagagtcttgctcagtcacccaggctggagtgcagtggtgcgatttcagctcactataacctccgcctcctgagtttaagcaattctcctgcctcagcctcctgagtagctgggattacagacatgcaccaccacacccagctaatttttgtatttgtagtagagatggggtttcaccatgttgkccaggctggtctcaaatgcctgaccttaagtgatctgctggcctcggcctcccaaagggctgggattaccggcgtragccaccgcccctcgaccatccagctttttttttttttttttcagtttttggtagaaatgtggtctcatgcctgtatcccagcactttgggaaggccgaggtgggcagatcacttgaggtcaggaattcgagactagcctgaccaacatggagaaaccccgtctctactaaaaatacaaaattagccgggcatggtggctcctgtctgtaatcccagctacttgggaggctgaggcaagagaatcacttgaacctggtaagcggggtttgcggtgagccaagatcgtgccattgcactccagcctgggcaacaagagtgaaattctgtctcaaaaaaataaaataaaataaaaatacaaaattagccaggcatggtggcacgcgcctgtaatcctagctactcaggaggctgaggcaggagaatcgcttgaacctggtaggcggaggttgcagtgagctgagattgtgccactgcaccccagcctaggagacaagagcaaaactctgtctgaaaaaaaaaaaaaaagaaatgtggtctcactatgttgcctaggctggtctcaaactcctggtctcaagggatcctcccacctcagcctcccaaagtgctgggattacaggcatgagccaccgctcccaaacagattagaggatgttttaaggaagactcaggaggttaccaagaaaaaagttcattcaaccaccacacttcctgatgtcccttatagagacatgtgaggagagttttgatgggtacatagaagctcacaagaataaaatgtatttgttcattcaatacaaggtcctctgatacttctcaaagagaatttgaagtggattttgaagaatatatagatgttaggccgggcrcagtggctcatgcctgtaatcctagcactttgggaggctgaggtgggtggatcgcctgaggtcaggagtttgagaccagcctggcaaacatggtgaaaccctgtctccactaaaaatacaaagattagccgggtgtggtggcaggtgcctgtaattccagctactcgggaggctgagcgcaggagaattgcttgaatccaggaggcggaggttgcagtgagccgagattgctccactgcacttcagcctggscaacagagctggacttttgtctcaaaaacaaaaaacaaaaaaacacaaatatatatatwtatatacttgtgtgtgtgcgtgtgtgtgtgtgtgtgtgtgttaaccayagaaaawctgcattcattcattcagtcagtccagtcagtcactcaataagcactccttcttgcccactgaggggttgttcaggaggcagttcagtgtaggaattctccagatggagcagcggatttgagacctctctggtggctctctccagcatgttcccacatgcccaacccaaccctggttcagggaacctctctttccccaggattccagtcaaagccccagggagggctctgataggctgagcttgggtcacatgtacaccttgaaccaatcacagtggctgaggtggataaacgagtctgagtcacatgtccaccccaggctggactaagggagaactttgaggcagagctgcccagagtcagaacaattggccattgcaggacatgagcttctcatcacttggggtgtgcaagctacagcctgaagttcacttagtgtaggactgccagataaaacacacgacttccccacccccattgacttctgccttctcagggaccttcagcccgaagagtggggagcttccctccatgtggccaagagaccctgatgcccctgaggggtcatctaaagagggtgttgaaggatgcataggagtttgccaggagaaaatctattcattcatttaacaaactcactcgtagtcattattcattaaataacatttaaattaaattcccagttaaattggaatttcagacaaccaacatattggtttgtgttttgttttgtcttgttttgttttgtttgagatggagtctcgctctgtcacccaggctggagtgcactggcactatctcagctcactgcaacctctgcctcccaggttcaagtgattctcctgcctcagccccccgagtagcggggattacaggcgtgccccattacgcccccttaatttttgtagttttagtagaracgcggtttcaccatgttgcccaggctggtctcaaactcctgacctcagatgatccacccacctcagcctcccaaagtgctgggattacagacatgagccagcacacacggccaacacattgttgtttaatgcaactatgtcccaagtactgaagggggcatacttacactgaaaaaacattcattgtttatggaaatttaaatttaactgggtgtttgctttggaaaacagcctggttgtcttttacaaatttaaaayatagagttgctgggcgcagtggctcatgcctgtaatcccagcacgttgggaagccaaggcaggaggatcgcttgagcccaagattttgagatcagcctgggtaacatggcgaaaccttgtctctacaaaaaatacaaaaaattagctgggcatggcggcatgtgcctgtagtctcagctactccgccctccagcctgggcgaaagagcaagaccctgtcccaaaacaaaacaaaacaacccaaaacatagagttacaccatatgaccccggaagtccattcctaggtaagtacccaagagaaccaaaatatatccacaaaggcagggggcggtagctcacacctgcaatcccagcctttcgggaggccaaggtggatggatcacttaaaggtcaggagttygagaccagcctggccaacatggtgaaacccccgtctctactaaaaatgcaaaaattagctgggagtggtggcgggtgtctgtaatcccagctactcaggaggctgaggcaggagaatcaattgaacctgggaggcagaggttgcagtgagccaagatcccgcgactgcactccagcctgggcatcagagcaacacttcatctcaaaataaataaataaagaaataaatctatgcaaaaagttgtatgccaatgtttatagcagctstattcagaatagctaccaaaaygtgaaaaaatccaagtgaccaccaacaaatgagtggatcaacaaaatgtacatgtacatatatacaatggaatattatttggtcatgaaacggaatgaagtactgatatttgccacaacatgggtgcatcttgaaagcatgatgctgaacgaagccagacacataaggccacatgttatgttttcatttttatgaaatatccagcacaggaaaattcatagaacaggaagcagattggtagttgccaggggctgagagagggggaatgaggactggctgctaataggtacagggtttcttttggggatgatacaaatgtcctggaatcagatcgtggtgatggttacacaactctgtgagtatgcttaaaacactgaatttattgcacactttaaaagcgtgaattttatggtatgtgaattatatgtcaatttttaaaattgtatgagaaaaacaagttttccctggcatcctgtatttttatttgctcaatctggccaccataacttgatgcaattctacagtacctcatggacagtcaggcccagtgacccttcctagggtcccctcgagcctgaaagcatactccagtgtccacactgtacagyggggcagccgaagacaactgcggctgcagagaaagtgcgagtcccagggaaagaaaaaatgcaggtgctaagccaggcacagtggctcatgcctgtagtcccagcgctttgggaggctgatgcaggagcatcacttgaggccaggagttcgagaccagcgcgggaaacatggcggtactccatctctacaaaaaaaacccaaaaaaattagccaggcatggtggcatgtgcctgtggtcccacctactctgggagctggggtatgggggctgaggcaggaagatcgcttgagcccgggaggtagaggctgcaatgagacaagattgcaccactgcactccagcctgggtgacagagagagaccctgtctcaaaaaaaaaatttttttttaaatgtgggtgctattttgggactttgggcttttctcagcctcagtttcccctcctgcaaaatggagtagaacaattatcttcaaatatctgtgagagatggtgtttatgagacacttagggcaaaaaggcaatcatcctcaaaaaagaaactgacaactgcagcggctacctgcttttgtaagtaaagttttattggcaccagggccaggattaaagggaggcaaacaaggctgagtggtgcaaggacaagggtctgatcatgtcttaagagttttagtgttttggccaggcaaaacaccaaaactctttggcctgcaatcccagaactttgggaggctaaggtgggtgaatcacctgaggccaggagttcragacaagcctggccaacatggtgagacctcatctctaccaaaaatacaaaaaatcagcctggtgtggtggtgggcacctgtagtcccagctactagggaggctgaggcaygagaatagcttgaacycaggaggcaggggttgccgagatcatgccactgcattctagtctgggcaacagagagactcgtctcataaattaaaaaaaaaaaaaaaaagttttggtgttttggccatatgcggtggctgacacctgtaatcccaacactttgggaggcctaggcagaaggatcttttgaggccaggagttcaagacsagcctgggcaacatagtgagatccccgtctctaaaaataaaataaaaaataaaagttttgatgttttgttcatcataaatgttttcattaattttatgtttttaaaatattatttctcttgatggctgagttttgtggggccaccttaaattttgcacaggggtgagatcctcactcgcctcaccctagaacccgttctgctgtgtgtactgggcacattttttgttgttgttttgtttttgtttttgagacagagtctcgctctgtcgcccagtctggagtgcagcggcgctatcccggctcactgtaacctccgcctcttggattcaagcgattctcctgcctcagtcttctgagtagctgggattacaggcgcgcgtcaccacccccaagtaattttttttttgttttgttttggttttttttgtttagtagagacagggtttcaccatgttggccagggtgatctcgaactcctgacctcaagtgatctgcccacctcggcctcccaaagtgctgggatacaggcgtgagccactgcgcccggccaatgcgctgggcatattgattaacctatcttagcctcagtttcttcatctgcaaaatggggctgaacgatgctgccttacttctgagaggattcatgcaaaatatttacttctgcgctctgctggaggggcggggccagckcgcccagtgggggcggggccctgtggtcgggctccccgggaggggcggggccaggccgtgtcagctgaccggcctggccaatggcacctggcggcggggcckggcaggccggggcggggccgggggcgggcctggcggcgcggactcccgggccatggacgagtcgagcctcctgcggcgccgcgggctccaggtgaggcccctgcgcgggcgggcggaaggcagagggcgcggccaagtggacgcggcctgaaaggtgccgggaggggcggggccttcacgggctgtagggaaactgaggcagagggtggggaacgctcagatcgcttctttttgaccacccgcttctcaaagtgctttttctcatggtgggaagggggaaggtgcccccttggacatctagggaaactgaggctccaagcgatggcgtgggaggaagaggctgagggctctgcccctccccaccagctgttctaataataatgctagcaacagcagccagagagctcaccatatgttcatggttgttttagtcctattactagcgatgtattaatatgagttcatatgtattaatacctccttgggtcgtcgctgcaccactgtacaccctcagctcagccctacgacgacctggggaggttggggctgtcaggcgcccatttgtcagaataaggaaactgaggctctagtcccggaaagccactctccagaggtcgcctagctgggattcgatctgcgccctcaaccagctctcttacggcacaaggcgctgccaaccagcagtgtgacctggggggagggcacccttgcttctctgggcctcagttttccaatgagccatagggtcctccttttactgagtttatgtttaggaggctgtgtcatcaggaggtagggacacaggcgtcggggacagcagaagcctaagtttgaagccacacagggactacatgaccccgggcagccaccctttgacttctctgggcctcagtgtccccattataagaaaagaaaaacaggaattaagatttggccattttcctctgggacttagaccacacccttaagaagccaccaagttttcaggtagggaacctgggattcagcacttacccaacgaacatttatggagcgcctgctgtgtgcctggctctggagaggcagcggagtgttctgcaacctctggagctgccctcctagaaaccccaacctgttgggggaggtagacgccagagcagcggtgaccccacggagtgatcagttgtgataagggactcacagcaagtgaaggaggcgcctgacccagtcattgctgggagccctggggtagaggaggcagccaagggtggcgaggcattgcagcggggggcggtatttagggaaatgaaagaggttgacagaagctggaacctagggaggactgagcaggtggggtgggggtcggggactgaggttagctccgggcgggttgagggggtgagaggaatggggccggcgggtctccaacctggagccgcaccggtagctgcgggactgcgaactcagcaggtgatgggaagccaggtcgggagtggtcagggaaggcacgggctgagctgcagatcagagacacccggtctctggccgcgcgggggtggggcagaactgraggcgctgaggccagaggcaagagtgggggacttgggcggaaaggagggggcggggcgggattggcgagcagcgtggtgttggtgggggggcagtcccgcctccagccccagttagatgccaacccgcccgcagcctcttaaaatagagaaaccgcctccgggtaggcgaatgggggtgctgctgacgtcaagaagtggggcctgttccatggtgggggggtcaaacatttcctgatggtaagttctatgttacaaaaggggaaactgaggttcagagaagcatagccactgtccgggtttcacaaagtataggtgacagagtcagacaggatttgaacccacgcagttccggcttcctctccaaaccaacccagcacaggcgtccctccacgaaggtggagggatgagcacggattccccgactgaatgagggcattccgggcagaggccacagcacgtgcaaaggcccagaggcatgtagcctttcttacctgtttatatggggaaacaagaacttgaacctatttcttagcactagaggctgatggccaggacttaatgcttccagggccttcagtgctgattttgaagaggttagactttccccctagggtgatggggagctatggaaggtgctggagcaggagaggacatgcccatattgaggggctgggaagactcctctggagggctaggagcaggagtgggggaatcaaaaagggcaggaagccaggaaggagcatggaatgaaagtctaagtgtaccaggtgtggtggctcatgactgtagtcccagctactcaaggaggctgaggcagaaggwtctctctctctctctyttttttttttttttgagaaagaatcatgctctgttacccaggctggagtccagtggcgcaatctcggctcactgcaacctccacctcccgggttcaagtaattctccctgcctcagcctcccgagtagctgggattacaggcacatgtcaccacgcccggctaatttttgtatttttagtagagacggggtttcrccatgttggccaggctggtatcaaactcctgayctcaggtgatccgcccacctcggcctcccaaagtgctagaattacargcgtgagccaccgcgcccagccaagaaggatctcttgagcccaggagtttgaggctatagtgagccatgatcacgagaccctatctcaaaaataaaaataaaggtccaagtggaagaagattaaaataataataaaataatagtaaagtgggaataaccgttcatattaacaggctaagccctctcatgcattcaattctcccaacagcccgagtggtcagtgctattattagttccacttttcaaaggaagaaactgaggcccaaagagggaagtacccaccaggaagccagagaaattctarccaatctggcacgtgaaggtgttgtcttcatcagccccagtttggggtctcttttgactggaaaccttgttaatggtccaggagcaccccagccaatcagggggtagatcgctgatgcgagccaatcagatttcctggaggccaaaggccaaagagtccattcacaaacgggtgctgaccggccaatccagacgcatagcccagggcgtcctctccggtggtgacaatgtgaggcgtgctgttggctgtgtgcaggaaaggtctgaaaaaggatccggcctggcccgcgggcggccagtttgcgacagccctgggtccagggaggaggtggagaccttcccaatttgggttaaactcagcctcacgcataacgtgtgcaggcaccgggtaacgtgagctgttattactactactactattatcttattacatttatcatctcctacttggacctttgctttacacatgaccgaatttcaaaacaccaggtcccacaaacagagcatcccccggcagagaagggctagagcctgtatctggacttttgtctctgccgctactggggtggctcctctaggttcagccctccaaggtgatcctgctttctcatggacagcttccacttattttcctcctcctcctcctcctcctccttctccttctcctcctcctcctcctcctcctggaagccctggggctggtgccatgtggtccatgctgacttctctcccatttaattccaggggcatcgaacttccaaccgggcttggtgcccagcaggctgagtctcacctccctttgcacgtgctgtttgctgggcatggactggtgttttccatgtgcctgcaggctttgtttgacaccccctactccaggaagccccttagctctcctctctgtgtgcctccaacccctcttctccctttgagtctctctttttttagacaggatcttgccctgtcgcccaggctggagtgcggtggcccaggctggagtgcagtggcgccatcttggctcactgcaggctccgtcacctggatacaagcgattctcacagcctcagcctcctgagtagctggattacaggcgagcgccaccacacccgactaatataatttttatattttttagtagagatggtgtttcaccatgttggccagaatggcctcaaactctttttttttttttttttttttttgagacggagtcttgctctgtcgcccaggctggagtgcagtggcgtgatctccgctcattccacctcccaggttcatgccattctcctgcctcagcctcccgagtagctgggactacaggctcctgccaccacacccggctaattttttgtatttttagcagagacgggctttcaccgtgttagccaggatggtctccatctgctgacttcgtgatcctcccrcctcggcctctcaaagtgctgagattacaggtgttagccactgcgcctggccttttttttttgaaacggagtttcactctttcgctcttcttgcccaggctggagtgcaatggcacgatctcggctcaccgcaacctctgcccccgagttcaagcgattctcctgcctcagcctcccaggtagctgggattacaggcatgcgccaccacatcctgctaattttgtatttttagtagagacggggtttctccatgttggtcaggctggtctcgaactcctgacctcaggtgatctgcctgcctcagcctcccaaagtcctgggattacaggcatgagccactgcgcccggccaccttttttttttttttttttgagacggagtctcattctgtcacccaggctggagtacaatggtgtggtctyggctcactgcaacctccgcctccsgggttcaagggattctcctgcctcggcctaccgagtagctgggactacaggcgcctgccaccacatccagctaatttttgtattttaagtagagacggggtttcactatgttggccaggctgatcttgaactcctgaccttgtgatccgcccaccttggcctcccagcgtgctgggattacaggcgtgagccaccgcacctggctcaaactcttgatcttaagtgatcctcccgcctcagcctcccaaagtgctgggattacaggcatgagccacagcacccagctgcttcgggtctctcttaatccctccagtatgggggtgctcctgctgtgctatgtcttctccaaaatgggatttcctcaaggtggggctaaagcttgttggggaggcagcatcccccagcctgggcaagcgcagacgggtataccataaatattacctttaaagggcagtttcagggggtcggggcctccccaacctccactcctctgggtgggaaccactcccaggggaacagcaggcacagagggagctgtgggtggaaagcagatggtgcggggaccgaagggtccgggagtggtgccaggagagttctgtgtggtccagcttccccgggagcctttgcagggagctgccgattttgcytcacctctctctgccactttaaaaaaacatcttcaggccaggcacagtggctcatgcctgtaatccagcgttttgggaggccgagatgggaggactgcttgaggtcaggaggtcaagaccagccwgaccaacatggtgaaatcctatctctactaaaaatacaaaatcagccaagcgtggtggtgggcgcctgtaatcccagcttacttgggaggctgaggcagaagaatcgcttgaacccaggaggtggaggttgcagtgagacaagatcgcaccattgccctccagcctgggcgacagagcaagtctccatctgaaaacaaacaaacaaacaaaatattcacatctttttgtcttttggaagcaactttcaactggtggttattattcacgtcttgatcattgtcttgactcccatccatccaagtytcccccagcaccaggctctgagcttgctactcattgattcctccagggaccctatgtcacygggccattttccaaatgagaaaactgaggcacagaggggttaagtcacttgtcgggtcacacagtgcaggagtgggggagccagactgggaacctaggactgtcagagttttggaaggaaatgcctggatggggtgcaagtgggaccccccaccagggttcaaatccctccctgtttcacgtggggtagtggaggaagtggtataagatcccacaactggctgggtgcagtggctcatgcctgtaatcccagcactttgggaggccaaggcaggtggatcacttgagaccaggagttcaagaccagcctgggcaacatggtgaaacctcatctctataaaaaatacaaaaattagccgggtgtggtggcacatgcccmcaatcccagctactctggaggcggaggttgcagtgagccaagattgcaccactgcattccagtctgggcgacatagccagacgctgtctcaaaaaaaaaaaaaaaaaaaaaaaaaaaaaaaawattcccacaactattggaaggggaagaaggagaccctaatggccacggtgatggtggtgatggttccatcaccatgactgcttgaactaaacgccgtgagttgtctgtcctcagacatattcaagcagtcagagagaccttcgaggggtagattattctcctcccatcgtgacagcttggttttctgagcgcagagcagctgaagtcaggcctggggtracgccacacccccgcgaccyttccccgcctctcccgggagaccttgccctcccagctgggtcatccggcagcccagcagcttccggccccctccaattggctgtaggggccgatggcgtcactggttgctatggcgaacacccagatcacgacgtgggcagcctggagcccaccaaagtaaaaatagtcgtgtgtccccaacgtggccgccctgatgtgtgtggagggagggtgtcctgagacccagtttcctgcctctcactccactaagagacgtgggcagccggctttcctctgcacctaagtttccctgccagtaaaacagcccctgcccgcggttcgtaggaggtggctcagtaaatgcaaggacatttaccaggtattatgacagcttccatggtcccttgctgagctcaacaatagtacaacagcacacaacagcagcaatagtaatggctgatcatgattaacccagaaccctcctcacgtcatctccagttacagatggggaaactgaggcacggggcatacaaataatttgcatggccaggaagaaacagagaattgaactggacccaggtctgggtgtccccagattctaaacttgtgccacatggcattttgagaatttaataaaccctcgtgattgaccgggtgcgatggcttacactgtaatcccagccctttgggaggctaaggtggatggatcacttgaggtcaggagttcgagaccagcctgggcaacatagtgaaacctcgtctctgctaaatatacaaaaattagccaggcatgctggcacacacctgtaaccccagttacttgggaggctgagtcaggagaatcgcttgaacccgagaggcagaggtttcagtgagccaagactgcaccactgcactccagcctggcgatacagtgagactccatctaaacaaacaaacaaacaaacaaaaaactggttttttggccaggcatggtggcttatgcctgtaatcccagcattttgtaatcccggcattttgggaggccaaagtgggtggatcatctgaggtcaggagttcaagactagcctgggtaacatggcaaaaccctgtctcttctaaaaaaaaaaaaaaaagtcccagctactctggaggttgaggcaggagaatcgcttgaacctgggagacagaggttgcagcgagccragattgtgtcattgcactccagcctgggcaacaagagcaaaagtctgtctcaaaaaaacaaaaacaacaacaaaaaaaaaccctcttgggcagcccatgtctgaggatggactgtgaggtcacagtggaacacaagctcasggctttctatccttcatgcggtgagggcacccagagttggtgcaggtcagtttgctgagctctaaaagggtcttcaaaagggagtcacccgtcagccgtcctccccacgcccccactggtacccagggcccaaacctgcataggctttgcagcgagtgaggagagaatggcgttcagacctagacccaggaggagagggacatctgagatgggacagggagaggacaactcaggaatctctgttttctcaacagattattagtttttagccactactgacatacttcttcataaatacaactaattggtaattttaaataaaattattattaattttttttagacttagagtcttgctctgtcacccagactagagtgcaatggtattatcatagttcactgcaacctccaactcctggggtcaagcaatcctcccacctcagtctcctgagtagctgggattgcaggcgtgcaacaccacacctggctaatttttttttcttttttgagacggaatctctcattgttgccaggctagagtgcaatggcaccatctcagctcactgcaagctcygcctcccaggttcaagcgatcctcccgagtagctggggctacaggtgtgcaataccacgcccagctaatttttgtatttttagtagagacagggtttcaccatgttggccaggatggtcttgatctcttgaccttgtgatctgcccgccttggcctcccaaagtactgggattacaggcatgagccaccgcacttggcccttcttatttatttatttatttatttatttatttatttatttatttatttttgagatggagtttcgctcttgtttcccaggctggagtgcaatggtgtgacctcggctcactgcaacctccgcctcccgggttcaagcgattctcctgccttagtctcccaagtagctggaattacaggcacccaccaccatgcctggctaattttgtatttttagtagagatggggtttcaccatgttggccaggctggtcttgaactcccgacctcaggtgatctgcccacctcagcctcccaaagctctgggattacaggtatgagccactgcgcctgaccggcccggcctttttttggagacagggctcaagcaatcctcccacctcagccccccaagtagctaggagtacaggcttgagccaccatgcccagcaatttttttttttttttttttttttttttttgtagagacggggtttcactctgttgcccaggctagtttcaaactcctgaactcaagtgatccatccgccttggcctcccaaagtgccagaattacaggygtgagccaccgcacccggcctactctggctaatttttttaaaaagttttgtagagatgtagtcttgctatgttgcccaatctggcttaaacttctgggctcaaacaaccctcctgctttggtctcccaaagtactgagatcacaggtgtgagccaccgtgcccagcctaaaatattttttaatgcaggtatggtaggagccgggtggggaattagactgtgaatctggagggcctccaggaagaaaggatgttgagttcaratctggagtatgagctgcagttaattagggccagaagggagggaaggctgttctgagagagcgcacagatagcgcaaaggccttgaggcagggctgagccagtgtgtagagtgagcgggaaagatgcattggttggggcatgggattggggattgtgggggtgcatcaacggccaggggttctgagggctagtctctctgagaatgatccccatttctgtctcattgcagaaggagctgagcctgccacgccgaggacgtgggtgagttcacctgggactggcgggctgggtgggccccagtggtcttggaagtggatatttcagcaacagccactgaattgtgaatgtatttaataattacagcaacacatctcatgttcattcttgccctcgtgtttgcaaagtgcttcacaagcacctggcctctcaccacaaacatgggaggccatgccagtttgcaaatgaggaagctgaggtgcaaaggggtttcatcaccagctaaggacactcagctgggaaggagagaaacttgtctggaatccagagtccagatgttgaatttcagctgaagtgtattagaactggcttgaatgcctctcatgacggggagctcacttccttttggggaacaccagcagaaaatcatctctcagctaggcacggtggctcccgcctgtaatcccagcactttggaaggctgaggcaggcagatcacttgaggccagaagttcragatcmgcctggccaacatggtgaaaccccgtctctactaaaaatacaaaaaaattaaccaggcgtggtggtgctcgcttgtaatcccaggtactcaggaggctgaggcaggagattcgcttgaagtgaggtgaagattgcagtgaaccaggctcccaccaccagacttcagtctgggcaacagagtgagactctgtctaaaaaaaaagaaaagaaaaaaatcatctctctcgggatcacatcagtgttcctgtaggttgggtttttttttttttgttttgctttgttttctttttgagacggggtccctctctctctgtcacccacatagtacagtgcagtagtgtcatcttggctcactgcaaccactgcctcccaggttcaagagagtctcccgcctcagcctccagagtagctgagactacacatgcgagcctccacacctgacttgtatgtttagtagagacagggtctcactatgttgcccaggctggtctcaaactcctggactcaagcgatctgcctgcctcaacctcccaaagtgctgggattacaggcatgagccaccatgcccagtctaggttaccattttttatccccaaatcttagagaacattattgttcaatgctttcattcatttacagatgaaagaaaccaaaggccggggtggggaggggttttccttgagctagtggtctggaagtgtgtgactgtggacaccccatctttgggagctgcttttgcctgagttgggggtgggaatcactcaatgaacatttttttgagcacctgctgtacactgggccctgctgaagccagaggggatacagacaattcaatctcagagcaatggttgaagttttgtactcaggagagagctcaaccagagaawgagacagaggtgctgggggtggctttatcctgaagatctggggcctcttggaggaagtgacctttgagcttagatctggaagaagaggaggagctggcagcggggaagtctggggagaatggcattccaagcagcaggaacagcttgggcaaagtttctggggtgccagtatgcttggcgttagaagaacagcatgaagacaagggtagctgagtggagtgagtggagatgaggtggcaggacagaaggaggaggtcctgggaatggggtcagagtggcccccaatcccaggccatctgcttctgttccagtggggatgatacagttggtggggaggtgcttgaaggccccagtggttgggggttgctgggggactgggacattgccccgagagccggcactgtttccagccttggcccaagctgtgggcagagtgttggaccgtgaatcaatgaggactgccgagggcaaagtcctggaccttggggcaggacagagccaaagactccacaagggatgwccactccctgccaccttccctgtgccccactgggtccaccggggcctcaagagggccagagtgagacacagacacccccagaccgtggggtttgcgctgagagggaggaaggacagagctggcggcgcctggtgctggtgggggtgcaggtacagcttggcggaggaggggctggtggggttgggatcgtatatgggtgagggggcgaccttcctggcagaggaaacagctggaagccagggactggaggtgtggtcagagcctctagtgtgcgcggggatgcggagacccgagcgggttaggacctcagtgctgagcagctggccgggatgcggggttggggagttggggcggactgcgctcagatcccggctcccagagagccccagggccggggcgagggcagaggccgggccggggcggggagaggcggggtcaggccatggagcaatcgcgcggaccgcggagccagtgaccgcccttcccttccggggcgcagctcgggggctcccaagccggcggcctcggcgtccctgcggcagacagggcggcacccgcggctcccctttcccgctgcgcgaccctcgctgccgggccgggcctgcgcgcaggtgcggagctgcgatccccgccccgaggcggagccagcccggcccccagcggcccagcccccgcgtctagtctgccgcaccagccaggcgtctgtccctgcgtccgtgtgtccgtccgtcrgtccgctcgcgccacgatcagggcttccgggggccaacaagggggcgtcggtaccccgccgcacagaggcggcctctgcctcggcatgaagtcccgcagggacaagctgcacatcccggcgctgaccctcgagtgagtgttgggcagggcgggggtatgcggggtgcagggaggacaggatgacaactaccctccccccacgtctctgttcgtgtcgcccagaaacgcaccgccgcctccggggagccctcccgggccatcggtctggccccgccctcacgtcctgagctgaacccagaatccccggtcttgggcccctactccctgagggaaccgcagccgccatccggagatccggattcggccacacgaaggggcggccgccaggttcaccgtccccggcctctttctttgcagtctgtctccgagcagccagagcccgtccctgctgggtcccagcagcccctgcagcccctgtagcccctccttgggcctgcacccctggaggtaagtgacagcgcgtgtgggcggggcgcagacatcgccctggcaccccagagccttggaaaccctccagactcatcggtctcctcaagatactgyaggttggtgacatcacctctctgggcctcagtttacccctccacataatggcactgcgatacgttctaggggcttaatgggaaaattccatttttagccaggccagcatctgacaggtggccaaggaaagggaagaacttaagctgttgcccaaggacttcgccaagacaggtgccggattcccaagcggctcagggcactccctgctgaattggcctggactcctgggtggtgacctcagggagaaagctcctccctytaaaacacacgcacacccaaggctgagaggccaccaacgagagccctgtgaattgagmttaaccraagtggcgccgggagaaaagaaccagggtgactgagcgctccctaaccctttcctgatccctacttcccagttaagaaaactgaggctcagagaggagatgccagttttcctgattcagtccatcccccgggggccaagcatcagggacagctttgctaccaggtctgttgagggttctactggccagttggttgactctgtgactggccaggtttcaggacaggaaggagttttgtgagctcctctcatggtttgggcaaaagtttagggagggacagatgtgaggtcaatggtgtctgttagagttatgtggcccatcaaccatttacactttagtatgaatgagctgcttaactctttccacagacttttttttttttttttttttttgaggcagagtcttgttctgtcccctaggctggagtgcagtggtgcaatctcagcttactgcaacctccacctcctgggttcaagcaattctcctgttgtagcctcccaagtagcagggactataggcacctaccaccacatccagctaatttttgtattttagtagagatggggtttcaccatgttggccaggctggtcgcaaacccctctgcctcagcctccccaagtgctgggattacaggcataagccacacgctgggccatccacagacctttaacggggagaagagagaacaatayagagcccacatttgggtgctgggcaacagggaggtaccttccttcagacgccaagcacttatgaggcacctactgagatccaggtgctaaaggcattgctataaagaaaacatagtccctccatcaatgacttctcagtcagcttagggaattcagtgataaaactaatggataaacaagatgtattcagacagggacctcttggggaggtgatgtttgagccaaggcctgggcacagctaaagaaagattggcaccaggcagtgggtactgcatgtgcaaaggtcctgtggcaggactgaggtggtgggttttttgtttttgttttttgagacagtctcactttgtcgcccaggttggactgcagtggcatgatctcggctcactgcaacctctgcctcccaggttcaagtgattctcctgtttcaggctccgagtagcggagactacaggcgtgccaccacgcccggctaattttttgtttgtttgtttgtttgtttgagaagggatcttgctctgttgcccaggctggagtccagtggtaccatcttggctcactgcaacctccgcctcctaggttcaggtgattctcctgcctcagcctcccaagtagctgggattacaggcacacaccaacactcccggctaatttttgtattttcagtaaagatggggtttcaccatgttrgctaggctggtctcgagctcccgacctcaagtgattctcccgccttggcctctcaaagtgctgggattacaggcatgaaccaccaagcctggcctaatgtttgtatttttagtagaggtggggtttcattatgttggccaggctggtcttgaactcctgacctcaggtgatccacccgccttggcttcccaaagtgctaggattataggcgtgagccactgcaccccgcctgagattttttttaagcctctgtgtctgccttggggggagaaagttctgctggggccaggaatggaggtggccagagagaaggaggtggctaggacaacatccaggaacaagtcgaggcatccactgagaatcagagactgccatcacccccatttagtgaagaaaacaggggcataggacctcagaatgtgttatcaggagcatcctaggaaggtttcgggccagatctgactctgtctaaatccttggcttccaccccaggtgaggacatgatgaagggagggacccgtgtgttggaggccgctgagcagatttgaccagttttaactgggaggggagggaggaagtatctgggactgagaaaggccrtaaggctgcctcactcaccaccggggggcagcagagccacattgccttgggcctggcgggggaatgggtccctgcctgccatgttccaagcatcctaggaataagctcataaacgtcccaacagagtccagcctctgcaactcccctgcctcctttttttttttgagacagtctcgctttgttgcccaggctggggtgcagtggtgtgatctctgcttactgccacctccgcctcctgggtcaagcgagtctcctgcctcagcctcctgagtagctgggattacaggcatgcaccactacactcagctaacatttgggtggttttttttgtttgtttgagacggagttttcctcttgttgcacaggctgcagtgaagtggcacgatcttggctcactgcaacctccgcctcctggattcaaatgattttcctgcctcagcctcgtgagtagctgggattacaggcatctgccaccactcctggctaattttttgtatttttagtagagatggggtttcaccatgttggccaggctggtctcaaactcctgacttcaggtgatccacccgccatggcctcccacaatgmtggaattacaagcgtgagccactgcgcctggcctgatctttatatttttagtagagacagggtttcaccatgttgaccaggctggtcttgaactcctgacctcaggtgatccacccgccttggcctcccacggtactggaattactggcatgagccattgtgcctggccttgcaacttccctgcttccatyctatccatctccccgtcgctcacttggctccagccacatggctgatcctccagaatgcaggctggtccagcctcagggcctttgcacttgctgtccccactgcccagagctctgttccctcctttcttcttccgtcacatcctcatcaaggcctcagcctcagataggaagccttccccaaccaccccctccttccaggccccacaaacatggggtataatatgcattatacctgtccatttccacatccagaccccagggattttctttttctttttttttttttttaagacagtcttgctctgttacccaggctggagtacagtggtgcgatatctcggctcactgcaacctttgcctcctgggttcaagtgattctcctgcctcagcctcgagagtagctgggattacagacatgcgccaccacgccctgctagttttgtatttttagtagagacagggtttcaccatgttggccaggctggtctcgaactcctgagttcaagcgatctgcccatctcagcctcccaaaatgttgggattacaggcataagccacggcacccagccaaccccagagatttaatttccacattgtcttgtgtgattatccagttatttttctcacccagaggtttgacagcctctccgagaccagaccttgtctgtcctggtcatatcgtagactcagggcaggcccagggtgtatacagcaggtgctcagttaatgcatgtggcttagatgaatgggcagtatctgggagggctgtccttgtggtagtgatagcattgggggttgggggtgttgttgaagaaggccatgagttgggcgctcataggcaaagtggctgttccaggcagcaacagcatcgtcagagacactttccttctggagcctcaaatcccaagggcaggaagaatgtggattttctacctagggcactaggagccatagagtgtggtgctgggagcggcacagatatatgggcaggtgggaagcgctggggtagtcccactaaaaagggaccgttgaacgggggtgtctgtatatctacctgagactttggcatttacagtcacagcacatgcagggagagtcaaatgccaatgtcacagagtttgtcagggacagggctaggatatgacccctgggagagggattcacccaggaatgcagttttgttttgctgtgagagcaatagggagccatggagggtttgtgagcagggggaagggcatgatctggggagcagtgggccgacaccagagatcagtggctcagccagcctttcatggaaggccttcaccgtggcagcaggccctctggattgtcagctgcagccctgttttgcagagggggaaactgaggacaaatgagcatgggagaaggttctctccctgctacagatgtcagggcagtgggtgtatgtaatagggggtgtgtaggtgttactgggtgtagctgtggctggggacgagggggcagcgcctttaccgagtgtgtgcaaaggtgtgtccccgtgcatatggggtggctcagcacgtagtgacagcaagtggagactgtggccccatccccacttgggtccccagaytcaagagaatctgcaccccgcatgaggcttgggctgcatacctgggggtcataggtgaccactcccatactcatcaccatctctggtggtctcaaaaccaccatctcccctggtctcaaaacaagtcccaaatccacccacttttctccacagcttcaatattcccctcccagacaccgtcccagacccttactggcctcctgctaccttcattcctgtcccccagcagtctgctccccatagcagacacaagggggtttacaaaygtagtccacatcataccctttctctgctcaagcaccctccatggctccccattgctcctacaatacaattgcactcctccctgcagcccacaaggcttatgtggtcagccccgctggcattttgccctcagtgctgcctcagagagttgtgccctttgcctgggacacgctttctgcatagccagctccttcctcctccatttctggctggctgcagcattacctcctctgagaggcctcctggctaaagtcgccccttgcagtgttctctcctttctcttcccttctcagccttggtatttgaaattatcttttttttttttttttttttttttgagacggagtctcgctctrtcacccaggctggagtgcattggtgtgatctcggcccactgcaacctccacctcccgggtacaagtgattctaccacctcagcctccagagcagctgggaatacaggcatgcaccaccatgcccagctatttcttttgtacttttatttcttttattttttatttttttttatttttttgagacagagtttcgctcttgttgcccaggatggagtgcaatggtgctatctcagctcactgcaacctccgcctcctgggttcaagcgattctcctgcctcagcctcccaagtagttgggattatagggacgtgccaccacgcccagctaattttgtattttttttagtagagactgggtttcaccttgttggccaggctggtctcaaactcctgacctcaggtgatccgcccgcttcggcctcccaaagtgctgggattacaggcgtgagccaccacgcccagccgaaattatcttgctcattgaattgtttcctgttggctgggcaaggtggctcacgcctgtaatcccggcactttgggaggccaaggcgggaggatcacctgaggtcaggagtttgagacgagcctggccaacatggtgaaactccgtctctactaaaaatacaaaaaaattagctgggcgtggtggtgcaacacctgtaatcccagcttctcgggaggctgagrcaggagaatcgyttgaacccrggaggcggaggctgcagtaagctgagactgcgccattgcattccagcctgggcaacgagagcgaaactctgtctcaaaaaaaaaaaatttgtctctttagctatgaagcctgggccccagcattgggcctggactgggtcccaaagtgtcctgtggcccaggaaggggcatccctcatgatgacactgcccctgacttrmctgggctgtcatgacaggaggaagcattaattcagtccttacggtgggagacacttctgcttccatagtgaacacatattgtaccctcagccctgttccaggctctgtgtctcagattttattctgttttcagtatgggggatgttacgcatggggaaacagaggcctggaagttagcctgatgctatcgtttatagagataaattatatatagatatggaacatataccaggtgcccttggaagcgcccccttacatctgatttgtgtaattctcatgtcagttcagttttcctccaatttcacagttgaggagactgaggctggagttcaatcaggtggctgcttcctaactgaggcagggctgatggcctttcccgccacacacagacagagcatgtcagacgccccgactcaatttgccaaacacaccctctatgccagtccggtgctgggagctgctgggaccctaaggagcccccarcctggggaagacatagccggacagacaggaaagcgggtttttcagaggagaggacgcagttttgccaggctagattccaagcagtggggccagggtgggcgtggtagcatgagccggccaggacgctggggtgggtcttgggtgccgcactgagaaggggtcagtgctctgggagagaggaaaaagatggagggagcgattagatttacattttagcagaaaggagccaaaatgcctgcccctagctcgaggttaaggtgctgccaacgccccgcccccgccgcccgcgrtcgtagcaacgcccggcctcagccgcccgcggccctagcaacgctccgcctctccgcccgcggccatggcagcgccccgcccactcgccggcacgcgggtccgccggcctcgcttccgcgtcgctcgctccgcctcccgacaggccccgcccccaacggccccgcccccgcactcgcctgggcggagttccagtcgcgctcgggggcgcgcgcttccttctcgccgcccccccatccccgcagccccgtgcgcccccctccctgtccggctccgcggggctcctggggccgatcccaccgccgaggcctcccttcccggcctcrggcggctgcggcggcacaaagggaagcagcatgtccgaccccagctactggacggcggtggcggctcccggccatcggagccgcytggcaaaaggcgcgctgctgcagcgctccaagaggtagggggcacggcgccggcgaaggctcggsggccagccgagcaaacaggagttgccagaagtgtgtcctggccgcgtggcgcggaccacggcgagcgtctgtctgtggcagcagtgggaaggggggaggacgcctgtggatcgaggtgtcccctggggtccctggcaccctcctttcgcccctcgttccctggactggggtgtctgtccgccagcgtcgcagctggggtggtgacagacaggagtgagttgagattgagctaggatttgaacccgggtgtccagggctgggcagaaccagggaggaacttcttggaaaaactgaggctgatctgccgctgggggtccattcagcagaaatgttggctcagaagcaaatatttactgcacgaggctggcatttgggtggggtgtcaggagtccagatagttggggttaacccccgccaaagcctcaccgctcttggagtctcagtttccccttttgaaaagcagagaggataagtgagggctgtggattctaccagacctgggttcaaatttcgactcagccactaccaggctgtgtgacctcaagtagctccttaacctctctgtgcttgggtttctcattggtgctggactggggcaaagtctgggcggtgggaccagctaccgaaagaccttgaatgctgagtccagggcttaaacttacctccaagatcgtggggagcattggagggggaatatgggtgccagagggatgaggtgcaggaggctggcttcaggcccctgctttctgccacattctctctgttgtgtcctgggtaccaagagaggatcgttctcaaatggcaacttctcsaggtcctggatctcctccaggaagagttgaacaaacagtcggccctgcatagatgcttgggaagtgaacagatgatgcttagttctcctttgaggcctcacatttggccgtgttttcaagaagacctcgcccaagaacaggagggagggcaacgaagtgtttttcccaaatgcttttggaagcagcaagtgatacagcaggatcggggagggagggtgctggtggtgcagtgtgggggcgaggaaccaggtgaggggctgggagaggatgtggagacagccaggtgagcgtgcattgaggggttggcaggaagttttgcagaaacctgtgggtttcacttttgcttctgcagctcaggctgggagamaatcactgtgactgttgacatctgtggcttcagtttcccagtctggaaaatgggctcagctggtcattcccaactctggggcttgttggaattggcagatgttggggatgtaattcactcaggaggcactggctgccctcccggcgtgagccaggccctgtgagcattgtctaggcaaagacaacagtgtatgtacccgagtccgacccaaagctgagcactggatgtggtaggtttyatccttcaaggtagagatgaggaaacaggctcaaggggcagccacatgtggagacgtagacaggctgggcctcttctccctgcccaccttgtcacctgtgtcctttgatgatcatacgcttgttctcccatggattgacctgctccgagcattctgcctgggaccccatttctgcacctcggaggccccgagacttcatctctccctccccgcgagattctcccgccgctgagctgcgttggcggcttggggtgtgtgggctgatgctcttgtggagcagagctgttgctgggcaactgctctggtggggcgggggacggtgtcgctcccaacttccttctgtcaaggtgtgggctgaggccagggcccaggtrggagaagaagccaggcagggtgtgagagacctgggccagggatctggtggccagaagggaactgggatggaaagaggaaaacgtgggcaaaagttcagcagaagaggcaggactgtgaaagaggttgcatttagggtttctagttgggtcacattggcattttaggggcatcttgagaagaaggagggttgtcaagagatgggagcaggggcttcaagaggggtatatagaatggggtgtctcagcccatatctgggctccagggtgtgtttggttcacctgatttgctggtgctgctggcagtagccatggtacagggaaaagtgtgggggtgggactgtgacacagaaccctgaaaagctggtccaggggctcctggccrtatgtagtgtcctccatcaggctagaagcacttcatgccattgctgttaataacaacactgccaatagtttgtgttkgtttttgttattgtttttcagatgaagtttcactcrtgtcgcccaggctggaatgcaatggcactatctcagcccactgcaacctccgcctcctgggttcaagtgattctctgccccagcctcctgagtagctgggattataagcatgcactaccacacctggctaatttttggtttttttgttttgttttgttttgttttgttttttgagacggagtttcactcttgttgcccaggctggagtgtaacggcacgatctcaccacaacctccacctcctgggttcaagcgattctcctgcctcagcctaccaagtagctgggattacaggcatgcatcaccacgcccagctaattttgtatttttagtacagaaagggttcctccctgttggtcaggctggtctcaaactcctgatctcaggtgatctacccayctcggcctcccaaagtactgggattacaggygtgagtcaccatgcccgacctaatttttgtgtttttagtagagacgggtttcaccatgtttaccaggatggtctcaaactcctgacctcaggtgatccgcatgcctcggcctcccaaagtgctgggattacagggatgagccactgtgcccagccttgtttttgtttttttaagagagagggccttgtgctgtcacctaggctggagtgctgtggcaccatcatggctcacggcagccttgacctcctgaggctcaagcgatcctcttgcctcagccttctgagtagctgggactacaggcgtgcaccaccacacccagctaatttttaaattttgtatagagacggggtcttgctatgttgcccaggctggtcttgaactcctggcttcagaggatcctcccaccttggcctyccaaagcactggggttactggcgtgagccaccatgcctggccagcagtagtgtcaataataaggaatgttagttgaggggtgattccctcctgggccttgaagacctggctaagggccatgggggaacccagctgggggcagagtgggagtggccatgtccaacatcccatccttctccagaacgggctgcgagtgtgatttaggctgggcaggtggcttagcgcggggccctgggcagccacctaccctgtccccttttcccccsacagctgccgcagcgggaaccgcaagagcttggtggtaggaacgccctccccgaccctctcccggcccctgtcgccattgtcggtcccaacgggtgagtgtgggagcagccagcgggtgctgtgtcctgcctctgccccgctgactcagtttccccgcctcctcctcagcaggcagcagccccttggatagtcctcggaatttctcggctgcctctgccctaaatttcccctttgcccggaggtgagtgattgccggctttggkagacagtgcgggcaccacgggcargggttgggcaggggcacgtgctcggtggctagacctggctcctcattcatttcattcaccttttcccctcccctggcccgtctggtggtggtctccccctctggctcccattcccggcaaatgcatgccatcttgcagccacatcccacgcatggacaggtaatttcaaccagcccagggggtggggggtcatggggggatatagccctaagaatcattaactcactaaagaaatcatkcattcattcacttaacaagagctgattgagcacctgtcatgtgccagacgcttgcatttcatttatttattcatacaacaacattcattaagcaccyactgtgtgtatgctctgtgctgcgggctgagggcatggtcgcaaatgggcagctggccctgagcccctggggagtcctccrtttggtggggggtggtcaatgtgtgccccagaagctacagctcagaggttgaagctttgacaggrgacacagtggcagctggastcacggggggggcttcctggaagaggtacctaaagagagagagcatgcagtggacttggtcagcctgtgtctctgttcttggttattttcaggagatccttcctacaacagggccagaatatgctggccacagtgtctgttcttagtccccacaaaccacaggggccaggccttccttccatctgttcttgttcccctctccagggcagacggcagaagatggtccctcgcgtctctcccatcttccggctatggaaccaacacacccagctccaccctctcggtacccatagccccaccttggcaggtggacaggcagatgccgggttgkggggggacacatctttgtgtgtttttttcaaggtgttggatagttgtgcrgtcagcaaacatactagttacttcctccatgcacgccccattctgggaaatgcagggtcccctgagaagacccagccttggccccaaaatagtccctggttggggagatacagatatcctcagcctatggggtcagggcctgaccagagggggacttggggctgcccaggggtacaggcagagaggacttcctggaggagagggcatcagagctagggttttgagggatgcataggagctaggcaggagaaaggatgttaccttctgatggccagcaggcagcctgggccttgaggggtggtgctgggttcctggccacagcactgacggtgaactcatggctytratccccaccactctctaccagtcaagctcatcctcccgggaacgtctccaccagcttcccttccagccgacgccggacgagctgcacttcctgtccaagcacttccgcagctcagagaatgtgcttgatgaggaaggcggccggtcaccccgcctccgaccccgctctcgcagtctcaggtgggccgcgacctctggccccagccccggcccctccctgggctggtgtggaggcccaagttgtggctcctccttcaccccagccctgaccctgcctgagcctagcctctgattcttgtccctcaaccctggctcagatcccccaacatcctcccctggggttggtctcaggtcccatatcacaagccagctgtcttcctttcagcccgggccgtgcaacggggaccttcgacaatgagattgtcatgatgaatcaygtgtaccgggagaggttccccaaggtgggcagcgcctggcggctggaccagcccctgcacttctttccacattgctgtccctccatggaactctgtcttcctggctatgtcccctttgccagtctkttcatttctgtctttccttcyccttccgttgaaagatgtcgttcctcctgcrccagccctcccacccgatcrccccattgccccatctcctctctccccaaccatgcctctcctgccccattctgcgtgtgtcactccagccccgccctctgaccaggtcgccccgtctcgccccacccaggccacagcacagatggagggccgtctgcaggagttcctgacggcctacgcgcccggcgcccggctggcgctggctgatggcgtcttgggcttcatccaccaccagatcgtcgagctggcccgagactgcttggccaagtctggcgagaacctcgtcacctcccgctacttcctagagatgcaggagaagctggagcggcttctgcaggatgtgcgtggtttttcgcatgttgaggttttgcatgcagtgggacgtggagtgaggggggtccccaggccagacggtgctgaggacctgtgggtgatgccacgacccacctcccccaggcccatgagcgttcggacagtgaggaggtcagcttcatcgtccagcttgtccggaaactgctgatcatcatctcacggccagctcggctgctggagtgtctggtaagtttctctttctacggccagcttggggtccaggcagaactgagattgggaccacaacagtcctgccaagatacaggtgacagttcccatcgtgtagggctttgagaggaacacagggtgctattgggctagcgtgggcttccctaaggaggcagcgggagtggagacccagkgggtgagctgggaagggtgctccaggcagagggaacagcatgtgcagaggcctgcaggtggaaccaagcccygggtgaccagccctcctgtgcccctaggagtttgaccctgaggaattttaccacctgctggaggcggctgagggccatgcgcgggagggccaaggcattaagactgaccttccacagtacatcattgggcagctgggcctggccaaggaccccctggagggtaagccgggatgggaagaggaaaccaaggctgggaaaggccggatggaggccaggcacggtggctcacacctttaatascagcactttgggaagctaaggcgggcagatcacttgaggccaggagttcgagaccagyctggccaacatggtggaaacccccccccytactaaaaatacaaarattagctaagtgtggtggcgcatgcctgtaatcccagctactcaggaggctgaggcacaagaattgcttgaactcaggagatggaggttgcagtgagctgagatcgcgccactgcrctccaacctgggcgacagagcgagaccctgtctcaaaaaaacaaaaaaagaaagggcagatgaagccaggattcaarcccaggcccatccgattccagaaccaccgcactgttctttgtctctctgtggccttgctcttaggtcacctgtgggaattatgctgagaccctctgatcttttggggcccaggggcctcagtgtcctcaaatgccacgttaagatggtcaggaagcctggggaccagtgttagcagtggccttccctttgtcctgcaaattcacaaatgactttaccaatttctgtggcctttactgtggcccagaaagtgaacttggagtcaaacaggacaacccgtaggtaagaagacggtcaaaaactcccacagccggccgggtgcggtggctcacgcctgtaatcccagcacttttgggaggccgaggtgggtggatcacaaggtcaggagttcaagaccagccaggacaacatggtgaaaccccatctctactaaagatacaaaaattarccgggtgtggtggcgtgtgcctgtaatcccagctactcgggaggctgaggcaggagaatcatttgaaccctggaggcggaggttgcagtgagccgagatcacaccacttcattccagcctgggcaacagggcaagactctgtctcaaaaaaaaaaacaaacaactcccacagccagccaggtgcagtggctcacgcctgtaatcccataatcccagcactttgtgagactgaggcgggtggatcacttraggtcaggaattcaagactagcctggccaatatgcagaaactccatctctactaaaaacaaatattagccgggtgtggtggcatgtgcctgtagatcccagctacttgggaggctgaggcaggagaatcgcttgaactcaggaggcagaggttgcagtgagccgagatcacgccactgtgctctagcctgggtgaaagagtgagcctacatttcaaaaaaaaaaagatgtagctgggtgtagtagtgygcgcctgtagtcccagctactcaggaggctaaggtgggaagatcgcttgagcttggcaggttgagactgcagtgagctatgatcacaccactgtcctccagcctgggtgacaaagccagaccctgtctcaaaaagagaaaaaaaaaaaatttccacaaatagccaggataagaggaactgaaagctggagcattgaacttggacctagcctggtccagcagtagccagggggaggctctgggaggaggcagtgttcaaactgaggcctggagggcaggaggtgaccaggttgcagatccaaaggaaagagtgaaacaggcagcataggcatagaccctaaggwtggaccatacctggagtgggactgacctgccactgtccccattgaaagctggggaggcccggcatggtagctcacacttgtaatcccagcactgtgggaggccaaggcaggaggatcacttgaagccaggagtttgagaccagcttgggcaacatactgagatctcgtctctattaaaaaaacaattagccaggcatgatsgcacatgcctatagtcctagctacttgcggggctgaagtgggaagactgcttgagcccaggggtttgaggctgcagtgagctatggtcgcacaactgcactccagcctgggygacatagcaagacyccatctctacaaaaagtaatttttttttttcttttttgagacagagtctcgctctctcgcccaggctggagtgcagtggcrcgatcttggctcactgcaagctcygcctcctgggttcacgccattctcctgcctcagcctcccgagtagctgggactacaggygcccgccaccacgcccggctaattttttgtatttttagtagaggcggggtttcactgtgttagccaggatggtctcgatctcctgacctcatgatccgcccgcctctgcctcccaaagtgctgggattacaggcgtgagccaccgcrcctggcctacaaaaagtatttttaaaaattagccaggcgtggcggtgaatgcctgtagtcccacctacttgagaggctgaggtgggaggattgcttgagtttaggagactgaagctgcagtgagccatgatggcaccactgcactccagcctrggtgacagagcaagagcctgtctctgaaataatcatacttggccgggtgcggtggctcacgcctgtaatcccagcactttgggaggccaaggcgggcagatcacctgaggtcaggagtttgagacgagcctggccaacatggtgaaaccctgtctctrctaaaaatacaaaaattaggctgggcgtagtggcttatacctgtaatcccagcactttgggaggccgaggcaggcggattacctgaggtcaggagttcaagaccagcctggccaatgtggtgaaaccccatctctactaaaaatacaaaagttagccaggtgtggtggcaggcgcctgtaatcccagccactcgggaggctgaggcaggagaatctcttcaactcaggtggtggaggttgcagtgagccaagatctcgccactgcactccagcctgggcracagagtgagactgcgtctcaaaaaataaaaatacaaatacaaaaattagctgggcatggtggcacacgcctgtaatcccgtctacttgggaggctgagacaggagaagcacttgaacccaagaggtggaggttgcagtgagctgagatcacaccactgcactccagcctgggtgacagagcgagcgactccatgtcaaataaataaattaaataatcatactaataaaaaataaagctgaggaaactgaggctccaggcagataaggctgagcagggaatcaaacccaggtgtacctaaggccagatcacatgtggtctgtggctggmccatgtttgccaggcattcgctaggggctgcccctctgccaaggcctggggcaagaacatattggaccctccacctgggctgcaccctgagctgaggaagatgttaggagctgacacccagggggcctgtgtctcatcccgtcttcacaggctcaaggctcagagcctaagtttgatcatgactgagcacttcagagccagggcagcccactggcccttctagaaggttcctaagtcattgcttcatccagcctcccggatgtggcttcatgacagtgtcatgagagctggtcaggggaggcactgcatccccagcctggggtgagaactctagaggcctcaggaaattgctgggtgatgcagggtgaggcagggaggctccagctgagcctcctccctcatcttgcagagatggtgccactgagtcacctcgaagaagaacagcccccagcacctgagtccccagaggtgagtagcagaggctgggggacccccgctcatcttgttctttccagagtggaccaggcacccgcagaaagggctgggtttgccgaggtcttgcatgtagcttaattagcatcggtgactttggaggcaaggtgacggcacgtgggactgccctgccttggaagtcgggtgggggcagtgctggaggggcactggacaggtgagttttgcaggacgtgtaagaatttcccaggaggagggcacagctgtgagcaaaaaagtacagaaagtcagaagctgagttggagaagtttggacaggggaggaggtagcatcgggcaccaggaccagtggtttgggcttgggggcaggagaagccttcccagctctgcagcggggcaggaccctaagcccttcccatcccctagagccgcgccctggtcggccagtcacggaggaagccatgcgaaagcgactttgagaccatcaaactcattagcaacggagcctatgggtgagtccctgagtcctgcatagacccatttcacagatgcctgaggggatggttgaggcccaggcagctcctgcatccccctcctaccccagcagggctcacacattcatccttgaatgggcagagaaggcacctgaggactggagggggaagtggagacacgccatagcgaggttacagcctcatgtgtgctctgtccacgagccaggcctttacctgccccaggtgtagggcgttctaggggcttgggggctgatcaaggaaatagatgcccacccagtgggagtagcacgcagtgagctttatttaggtgctgctttgaatggcaggcttgcatacaagggaagtccctcatagcataagccytttggaggctgaggttccaggagtcaccatcaagagggagaggccggcaagggaactccccgggcagagggggatcagagagggggcttacatgtctaggtgatgttgttcaacagcatgggcactcaatctctgggtcagagactccctgcagggtggtagcagcttagrgtcttgaaatccacaaagttcatcttatccatggctcagagatggtgcagtttcacgagtctgcaaagcagacaggctctcagtggctaaaattttgcttacttggtctgtgtgtaaaacaaacggatgtgtaaaactttgagtttggygctagcggtcttttaaaagagctagaccaggtgcggaggcactttgggaggccaaggtaggaggatcgcttgaggccaggagttcgagaccagcctgggcaacatggcaaaactccatcaatactaaaaatagaataattaactgggcgtaatggcacatgcctgtaattccagctacttgggaggctgaagttggaggatcacctgaacccaggaggcagaggttgcagtgagccgagatcaccccactgcactccagcctgggtgacacagtgagaccatctcaaaaaaaaaaaaaaarrgaaagaaagaaagaaagaaatacacaagcagccaggtgcagtggctctcgcctataatcccagcactttgggagcccgaagtgggagggtcacttgaggccaggagtttgagactagcctccacaacatagcgagaccccatctctacaaaaaatttaaacattagccaggttctgttgtgggaggatcatttgagccgggggggtggtaaagactatagtgagccgtgatctcatgactgtgctccagcctgggcaacagagtgaggcgctatctcaaaaaacataagataaaataaaaataaaagaaacatacaacctagaggccaatatacaagggccatgtgcagcccatttatatggcccccagccatggtggcttaaacccaaaggtggctgctctgggagggggaacaggtaaggagaatgggtggcccaggtggagggcacagcacaggcaaaggccaggcaggttgggatctgggctcaagttgagctgtagtgcctgctggggcctcgatctccggtcccagcaagcctggccctctgtccccagggccgtctacctggtgcggcaccgtgacacacggcagcgctttgccatcaagaagatcaacaaacagaacttgatcctgcgtaaccagatccagcaggtctttgtggagcgtgacattctcacctttgccgagaacccctttgtggtcagcatgttctgctcctttgagacccggcgccacctatgtatggtcatggaatacgtggaaggtacgctcactggggcttgcatgcctccagcgatggggagctcacccctccacgcctgggagaaaatttttagaccaagttgaggtctgttctgtcctccatgaggtctcaccctgctttggggaaccctcaggaaccccagtctggggtagggagcccagccatgggggtttagggctggaggagcccagacagragtgtgtgaggatgggaccctggaggcaagaggagggtggccatcctaggtggggggaactgatgggcagaggcctggagaccagaagtgaaggcagggagatgtatggttcaggcaggtaaagtactattaccaaagtactgccaggygagagagcgaacatgcacttaggagacaccagctgtatacrgcactaattgctgccctgtcggggagaatcagaaggcagggtctcagcttggcgcgctggctcacgcctgtagtcccagcactttgggaggccgaagtgggctgatcgcttgaggtcaggacttcgagaccagcctaagcaacatggcgaaacccccattcacgcctatagtcccagctactcgggaggctgaagcaggagattcgcttgaactctagaggcggagcttgcagtgagccgagactgcgccactgcactctagcctgggcaacagagcgggcaacagagtgagactctgtctcaaaaaaataawtaaaaatttaaaaaataggccaggcgcggtggccaacgcctgtaatctcagcactttgggaggccaaggctggtggatcacgaggtcaagagatcgagaccatcctgaccaacatagtgaagccccatctctactaagaatacaaaaattagctgggtgtggtggtgtgcgcctgtaatcccagctactckggaggctgrrgcaggagaytcgcttgaacccgggaggcggagsttgcagtgagccgagayygcgccactgcactcyagcctggcgacagagcgagactctctctcaaaaagaagaaaaaattaaaaaattaaaaataaatgaaggtagggtccgccccttccctctcccccgaccctccccgctgagatagaacaaactggggaccttttgcaggaggtaaagcgaggaggatgcataggcattgggcataacctaaggggcgggcsgggggygggggtgccccgggcctcatgactacatccgcccttctcccaggcggcgactgcgccacgctcctgaagaacatgggcccgctgcccgtggacatggcccgcctgtacttcgccgagacggtgttggcgctggagtacctgcataactatggcatcgtgcaccgtgacctcaaaccagacaagtgagctgagctagcatgagcggggcctcgcggagggcggggccagagaggatcaggggcggggccaaagaggatcagggcagagyctctgaggtgcatcccgggacccttcaggagccccatctgtctgagctctgttggtacctcctgacaggaaggcagggaatgagcgcatggtgaacatcttgtgtgtacagaggagaggagagcagacacttaataggcgtctgctgtatgcaggggaaggccggtgcacttatggaggtgctgccaatccaggggagaggatgtgcacttaggatgcacacactgtatacaggagaaggggctgcgcacccagagctgctgctgcacaaggggagagaacatgcacttataagacaccaactacacacacagaacaggattatgcaatttgcgagaccttacatgtaaagacagtgaccgtgcatgtcttgagcacctgctgtatattagtgcaggaaagcaaggaagagaacgtgtttactgagagccttaggatgtttattttattctggtaggtggtaagcacctactgcatgccagaccctctgtgggcaactgggagacacagggccacctgctttgaaacccctgtattattttctcctctgcatttattgagcgcctgctgtgtgcagggaaaaaggaatgcctgtttgtcaggtgtcctcgagatacgaggcaagaactgacatttctcacatacatgtgtggagatgtgaacatgagtgttaagagccttgcatgtaggccaggcttggtggctcacacctgtaatcccagcactttgggaggccaaggcgggcggatcacctgaggtcaggagttcaagcccagcctggccaacatagtgaaaccttgtctctactaaaaatacaaaaatcagctgggagtggtagcgcgcacttgtagtcccagctactcaggaggctgaggcaggagaatctcttgaacccggcggaggttgcaatgagccaagatcgtgccactgcacccaagcctgggcgacagagcgagactccatcttaaaaaaaaaaaaaagcgcctcgcatgttttcagggcattttgcagttggcaagtggcttagaaaacagacatgtatgtggcacctgctgtatacttgggcctgtgctcgatgctctaaggaactcagaagcatgaataactccttacacactaacgttgggtttctatatcacattttcttggttggcatgtacttgttaggcaccaggtgtatacaaaataggcagaagaacagttattaggcaatgactgtgtacctggcccagaacactttatctttatttatttatttattttttgagacagggacagtctttgtckccygggctggagtacagtggcgcagtcttggctcactgcaacctccgcctaccgggttcaagcaatattcctgcctcagcttcccgagtagctgggattacaggcatgcgccaccactacgcccagctaatttttttttttttttttttttttttgagacggggtctcactctgtcgccaggctggagtgcagtggtgcgatctcggctcactgcaacctcagagtccctggttcaagcgattctcctgcctcagccttccaattagctgggattacaggcatgcgccaccacgcccagataatttttgtatttttagtagagacggggtttcaccatgttggtcaggctggttttgaactcccgacctcaggtgatctgccggcttcggcctcccaaagtgctgggattacagttgtgagccactgcgcccggcaaatgaactcatttttaaaactctcacrcaagtacagtatatactgctgtttaggttttcctatggacttaaatatataaatgttttgctacatcatagtgtcttatgcaccagctgtatgaagtcgcatttccgtgcaccttctgggtgcatctgccacttaaaaatacattccagagaattcactgtgtataaccatcatttaatgaactatgtagtcagtacctcctgtttgctccagctctgtaaagaaacaattctgtgccggcactttgggaggccgaggcagrtgaactacctgagatcaggagttcaagaccagcctgaccaacacggcaaaaccccgtctctactaaaagtacactaaaaaaatatatatatatatacacacacacacatatacgcacacacagtagagaccaggcatgctggctcacacctgtcatgccagcactttcaaaggtgggaggattgcttgaggccagcaattcaagaccagcctgggcaacatagcaagaccttatgtctacaaaaaaaaccttagctgggtgtggtggtgtgcacctgtagttccagctacttgggaggctgagcaggaggatcgctagggcccaggagttggaggcagagctctgcccatctcaggcggagccaaggtctagggcagaaggggaggccaggcaccccagccccccagctctgagcacactcctaacctgcccacagtctgctcatcacctcgcttggccacatcaagctcacggacttcggcctgtccaagatcggcctcatgagcatggccaccaacctctatgagggccacatcgagaaggacgcccgagagttcatygacaagcaggtgggcgggcaggtgggtgggcagccccgggatgcctcctcctctctcctgggacctctcttgggctgggggctggcctcagtttccccgttctccctggcccaggtgtgtgggacgccggagtacatagcccccgaggtgatcttccgccagggctatgggaagccagtggactggtgggccatgggcgtcgtcctctatgagtttctggtgggctgcgtgcctttctttggagatacccccgaggaactcttcggtcaggtggtcagcggtgcgtttcctccaygggccygggtttgagctgcagccccaccagagctctgggcagcggtcctccacccgcatgtcagggagagaagcaggaagaggggagggagttggatgccaggtggggaggcggtggggtgctgagtgaggcgggtggctggattaattatagggtcacagaggcttcactgaagtgacttgtgaggctgggcacagtggcaaacacctgtaattccagcactttgggaggctgaggcgggaggatcatataaggtcaggagtttaagaccagcctggacaacatggtgaaaccccatctctactaaaaatacaaaaattagccgagcatggtggcgggcacctgtaatcccagctacttgggaggctgaggcaagagaatcacttgaacccaggaggcagaggttgcagtgagctgagattgtgccactgcactccagcctgrgtgacagagcgagactccatctcaaaaaataaaaaaaagaagtgacatgtgagcagagacctgcaagaacctgagaatgagagaaagccatagagacagaaaagagaaaggtggctctgagcatagggcacagctgtggsaaaggctgtcagtgggtaccaagcctgccacgttgcaggggcagaggaggccagtggcttggagtacagtgaagtgaggggaaatggtggatggtactagaaaggggtaccctgccttctccctccctccctcattttacctccctccctcattttagatgagatcatgtggccagagggagatgaggcccttccagcagacgcccaggacctcatcaccaggttgctccggcagagcccgctggaccgtctgggcactggtatgtagtgtgggggagaacccaggtgggtggctccttcaggccctgggacccagggaatggagggatagcgcccggggtagacaagagttctacttgggaagctgcatggaggagggggtttgcagctagggttttgaaggatgcacaggagttctccaggaactatcacaagaccttggaaagaatagaaagtagctgggtctggtgcccatatggagcactgagcctgaataagtrtgtgaggctgtaaagtcaccaggacctgtgtcaaaggcccagcccagaagatcccactgtcccagttttcccagccacctggttaatcattaagggaccgtttgagactcatgcagccacccatcacgtggccactatggctcctgttcatgactgaggctttgctatgggagacggttgggtccaaggtcggggatcatcacctgctctgtggagcagaagtgggagaagcccgggaaggaggccctcgtaaggctctgggctttctctaggcggtgtggtcccagatggcagcagagagaagggcagaatctttggaacctgggcagcctgggtgcttttttwtttttttgagattagatctcactctgtcactcaggctggagtgsagtwgcacaatcttggctcactgmaacctcygcctcccaggctcaagcgatcctcccacctcagcctcccgagtagccggaaccacaggcatgtgccatcatgcccggctaatttttatacttttggtagagacgaaattgagacgaaatttcaccatgttgcccaggctggtctcaaactcctgacctcaagtgatctgcccgcctcagcctcccaaagtgctggcattacaggcatgagccaccatgcctggctgctggcctgggtttgaatcctggcttcgtccctctccaggctcctaaatgacagcggatttttgttcccatttttctggttctttgttgttgttgttgttgttgttttttgagacagagtcttgctttgttgcccaggttggagtgcagtggtgctatctcagctcactgctgcaatctccacctcccaggttcgagcgattctcttgcctcagcctcccgagtagctgggaatacaggcaccagccaccacacccggctaatttttgtgtttttagaagagatggggttttgccatgctggccagactggtctygaactcctgacctcaggtgatcctcccttcttggcctcccaaagtgctgggattacaggtgtgagccactgcgcccggcccatttttctggttctgtgttgtccctactatgtgtccagcatgggcagtgggggtaggggggcatcctgtggcgggtgaggtgaggacctgcagggctcagcggggcatatctgcaggtggcacccacgaagtgaagcagcacccctttttcctggccctggactgggcagggcttctccgacacaaagccgagttcgtgccccagctcgaagcygaggatgataccagctactttgacagtaaggagggatccccctggagggggggcggggggtgctctgccatccctcagtccctgggggcagagggctgtgtgccaggcattccacccgagcttggcacctcaccttaggcctggagcttccgacttcctgagccttccaagaatctagggcgtgtgtcggccgccccctggctggatttcctgtgtgtctgggctcaggaggccacagcatccctcaggcttcagaaggagaaaccraggcaccaagtgtggcagacccttgtctggggttccccagcaagttgggcctcctgggtgtccgtccctgaccaggcatggggccccatctgttacccaggagggtagggcgcctagtgcagcttttttggaggcgtccctgcaggggcactgtaggtgagctctgaggaatgactctctctctccccacttggggttcctgcccttcagtgtccagcacctccttcagaacttgcttcatgtcagaggtcttctctgagcttctgtttcctcttctgtaaaatgaggaacatcctttatgttggagatgcacaattttggccaggcgcagtggctcaagcctttaatcccagaactttgggaggctgaggtgggcagatcacctgaggtcaggagttcgagaccaggctgcctgaccaacatggagaaaccccatctctactaaaaatacaaaaaattaggcaggcatggtggtacatgcctgtaatcccagctatttgggaggctgaggcacgagaattgcttgaacccaggaggtggaggttgcagtgagctgagatggcactaytgcactccagcttgcgcaacaagagcaaaactgcctgaaaaaaaaaaaaagatgcgcaattttacctaattctgtgtgacccatttcaaggaatcactgaagctcagaaataggaattcccgcccctggtcccacaacctgttttttttttttgagacggagtctcactctgtcgcccaggctggagtgcagtggcgcgatctcggcttactggaacttctacctcccggtttcaagcaattatctgcctcagcctcccgagtagtcgggattacaggtgcctgccaccatgcttggctaattggtcccacaactttttaattatttattttttgagatggagtcttgctctgtcacccaggctggagtgcagtggtgcgatttcgactcaccacaacctctgcctcccgggttcaagcgattctcctgcctcagcctcccaagtagctgggattacaggygcttaccactactgcccagctaatatttgtatttgtagtagagatggggtttcaccatgttggccaggctggtctcaaactcctgacctcaagtgagccacccaccttggcctctcaaagtgctgggattacaggcgtgagccaccgcacccggccccacaactttttagggacacagctggtgttgatccccagatatctgctctrccgcccaagcctcccgtggtccttaaacacaccaggcactgtcccacctcagagcctttgccctggcagtgaccctatcctgagatgccctccccgtattgccacaccgcccttgagatcatctctgggcatcaggcgtgctgcatgtgcctctccctcccacagcacgttcggaacgttaccgccatctgggctccgaggacgacgagaccaatgatgaagaatcgtccacagagatcccccagttctcctcctgctcccaccggttcagcaaggtgggcccgggtcccgaggggagccactgctcagaaaacattgcatgatgtctgtttgctttcgtatctgttttttgattttgctttgttttgttctgtagagatgaggtcttgctatgctgcccaggctggtctccaactcctgaactcaagtgatcctcccacctcagcctcccaaagtgctaggaattgtattggttttttgttttgttttgtttgagatggagtctcrctctgttgcccaggctggagtgcaatggcgcagtctcggctcaccgcaacctctgccttccaggttcaagcgattctcctgcctcagcctgccgagtagctgggattacaggcgcatgccgtcacgcccagctaatttttgtatttttaatagagatggggtttcaccatgttggccaggctggtctcaaactcctgacctcaggctatcctcctgcctcagcctcccaaagtgctgggattacaggcatgagccaccacacctggtcaaatttttttgtattttcagtagagatggtgtttcaccatgttggccaggctggtctcaaactcttgacctcatgatctgcccgcctcggcctcctaaagcgctgggattacagrcatgagccatcgcacccggccttgtatttttttattttgttttgttgttttaatttgcttttgttttagccattttkttttttyttttttttttttttgagacagagtctcgctctttygcccaggctggagtgcagtggcgygatctctgctcactgcaagctccgcctcccgggttcacgccattctcctgcctcagcctcccaagtagctgggattacaggtgcccgccaccacgcccggctaattttttgtattttcagtagagacggggtttcaccgtgttagccaggatggtctcgatctcctgacctcgtgatccacctgcctcggcctcccaaagtgctgggattacaggcgtgagccaccgygcccggcctgttttagccattttaaggcaatttccgaggcaggcggatcacttgaggtcaggagttcaagaccagcctgactaacatggtgaagccctgtctctactaaaaatacaaaaattagccaggcggtggtgggtgcctgtaaccccagctactcgggaggctgaggcaagagtattgcctgaaccccagaggtggaggctgcagtaagctgagatcacagcgctgcactccagcctgggcgacagagcgagactctgtctcaaaaaataatgataataataaagtgtacaatttcgtggcattcagcacattcataatgttgtgcaaccatcacctctatctagctctcaaatgtttgattcccccaaaaatttgtacccattagcaaccactccccatttgtcctccttcagcttccatctttatggatttgcctgttctgggcatttcatatcaatgcaattcacactatgtggccttttgggtctggcttctcttactcagcatcacgtactcaaggctcatccctactgcagtgtggaccagtgcttgcttcctttttatggctgagtaatattccatcatatggatggaacacattgtttatccacccatctttgatgcacatttgggtctattccaccttgtgaatacaggtaccattttagtttatttacttatttatttatttattgagatggagtcttgctctgttgccsaggctggagtgcartagtgcaatctcagctcactgcaacctccaccttctgggttcaagcgattctcctgcctcagcctcccgagtagctgggattacaggtgcgygccaccacacccggctaatttttgtatttttagtagcgaccaggtttcaccatgttgcccaggctggtctcaaactcctgtcctcaagcgatccgcctgcctcagcctcccaaagtcctgggattaaaggcatgaaccaccgcacctggccctggatgttattttataacctcacgagcttaacttacattccctactttttttatgatctgatcaaaaaatgctccactctgctttaggcctgggccccaggcaggactttctagtcaacagcaaaaacgcagcttggtagcctggcccctgagcctcagtttttccatctgtacaatgggctaaagtctatgctcttttagggatgtggggagtgaggatttagagaagtgactcatactgaagcaactggtacataggaatcactggactaagccagctttcttttttttttttttttttttttgaaacagagtctcgctctgtctcctaggctggagtgcagtggcacaatctcggctcactgcaacctccgccttctgggttcaagccattctyctgcctcagccttccaagtagctgggactacaggcatgtgccaccacrcccagctaatttttgtatttttagtagagacgggttttcaccatgttgaccaggctggtcttgaacgcctgacctcaagtgatccgcccacctcagcctcccagagtggtgggattacaggcataagtcaccaggcctggtctaagccagctttcttgccacctttgttactggtttttttgtttgggtttctttttttttctttttttgagacagggttttgctatgttgcccaggctggtctcaaactcctgggctcaagtgatcctcccagctgggcctctgaaagtgctgggattacaggcatgagccaccgcacccggcttaccattcttttgtcttgcctcccaggtctacagcagctctgagttcctggccgtccagcccactcctaccttcgctgaaaggagcttcagtgaagaccgggaggaggggtgggagcgcagcgaagtggactatggccgccggctgagtgctgacatccggtargtggcctggggaagtgtaggcagatccagcttccaagcctgctgggaggtagagacacaaaatctgatgcaaagggagcttcctagtggccaagtagaaaagggtcaaacatattgaccagcctatcaggtccctggcaaccttgctccctttggctctgtgttcctcaccatgcaaacataaaacagctgtgtaccatcatgctgctaggcacacttttccttctgtccagaatgccctttgcttactaactcctgttcatccttcaaagctcagacccaacagaaacagtcaatgtctgctagaggatgggtgttggaagctggccttttttttttttttttttttttgagacrgagtctcgctctgtcgcacaggctggagtgcagtggcgcaatctcggctcactgcaagctccgcctcccgggttcacgccattctcctgcctcagcctcccgagtagctgggactacaggcacctgccaccacacccggctaatttttatatttttagtagagacggggttttgccatgttagccaggatggtctcggtctcctgacctcgtgatccgccctcctcaacctcccaaagtgctaggattacaggcgtgagccaatgtgcccggccttttttttttttctttttttaagagactggttctcactctgtctcccagactggagtgcagtggcacgatcatagctcacttcagcctcagactcctgggctcaagagatcctctcaagtagctgggactacaggcgtgcaccacggcacccggctaattttttaagcaattttttgtaggccaggtgcagtgacttacacctgtaatcccaacactttgggaagccgaggcaggtggattacctgaggtcaggagttcaagaccagcctggtcaacatggcaaaaccccatctctactaaaactccaaaaatttagccgggcatagtggtgcacgcctgtaatcccagctacttgggaggcttaggcacgagaattgcttgaccctgggaggyggaggttacagtgagccaagatcgtgccactgcactccggccggggtgacagagcgagactctgtctcaaaaaaaaaaacaaaacaaaaaacaaaaaattgcagagatggggtctccttatgttgcccrccctggtctcgaactcctggcctcaaacaatcctcctgtctcagcctcccaaagtgctggaattataggtgtcagccactgcacccagcctggaagctgggttttaaaagttgaataggaagccgggtgcagtggctcacgcctgtaatcccagcactttgggaccccaaggcaggcaggtcacttgagctcaggaattcaagaccagtctggccaacatggtgtaaccccgtctctactaaaaatacaaaaattagcccagtgtggcggcaggcacccataatcccagctacttgggaggctgaggcaggagactcacttgagccctggaggcagtggttgtagtgagctgagattgcaccactgcacttcagcctgggtgacagagtgagaccctgtctttaaaaaaaaaggtgaataagcggtctccaggtggacagagaggacagtgcagacagaaggaactcgtcctgtctatgcaaattacccttgactgcagactgagagttaagatgtggccatgaaggtggctgagtatcctggggtgcaggtgcctggcaggggtgatgcaggctcttcctccctgcaggctgaggtcctggacatcctctggatcctcctgtcagtcatcttcgtcccagcccgagcggggtcccagcccatctctcctgaatacyatcagcctggacacaatgcccaagtttgccttctcatcagaggatgagggggtaggcccaggccctgcaggccccaagaggcccgtcttcattctaggggagcctgaccccccaccagcggccaccccagtgatgcccaagccctcgagcctttctggtaagtggggccctgagtaagagggatgatgtcatggaagtttcccagaggaggggctrtttgagatgggttttcaaggatgagtaggagttctccagagccaacaaaggctttaagagaggagaagccagggtcccagagagacccccagcccccaaggaaccccagtctagggtaaatgcccccagcttcatagagtcaggatgggacccctagctcccaagatgggggaactaagggtctaaatgggtgtggaggaaggcttcctggaggaggggacttgaagacttttgcatagagaataatttgggaagggagtgcaggaagagggaactgcatgagcaaaggccaggaggctggactgtgtaaatagtgaccagggaggaagggccttaaggtccctttaggaccacatggtgagtttgaggggcacccagctgaccctgctgaccctctagccgacacagctgctctcagccacgcccgcctacggagcaatagcatcggcgcccgacactccacaccaaggcctctggatgccrgccggggccgccgccttgggggcccaagagacccagcccctgagaagtccagagcctcctccagcggtggcagtggtggcggcagtgggggccgcgtgcccaagtcagcctctgtctctgccctgtccctcatcatcacggcaggtaatgcccaaggcccctctcacctttgtctgtctgcacccattttcaccaacagggtgggggcccttcctgagttggggaggctggggrtgagccccagaagaggggaggaggagtaggacacatggagagctggggagatggtgttcccagtagagggcactgcacgtgcaaaggcctggtggggtgaccatgcttgggacattgaagcaacagcaaagtggccagggtggtcgttgtggtgggaaagagggggccccaggggagacctgtgagggagtgagtgaccccctccctaaccccctgcagatgatggcagcggcggccccctcatgagccccctttccccgcgctctctgtcctcgaacccgtcgtcccgtgaytcttcgccgagccgagacccgtcccccgtgtgtggcagcctgcggccccccatcgttatccacagctctggcaagaagtacggcttcagcctgcgggcgatccgcgtctacatgggtgatagcgacgtctacactgtgcaccacgtcgtctgggtgagtgccgagtgggaatggcagggacccgggttctagtttgactctgcccggtcatgtcccttctcagagctgcattttggagcctggcagggttaggtagatagagctggtgccaccgagttcatctcggtccctgtcatttggcagggaggaggtcagatgagagagacaaggatggatggatggaagctcacagatcccaagtggcattaacctcccagctccatatggggacgcactgggcatgttatcctccctctcccagcccaagggcgtcgaggcatgccctccctattggttgctccctgaacagacacagaaggctttctggagaagggggcgtaggagctggggctttgatgggtgagtaggagttccccaggatcagggaaactgagacagcacaagaggcagcagcttgctggggtcccacagcagacccagcctgggctggggtccccagatgtggggcccaggccattgaccccaccgttctcgtctgcccccagagtgtggaggacggaagccccgcccaggaggcgggcctgcgggctggggacctcatcacccacatcaacggggagtcagtgctggggctggtgcacatggacgtcgtggagctgctgctgaaggtgcggcacccccactgcccaccctcagggctccccagcaccccttggccgcagctcccggttccccgtggttctccgcgtccagacacacaaccccacattcaatgtcaactccaggcctggcacatccacttccttcggcccagaatacatgtccttcttcagcccccaacatcaccccttagagctgctcctccaggaagccctcccttctccctgggcaccctcacatctgttcctccctctggcctgaggcctggaggtaggagatgggctcaagacaggaggaagggccgggcgcggtggcacacgcctgtaatcccagcactttgggaggccgaggcaggatgatcacctgagctcaggactttgagaccagcctgggcaacagagcgagacccccatctctgcaaaaaattaaaaaataaaattagctaggcatggtggcatgcgcctatagtcctaggtacttaggagtctgaggtgagaggatcgcttgggccgaggaggttgaggccatagtgagctgtgatcgtgccatactgcactccagcctgggacacagagtgagaccctccctggttctaaaaaaatagagggctctcatgtgggcagctgcatgggtggttcattgaatagctggacactgggtaggtgtctttggcctaatgactcatgggccattaggtgagtgattgggggatggggagatgttggggtgattaatgggtggataccagataggtgggtgacagaccccgggagggtggagagtgaagagggcaggcctcgatcggcgttgaccgcagagggaaggatcttagcaggaggggtggtgctccctgggctattgtttgaccggatatattgggtaggtcactggttgtgtggatgaatggatgctggggtggtgggtcccagctggtgcccggagtgaaggggacatagcagctgcctggcaagtgctgggccctgtgagaggcacagaggcaacccctcaccatccctcccgcagagcggcaacaagatatccctgcggaccacagccctggagaacacctccatcaaggtgggycccgcccggaagaatgtggccaagggccgcatggcacgcaggagcaagaggagccgtcggcgggagacccaggatcggtgcgcggcagtgaccaccagggagcggtacacagggggcggggccayggggactggggttctttttttcttttctttttcctttttttttttttttttttgagacagagtcttgctctgttgcccaggctggagtgcagtggctcaatctcggctcmctgcaacctccacctcccgggttcaagcgactgtcctgcctcagccccctaagtaactgggactacggcgtgcaccatcatgcccagctaatttttatattttcagtagagacagggtttcgccatgttggccaggctggtctcgaactcctgaccttaaatgatccatctgcctcggcctctgaaagtgctgggattacaggtgtgagccaccatgcctggccaggagcaggggttctgaagcctccggttttcttaccccaggcggaagtcacttttcaagaagatctccaagcagacctccgtgctgcacaccagccgcagcttctcctccggactccaccactcactgtcatccagtgagagcctccccggctcgcccacccacagcctctcccccagccccaccactccctgccgaagcccagcccctgatgtcccagcaggtgggtgcaccccgaccccccaccrccccggctaccctgggagcaagggctggtgggccccaggagggaggaaggagytcaggggatggaatgacacgatgtagggaaaaagatgaccgggatcctggtgtctagcagggaacctgggagtacttagagacgartgcaggtgccagggaaggatgcacccagcagaggaaacatcatggacaaatggggctagacaggagggtgggaaaactgagaagaggccaggcrcggaggctyacgcctgtaatcccaacactttgggagcccgaggcaggaggatcactgagcccaggagtttgagaccagcctgggcaacacagggagaccccatctgtacaaaacataaaaaaattaggtgggtgtgaggccgggcatggaggctcacacctgtaatcccagcactttgggaggccgaggcaggtggatcacctgaggtcgggagttcaagaccagcctggccaacatggagaaaccccgtctgtactaaaaatacaaaatcagccaggtgtggtggcacatgcctgtagtcccagctactagggaggctgaggcaggagaatcgcttgaacccaggaggtggaggttgcggtgagccgagattgagccattgcactccagcctgggcaacaagagcaaaactccatctcaaaaaaaaaaattaggtggttgtggtggtgcacacatgtggtcccagctactctggaggctgagatgggaggctcacttgagcccaggaggtcaaggctgcagtgagccatgattgcaccactgcactccagcctaggcaacagagtgagaccccatctcaaaaaacaaaagggaaaaaaaaaaagaaaacagaagtgatacagagaaggctttctggaggagggggagtaggagctggggctttgatgggtgagtgggagttcaccagagctaggccaaggaaacaaccctgagcaggaggcagaaaagtctggcatgaaccaggcatgatggctcatgcctgtaatcccagcactttgggaggccaaagcaggcggatcacttgaggtcaggagtttgagaccagcctggccaacatggtgaaaccccaactctactaaaaatacaaaaattagccagrtgtggtggcacatgcctgtagtcccagttacttagggggccgaggcacgagaatcatttcaacctgggaggtgaaggttgcagtgagccaagatcatgccactgcactccagcctgggtgacagagcgagactctattgaaaaaaaaaaaaattagccagccatggtgacgtgcacctgttgtcccagctactcaggaggctgagttgtgaggatcacttcagcccaggaggttgaggctatgattgagccagtgcactacagtctgggcaacagagcaagaccctgtctcaaaaacaaaaacaaccaggcatgatgggtggccacatggaaggatgtgggctttagcagtttttgtcagtcccacagctccacttctgggctggggacattgaggccagcagccctgacctacgcttatcacccacagataccactgcatccccacccagcgcatccccgagctccagcagccccgcctccccagctgctgctggccacacccgccccagctccctgcacggcctggctgccaagcttgggccaccccgccccaagactggccgccgcaagtccaccagcagcatcccgccctccccgctggcctgcccgcccatctccgcgcccccaccccgctcgccctcgcccctgcccgggcacccgcccgcacctgcccgatccccgcggctgcgccggggccagtcagctgacaagctgggcacaggggagcggctggatggggaggcggggcggcgcactcgtgggccagaggccgagctcgtggtcatgcggcggctgcacctgtccgagcgccgagactccttcaagaagcaggaggccgtgcaggaggttagcttcgatgagccgcaggaggaggccactgggctgcccacctcagtgccacagatcgccgtggagggcgaggaagccgtgccagtagctctcgggcccaccggaagagactgatcccctgccaggtctctccctggcatcaaagttacgcgttttcttgtgcaatgttttttccgtaaagtcatgcctggatggggactgagccaccagcctgacacccagaaggcgagaagccatctcggtccttgctggaaggtggagacatcgcttgtgttctggtgtcaatcagggggctggatggggcaagaatgggggacaagggtggctttgtaaatagcagcaaatccctgcaactaatttattactttttyttttttttttttttttttgagacagagtctcactctgttgcccgggctggagtgcagcggcgtgatctcagctcactgcaacctccgcctcccaagttcaagcgattgtcctgcctcagcttcccaagtggctgggattacaggcgcccaccactatgcccagctaattttttgtatttttagtacagacggggtttcaccatgttggtcaggctggtctcgaactcctgacctcatgatttgcctgcctttgcctcccaaagtgctgggattacaggcgtgagccactgggcccagcctaatttattactttttataagcgatagccgtactgagccgccccctgaaggcggctgccaggtcttgccccaggcacctgggactctgtttgcaggccctgccctctgggctgagaaggatgcactttggacaagtcatctgtgtttgtgttttccagtttttctgtactttttaagtgttttgtgttacctggtctcattcccctccccacacctacccatttgaggggatggagttgaagtcacctggtcacctgtaccggcccagttcggctacaacctggagtgtccgtaaacaattcctctcacccacaaaacaatgtaatcccagcgatggactggattctgaaggccacttcccaccatcatagctgccatgcccaggcagtgcctgctctatatatagagtctgcctccaatcctgctggcttcagcctggagaagggatatgggagctggagctttgatggatgaataggtgttcaccggatctgggcagaggggtcatccgctccccaggtgggcactgataaaggaaggtacaggcctcacctggaactgccaaggcagcctccagaaatgctcggctgtctcggggcacgctccagtatgccagtcctgcgggattacgtccagctacttccagaaacactcagtgtcccctcccctcaggctctgccttggcctggccttgtccagtctaccctggacaagatgccgtgtgtttgaggcccagcagagtaagcccttggccgtgatgtgtctgaaacacctgttaggggttccctccatatgtcagagcctctctgggatgaagttcaagccagaaaacccagtcgaggctcaagtttgaatttcagcttcactgtgtggctctgggaaaatggctttcccactctgtgcctcagtttccttgtgtttacaagactaatcccattgactgtttattaagcacctactgtgtgccaagcgcttttacgtggcttctccctcagccagccttgagaaggctggaggtggtgtcatcacctccattttacagacaaagcagctgagaccccagcgaggggcggagacctgtcccacgatcacccagcaggagtcgtggcagaacggagcatcagccagaccctgttgtgggcgttgtcatcaagggagcttgaatggagggtctggtgtcagatacagccgactccagccccagctcatcccccatgatgctgtgtgacccactgggcactctggtgagggagctttccagacatcaacagcccactctgcttccctttytgagtcccctgtccagcactgcctagtgttggagggtagaccaaggctgtgcatgattcaccccctccttccatcctggagctggcagtgaataaaagcccgtatttacaaagatgagctccaacgtctggatttgtgaggggctgagaaaggaggaagggaagagtggggaggggagcggagtgaaatagacccatggctcaaagtcattgcaagtgggttttgaggactgcatagcagttcgctgttgagattcttcctgatgccatcgctggtaccagcctsctgctaccctctccctgcgagtactccatcatagccctgcctttaaaagcttcctccagacatctgggccctgagctatgttttttatttttatgtttttgagacaaggtctcgctctgtaacccaggttggagtacagtggcgcaatcacggcacattgcagcctcgacctcctgggcgccctgggctatgttaataaaataaataagcggcggggcgcggtggctcacgcctgtaatcccagcactttggaaggccaaggcgggcggatctcctgaggtcgggagttccaaaccaccctgaccaacatggagaaaccccgtctctactaaaaatacaaaattagccgggcgtggtggcgcatgcctgtaatcccagctgctcgggaggctgaggcaggagaatcgcttgaactcgggaggtggaggttgcggcgagccgagatagcgccattgcactccagcctgggcaacaagagcgaaactccgtctcaaaaaataataayaaaataagcaatcgtcgcgtcctttctatcctggtcttagcttgcgctctgccataaaactccctctagccgaacccggcccagccctagagcaatccgttacttccggggcgctcagccggcatgcaaacactcttggctacagccccatctccgagtgcgttcggctatttccggaaaccgtcggcatctaggctcaagtccgctaaattctagtgcccgtaggggtcgagatcgttggctgtttccggacgctctgggttgccatggaaactccttcaaccctggctttctccgacttctgctttttgcggcaggccctttccccactctactgccccctgtttgctgagcttgagaacgcctcatttgtcccctggaaccatctatgcttcagtaattcccataagctggcggtcgcctctgggtctaaactcccaaggcctccattgggcactgagcacattcggttatttccagaaacgctccgcggtcttggggatcagcctcagttgtgccagtgcggcsgtagagagtgttcggccatttccgaaagcgctcgggcgtctctaagcccagccgagcccagtctcggatccctcgccgacccgattgcactcggctacctctggaaacgctcggctgtctcgggggcaccctctagtccaccagtcccgcgggattacgttcggctayttccggaaacactcgggtgcccccttacctcaggctccgcctcggcctcggttcatccgcccggctcgaatgcgctcgggcatttccgccgggggcgggccaggccgctcggaaccgtggcggcggcggaggcggggatcccgcggctgcggcgacggtggccgcggtggagccacggggcgggcttggcttggtgtgacggcggctgcggcggcggtggcggccgcgaccaggtgagtcctgactggccctcgtggcgggggcggctgggagtgtgcttaaatgcggggcgcccgggggcagtgccgggccccggtggaagccagaacgcaagcgccaggctgcgtcgggccccgcgggaactgggggggccgcaggcaagggggggcctcgggctcggctccgcagcggtgcagcctccttgggacggtcggggcagaatggggagagactccccgcgtccaagataccggactggagccgaggccccaaatgaagggaggccctgcctggaatggggcttcgaatagtaccgaggggcgcccaggcattgtgcggggcagaatggggtgcgggagggccgggggtygaacccacttccggtcccctagccgggtggccgggtccacgcagacccaagtgcgcgtctgtgtgagcgctcaggccctgccttcacccgcggagcccccagccctgcctgccccgcccctcccgcctcccggattcggggagcgctgctcccggggcgcgcacaccggggcgtgggggcgggctggcaggcagatccaggcggttttctgggcatcccctctcggggcctcagtttccccacctgtagaatgagggtaacagaggcctaggaatgggtaaattgggcacccgagaatgtggcgcccctccgccctgctcggacacctcttggggttccccgtgactgaaggatgctcagagcctccacctgacactcgggcctcttggtggatagcacctatccttatagccaccctgaatccttgacaagcaacttaacccactgccaaggctttgcatgtgccgttccgtctgcctrtcgcgccttcctatccgctgtgatgatccattctctagaacagcacgtccatcccccgaccctagccctgtccatcacagggcgtctgaacccgcagggctaggctgggaatgtgtgcctatctccgcctccccaggctgggactcctggggaataatcaatgccctgctgccggcagcctcccctcctcctcagctgcagtacccccaccttctcctggctccctgtccctgcctggggctaaggttccttctaagcacctccccatctgcattttgtgcctactctgggccccaggctggagctacctgccagcccactcactcctcctctgcagagactggaggtccatttgcttggactcacctcgaggcctttgcttgtgtagaggcctcttcctggactttgttccctacctcttagttcagctggcctgacccctctatggagctcccaaagcacccggagtggcctccattgcgtcctccctgccctaggtatctggccacctggctgctgccccctcatgtccaactgggccaagtcggcagatctaggtgtaagtcctggcttcctcctggcctactgcacggccctagatacctccctgctctgagcctcagtttccccatctgtaacaggggtgatgaaaagcctgtttactggccgggcgcggtggctcacacctgtaatcccaacactttggaaggcagaggcrggaggactgcttcagcccaggagtttgsgaccaacctgggcaacatagcaagaccccacctytattggaaaaaaaaaaaaaaaggctgggcaaggtggctcatgcctgtaatcccagcaytttgggaggccaaggcgagcagatcacttgaggtcaggagttcaagaccagcctggccaacatggtgaaacctcgtctctactaaaaatacaaaaattagctgggtgtggtggcctgctactcgggaggctgaggcaggagaattgcttgaacctgggagacaggttgcagtgagctgagatcacaccactgcactccagcctgggtgacagagcaagactctatctcaaaaaaaaaaaaaaaaaaaaactgatttactgagcatgtagtatacctggggcaggttcttgggaactctactcccagcagctccaagggaaggctgtcagtatacccattttacagatagagaagctgaggccctgagagggaccggccccaaggtcacccagtgattcagggaattccaaatcaggatttgggcccatctccgtgttgggggtgagaggagttggcctggctaacgctgccctatccctgtctccctaggtcggcgtcctcagctggccgagcatggtggcagcctgcacccttggctcccttgtctggtgcagccagcagagccgccagccttgggcgcccatggccctccrtgtgagggcgtgagcggcctgccccagcctcacctgctgatggaggactcaatggcccagtgacctgacaccacaccaccaactccctcccaccagctgacgaatggtggacccagtgacragtggcccttgtaagggtcatggaataatttgaagcgaggcatgagcggcccctgtggtcgcctgtgactgctrgagatagaggtcccagcaccccaagccaacccagcggaccctcccagccctgcttcaaccaatggggccagtggggctccaagcagccacctaaccatccagaccccaccccactcacgcggccatggcgggccctgagggcttccagtaccgcgctctgtacccgttccgccgggagcggccggaggacctggagctgctgcccggcgacgtgctggtagtgagccgggcggccttgcakgcgctgggcgtggccgagggtggcgagcgctgcccacagagcgtgggctggatgcccggcctcaacgagcgcacacggcagcgaggtgacttccctggcacctatgtggagttcctggggcccgtggccctggcccggcccggccctcgcccacggggcccccgcccactgcccgccaggccccgtgatggggcccctgagccaggtgagcagcaagcaggggccctggaaaggggggtggtcccctcagacccttggtctcctcttctgtccagtgaggcaatgggatctccaaggaaggaggaaaaaggacatttggtcatttgacaagtgtcttcagtgctaggctcagcagtggacacaaggcctgttcctgccctcatgagcttctggttcaagaagggatgagagtgggttcaggaggtgacacatgccatgaggaagggggcttgcgtgggaagatgcgagggtggaagctcaaggcagtgggggcagcgagggcagaggctgtggagtagaactctaatggcgggaacggccagcaggaggaccagagggaggaaggggagggcaatgtgcgctggcatggaggacttagtgggattgattttgaggacaatggagagtgttcagtaggattcagaggctcagcctagcttcatcctgccttttgcagacagggtcccttgaagaacccctttggagaccctgatttccaaaatgaagccacaaggagggtrggatgtgggctgctcagctgaggccacacagcacagtgggatatgaggaccccacatccctcttcaaagacccttggccatcaccacttgccaggggtgtgccaggtgtagagaatcgggggcaccgagcccmctcagtgactgctgtttgatgggcagggagtgtgggctctggccggggaaactgtggcccaggttgcaaggaggaggctaagaggtgctgcatgctcggcatggtctgctccgaccctcccagcagcccagcaaaaggccctgtgtgcagaccgggaggcctgagtgcaaggccgtcaaatgccgtacttgaaaccagttggtcacccagggaggccaaagccccgggaggtgccaggcctgctttgtgccagggtgacattgcccaaaggcaaaccagagtcccccagcgcagggcggaatagggggtgctgaggtggtgcgacgctggccccagcctccaggcatctggtatctccagggcccaggcctgcgtcctgcctcggcctgaaggagcaggaggyggccccgtctgggctcccagccagaatctgcctctccccctggtaacagccacctccctcctctgcctggcctctgtccagccaccatacacggccccacgtggggcggctgcccagccccaccctctgaatcttccagggttatgtgacctcggccagaacccgccccctcgaggcctcagtttcctcatctggaaacaacagggttggtccctggggatgctgggacccaacccctcggaaatgtgctgaagtcacctgagccccacctggctgtgcacccacgggggaggttgcagcccctctgacccacaattcctcacctgcaaagtcggggtgatgcagttctgatgggaaccccctccccattctgcagattgatcccaggccactctcagggttgagtttccca

SEQ ID NO: 13491 - DNA, 23983 bp, Homo sapiens
ggtggctgaggatctcctgggtgagggacggtgccatcttcccgccagtcacagacatggtgctactggttgccctggggaaggaaacaggagcccacagagctgaatttcctggcccttcagggactccttatgacccccccgagaccctggaccctgggttccagtcacctgttcctttccttgctgcagaaaaaaagatcaacctgcttaggcttggagccagaaatggagctgaaatggtgaggtaagaggggagcccccaccttccccacctctccccactcctttaggaagtggggattgatgcggaatgctcctggaccaggcgccaaccctccctgatgccagggtcagcaccaaagctcctcaggccttggtccgcggtagatgcctcccttctgaggtctatggccctccttcctgggcctggctggggtctcctgggcagtgcaggggagctgaggtgaggtggcaggattawccacgcagagtggaagacaactcgaaatagcatcttcccccaccggcagccccagctgacaagcaaccctcaattcctgcctgtacagctgcctacctgctcagcagcacaggagcacaggccggaatctctaggtcagcaggtgcaatctcttagctgatgtgagcaagagttcttgcaagtacgtggatgcctggacagaaaggaggcactctcatgttggaaaaggaaaactcatttttccctcccccaagcaatcaacaagccctcctggcatggggccgtgggcccagtacttactcaraggtgccaraggtgaggtgggtgtcrttgttgtggcctggtagcttgcctgtgtgagcactgcctccggtgtggcctggtaraggaaagtgggggtgtgtgcagcctaggctgaacagcmmgtcagatgacctctcttagggacgaacccagcagttgtctgactctggcccctcccagaygtgggagaggaccgggctgtacagagtcccacatgcagacaccttcctgcccagcatctcttctcccaggaactgggcctcaatccatgtgagtgaactccactcagcctctcagcggctcagcctcaaacacaggagrcttttatgcactgccttccctgtgggtccaggtgggaccacagagacctagtctcaaagtccagcttctgacctggctctgccccagcttctgacctggctctgcctctggctccagctccctggggggcaggtcagacaggctgcaggctgatttcaaggctgatagggaaaaacctgttggggcacataccagcagggcaccccagcctgcaccccagagggggtcccagcccagaaactcccttgactgctgccttactagagccagmtgacctaggtggagagtgcccagggattgtgtatatctgtggagaaggaagggcacaagtatttgggagtggaagttgatgaacagagtcaagagagaaaaatgcaaagggtgttaccttcagagggaagctctatgctcccaaaaggcaacagggagatgggggaggctcccttgcctggtttcttagattgcttctgttgccttttggcagcctgggccctgtggctgttttagctgcaggtgatgcaaccccagcagctggacttgaggctgyctctgcacagagcagcaggtgaacagccctgtggagcccccgccccgccatgcagcaactgctccagcctcacagctggctccctcaggtctaaacacagcctctttcctgcctccctggagagcctgggtaggggcggggcacagaagctacagccctgcctccactcactcctctgcctctctcccaactcaggaaggccttcactggcattcctacatccctggaggagggacctgcagtggctccaccacactgagtagaccatgccggaggacacgccatgaaaggatatttctgtggcggtaatcactgctcctcacttttctctcctgttaaaaggaaaacatgcacctgtgtcagaactggagaatgagggttcaatatccagctctgccacctatgttctgtaagcttcgctagtcctttcagctctctaaatgggaggattgagagagacggaggctgtgggacatgctggggcctccgaggacaggtttcctgggatgattaaatgaagtaatgtgtccactraagaacttatccatgtaaccaaacaccaccttgtccccaaaaactattgaactcataaaaataaataaataaataaataaataaataaggtaatgtggccaggcacggtggctcatgcctgtaatcccagcactttgtgaggccgaggcgggtggatcatgaggcaggagatcgagaccagccttggcttacacagtgaaaccccgtctctactaaaaatacaaaaaattagccgggcatggcggcgcatgcctgtaatcccagctactcgggaggctgaggcaggagaatcacttgaacctgggaggcagaggttgcagtgagctgagatggcgccactgcactccacagcctgggcgacagagtgagactccgtctcaaaaaaaaaaaaaaaaaaaaaaagtaatctgtgtaattgcatgtggcagagaaaagtgccctgtaaagtaggggtattagattaaataaataaatatacaggacatgcagcttaatcagaatttcacgtaaatgaggaatcatttgttggtacamgtatgacccaaatatttcattaaatatactaacatttttttttttgaggcggagtctctctctgttgcccaggctggmrtgcagtggcattatgttggctcactgcaagctccacctcccgggttcaagcgattctcctgcctccgcctcccgagtagctgggattataggcgcctgccatcatgcctggctaattttttgtattcttagtagagatagggtttcaccatgttggccaggctrgtctcgaactcctgacctcgtgatccacctgccttggactcccaaagtgctgggattacaggcgtgagccaccgcctgtaattattattttttgtttatctgaaattatagtttaacagtgtgtcctgtatttcacctgacaaccccaaaatggaactcagtctcagcgtggtggctaaaagcaaagcttctggagccagacttctcagagtcgggattctggtcttctgtgtgaccttgggcaactattctgtgctcagtttcctcatcatcaacagacaagtaatagtgtttatgttataggttgttgtgagaattaaataactacagtgcatataaagcacttagaagagttctgggcacagcgctgttaagtagaaatgtcacaatgttatcaaatatataacgataagtattgttatatggtaactgttactgttgttattacttacctccttaagaattccgatcttggctcgcttctgaaacttttctggccaatccccaaaatggccacaagagggcgtcagcagccactgagagtctcgagccccctagtggccccttgaggtctctggctccagccccacatattaaggggctgtctcagcccacttgggaagtgcagcctcctgaggacgccaggttcctgggtggaattggtatgcaggtagcatcaggggaagagcctcaggtagatacctactcaggggagcccccgaggctgacctcagacacatgcaggagactgggtgaccgcagttaggctgggtaaacacggtactgcagctccgcagccggggtccccctggccctyggctttctgtacccttcagagtttcttctggctacctgcccagcagatttagggagaaccgaaggaagcgtgaggcctcctgtttcctcasgccgaatctctccaaggggctcctggccggcatgccaggctgaactctgaatttggagaagtccaacagagtctcagtcacatggcagaagcgaagtccttgcctgtgaggagtgtgtgtgtgatgcgttcacaatcgctgcattgaaacctgctacaaactcattcctctccctaggttttgttttgttcaacttcagggccggattgcagttgtttacagttgtactgatcaccttccttccccatgttgtacattttagaattgcagagttggaggaaatcttagrgaggatctaatctaccaccttttcktttcttttttttgagacagagtctcactctgttgcccaggttagagtgcaatggcgcgatctcggctcattgcaacctccgactccctggttcaagcaattctcctgcctcaacctcctgagtagctgggattacaggcatgcaccaccatgcccagctaatttttgtatttttagtagagacagtgtttcaccatgttggccaggctggtcttgaactcctgaccttgtgatccgcccacctcggcctcccaaagtgttgggattacaggcatgagccactgcgcccagcctctaatctactaccttttcattactgactcaaggagtctgagtgacttcccgaggccatggagttggaactagcatccatgtttctcagctgcctctcagtgttttcttcatccctcaatgcaggcgaggcagatttgggctccctctcagtggaatacaggggaaaggcagccacatacaccgcctccactgttcatgcatgtccacctcttcagcctccaagtcccacattgcttttatttatttatttrttgagaccgagtcttactctgtcacccaggctggagtgcagtggtgtgatctcagctcactgtaacctctgcctcccaggttcaagtgattctccttcctcagcctcycgagtagctgggattacagggcccaccaccacacccagctaatttttgtatttttagtagagacagggtttcaccatgttggccaggctggtcccaaactcttgacctcaggttatccgcccacctcggcctcccaaagtgctggaattataggcatgaatcactgcacccagccttttatttatttttgagatggagtctcactctgttgccargctggagggcagtggcatgatctyggctcactgcaacctcaccctcctaggttcaagcaattctcctgcctcagcctccaaagtagctggaactacaggcatgtgccaccatgcctagctaacttttgtatttttagtagagatgaggtttcaccatgttgggcaggctggtcttgaactcctgaccgcaggtgatccacccacctcggcctcccaaagtgttgggattacaggcataagccaccacgcctggtccctacattgcttttctgcaaatactttccattgcctgatttcagaatacatagaaactcctcttggctattttacctctctgttaggaaatgtttcctccccgatactcctggcccctgaatctccattaggtactagctaggctctgcttcttacccaaataggcttcagtgttaacagttccacctgacctgaaaaaacctaccttccacatttgggctccctgtatgcttgcccatccacaaagcctgcccagatatctaaactyggggctgaaggcctggagatggcctgtcctctccttgggacagttcagcagcccatacagaggaagtgagtcactgcaaggcaggcagcacttggggcactgtgggcgtggccatgccagcctgcgtgttgggggatgggttggaagggtggtgatcacagtctccggtccagccaaggcaagcggtgtgtatgctccccaagcgtgctgacaaagctggtcgcatcatcccggtgctggctgaggcccagtttccccttctccatccaccttctcttttgtctcctgggggaggaatataccctcttatctttatttctcaggccctggttatccaacttctgccccagaacttcccctccccactgctatcttaaaaraaagaaaaaaaagttaaccagtcttcagttctcctgaggaagcatttgaaaagtctggtagggactacaggaaagcctggcacttaggaaaaccacaagaaagggattcagaactaaaagaaggaagatgaataggacggaggtgtggagagtgttagagacccgaaggtgagctgcggcccaaagagccctggaactatgctggaaaaaaggtgtgtaggtgtgtagcagataaggactctggggagagcactgaagaaaggaagagggaactttggaattagaaggctgaaggaggagagttccaagggggtagaaagagacaattgggatgcaaggtggctcatgcttgtaatcccagcactttgaaaggccaaggcgggtggatggtttgagctcaggagttcacgaccagygtgagcgacatggtgaaatctcaaaaatacaaaaattagccgggcatggtggcgtcgcctgtggtccctgctacttgggaggctgaggtggaggatagcttgagcctggaaggtcgaggctgcagtgacagagtgagacctcctctccaaaggaaaaaaaaaaaaaagaaaggaaagaaagatacaatggaagatatgctaataagggagggaggagaaaaacacagctggaggggttgctggaaactgggagatcaggcaggcctggggcttagaaaagcctagagaaaccctgggagctggttaggggccaccactctcatctttcccatggtgtgtcagggctgcgggtccccctgaaaagagaggcagaacaaacagttgggtcggacagcctctacctccttaccctccagaaagggcctgagatgagggatgggccctccaactggattagtgggggttgcactccttcctacgagtacttgaccagataaacggggaaacaagctactgtcagaggctctgattgcaacagcataaaaaaggcaatacttcatctaggtgagaaatttgacaaaagtacctctccatggagtaagctgcagctctccctgtataggagccctcaaatacatcttagtcaccactcgttcacgttaggagttaagaccagctttctaggaaaaccatgttgcatcttccaacagtaattacttctgaaacagtaattttaccacacgactcaaggggaaaactttttttttttwaatttataaaggagttgggggtctcgctatgttgaccaggctggtcttgaactctgacctcaagtgatctgcccacctcggccacccaaagtgctgagattacaggcataagccacggcgccaggccaaggggagaacactttttttttttttttcctgagacggagtctcactctgtcgcccaggctggagtgcagtggcgagatctcggctcactgcaaactccacctccagggttcaagcgattctcgtggctcagcctcccgagtagctgggattacaagcgcgagccaccgtgcccggctaatttttgtatttttagtagagacagggtttaaccatgttggccagggtggtctcgaacgcctgacctcaggtgatctgcccgcctcggcctcccaaagtgctgggattacaggcgtgagccaccgcgcccggccggaaaacactttttaacacgaaatcgaatacggataaacgtggtgtcatttgaaaactcatacattttacaaaacaaaagttggggtggctctttcagacagggccgccgggtgtgcgcaagttcgggtttgctcttccttgccacgggggtaggtcccgtagcacctaggtggaaaggccgcggcttttacggcggggtaggcgagggtcgcccgagtgatcgcaggctccgactgggtctcgagggtcggctgcttcggtctgccctggagaggttttcagcttcggcgcgaggcacttgggcaggatmcccgggctgcaccctcctccgcccgcgccccgtggggctggaagtgggaatgtgcccaccctggcggggaccgggggccgcacagcagttgggggtgggtgggggtgggtaggagtaaggggacagggacaccgccgctcggagcccgggaccccgcggcatccagtgcgtctgtgtcggtcccagtgggagacctcccaccccgaaaagagaccgaagtggcggaaggagcccgcacccgcctccccaggtcggcggtttctctagcgcaaggtgacgggcgtggacgcggctgtggggccgggagcggagggttggggtctggcctcccgcgccggggcgaaggggcagccgcagcgcagaggcccgccccgccctcccctcccgtcacgcccagcctcccggcccttgggctgctcgcggcctttttttcccggctgggctcgggctcagctcgactgggctcggcgggcggcggcggcggcgccsgcggctggcggaggagggagggcgagggcgggcgcgggccggcgggcgggcggaagagggaggagaggcgcggggagccaggcctcggggcctcggagcaaccacccgagcagacggagtacacggagcagcggccccggccccgccaacgctgccgccgggtgagtcggggcccccgcccggcgcccgagccccgcgcgggggtgggaaggggctgcggaaaagttgggagccccgggtgccgctttgtcgcggggccgcggaggggtcgggctgggaaggccgcggggccggggcgaggagggaggcggcgctggcggggggcgctgcgggcgctcatggcggcggccgccgggtaaggcgggcgcagcgcctcaagggagcggccggggccggcgggcctggcgccgcggtgtccgcggcagcgccgccctgagccggagaagctttcccgggcaacaggtagggcggaaggtggggacgcgggggctgcgggcgacggggccgagccgtgggcttccctttgttggggagtggaggagcttggtgaccattggcgcgagagcctccaccctggcagcggcccgcggggttgccctggcctggacgcgtcctgtggcttgggtgggaggagaggggagggccctgccccgttttcttcctaccggcccwccgtgcccacctcgcaggcgaggtcagagcttccatgtgcttaacgggaaacaggaaggagcggcccggagcgcctgccccggcccggtagggytaaggcataccgttatgaggtgtggatggctggcaagggagctcctggtggaactggctttctgggccgtagcttgttaatcactagaggcccgtggcaagtgggttgactgcaggtgtagagcactcatctttagcctgcagttggagtctctccctccctaagcctagctcctggcatcaaaacctggtttcagtcacctgagttgccaggcccaggttcagggggttctgaggatcgtggcgaatgcagtgagcccctgttcctggagaagtgagtccgagcaggcctccagcaggcagtcacccccatatctgtgctggggcaggggtgggtggcggttgctgccgcataccggagtcgggatgaccgcaccggggtgtgagtggctgcacatgtaaaggggctcctaagggtaaggacttgcctgcagtcctgtccctgaggacctggcgctgaccataccgtgatctgcacagtctgttccagagagggatccttttctcccctggtcccccacttccctcactggggcctctggccagattttcccctgggaggaagggcctccttttacccctgtcactggccataggctggctgatccctcactgtgtccttcaacaccgccccagctgtctctcaaacccaccggcgtctccctgcccctggggccatagtctcatgcagtgtttkggtccgtggaggcctttggtgggactttgcagacaagctgtaggccagatgaggctgaggactactgttctgactgcctctcacccacctcttttttacartctggcttattttgaggcccatcctgcagcctggagggataacacacctctcattggctccatccatggcttgtagacttctagtwcatgacctgcttctgttgcctgaaagttttcaacaaggaagactattcaggacttcttcagtggaagcagggagccggtgggacctttgtcactcctcccttgtcaacaactcctttctattttcctcagktattcttccaaactatgagagccagtcagactgaccacctggagtctgagagaattccttcctctcaggccgaaacttctgccttctcagccgtttggatctacaaactcccatggggatcctctgctcctttcatccacctagaggggtcttgtgggggtgtcagtcagagttggggcaaaggttggggctggacagagtcctgctcaagttcctgctaatctaatgccagttaaatccctgctcttctggcccctctccagcctgtgcctcagaaagtggcatctgtgcctccaaggcaggtgtgtgtgagagagagcgtagacagataccatgtctcttcatgtgtatgggggagtgaagtctgggtggaaaagtgtttctagatgtgattttctccataagaagtcaagtaactgccctgaaggcccagggggcctggaaaaacagggttgtctccttaccgtgtgtacacttcagcttttcttgccccagcctcttgtttatggggtcttgcttggatctgtgtgctggtgctaagaggcctccccagtactgccacagggacccaactctttggttctgtggggatgtgtaagtgaggccggccaggccccagctgtcctcccctctcttcatgttgagtcagaggtcctgaccctgctgaatctggggcctccctgctggggagatgggggtagtgcctctctgctaatggaggtgcaggaccaccagggagggctgtggtcatgggaagcctgcaacctcrgtgtaaaagcccccattaatctgcatttcccaagtcttccactctccctgcttggagtggaagaggacaggcgctatctcatcttggggatgaggaagttgcactgcccaggtgtctgtccttgaccatgctctagtgcctactttgcctgccccccaccccctgytttgcaggcatgagacattcctgggccccaggagtccagcaggggctccaccctccctctgcgactccagcctgccgcctgactagagaaacatccctgccagttttcacagacctggttggggatgggatctgaagtctaggactgccagggcaacatggtacctttggctttacatttccctggagaagttgggctccaagagacagcagtcaggtgactgggtcaggctgatttctcgcttccaatcaggctgagcaaaaaagtgggaagagggggccatgtgcacacatcaaagtgttccgcattgtcccttctctgtgcrttttctacccttgtcccttctttattcaattttctacaacttttctstaggaaaaaagtgtgtgtttgtgtggggaaagttccactgtggataattacatttaattttgttcagttcagaaggcttccatctgtttaattaaatatttattctggctgaggtggagggggcaggggcagtgtctggaatgtgtgtgtgtgatttgggggaggaggaggggagaaggtggagctgaagctcctttactggcagtgctgacctctgatttcatccgagagagcagtgaccaggagtggggacaagggggtaaagtccttgagctggaatactgacccgtgacaggctgagggatttcgcaagggctacagtggtgggtgggggtggagcgggagctgtcagagcagcagcaggaccagcccagcccagctgtggtctcaggctctgtcttcagtcagtggcaccaactagtctccaggtcactgtggataacaatttcaccactctcttttcttcctgtctctgctttcactttctgggccagcctaaatcccaccgcctcatctccttcccaggagaacaaggggtggggagcctggaaaagactgtcatggtcatcctgctgcggcttcttgctgagtcctaggattgccaggtgtttgctggacccagcatccctggctctcctggaccatcttgccattcctctcagcttcaagcagctgctcttccctcatgagccacacacgtctgaccgttccctccctcctctgggtatccaagtggtcactcccaccatgttgttcgtctttcagttgggggaggaggtttacatagcrgctctttcctagactgagagggtatgggtgttcccctgcagactaggattctgttttctggatgagcatttatacgaaatagctctgaccaggcaccgtggctcatgcctgtaatcccagcactttgggaggccaaggctggcaggttgcttgagcccaggagttcaagaccagtctgggcaacatggcaaaaccctgtttctaccaaaaaaaaaattcaaaaattagccagatgtggtgtgtgctacttggtagtgcatgctactcatagccccaggcactcgggaggctgaggcaggaggggaggatggcttgaacctgggaggtggaggttgcagtgagctgtgattgtaccactgcactccagcttgggtgacagaggaagaccctgtctcaaaagaaaataaaagaatagctcttaattccatcagatgtattggtccgctctcttggttccctgccccacaatccctgactctttgcagccctaccttcacttttctttctgaagagttatacatagggtccttctgccttgtgtgtagggactagatggcttggcatggagtgtcaaccttgtgtgcagtagttcgatgtccagtgattgtggagctcagtgtcatttggggacataattttgctttaccttggcttttttttttttttttttttttttgagacagagtctcactgtgttacccaggctggagtgcagtggcaagagcatggctcactgcaaccttcacctcccaggctcaagtgatcctcccacctcagcctcctgagtagctgggattacaggcatgtgccaccacatccagctaatttttgtattttttgtagagatggggtttcaccgtgttgcccaggctggtctcaaactcctgagctcaagtgatcagcctgccttggtctcccaaagtgctgggatttcaggcgtgagctactgcccagcctaccctgtctcttaatttttctttagggacttgctactcagatgggttgtaggttgtagggaaggggaagaagggtttgcctcagccctgcaatgttttggggcaccccctggaagctttcagctgagttggcttggaggctcgaggaagtggccagagtgtagggggataagggagggactttactcagattgttggctacagcttctagggccaggtcctgcctgtcttgcaggttaagatagcaaaatgacaagacccccaaggttcttcccccactccccgaaatcagagkttgtaaggaccccaagtttcttaattccagggaatcacgtctgcaggttgctgtagacaataaatgctttttttttttttttgagacagtctcgctgtcacctaggctagagtgcaatggcrtgattccggctcactgcaacctctgcctcctgggttcaagcgattctcctgcctcagcctccygagtagctgggactataggcgcccgccaccacacccagctagttttttgtatttttagtagagatgaggtttcgccatgttggccaggctggtctcgaactcctgacctcgtgatctgccagcctcggcctcccaaagtgctgggmccacaggcatgagccatcacggccggcctaacagtaaatgttaaaactggaaagccacygtattacagatgaggaaactgatttgcccaaggctacatagccaggatagggatctagagttcgactctctgcccccttctccttttgatacatcctgaaaacttttattcatctmtctcttcctccatagctactccctcttgatgccctcccctttgcccctcactcaggatgctccagaccttgtatgattacttctggtgggaacgtctgtggctgcctgtgaacttgacctgggccgatctagaagaccgagatggacgtgtctacgccaaagcctcagatctctatatcacgctgcccctggccttgctcttcctcatcgttcgatacttctttgagctgtaagcatgccarcctaccctcatgccttcccctgttgccagttgcagtttcttggacttcaagtttgttccttgctgtttaattagcccttgaccctgatgttctggctactcaggttcctgcccactgtgcaccccctcccctgaaggcaccattgtcttcctgaaggctcagcacccccaggccctttccatcaatggttatttgttctcaccctctacccgccgcccgcctggccactagtgaacacacaggcagctttgtcagctgtgggcagccctggaggctagagaaaagggggttgccaggaagctggggaaactgaggccagggtaaagttgccttagcttgcagccctttcccttcccagcaagctagataccttactcatatcccttccccaggtacgtggctacaccactggctgccctcttgaacataaaggagaaaactcggctgcgggcacctcccaacgccaccttggaacatttctacctgaccagtggcaagcagcccaagcaggtatgagccgcatgctgctctggctctgggaatcactgagtttggtggtggggggacagggtttgaatgttagctctggcaggtgaagagatggggaagcagtggtgctgactgaggttgttactgggagaggctggggatgctgctgagttccgaaggtaaacataacaatgggcttcttcactgtgcccaggtggaagtagagcttttgtcccggcagagcgggctctctggccgccaggtagmgcgttggttccgtcgccgccgcaaccaggaccggcccagtctcctcaagaagttccgagaagccaggtgggggaggctggggcagaagctgggtgacaaggaatatcctgatgtgtcttgctgggagggataggcggtggctatacgcagggagatgtgaggaggtgaattcagttattaatggtatcttgtgagggtatctgcaggtatttgggggctgctgggggactgtgctrtcctctgacctagccatttctgcttcctctrmcagctggagattcacattttacctgattgccttcattgccggcatggcygtcattgtggatgtgagtggggattactgggaggtgggagtaggttctctggcaaggtcaggtgaggccatggaatttgggttcctcctcttttaacttctcaccatctctctgcagaaaccctggttctatgacatgaagaaagtttgggagggatatcccatacaggtatgagttctgcttcctcatgtgggggtggactaagacacaccctagtgaagagacggtttgtggaatccatggcagagggattagagtgatggaatgaagaacctcaggggctagggggtttgtggagtggggacasccttgcggctggttgctcttacctctctctcctctcccagagcactatcccttcccagtattggtactacatgattgaactttccttctactggtccctgctcttcagcattgcctcygatgtcaagcgaaaggtgggtgaaggggttgtgcaattaagcctcagagccaaaatgaggccctgggatgaacaccctctcctttgacttctgggtactctgaatggagctgttggtatatggggaaccaaaggcaagkggtaagaaggcatagtgagagctggggaataaaaaaaggccctggggcctgcatcatctctgcaggatttcaaggaacagatcatccaccatgtggccaccatcattctcatcagcttttcctggtttgccaattacatccgagctgggactctaatcatggctctgcatgactcttccgattacctgctggaggtcaggcttcctcaaatctagagaccctggtgcaggttcttctgtccctttggttttctttgggagggaggtgcggggtgggaatttggaggatgacattcctgggaccaaggaggagggcacagagtcagtgctcctaactggagtgtacatmtgaatgtactcgagggagtcaggagcccatgatgatggatgggggctctctatgcagtcagccaagatgtttaactaygcgggatggaagaacacctgcaacaacatcttcatcgtcttcgccattgtttttatcatcacccgactggtcatcctgcccttctggtgagtaggcagctaggctacactcctgttctgaagaaatcaggagccttgcctttcttcccctcctgtatctccccggtgtctgacctgctcttgtccacgttctctctctccttgaatcctcaggatcctgcattgcaccctggtgtacccactggagctctatcctgccttctttggctattacttcttcaattccatgatgggagttctacagctgctgcatatcttctgggcctacctcattttgcgcatggcccacaagttcataactggaaaggtgaagccctgttcccattgtgtaggccttactactctctacaacttcctgaactcccatcttgccagtaactctctaaaaaactagtgtggagccctgggtataacaggaacaagccctcagagagaagcagtacttakgggtttgaggatctcatgtaataacccttcttgtcccttttccacagctggtagaagatgaacgcagtgaccgggaagaaacagagagctcagagggggaggaggctgcagctgggggaggagcaaagagccggcccctagccaatggccaccccatcctcaataacaaccatcgtaagaatgactgaaccattaytccagctgcctcccagattaatgcataaagccaaggaactacccygctccctgcgctatagggtcactttaagctctggggaaaaaggagaaagtgagaggagagttctctgcatcctccctccttgcttgtcacccagttgcctttaaaccaaattctaaccagcctatccccaggtagggggacgttggttatattctgttagagggggacggtcgtattttcctccctaccygccaagtcatcctttctactgcttttgaggscctccctcagctctctgtgggtaggggttacaattcacattccttattctgagaatttggccccagctgtttgcctttgactccctgacctccagagccagggttgtgccttattgtcccatctgtgggcctcattctgccaaagctggaccaaggctaacctttctaagctccctaacttgggccagaaaccaaagctgagcttttaactttctccctctatgacacaaatgaattgagggtaggaggagggtgcacataacccttaccctacctctgccaaaaagtgggggctgtactggggactgctcggatgatctttcttagtgctacttctttcagctgtccctgtagcgacaggtctaagatctgactgcctcctcctttctctggcctcttcccccttccctcttctcttcagctaggctagctggtttggagtagaatggcaactaattctaatttttatttattaaatatttggggttttggttttaaagccagaattacggctagcacctagcatttcagyagagggaccattttagaccaaaatgtactgttaatgggttttttttwaaaattaaaagattaaataaaaaatattaaataaaacatggcaataagtgtcagactattaggaattgagaagggggatcaactaaataaacgaagagagtctttcttaygccttccttgcagttatgtaatattttcttttttaaatttcacatgcatgtaatttgagcactttgrggggccaaggagggtggatcmctagaggtcaggagtttgagaccagcctggccaacatggcgaaaccccatctctactaaaaatacatctagctgggtgtggtggcgggcgactgtaatctcagctacttaggaggctgaggcaggagaatcacctgaacccgggaggcggaggctgcagtgagtcgarattgcaccattgcactccagcctgggtgacagagcgagaactccatctaaaaaaattcacatgcaagaagcaaagrtagacaaggtagaagatgaatgacagcagcccacaggggaggatggggataatacctcactgaaagatccagaattgggagtatcgggctgagagagagaaacaaaaccacaatcttagttttatcatattgttaaaagactttcaagaaataatacaaactggagatagtagatacacaggctccattctaagaacaaagtctgttagaagcaggaacacttggacaaatatgggatgggagggatgtcaggccgaggttagagtggtgatctctccccaccctttagggcctttggaggtggagaagggatcctgcctgctagcaccacattggaagggatcatctggtccagaacccccatttctatcaactaggagctggggggagtagctagcccagagacttcgggtcagggttcaacartcaggaagacccagttcctgaggaaacgacagttcaagaagggttgggaagaaggctgtcctctaaagaagacgtcctctgcattcaatggccccacagcaacagagtagctccttgccttccacactgcccacctcgtagttgtagtcccaagtaagttctgtcccagcccggattcttctgaagaggaagaaaaggatggtgtgtggcaaagacagcagataacccaggcacttggggttactsaatatgtaggtggagttggatcatgaatggaggaggggcccttagaacttcagtggtccttgcccctccccagtcatcccctttcctgactccttacttgctggcaaagaaggccacccaggggaagcgaagatcatgggtatccacgaagacattctggacaaacaggttggggctgcaactgtgctgtaggtttaaggacaggatcaaataagaaccagggaaactgaacctggctttgcagggagagtgagagttggaagaaaaatgatgccatctgaccctccccattataatagatgctttgaaagaaagctacctctttaagatcctttgagatcaagagtttataacaagaaaagggcttatagagtatsttaaaagaaatctgaggaccatgggataatccagcatctagaggtggggagaggggtctcacgttgaggtagcggcccaggttgccttcaagcttggcatcaatgatgtagcaagactcctcgccatcatagaattggcgtgtgttcttacgaacaggtgcgctctcccccttgtccacagaggccatrttggttgatttaattgcaatcccatgggttgatttaagagcaaagcctcgggttgattttactgccacttgacgcttcattggacctggacaggagggagaatggggtcaggacccatcccarctcatgaacagacattctatcatgaatggacattctacccctatttctctcccaacattgcagctgagaaacaccaataagctggaactcaaagaycctaagtagcaggtttttttttcaagcataattagatctgctagacaaaggagctgaggggaaagagtaaaaaaatggaaatgagagaggatgtgtcaaacaatagtttagcttggagtcagaaagccctcccagagatgctccaattcttaggatctgaatttttacccactacttctttagcttccttaaaaaatgctctatcccaagtttcttactatttcttcccaccattcccaaaatttttccaggctaccagtcatgttcttcttgtcctcaaagtcatccccttcagagccagaggatatggtctggatatcatcactgtcaaccgctgtagccgaagtctgaccagcagtgggctttcggctggtcccactttccccctcactttctgtgctgctggacagtgtcaggacatcctggggaagcaggagggtaagaagtaagagaagtaaatgggaagggctcctttaagtccttgctgttacccacggtttggcaggaaagggcggtggcaagaggaagattagatgctggatgaaagaaaataargcaggaagtcaaggctaaagaagtaggagaagacctaacagtaattatagtgaaggacttgatgaggtgacaatggcccattttcctttattagactctgaataagcttgaggtgacttacatcagggttggactgagcagaagccatgagtcttcggctttgatgcatactagtcttactaggtgggcggcgaagtccttcaggcttcacaggagaaggattgtaaccgtaatttcgagagctttcagtaactctaatgggaggggaaggaatgaagccaacaggttactggctgtttcttaggcttctagcctaggtttgagagaaggcagatttggagacaggtcaaaaagacaggcactgggctggacacggtagctcatggctgtaatcccagcactttgggaggctgaggatcccctttgggagcatcgcttgagcccaggagttcaagaccagtctgggaaacatggtgaaaccccgtgtctacaaaaaatacaaaaactagccaggcatggtggtgcacacccgtagtcccagctactagggaggctgaggtgggagaatctcttgagcctgggagggggaggttgcaatgagctgagattacgccactgcactccagcctgggtgacaaagcaagactctgtctcaaaacaaaacaaaacaaaaggcacttacactgacatcttgtttcggtcgtcagtgtcctggaaaagaacaagtgaagggttaaatgctttcacagcctcgggtaacaagtccaataatcagacttcaaatgacctccacagataacatcagccagtgacaggtacacattctaaagtggggtgggtaaaccactctgcaacttgacagaaatcctcactacactccctggctggagcctttaagccttctcagtgatggggcttaatgctcatggaaaacaccacgagcaggattacatcaaccagggacagtttcaccatctgtaatgtggaaagcagcataatcatcaaagagatacttaaaatcaattcttgtttctctactttagtagaaggaaacaatgatgtgaataacttgaaacagcatttaacattaaaaaatcacttataaatctttcattttgtaattaatcagatacttgtccaccctctaccaccaggcaagtggattttaaaataatttttttttttttgagacagagtctcgttctgtcacccaggctggagtgcagtggtgcgatctcggctcactgcacctccaccctccaggttcaagcgattctcctgcctcagcctcccaagtagctggaaatacaggcatgcaccwccacgcccggctaatttttgtattttttagtagagacggggtttcaccatgttggccaggatggtctccaactcctgaacttcaagttatccacctgcctcggcctcccaaagtgttgggattacaggtgtgagccactgtgcccggtcaataatttggttctttaaacaaacactaggaatgtgctagttagggggagagataacgaggtggccacagaaatatccatcaagtagaataatctacatgcaaagactcatggtgagactgcattgttactgcaccaaagttaaagccatagctctcagagtgttctgccactgcttacctctttcttggcctgtttgatgtctccctcatccttgatgcctagtcctgaggtggaggccttctcagcctccattcggcttcccccagcccggccctccccaccttcattagtcttgaaggatgaatggctatcagagtcagcaaaaccaccttcactgacactattgcagctcaaccatgaggccaccttgttcttgggtgtctcttcggaggaaggtggattgcagccacctacagggattgagggaggaacaggaatatgtgggggtccaagatctggggggtgggagtccttggaagttgtctcagagagtccgttctctttctggccccgggtctgcctccgggtagcatagctccgccacactgaactggtgctgaagtcctcatccttacagaagttatcatctgagctatcatcattggactcttcagggtcctctgtaccgctgttgccatcttcctggtccttcaagtctacaccactgctgtcagaggaacagggggcatcactctcatatccttctttgaagttctccacgctctcgatatggtccagatttgcaaagtactcatcacccatttccagaccctccttgtctgcaaagtcatctgtcaggattttgcctgagaatgaagagaattaaaggccttctagggttatggggacctattagtttttttttttgtttgcttttttttttttttttttccagatggagtcttgctctgtcacccaggctggagtgcagtggcgcgatctcggctcactgcaacctctgcctcccaggttcaagtgattctcctgccttagcctcctgagtagataggactacaggtgcacgccaccatgcctggctaattttttttgtatttttggtagagatggcgtttcaccatgttggccaggttggtctcgaactcctgacctcaggtgatctgcccgcctcagcctcccacagtgttgggwttacaggtgttagccaccgcacccggccacggggacctattagaaagaataaggattattccatcaatacccgctctaccagcatatagagtcaaaaagcctccattctggtctctcatttctgtttttttttttgttttgtttttgagacagagtttcgcttttgtcacccaggctggagtgcagtggcatgayctcggctcactgcaatctctgcctcaagggttcaagtgattctcctgcctcagcctcccaagtagctgggattacaggcatccaccaccacacctggctaatttttgtatttttagtagagatggggtttcaactatgttggccaggctggtctccaactcctgacctcaggtgatccacccacttcggcctcccaaagttttgggattacaggcatgagccaccacgccggcccagtgtttctctttgataatacctccctttgtatcttaactatgaaagtatggagaacttactgtcattttaaatcttgccctttctgtctttccatttcttctactttattgaaacagagtactgggctatgctaaaagatctctgagtggagtgacatgggagaaaatgatacactggactctataatcatgtctgttctctgaaatatcaccatgtccaaaatttcatcccttttcattctcttatttgtgaaacacttgtgtccctctctggtctagctagacaggtacatcactcatcacgttctttgtagaagtccctggcctcctcttactccagttcacatgtcaagcactttcttcttatgttcaatttgtctctggttcaattccctaccatgtcccagtctcaggaaacaacccttatattttatcaccaacctgcataaatacaaacaaaagagcctttgssaatgtcatccaagcagcggataccccagcccttgttctgtgtcttgaatagctgtagccgaacttgtagtccatgttgcaccaaccggtttgtgcacatgtttgggtcacatttgcagcgtttgttacactcatat

SEQ ID NO: 13492 - DNA, 21852 bp, Homo sapiens
aaaagacttcacattttcatctccatgactatgtgtaaaaatatagaaatcttaaaacaaggatcagacaggttgcaaaaccacaatatctgtcatctgtacattttttctgatactgagcaggggtcagccaaccatagcttytgggacaaataccatgcactgcctttctttgtaaataaagttttattaaaagacagtcaagtccacttgtgtacatattattcataacagcagcgttgagtaggcctgcaaagcctaaaatatttactatctggaccttyatagagtttactgactcctgatatagaaagaaaggtacaccagccatataaataaccacaattaacaatgtggtatgtttctgtgttggggaaatcaagaattgcttctatgtctcatggtgtaaaaaaaaaaaaaaaaaaaaagcttaaatccctcagttgtgcaggcatctccatgttctttctctacaaaagggtgagaaatgagtggttccacgcttaggcctaacattgactcgaacagtgggacaggcttctgtttctgtcttttctggattttcaaacaagtatgtgttctctctttgaaaatacagaaagtataaaaacttaaggtaaaaaaaaaattataaatactgtgaaatactctcttgaacatgttatatatgacagatcattgccagggttacaatctcaaatttctratcagttatttattatactcaacccatccttgctagataccctctccaaaaaataatcctcaaagataaaacaacataggtcacaagtcaggaatgcagaccctcaattcccctctggtatcatattgtgctgatctggttcttttgatcctttaacatttttaaactatggttcacagagtcctaagtcagtttttcttaacctgggatacatatgttagaatcacctgggagcttttaaaaataacgatgccagggccctaccttggaataattacatcagaatcactggaggtgggcctaagtcatataatttagtaaaaactcccctagctaatcctgatgtgtagctgggaaatgaaaatcattcattctgggagaatcgttcttagagaagttatcaaaatcattgggagtgttttgttttgttctgcttttctaaatggaggaatggcatgaggggttgcttcttcaaggactgtttcagtmggtttaggatgaggcccagccactgctattctgaaaatgtttcatggctgcatctgaggtgcatccttaattaaaatgctactcaagaggttctgcagaggtgtggctctggggtaaagtctggggaagattcagaaaaggtagcacattacatacatttatatatacatatacataatatttacataagaaagacaaaacctatatgatcacacttcatagttctgaaagataattcagataccagagatatcaatagtatactatagtaagatcagaagagagagtccattacccagtaacccataccgcaggtgagcaaagaaatcaaccggcagtgtttggttctgtatttccttaacaaacttgcgggctgtgtcgggtgggtctccggtgcccgtggtagaaaccacaacaacaagaggagctgtttcggtttttaggtcatactacaaaacaaggatatcaagtcagggacctaacactacatgcatttttgatttaactcagcagcaaagcaatcagcttagtttcctgtcttgtatttcaatcttcttccttgccagtttttttgagacgaccagtccagtgactaggcgctctcagcttaatcaatttgcctaatgcaggatgtcattcaaggaaaccatgcgtctgttttgttgatgctcatcaagaggttgggggggattaacacgtctttctcttcatgttgtgtacgaaaggcagggacaggcacagacagtacccatcccaggtttccatctagtcccagtctttcatttttagaaaaatcagaggaaataggatatagtcaactctttgccactgagtcatgggccaaacattaacatgagctcaaatctgcaaggcaaatcagcactgctaagagccaagatgaggcacctaggcactgtgatgagctgccaaggaggaacagcagctaactgggtggaaacgtcttttcataagaaagtaaaaaaaagcaaggaaagaggtgttaaaatggggatggggagactcagaaataaagagaactgatacataagcactcaggattagaatgccaagacaaggaagcaacaagtagaatactgtggtaaagaaaaacagcaataaaaacacaacagctctgaaatcttcagcaaaatataaaaccagccatgtgtactgcatgtgacactaaggcagagggataacagggcattttaaaactgggaaattaaaagtgttaccccttctaaatcagggacctggctatcaagaaccgctcattccctcaggtttccagagagctgagaatatcattagctataagcgagctacaaactcttacaaatcaagtttattcttattctcatgtaagtttaaatatttcatatagagcatttcactgtcttaactctgagaatatcattagctataagctgagctataaactcttacaaatcaagtttctttattcttactctcgtgtaaatttaagtatttcaaatagaacacttccttgtcttacttgtaagactccacaagctttactgcccatgaacaccatcgaatttggctccaaataattcaccttatttttcacactgataaaagaggtaacaacttaactttttaccgaagtatttaatgcttccaagactctatgtaagttgtgtgttaaactctacatacagagtttgtataagtaatgtcagtaccttgaaaaggactatgtgaaataggaaggatattagattatgaacagctagacgaaaccatcagccagggaggataaayagcatgactatcttggtgttaaaaaaaaaattcaccattcatctgactgccaaaacacctgctgatcaacttactgaggtcaaccacaaggggccaaatcaggactagttttatgatactgatggctttggttttgtccaaagtaacagatycagatacttcatcatgtggcactgcaatctgaacttaagttactgtagaatgacagagtctgctgactggcagtctcctccaggaagctcccttttctctggtgtccagagttaccgtggcagggctgcataaaggaactaggtgagtctccttccgtgagctgggtttataattcacttgagctgcacacagtctagtgttctgaactggagttttaggaaaggccagagagggttgtgcacttgggtgagagagcactggcaggacagtctctgaaatgttgaagtgaattttaactgcttagcggctggcaaatcatcttgtggtataaagcccytgccaactgttatcgcctgaattgtctgaaatagtatratctggaggcagcaaactaaataaaagaacacaagatggtaaagttgcatataccctaaggtaggaacttctgcagagactgaacataaacaactagtccctgaagaagcagccgagttttttccagatcyttacactactactttaaattctatttcacaaaagaatctaggcggtccttcatcaggaggaactctaacacgcacggcaaggcctttcttttggggaaaaaagtgggacactgagattcaagaggtggaaagcacacctgagcaggcaaacacacatctcacttgttctcacagccaccctgtgaaacagacacagcatatgctacttctgtcatttacagttgagttgttacttgtttcaatttttgagaccatttagtctaattcaactacacacttctatattaaaaaaatgctgstgatatcttactataccattgaacaaacacatttctgttaaaaaacaaagactatgtggtggtattagtgtccttttgtttcataaatatcacttcccaaccaaaattcttcaaagcacaaaacggtaaaatccactgtaayggctctaaccttatcggattcactaatacagtgaagatctgcagaaaatccatgtaccacagcttgctcacayatttcttctgcratggcctttgcctgtccctgctgtgtagcatatagtaacagaaacctcctcatcacttcaaggcatgtaacagtgaaactgaaaaatgggggaaaaaagatcctctttttaatgaagcagtaacaacctaaagatattaattctccctcaatctttaagaaacaatgcaacaatacccacacataatatgaaatggccttttctaaatttgttttcagcactaatctcaaatgagcctaaataagaattcatcaaattaaggagagtgtacgaatgaaactctaattccatggctcagaaatcagatgatcsgctcgaaactacttgggcttgaatctgtgtttcctaagtgcaaccctgtagacaagctccccaaatgatccgtaccacagctcctttatcctaaaaatgagagtattaccacctacctgaaaaacgatgtggcacaagccaagaacctgaacaaaacttgagccacagtatcattcacaacagtcttaaatagcttttggtttcctctttttaaaaaaagataaaagtaaaaactatattaaaatgataggattcttggttcttatttgatcctaacgctaaacaaactaatcatagtactaaaggtaactgaagcacatactctccttcattatttaatgcaaatcaaaaatatgtgagtgtatgggcatatatacaaacgggtgcatataacgaaaaaatatttccaatccacttaaacattttactaacacgtttttccgcaagagataagcagtagtaaaacaaacgacactcacagatttttttccatactcatctaacggctaaaattggtgggctgtcaatttgcagagacagatttaaactgaaayccaaaccaaaakcttggctttcggtgaatgaaccgcccagaacggcacctggcatgaaactggtactcgataagttatctgaatgagtgaataaacaatatgaaaacactacacattgacagctcacagaaaacggtggaaacgataatgaaaaccttactacagctaaaatttctatcacttcccatgaaacacacatcctgagggcttcccaggatcaatcaacccctcatccctgctactgccccacaatccggcaccaccttcccacgactctcagcggaggcccgggccccagcagccccggaagcggcgcggaggcggtgggcagagctcacggccgcgggcagaactcacggccgcgtcccgccgggtgggcgctcggaacgtcccgggttccccggagcgcgccgccccaacccggcatgttccccagttccccgcgtccccgagtgcggtttccctaggcctggaaagcgcctagaaccaaaggcagaacatgaggagagaccccacgccgcccaggggcctcccgcggcagaggccgacgccgagcccaaggacacgctcccggggacaccaaagccaaaggccaaaggccaagtccgagccccagcccgcgcccgcggcgacccccggaggccgaagggcgtgggaaccacgggcgcaagccggctgcccacccccgccccgggccgcctctcccaggagattagtgcagggcgagcggccggaatccgggaaccgtagccgacaggcagcttacccacgccgcgccagccgggcacgaacctgcacaacgcgacttccaccaaccttgcgccagcgcgcactgacgcagcgcccatgctcggtacccrggaccaatagaaagctccgaaggggacctgggccaatcacattgcgccgccctgagtcgtgctcccgccccgcgtttgctacggaggcccacgacgcccaggcgcttccgcgaccacccggagtgattgcccggcagagcgcggtaggtgtcaacgcggggtctccgcgcagttggtccggctgggtgtcaaagacctggccggctttctcctcaggctgcgccgcccggcccgtgtctcagcgcaggtccccggggcgccgagtttgggggtgctcgccccgcgggtccctttcattcctaggaaaacgcgccgcggggcctcccgtctgtctgtcttgcacacacgtgttgccaaatccccccgcascgtctttagatctggactggccgccccaccttctcccttcattgatctatgttttgctttttcttttcctaccttgtttccattgacaaagtagaccctttccttcaacactaaccttctcccgacaccgaggggaaaccaacagcttagggcctttccagcgcgtttttacccttgccttgctctaacctcgcctaattttgcccactttacctgttctttgatttctatccaaatgcaatttcttccttcaaccaacatttaagggccacccttaagagctacattgcctgagtttgaaccctagctctgccacttaaccmcctgcataaactgggcaaagtaactttgtgcttcaacttcttcctcgtgtaaaatgatagtaaaagtactgaatctgtgtaagttaatagaatacctacaacagtgtttagcaagtaatagcgattgttattgttcaatgtcagccactcttctaactctaggatgcagagactttgcccctctggtgtttatatgttaaccatccttttttttttttttttttttccagatactcgtttgtagtttcataaacattgatgttgggycaaycatgttctcaatgtatttaaccatgtgtttttaaattttttaatttagttatcaaattgagaatctgatggtatggcattwatcaccttgaggaagaacctttatcgtttatctgattttcagatgcatagagctctggctgctttaaaaaataaacctctaaatcatgttcacaaggtagtcaaggagcgtctgtgcccttggttgtgttcacgacaacctgagcctttcggggtcarattccatcatgcccattgtaaaaagtttcattcgaaaaatggaaatgaccttcatccactcggtggaccagtgttctctcaagtatctgactgcgacaggcttgaacaaaatgttaaaaatgaggagagtcagatgttttacaggagactgagcaacttgacttcatcagaagaagtgctaagttttataagcacgatggaaaccctgcctgacactatggcagcaggagctttacaacgaatttgtgaagtggaaaaaaaggatggtgatcaagggctgccaaaagaaatactggagaatagcatctttcaagctttatgctttcagtttgaaaaggagccctcacagctgtcaaacactagtttagtgactgctttgcaagctctgattctgttgcatgtggatcctcaaagtagcctgttgctgaacctggtggcagaatgccaaaatcgtctcagaaaaggtggcatggaagttcgcaatctttgtattcttggggaaagtctgattacactgcacagttcaggttgtgtgacactagaactcattataaatcaacttcaaggtgaaaaattggaaacatttaccccggaggatattgtggccctttatagaatcttgcaggcatgtactgaaaaagtggatgaacaccaaacatttttaaataagataaacracttttccctatcaatagtttccaacctgagtcctaaattgattagccaaatgctcactgccctggtggttcttgatcaaagtcaagcatttcctctgattataaaattgggcaaataygtcgtgaggcatgtcccacatttcactaacgaggagcttaggagagtcttggaggcgttcatatattttgggcaccatgacacattttttacaaaagccctagagcatcgtgtagctgcggtgtgcctcacgttggatcctgaagttgtctgcagggtcatggagtactgcagtagagaactgattctttcaaaacccatcctcaatgcagtggcagaaacttttgtttgccaaacagaaaaattttcacctcgtcagatttctgcsttaatggaaccatttgggaaactcaattatttgccaccaaatgcctctgctttatttagamagctggaaaacgtgctattcactcatttcaattattttccacccaaatcattattgaaacttcttcattcatgttcacttaatgratgccatccagtcaactttctggcaaaaatattcaagcctcttttccttcaacggctgcaaggtgagttggttataaattctgacagttggaaaaaagtaacctttgaactggcagtggtttcaagtcacatataaaggcaatatgttgcctttagtttttcttccatagtgatccgaagatgagacctgaagttaacagatgctggcataaacacagttaaagcatgctaggaaatcatgtagagggaagaaagctgtctcagataaactgacttttgccttatctgagaaattgcagcattcttaggagatatggtaatggcagtggaaatagccacattaacatgttagaacttttgatgagtgagcaactgtatctttttttttttttttgagaggatggtattattcatcttaattcaaggccacccaaatatgtcaaatttccggaactccatagttaaaggaaatttccactaattctgtgaacatattttatctcttttaattgtattctgtagctaggagcttgggttcttggaagtcaatttcattggtggcaagaggagggcataattaattctaacaagttcatttcatagtgtcatttaaaaatagaatacttctgtctggagtgtgtaaattgatgttgaatgttcatgatgttctctcatacatacmtcaattcagacgtaactatgactgggatgcttwctgtttcaggtaaagaatctcatttggacacattgagtcgggcacaactgacccaacttttcttagcctcagtcctggaatgccctttctataaggtaaaagcatgaactatatgtggctttatttccccatgggtgcagtttccttttaagttcctttacttctgatctgtctcaataacctgaaaaagcagaatttcatttacttggagtcakttgccaccagataggcttttctttgataaatggaccccatttttgtgttcttgttcttgaaggaacaatttcctgctgtttaagatttcttaggaggttttatcaagtgctgcaggcatgtgagttacagtatttctccattctctctgaaggttttacagggttttagtactaggtttactactaggtttcccatagctgtttgttatcaaagtgtgaatgtctggactgaacaaatacctaaattatttgcaagtacagtatatttttaagccaagccagaaatttcacttttatctaatagagtttagtttatctagagttcgctcttcccataaagacctataaagatttatcctattayctatcacattccttatgtagaatcagaaatagcacaccagactatgacattctctctctgcttctctctacttgactctgaatcatagtttagagtatctgatttttgaaataaggtaataagaatggaaaaataccccttttttaaaacagcttagacagtactaagttatataaagataaataatagttaaccccgatctcttaccatttctaaaggaacagtattaaaagcagtttctacgcccaaatgtawacagatacataaacactgtctattttttttctcttttcaaggaatgagactcactaatcaaagtacaatttgcttttatgcgcagtatatcatggccatccctcgaggccagtgcatacagatcacatgcattctttttagaaaggcatgatatttcatggtgtttattctactattgatgcacttggaggtttttgcaacttttgtctctatcgggaatgctataataaacattcttgcaaatcctgtcatactagagcctttttggtttttttcatatataaactagattcccaaaaatgtgattagtggattaatttttgatggatactggcagattttttttccctwatagttacagatgtcacatttccccagcaatgaatgaaggtggccatgtctcctccacttctattgcagtgtgttagtagtctctttaatttgtgttactcaactacatgaaagaggatatcatatcatatatttaagttgcattttaatgagcattaatgaagtttagcatattttcaaatatgtgttggccatttacatttcttttgaattgcctttctacaccttaatttatttctgttggatggtttgtctttaaggactcattgtaaaacagatattaactattatgaatgttgtacatattttcccgatttgtactcttttattactttttaatattacttatgatgtatttttaaatgttctgtagtcgaatctgtcttttatgacttccgaggttcctatctcaagagcatgaatattttacatttttaaaaataatatcttttaaattttatttagatctttgatctaaaagtaaaattgaatttttatttatgtattctaattaacaaaaattgtatatacttattatgttcatgttgttttgaaatatgtatacattgtagaatggctaaatcaaaccaattaacatgtgtattacctccatatctatcattttattttgtggtaagaatatttaaaatgtactcttgccgtgcgcagtggctcatgcctgtaatcgcagcacttttggaggccaaggcgggtggatcacctgaggtcaggagttcgagaccagccttgctaacatggtgaaaccctgtctctactaaaaatacaaaaaattagccgggcatgatggcacacgcctgtagtcccagctactctggactctgagttaggagaatcgctcaacccaggaggcggaggttgcagtgagccgaggtcgcgtcattgtactccagcctgggcaacaagagtgaaactctgtctcagaaacaaaaacaaaaacaaacaaaaaaaaaggtaaaaaagtactctcagccattttcaagcacgcaatcattcttattaactatagtcagcatgttgtacacctggaatttattagcatctgtcatggatgacagaagtttaatttagttattttccaaataaataaccattttctccagcatcgtttattatattgctatccttttcttcctaaactggaatgtcatttatatcacattttccattacagattgagtatcccttatccaaaatgctcaggaccagaagtgtttcagctttcagattttttcatattttaaaatattctcattatatttaccagttcagcatccctaattcaaaaatttgaaatccagaatgcttcatgagcattttctttaagcagcctgtctgtgcttaaaaggtttcggattttggagcattttggattttggattttcagattagagaaattaaacctgtgttgaaaactttagttgtgtgtacttaagacccttgggacaattctcagttctaaaaatgtttcttgaactgttagcattattatgtttcttctcactctctcctcactcctttttaccttccttctttacttttctttctgtttatggtaaccagtgactactgtaaaaacacatataaaagacattttgaactattagacttgcactgtaagaagagaagtttgcattatcattttgagagagatgcctgtcccaattcctggaaaagtatcatgcctataaagtaatgttatatcaaacttttctacctaggtaaccttcaatttattctctgttgttatatcttatttttctttctcacatttgcacttatgattttttagggtccaaaactccttcctaaatatcaagtgaagtcatttcttaccccatgctgttccctggagacccctgtggattctcagctttatagatatgtgaagattgggctgactaaccttttaggagcaagattatattttgctccaaaagtgttgacaccctattgttatacaataggtaagtagtrtaaggagttttgttgttttaaacctaagcatcctgttcgattttggagatatatgggacttagaagcaatagaagttctctggaaatgcaaaatggaatggtcccttccctgaaggcaagttggggttagcagcagagccgttgagtcaagactgtctgggtttaagtctcaaatattagccacgtagtagcagaatatcctgggcagaatatttaacctttttctgcttgcttcttcctctgtaaaatgatagtaataytgacctcaaagacttacttaaggtctaaataaaatagtacctggaacgtaggaaatgctcactaattgttagctactactataacctaggcttgtactgtccaaatatagtagccactagaccatgtggctatttaaatttaaattattaaaagtttaagaaaattcaattcctcagtcacattgtaagtgctcagtagccacatgtggctcatggctgccaaattggacagcaccattataaagatttccacatcacagaaatttctcctggacagcactgacragagactccaagtcctccgtccttacagttcttctaacttgatgagcagaagaaagccttctcgtaaaggacagcagttcataggcttcagatggtcacttctcttctctttacgaagggaactgcagtttaccagaggggaaggacagttcggaagccttccgtgctcgcagaccaggtgtctgggtgtggcatgctttctttacttaccatggaggcactgcaagttggaatgatggaagttatgagttgcacagatgtctaatgtcttaactcaagggttttcttcacagtctggattgaaggatctctgccacctatcataaggggaaagagaaagcatgcatggttcttgtcataccccagataacttcagaacccattctgtggtttagygttattgagctttcttaatttaaggctgacttgattgatcataaagccaattgaattaaaattctcaccattgtttggttgtggtcattactttgcagccttcagtccaattgatcaatgcaaggtggaaggaatcaaagcaaagcaaaggaatgaatacaggaagatagtgtttgtgagggtatcacacgaggaatttttcctttcttctctcaccagatgttgaaattaaattagatgaagaaggatttgtattgccatccacagctaatgaagatatccataaaaggtacaggaaaatgttgtgtttttcacattacaagactcgttgaggctaataagcagcrgtatctttttctcaagaargtgaaaaaaatagatatgattctggaaattaaaatactacatttcagaataccatgttgggaaattccttgtaatattttataaacattaatattaataagatcaaattcatgattcatttgaaaataatattggcacatagtaatagmcaaatcccaaataaactttggcaactaaaatatataataaatattttggattatttaaaaaattaagtatttttctccttttttatttttcaggatagcactgtgtattgatggtccaaaaaggttttgctccaatagcaaacacttactggggaaagaagctattaaacaaagacacctacagttactcggttatcaagttgttcaggtacggtttcacctattttttttgtttcccaaaagcaaatcctatttcaaaattatttttccaggttacttttaaaaagtaatctgaggcacagtaaaattttaaagaatttgatcaggcagcaattattgaactggacagcacaaaactcgaaatggcttgggaacccaagagggaggcttttataggaagaacacaagtacacaaagaatctacttgactggttacagttacatattcttgctgccttgtttgaactattctgtggaaagttcctagttatataattattagtttgtgagatgcttctgattggttgagcttaagttctgtttttctgtagtagaagcttckacaagaaatagcccaagttaaattttgcttaacatttgcactttaagcaaagttaaggttattttcaaggcccaactggcttggtctgctcagggatttttcaggcacaggctccattttaatttgcttttacagtactaactggtttgccagcccagtggaccaccgatcttacgtctagtttaaatcccaacgttgttaattcggcttaaatctcttgacttatattttgaaatacagaattttcagagctttgatttttcaaaagtggggcctacctatattcattataagctatgcttaaccctgcttttagaattactcaattgttggaatatatgttctgttttaatttctccttgatttaataaataaaaatgaacaagataatccattaaaataaggagcttcaccaacacttaatatttaagaccttttaaatatttcactrtagataatgtaagaaggtcttatgtgagggctcagcagtgcgtgagaatgagmgctgccctaattctctaagctgtcagtactaggcagcactgtggtttcatatctgctgacttttttctccatcttgcacatccccagctgaatattcctaaaactaatcatgccagtgtctactcagaagcttcaatgtttctttactgcttacagaataaagtaaaaacttctctacatcttaacattcaagaccctccaatggttggcctgcagccaggctgcaggcacatgattactacctggcccctctgctcccagctgagcagactctctcctttgctgcgcctcctgctctctccctcttcattccctctttgtccctgctgcgtcctccagctctctgaatacctaccttccagcagtttgtcggcatccccaccctcatctaatgaaatgctcactccctcttagcactagatcaccaacctacagcttgttttttatatttattgtgtaatttaacttgccacccaagttgtgaactcctggagaacaagagatcatgtttaattcttatttgcatattctacatattaattcatcaaatatttaccaagccccttctcagtgccaggcactgttctagacattggggatacaggatgaagaagctggttgggatatttgccttccaggagcttacattccgctgtggggaagcgtgtaagaaamaaacaaagtaaccaatagccagaggamcctcagattttgaaggatcttgaccagttttacttttctacctttacagatcccctatcatgagattgggatgctaaaatcaagacgtgaattggtggaatatttacaaagaaaactgttttctcaaaacactgttcattggttgcaagaatgaatactgacttcagaactcaaacaayggaagaacttgcatttttatggaactcagtattaaaagaaaaatataatgtgaattagccactttgcagaatatgttctagactggtgrtctgaaagcatctgtagttttccttatactatgtatacatttattgtggtaaaatttaaaattaattttaatttaatactagtgtcatagatactttttgtacatcaaacaattgatcatgtgctgtaaaggaattcaatgaataaatgttatttttaagtattttgtcatagttatctgctaaatgaaaatattttgctctttagagaccttttgttttctaacagatggaggaaattttttctctttgtgtgctgtgagtggaagtgagatttaccgtaaggaaaaggagcaatgagaaatagagtacagtgctttggatataaatattatagaattatgcagaaacaatcttctggttaatgagatatattagtatggaaacttttttttaataaatatttagagaaatggaaaagcaatttaggtaggttttttggggagctgtttgattggagggaggatcttctaaattataaatcaagaatgaattaaattgtcattagttcattgcagagccttcattgcctcatcacagtcaggttacagtttcaaggagaagaggacaagagagccgactggagtagcagagtgtattttttgaaggagggaggagggatacaattgaacctgtaacaggttgagatgataattacataaagcacttagaaaagtgccttgcacagagtaagcacacagtgcaagttagctggtgttagtctgaacgtctaccccatcatggtttttacttcactttagctttttgggtctatttacttatctttagaacaggaaatggaaactagatgagctaagatcattttttgtctccaattacaaagaaagagagaggcaatggaagcaaattgagattgagcaggagataagcacggtagattctgatgtatccrggtacccagctgaccttgccgctcatttgggacctggcttggaaggattctcacagctctctgaaatctgggtaattagatgatttacactttttcacagctcttagatgacttaaaacaggcattcctgacactgagcctaagatctgttccagatcatatcaggcctcagaaacccctttcacacctccttgcagctaatatccagtcctgtgtctttttctgcctttttagtgaactcaggttccctccctggcctctggtccaccctcactgtgctgtacacctcttcctatgactcagctaatttttggtgcgaaactcaacccagcaatgtggtgtgaggttaaaagcattcagtttaaggagcagaaagggacttaaccaattaaacagccacacgaagaggtaatgacggtctgttataaatgctatgaagaaaaatacagcacgagcgttcttcacctgtgctgttgatgtaagtccatctcatccattgcaagcttttccctgtttgctcatcagaatcagatgctcctccttctgcagttttcacttacagcctctgctgatcctgtctcatttggctctcccctaccctcttcacgtacgcattcagcagacagttctgatcacgctgggcacactcaatgctccagctctagggccaaataggaaagagcccctgcccttgaggggcttgaaacaggtgagattagtgagcaggcgatgggagtggtgaggcctccggcaccctgacacacagtcaaggctctgggaacacagagacctcatgcccacctgggcagtgagagagagcctcagagtgatttgtaagctgagttttagaaggaagagagcagggtctaggggcgcaattgtcaatggctggaacacccagtgtaaagcatacagggttggcccagggagggaggctagasctgcctctggccctgttcaaattttaatcccgaagtacatgaaaataatttaggctaatagagagatataaggttgctggtgtcactaaygagcaaatttgacaagctttgtcaaatcataaagctaagtccttttaaactgaattctcatgctgatraattcattggtatgtctatacctgtacaaacaaaagtgatctgaatgtgtcagttgcaattacatattcaatatgatggctcttgcaactatatatttgataatatttttaataattgcataacctttctatatttgttttcaaaagtaaagcaaagcaagaaaaatgaatgaaaaaaaattgttttacttgctagcacaacccctgcagcaacagtgatagtctttgggcctatcaatagggggcagcaaagttcaggactttgggctgcagcagttgaaactagaggatctctggaggagagagtggatcctctctgagtgtgtgttgtgagtgtgtgtgtagatggcaggcaggcaggagctgtggaagagtgtggtgacagttctgcctgaacaacacaggcagtcttctttacctttccttgccttcctctatgtgaggaatgtgcgtcgcttgggtacatgtggacacttgaaagatatttgatagaattctgggaaaacggaagcagtcagttcctcctaaaaaaaaaataaataaaattaaaaaaaaaaaaaagtatacctaccagaagatgatgtgcgcaaatccagagaggggtcttggctcagtgaggaaccaggcaaattatccccttagggctgcgatctcccaaattgggaatgtgcccacccccatttggagtctaaatacttagtgtagatagtgaaatgagacacgtcttgtaagctgtttagcccaattcctggaaaatagtaaatactcagtgaacattgggtgcaattattgttattggtacacgtgtgttccttcattctcagttaaactttatcgtacagctcgyggtgaagggtcatgtaaggmatggtctgtaagaaggaacatggctaacttgctggtcaggacttctaggggtgccactgtgagcctttgacaactgcctttgttaattatcatcaaggacatagtgctaagaaactttgttctctaaagcctttgttgtttgaaatcagagcaataaaatggaacatctaactgttgtctatatgagctgagccacatgggccaatctgaccaatggagaagtagcttcaatatccccctcaattgcagagctctagacgtgggaattttgcatacaacgttccacatttcttttccctttgagggacctgaatcggcttcttaggtcagggttactgttaactctttggcacactaacttgctgtgcttgagtctctccagctcagcttcattaaattttacctaaattcacccctccccaaatcctacaacagccctgtctagtcctatgtttgactcgatgtctctaggctcctgtggtgtgcagtctcccctgctgcacgagtcaggaaacctgccttcatgttgatgttctccccctgttgggctccatcaaaagaaattttgccttcatccagtacttgtaatcccatcccagaaaaagcaaacatctccctcccactcccacagtctccgatacagagtgctcacagtgtgtgggtggagttgatattttgggttctaatgtttacaagaaacaatcttaataaccctactgtttttgcttgtattacaggaaattttgaacacacataagaattgaaagaaaagtataagaattgaaagaaaagctggctcagtggctcatgttgtattcccagtgctttgggaggccacggcaggaggattacttgaggccaggagctatgatcacgccactgctctccagcctgagtggcagagcaaaaccccatctctaaaaaaaaaagtataagtttgcaagttcctctattcagcatgaaaattaccataattttccaatcatgtttcatctattctttaactttttctttttttttttttccactggaatgtttctagagaaatccaagctatcatattattttatcctaaatacttcagtattcatctataattgataagctttttttctttttwtatctaatcattcagccattgttacaaataacaaaattagttattattccctgtcatcatttaatgtgtagtctatattctaaatttcctgtactatctcaaaaatattttttaactgttgatgtttttgaatcaggatccaaagtccacgtatgacttttagagattctaccactgaagtctcttatgtctctaactgctactctttctcacgtagttttcatgtcattaagttattggagaaattagatcaattgccctgtagaatgtcccacactgttgatttggtgttgtctaacttgtttctatatctatctgctgcatttcctattaaaccaaagggcagatccagagacttgcttcaatttggcttgaatgccttgggaatgatgccagaatataaaagcaggcagaagaaggtgaaagactagactggcttagcctcccagcctacctctttctcccgtgctagatgcttcctgcccttgaacatcaaactccaagttcttcagctctgggactcagactggcctccttgctcctcagcttgcaggtggccgattgtaggactgatatggtttggctctacgtcccgacccaaatctccataattctcatgtgttgtgggagagacccggagggagatagcttgaatcatggggstggttcccccatattctcgtggtagggaataagtctcatgagatctgatrgttttatcaggggtttccrcttttgcatcttcctcattttctcttgccgccaccatgtaaggagtgcctttcatctcctgccatgattctgaggcctccctagccatgtggaactctaagtccaattaaacctcttttcatcccagtcttgggtatgtctttatcagcagagtgaaaacgaactaatacagggaacttgtgatcacgtgagttaatactccttaataaactcccatataaaaaaatatatataatatatatctttacatagatatatatatacatcctattagttctgtcccttgagggaaccctcactaatacactaygtttaacccagccccagtgtgtgtccttactctattaatttgcctcctttgagaggagggtttttatgcttctttcatcctccccttctccggcacagaacttttgrgtacgagtacagacatgaggagcctaaatgtatgactctgtgaccttgtattccactcatgtacctgggaatatataataagatcatataggaaaatacttttttaaaaagagtatttttaaaaaaggaactaaagcctcttaataatcaaaattgccaaagtctgccttgcccatggtttcatctgtctctggtaacctgccctgcatcctcagggcctcacatctcattccaccctcatctctggtggaccattccgtggggctatgactcacctcatgaaagaagcatctcacctccagtacatgcccctgtcttttgctgtcagccctagggctcctcggacaccaaggaggcaagacactccaggggagactgtgaggccctggggcagtggtcgtacaagttcaggagtcaacaactgaaggagcgagcctccaccgagcagacaggagcaagtgatgaaacatgcctccatgttgatcctctggggcaattcttcaaggcctctccaggcccctcagaaaggttcatgaccattcaccagttgccttcagcagtgacctgggtagtgcatccttggtgtctctcctgcttcttgctcctcttggtccctctctcctgttccctggaattacctcccaaataaactcaggcccttgtctcagactcaaatatttgacttcctactgtatgcctgtatgcctgacttgagccatctgtataagtttgttctcatgctgctataaagaaatacctgagactgggtaattcataaaggaaagagttttaattgtctcacagttcagtatggctggggtggcctcaggaaacttacaatcacggcagaaagcaaaggggaagcaaggcaccttcttcacaaggtggcaggaaggagaagcaytgaacaaaaggggaggagccccttataaaaccatcagatcctgtgagaattcactatcacaagaacagcatgggggaaattgcccccaggattcaattatctccacttggtca

SEQ ID NO: 13493 - DNA, 40394 bp, Homo sapiens
gatcagagtttttaaagatagtttggtgctgggtgtggtggctcacgcttgtaatcccggcactttgggaggctgaggcaggcggatcacctgaggtcaggagttcaagaccagcctggccaacatggcgaaaccccatctgtactaaaaatacaaaaaattagctgggcgtggtggcacttgcctgtaaacccaggtwctcgggagattgaggctggagactcacttgaacccaggaggcggaggttgcagtgagctgagattgtgccactgcactccagcctgggcaacagagtgagactccatcacaaacaaacaaacaaacataatttggcaggtagggkctcaggaagcagagtgctgattggtcaaggttggagatggaatcctaggggggtcgaactgaggttttcttgctgttttctactcctagatgggatggcagaactgattggcccagattaccggtctggatggtgtcagctgatccatccagtataggatctacaaaatatctcaaacactgatcttaggttttacaatagtgatgctatccccaaaagcaatttggggcggttcagactcttggagccagaggctgcatgacccctaaaccgtaatttctaatcttgtagctaacttgttagtcctgcaaaggcagactggtccccaggcaagaagggagtcttttcgggaaagcgctattattaattttgtttcagagtcaaactatgaactgaattccttcccaaatgcccagcaatgaacaaggacagcttaaaggttagaagcaagatggagtcggttaggtctgatctctttcactgttataatttcttcagttataatttttgcaaaggcagttgaaactgtgtctttgaaaagacacagcagaaacatctgttacataaacaacagaaatgaggaagaaagtatctgactcagtagcaaaggaaatccacagaaagaatgttctgagaacggaagcaatgatcagaccaggtagggatatgatagaaagaaaattctcatctaattcaaattctggccagtccttttggtgatttccatactaatactaggcactttaaaatgtgagttctggtaacacatggaacctcaaagtagaaatgtctgttgttcatttttaaaagactatttgcagagttttgatgtttatcaatgaaaagagtttttttttwaaatttatgaagaatagggaatcctatatgggcatggggcaaataatcaaactgttttaatgcagaaaaaaatgtgcaacagaaagagatagctcatggagggataaagactttattctggaccctctagattctgkggggcctgcagtagcttcaagatgccccagcatgtcctgcgcccacacccctgtcaagatcactgtggtcagggcgtcttgcccatggccagtgtattagtctgcttgggttgccacaacaaaataccacagactgaggttgaaaacatttattttctcacagttttggaggctagaagtcctagatcaaggtgccagcagcgttgcttcctctgaggcagctcttcttggcctgtaggtggcgccttcttgctgtgtcttcacatgggcggcccctcagtctgtgtgtctaggtcctaatcttctcttataaacacaccagtcatactggattagggtccatcattttaccttaacggcctatttaaaggccttatctccaaatacagatgcattttgaaatactaagggttagtacctcaacatctgaattctggggggacacacttcaacccataacatgcaggcagacctcaatgctgcttgcagacccaaggcgaactgcacaacaatcaagcctggctcttaggacaaaaacatctgccagagtcaaccaaactgaattctctgggaaggacgagatgcctggtgtcataaaaagaccatagtcttttttaagtgtgatgcatgcgcacacaggcacgcayacacacrcgcrcacacrcrcrcacacactgcactgctgccctgtccttggcagacattcctgtggggtcatgttcgaaatatgcacttctgtggagtagcttgggttttcttggaagtctctttttctaaacttgtacctaagctgatggcctgtgcctgcttgggcatgaggggtcggagtggggatgggtcaagactgactcctgttcactgtgaagtagaggaaggcagtgatagccagacagggacgtgtgtttagggaagtcctctgtgttttcagttctgtkttygttttgtttttatgatgggagagatgagcaaatataaaggctgcttctaggagcabgagtgaggagaggttgcctatatgagagaaacgggatggtcaatactgtaggtttttttgagaaggtgaaatatggaattcattttttaaattttttaaatttttttttttttgagacagagtctcgctctgtcacccaggctggagtgcagtgatgtgatctctgctcattgcaacttctgcctcctgtttatataaacaggccaaaccctgtatgtatgtatgtatktatktatttttgagatggagtttcgctcttgktccacttgttgcccaggctggagtgcaatggcacgatcttggctcactgcaacctgcaactcccgggttcaagcgattctcctgcctcagcctcccaagtagctgggattaccagcactcaccaccacagccggctaatttttttgtatttttagtagagacggggtttcaccatgttggccaggctggtctcgaactcttgacctcaggtgatccacctgcctcagcttcccaaagtgctaggattacaggcatgagccactgcacccagccgaaagatggaattcaaagaagtgctggtaagtcactgtggtatttgtgaaaaaataaaaataaagagggtttgggctaggcgcggtggctcatgcctgtaatctcagcactttgggaggccaaggggggtggatcacctgaggttgggagttcgagaccagcctgaccaacatggagaaaccctgtctctactgaaaatacaaaattagccgggtgtggtggcgcatgcctgtaatcccagctactcgggaggctgaggcaggagaatcacttgaaccgagaggtagaggttgcagtgagccaagattgtgccactgcactccagcctgggcaacaagaggaacaagagcaaaactccatcaaataaataaataaataaataaataaaaacagggtttggccttgggcaggatggaccgttttctagaargacagccgtggtgcgctgcacaactggtatgaagcccagtttccatctgaagtcctcgatgttcatggaaataggggcgagacagtctgaggagtgtgaagaaggcctgaaaatatccttgcagagaacaggagagacaatgactgggacagccaggcagggctgagggcccatttgaatttccmgcagtgccctctgtcctgttgtgtgacccctccagcagtaggtactgggaaagcaggtggctgagttcatccaggactgaggctctgccagacaagaacagtgcagcaaggatgttgaaggtaatggcaaaaaataactggaatgcagagaaatgaaatcaaagctgatgaggagggaagggaagagaggagagggcagatagacttgggtagagaggacagaacaatgacagggcaaactggtgatgttgaggaagagtcacagggagcagctaaacaagccagctgcagggatggcactgwgtggctggagagcagggttctggagttatcggkttttccatgtgtgacatgggcctgggtgggtgaggctgagtgtagaagtcttacatttccagtcttgtcactcctctgatgagtttcagaccaatatatccatctgcctagatgtcatttctccttggattcacatgctccaaaccaaactcctgggctcagacatcaaagccactcaaaaatagctctctgagaaatagaactaccatatgatccagtaatccaacttttgggtatagacccaaaagaattaaaaacagaatattgaacagatatttgcatagctttattcacaacagccaaaggtgggaacaacccacatgcccatcaacagacgaatggataaacaaaatgtgctatatacataaaatggaatctttttcggccttaatgaaggaaggaaatcctgacacatgctacatggatgaaccttgaggatattttgctaagcaaaagaagccagacactaatggacaaatactataaaatccacttatatgagatacttagagtagtcaaatttagggacagaatcagatttgcaagataaaaagtttctggaaacgtatttcacaataatgtgaatatgcctgatactactgaacacctcaaaaagggttaacacggggccgggcgcggtggctcatgcctgtaatctcatcactgtgggaggccaaggtgggcagatcacctgaggttaggagttggagaccagcctggccaacatggtgaaacccggtctctgctaaaaatacacacaaaaaaattagctgggcatggtggcaggtgcctgtaatcccagctacttgggaggctgatgcgggagaatcgcttgaacccgggaggtggaggttgcagtgaaccgagacagggccattgcactccagcctgggcaacaagaacgaaattccgtctcaaaataaaataaaataaacaataaaaataaagggttaacatgggggctgagcacggtcagcgagagaatcacttgaggccaggagtctgagaccagcctgggcaacagagaacgctgtctctacaaagcataataataaaaaaatgagccaggtgtggtggcatgcacccgtggtcccagctacttgtgaggctgagatgggaggytgagactgcagtgagccgtgttcgcatcactgctctccagcctgggcacagagacactctgtcyctgaaacaaacaaaaaaagaggggctaacatggtaaatttcatgtttcttatcaagtaaaaaggcttgctgacccacaatctatattaggtttccctgttactagcaaggagtgaaggatgtgctatcccaaaatatgtccaaaaattggtatattattttgagctaaaaacaccggagaaattgtagtttcagaaagggctagatgacctgtcgtttcctacagggaataagcagtaaagattcctctgggagtggcaccctctctgtacccgggtcagaaaatagcccttatcaccagagactgggagttggggctgcaayggacctgaataaatgaacttcccaagtaacacttaccttccactaattttacaccctccccaatatttctcctagtgactctcttagaaatgtatcgccccagccagatgccttttgtgctttcttctcaaatgcatcattctttgtctaaaaagtataaaagcatcttgctgtggccacttcttcagacctcactctcttttgaaggtccccatgaaaaactaataaagtgtgtatgcttttcttttgtttatctgcctcttgtcaattcggtttctggctccagcggaagagcccgcagaagcgctgaggggactggagacggtctctggcgcccctacacctgctcagtgagccttcagccccttctccctgacgaagctcccagaggctggaactctggcgcgggaggcacttgggaaatcctcccgaaagcaaggaggagcctttcctagaccgggagcggtcccacgcgggggtacaggttggggcaggggcgaccgagccgggcacaggaactcgcagcagggtagggttggcggctacgccgccctcggtccgcggggaaccrcgcgggcttccgggtcacgccrccgcgttccgaccgccctcggggagaggggaggagcctccagcgccgggcggggcgtggttaaggccggtgggccccaccgcagccagacgctgcccgtttaagcgcagagggccgcgggtcacgtggtgggcggggtgggggcgtggcaccaggaagcggcgtccgcgccgggcccagagccgcagccgcagccgccgctacagtccgggccgggctccaccgcgcatcctgctccactctggcgaccgcccccggggcccccgccgcgggcgcggcgcccgccatgggcgaggaggactactatctggagctgtgcgagcggccggtgcagttcgagaaggcgaaccctgtcaactgcgtcttcttcgatgaggccaacaagcaggtccggcgcgcccgcgcttcctcccccgcgcggccctgccggggtcgtgggcgygccaaggccggtcccgcgcgaccaggcccgagcgtcccctcctgtcctgtcccgtcccgtcccagcgcgggaggcggcgcgcgctccttccttgttgggtgggctcagccgcggccaggtgtcctcgcaggtgacctcggggctggacccccgagccagctgcgcggatgcagtggccccgtggccagtgtctcaattgttggcgcgcccgtcttatctaggcttcttttgttgtgtttgtcattagttacactcgtagtcaagggtttagacgtcgagattttcattttccttgaaattttgtaaagggggaaaagactgtacttcaggcgtatcagcggcgccgatgcgcgaaccggygttagaacttggagcctcgggaacccgacccggtgtcacggtggcatccttttcgctctctgctcttggtttttaaaattcacctgagcagccaaacatctgtaccttgatatgtgccgtgttactttagttgaacccagggtggtgtataacagaaataatcgcttgcgggttggcttctgagtttagatcctttcagagttcaggctgttaaccttgctgcttttccctctcaggtttttgctgttcgatctggtggagctactggcgtggtagttaaaggcccagatgataggaatcccatctcatttaggtaatggtatagacactttcagatcattttgtcatgtaaacagaatgatgtttttctaattcaaatggttttttataattttgtcatttggtctgccctaagaggcctgaagtctgtgtgcgcacatggaattcctgtctgtagggagggtcttcgtggcacttactagcacctcttgtcagagtggaatatctggagcagttgatttgggagccaaatacttcaaaagtggggcagccacttcctagcactggaaattaacaagtcagcgtgatgatgtgcccatttctggtttgttcacagaggagggcgttcatttctttagcccaggtctttccagagtggcaggtggaggagattcattgtttctcatgtaataatacaagaaaatcatggcttccactatacttaaggtgactgcatagtcccagttcgcactgttgaacaggtttaatgatcaacagcagggcctttcactttcagaagtgtctcgatttggatgataagctatctggccacygtaacactggtgcttacagaaggtgaaagtataatgtaggccctcaattcagtagtgacttaaaaaattttactgttggtctgtgttaatgagaaactgtccttttttgagagggagcctccctctgttccccagggtggagtgcagtggtgcratcttggctgactgcaacctccgcctcccaggttcaagtgattctcctgcttcagcttcccaagtagctgggattagaggcgcccaccaccacgcccggctaattttttttgtatttttagtagagatggggtttcrccgtgttggccaggctggtttcgaactcctgacctcaaaacgatccgcccgcctcagactcccacagtgctaggattacaggcatgagccgctgcacccggcctgagcaaggttttaaagtatggatggggtkcgagcatggtgttttggggaactctgggtctgtgtaactgaaggttacatagggtgtctccacagggaaggggaaatggtggtggtgtggccactggcaggggccagcttgaaccttacatattctcctatgaaattagagctttatcttcttattgaaacttatcaggtggggtgtgggatgatcatgtcagtgtttggcaagatcatgctgttcacagcacggaggctggcttagttgggagcctgtcagagttagggatgctatggagagtagcaatcagcgagccatgtgtggtgaagagcagcgctctggtggtgtagagtggcattgcataggcaatcaagggatacttaggaagatgggtctctcgtaagacccgggggtcggttgggtgtggaaaacgagtgagcccgtgataatctagattgggggctctaagaagtttgtgggtggggggaaggtactgaatttaacttaaaaagagtttttagactgggcrcggtggctcatgcctgtaatcccagcactttgggaggccgaggcgggtggatcacttgagatcaggagttcgagaccagcctggccagcatggtgaaaccctgtctctactaaaaatacaaaaattagccaggtgtggtggcacgtgcctgtaatcccagctactcggaacgctgaggcaggagaatcacgtgaacccgagaggcagaggttgcagtgagccgagatcatgccactgcactgtagcctgggcaacagagcaagactcygtctcaaaaaaaaaaaaaaaaagatttttaaaagcagctttattgaggcatagttgacacataataaactgtacacacttaatattatgcmatatgtgagttttgacatgtatacacccatgaaaccatcaccacaatcaaggcaatgaacatgttcagaccccgaaaagtttccttgggcccttctgtaatccatcccttgagttttttttttttaaatgaatttttaatttaaaaaatgtatgtattggaatagagacrgggtctcactgtgttgctgaggctggtctcgaattcctgtgatcctcctgcttcatcctctcacagtgctgggattacaggtgtaggccgctgtgcccagctgagttcactttttaacatctgtctgaggcggtcatgagacactgtagtggagccatctgggttgcataatgaatgtgctgtgagatgcacaagtagatagttctttccagaagctttgctgtgagagagaaacagcagttacggagaaggctcctgagcgggtctatagttatttatgttggaacaattctcaggtgatatgtgtgtgtgatctgaattcttcaatcacttgttacccataatactgtaagtttcccagcaagttctttccagttggatttggtagtttgaaaagaggtcctactgatggcttccgaaacataattttaattttagactagaatttgctgcctcctgaatatagattgtgtcttttgccttttcaataaatggtagtagctagaattcggttatttaactactaacacaatctttcttcttaaagaatggatgacaaaggagaagtgaagtgcattaagttttccttagaaaataagatattggctgttcagaggacctcaaagactgtggtaagacttatctttaaaatacagcattaaagggcattagaaatacatttggaagagaaggaatcgcaaattttcagtgttaaaggaaacttttattatcttactgttgtgaaaggtatagttatgttgcattgtattagagccttcaaaaacgaaaaagacatttgagtgggttaaaaaaatgaccttagtttgatttttaaattaaattaaaaatttttttttgagccagtcttcctttgttgcccaggctggagtgcagtgatgtgatctcggctcactgcagcctcgatctctcaggctcaagtgattctctcgcctcagtctcccttaaaaattgttaaaaaataatttggaacttcrtgtgtcttttgtattgcttgatagcagcatagaatatgtgaggtatttttggctactttgtgaattagccttttcatctctcatttctgagtgctagatctgataggagcagatattccaagttgaagcagcctacaggcactttagccygtgtaaatgttcaccattgccgtttgtagagtagagggaaggctgttagaaacaggcagaatcctctgttagtttcttccatcagttttaagtgttaaagtcttggggaagcctcttagtgcagcaacacatttctctgacatcagctgcttgaggaatgaatttttgaaaggagttactaaactgtaactgaatatttgtattaacttaaaaaaaawtgaatcgtaagcctgctgctgttgagacagatgatccgaattggtctttttatctttcctgtgttttggttgtcttcagttattttctggtcaytttttaagttaatatttatttttcttgtcttgtagtatgccaacgtaggttggcagtatgctgcctaatccaaatttgtgtgtgtctgtgtgtttttcctttcaggatttttgtaattttatccctgataattcccagctggaatacacacaggagtgcaaggtatgaccccaggccctttctcagctgctggtgtcagtggtgttgagctgggttatgtagtggagagcggggcatyggggtcgcagggagcacagacttgaagtcagactgtccctcatgttgattcccaaactggagtcaggcggggtgtttgctttgtgacactgaacagttttctaagtttgaaagcttgttcctttggagggggagggttcaatggatgatgcgtggtgaacacccagtagtgctagcccttggggctgtcgtctgtcttgccctttttctcctcactgggctgacagcacatctgggtctgggccctgggatgcctcacagccacctggagtggaggtttctggtgaggagtttctttttctgtttcctgaagtttcctttcctcaatttgttgtctttgtcttgtccttactctttctttcttctcctaggtgttgattctaatccacattaatgagatttgctgggtgtagtaaactaggctagagggagctgagctaaaattggcagtgtggcaccttgggcgctgacagaagctgctagtggttggggtagggctttctgcatttttgtgactgttttgctcaatggagttcagggcggactctttggtgaggagaggtgcatccccaccactgtcctgcctgccctgcagtggccccgtgtgaagagaccctcagcccggcccttctcaaacctgtctgccctcaagcgagtcgggtgtgtgtctcagggtcctcaacccattttagtcaacactcactaaagacccttaggcctttgtacatttttaataaccatttttataacgtgggtgactaagaatgttggcagtatggtgattcctgcaggtagaagctgctgtctgtgagctctggtcagttacttttctacaaaacacagacttctcctgttctgtttagtagaaggaattaggattcaggttcttgaatgaagagttatgggcaaaaatcagggaacattgtatttaaaagaaaatttgttttgttaattagtaaacattccggggaacgttcattaaagaatgacaaacygcagagtttgtgaagcttttgaagagagttatatgtgttttttcttattaattaaaaatatttttaaaaaatttttcttagactaagaatgccaacattctaggattctgctggactagttcaactgaaattgtcttcataacagatcaaggaatcgaattttaccaggtattatgtttatcatttatgtttgttggttaaagttcagtgatagcattctggcagccttttgaattcagtactgaatatatatatatatattttaaacattttctagagatggagtcttgctctgttgcccaggctgcagtgcagtggcaccatcatggctcactgtaatctcaaactcctgggctcaagcaatcctcctgcctcagtctcctgagtaggtgggactacaggcatgtaccaccatgcctggctaatttttctttttattattttattttattttattttatttttgagacggagtttcgctcttgttgcccaggctggtggagtgcaatggcgcgatctcggctcaccgcaacctccgcctcccaggttcaagcgattctcctgtctcagcctcgtgagtagatgggattacaggcatgcatcaccatgcccgggtaattttgtatttttagtagagacgggatttctccatgttgagactggtctcgaactcccgacctcaggtgatccacccgcctcggcctcccaaagtgctgggattacaggcgtgagccactgcgcccggccctggctaatttttaaacttttttgtagagacgaagtcttgctatgttgcccaggctggtgtcaaactcctaacctcaactcctgccttggccactcagctytagyctcttgctggggattttattctttttttttttttttataattgcaagtaataaattaaaaaaaaaaaaaagaaaagaaaaagggcttggtggcccrtgcctgtaattccagctctttggaaggccaaggtgggtggatggcttgagtccaggagtctgagaccagccaggccaacatgatgaaatcccatctctataaaaaatacaaaatgttagtcaggcatggtggtgtgcgcctgtagtcccagctacttgggaggctgaagtgggaggattgcttgagcctgggaggcaggaggttgcagtgagccaagatcacagcactgcactccagcctggatgacagtgagaccccatctcaaaaaaaaaaacaaaaacacaacaacattaaaaagtgggcaaaggccaggtacagtggctcacacctgtaatcccagcactttgggagaccgaggtgggcagatcacctgaggtcaggagttcgagaccagcatggccaacatgacgaaaccctgtctctattaaaaatacaaaaattagccaggttggtggcaggcacctgtaatcccagctactagggaggctgaggccagggaattgcttgaacctggaaggcggagcttgtagtgagctgagatggtgccactgcactccagcctgggcaacagagcgagactccgtctcaaaaaaaaaaaagtgggcaaaggacatgagcagacactttttaaaagaagacacacatgcgaccaacaaacataaaagagctcaacatcactgatcattagagaaatgcaaatcaaaaccacaatgagaaactatctcacactagtcagcatagccattataaaaaagtcaaagaataacagatactggcaaggttgtggagaaaagggaacccttatgcactattgctgggagtgtaaattagttcaacctttgtggaaaacagtatggcgattcctcagagagctaaaagcagaactactgtttgacctagcagccccattactgggtgtaatatgcagaggaatataaattattctaccataaaggcacatgcacgtgaatgttcattgcagcactgttcacaatggcaaagacatggaatcatcctaaatgcccatcagtgacagattggataaagaaaatgtggtacatatataccatggaatactatgcagccataaaaatgaayaagatcatgtcttttgtgggaacatggatggagctggaggccatcatccttagcaaactaacacaggaacagaaaaccaaataccacatgwtctcacttctaagtgggagctaaatgtaagttatgaatgcaaagaaggaaacaacagacacggggggctacttgagcaggggagggtgggaggagggagaggagcagaaaagataactattgggtactggacttaatacctgggtgatgaaataatctgtaccacaaaccccgtgacatgagtttacgtatgtaacaaaccttcacatctatccctgaacctaaaagttaaaacaaaaaacattcaaacattgcaagatatgtaatatggaaagcaaatgttccctataatcccgataaataattattatgaacagtttggtgcatattcctctatttttaaaaataaatacaaacttctttttaacaaaaaggggaatgttgtatataaacttttgcagctagctttttttttttttgtccaaagtgtatcttggacatctttctatattttattctgactgggtagtatyccactgtatggatggactgcagtttaaaaattttcttgttatkggacattggctggttttccatttttttgtgattacaaataacccttcagtaacatgcttgtacacacttctttatattagagggagagttgcagtataggtacgaacatctgaaaagctgaaccagtatcgccaaatttcttctagacatgtgtattttcactagcaatataggaacttctgcttttcatacctttaggaggactggatattatcagtctatagacatttgccaacctgagaggtagaaagacttttttttttttttttttttctgagacagagtctcactccgtcgcccaggctggagtgcaatggtgcgatctcggctcacggcaacctccacctcctgggttcaagcaattctcctgcctcagcctcccaagtagctgggtctacaggcgcccagcaccacgcctggctaatttttgtatttttagaagaggtggggtttcaccatgttggccaggctggtcttgaacccctggcctcaaataatccacctatctcggccccctaaagtgctgggattacaggcrtgagccaccatgcctggccgaaagacattttaatttgcattttacattactagggaagtaagcatcttttcatttgtatattgtccatttgtattttgttaacttcctcttaaaatttttttattttgtaataattattttgagacaggatctctgtcacccaggctggagtacagtggcacaatcacggctcactgcagcctcgacctcctagcctcacgtagtcctcccacctcagcttcctgagtagctggaactacaggtgtgtgccagcacgcccaacttaatttttttttcctttttttttttttgtagagatgaggtcttgctgtgttgcctagactggtcttgaactcctaggttcaagccattcttctgccttggcctcccagagtgctgggatttatgggcatgagccactgtgtgtggtcaaaaatattttttttactgtggtaaaaaaacatacaacatttattatcttaactgtttttaagtgttcagttcagtagtgttaagtatattcattcacattgttatgaaatagctccagaacttttttcatcttgtgaaaccaaaactatccagtaaacaactccccttatcccttccctgcagccccagcaatctctattttactttctgtttctatgaatttgactcctttttttttaagatggagtcttgctctgttgcccaggctggagtgcagtggcgtgatctcagctcactgcaacctctgtctcctgggttcaggcgattctcctgtctcagcttcctgaatagctgggattacaggtgtgcgccaccacgcctggctaatttttgtatttttggtagagatgggrtttcaccatgttggccaagctggtcttgaactcctgacttcaggtgatccactcacctcagcctcccaaagtgctgggattacaggcgtgagccactgtgtccggccgaatttgattaccttttatacttcatataagtgaaattatacagtatttgtccctttgtgactggcttatttcatctaccataatttcctacaggttcccccatgccatagcatgtgatagggtttcctttttaagactgataataccgcactgagcgtatacaccacattttgcttatccattcatctgttgagggacatttgggttgcttctgcctcttggccattgtgaatagtgctgctgtcaatacaggtatgcagataccgcttcaagatcccgttttcagttcttttagatttatacccagagtgagattgctggagcagatggtagttctgtttctgaatattttagggaaccgctatactgttttccatagcagttacaccattttgcaatccctccaagtgtacaagggtcccagtttctccatatcctcaccaacacttgctgttttgttttgttttgtttttgatactagccatcttaattgtggttttgatttgcgctctttgttgattagtgatgttgagcacttttgtgtgtgtgttttggccactttgtgtatcatctttggagaaatgactaattcgggtcattgtgcctatttttaaaatcaaattactattatttgttgaattgtagttctttatatattctgatattarcaccttcttagagatacaatttgcaagtattttctccgaatccggaggttgcctttccactctgtggattgtgtcctttgatgtacctgcctgtttcttttcatctgttccagcttcctgacctattaagcatgcttctgagatctctaaggggaactaatttagagggtgttaagagttctttcaggttttaattttgttgacctaatgaaagtcatataatttagaatgtatggttagagaaaatacacctgtgtgttaatgccatggtgctttgctgtaaggccatcatcgaaatcttagtaatgactggctgggcayggtggctcatgcctgtaatcctagcactttgggaggccgaggtgggcgatcatctgaggtcaggagttcgagaccagcctggccgccatggcgaaaccccgtctctattaaactccatctttactaagtgccgtctctactgtctcaaaataaaaatacaaaaattagctgggtgtggtggtgggcgcctataatcccagttacttgggaggctgaggcagaagaatcccttgaacgtgggaggtggaggttgcggtgagccgagattgtgccactgcactccagcctgggcaacaagagtgaaactccgtctcaaaaaaaaaaaaaatttgtaatgaccaataggagaactttaaacaaactttagacaaattccatacacacagaaatagaattttgtacatgtgattgcatgggaaggatggcttgctttctgggggagttccctatggtaatcatttaaaagtctgtctttctgttctctgcagtgggaaagtataccttaaggttacctagatggcttcagatcttcaagaaaaaagttaaaaagaaagaagactctagcacatcctaattattatagttcttaagaagcttacggctcctgcccctgacttgcgcagcagttcttcagtgcagtgtaccatgagcattaatgtcttgggggctctgtacagtgttctgtaatatcggaatatttagggtacattgaaaatgtgcctggattataaagtactgcatttgtatggagtcttatgaacacatctgctagaagaagggagctcctcccaggcccagtgtagactggagtcgaggtggaggccaagcagaaggcagatctgccatggtctgggaggtggccgagttaacacatggggtcctggaggtgtcagtttcttttggccgtttcctggatgaggagaaatttgttgtaaattgctcttaggtgtatccatgtgctccacatgcccaggcatgtggaggcacagataaggattttggagggaaacagcctacccaggctataattgctttgttaaggggcaggttccctaatccactcttggagccttgtttctcatctggctaatagggccagtgatgcctgcctctcagtcgtggcaaagagtaaatgagttaggaggctctgtaaagcaccaagcatagggctggttaagtagtagctgtaataagtacaagtgagaatgttcatttcacttagtgggtttcttctgctttttattctcagagcgcactgtaaggatcttctgacagtttgctgttattgatttatttattaattgagactgaatctcgctctgtcactcacgctggagtgtgatggtgcaatcttgactcactgcaacctctgcctcctgggttcattcaagcaattcttgtgcctcagccttctgagtagctggaattacaggcatgtgccaccacgcctggctaatttttgtatttttagtagagatggggttttaccattttgtccaggctggtctcgaactcctgacctcaggtgatccgcccaccttagcctcccaaagtgctgggattagtttgccgttttttaaatgaagatcctgtttcttaaactctgcttcaggtattaccagagaaacggagtctgaaactcttgaagagccacaatctcaatgtgaattggtacatgtactgccccgagagcgccgtgatcttgctgtctaccacrgtcctggagaatgtcctgcagccttttcactttagggtaagaggaagcctcccctgaaaaaaacacctttccccagttgtcccctgttcctgtagcatcctaatgtgtcaggcacgttagggacaggttcctctagccgtaacgtcaccgctctgaccactagagggcactctgtatacccgtcagctcctggagccattcattctatgctgggcagacaggctgtgagaggacatgggggacggtggaaaggatccaaagacgaagtctgtgtttatccttgttggttttacacagggaatgatgaaacattgaaggggtttaataagcttttcctaaaacattttccccctaaacaggctggcactatgtcgaagctgcccaaatttgagattgaattaccagctgcgcctaagtcaactaaacccagcctttccgaaagagacatcgcaatggctaccatgtatgtccgtgtcagagagaattccatcctgtgattgctttcagtaatataaataatagaaggagtgtgttacaagcaccacgtgatgccctgacccctagaacacataaggaggactccccttgttctgggtattcagtgtataggtcctgtgaacatagaaaacctgcagtgtttttggcattcctttttgatttttatcagctttgtgatgctaaggaattcctttacctttctagcctgataaaacaagaacattgaaccaatttatttcttagtatctttgttttagaatttcttcttctttttttttttttttcgagacagagtcttgttctgtcccctaggctggagtgcagtggtgcagtgtcggctcactgcagcctccacctcccaggctcaaacgattcttctgcttcagcctcccaagtagctgggattacaagtgtgcgtcacctcgcccggctagtctttgtatttttggtagagacagggcttcaccatgttggccaggctggtctcgaactcctgacctcaagtgatccacctgccttggcttcccaaagtgctgggattacaggcatgagccactgtgcctggccaagtttattttttttaaaagctcagttaaataataattgttctaaataagaaaatagattaagattttatgtaacagacatggaactaaattacgtatatatagaggtatattttcttttactttttttttttgtttgtttttgtgatggagtcttgctctgttgccaggctggagtacagtggcacgatcttggctcactgcaacctccgcctcccaggttcaagcgattctcctgcctcagcctcccgagtagctgggactacaggtgcgtgccaccatgcccaactaatttttgtatttttagtagagacagggtttcaccatgttggccagggtggtctcggtctcttgacctcttgatctgccctcctcagcctcccaaagtgttgggattacaggcgtgagccaccacgcctggcagtacggaggtatattttcatttgaaaaagtggatatctcagtttttaartttgtaatgaaaattttaaacacacaatagagactaataaaaaagaacccctgtatgcctgtatctgattcgacaatagtcaaaattttgcttctaagttacttctgattcttctgtggcctaaaacagtggcccaaactttcaaactttatggtagttagtataatgttctttcatttcttcttcctttttttttaaacrtactcttctgtggcattcctgtttatttttaaattttttttggagagtgtcgctctgttgcccaggctggagtgcagtgttacaatctcagctcaccacaacctccgccttctaggttcaagtgattttcctgccacagtctcccaagtagctgggactacaggcgcatgccaccacatctggataatttttgtattttctgaagagatggagtttcaccatgttgcccaggctggtcttgaactcctgggctcgggtgatcctcccgcctcatcctcccaaagtgctgggtttataggcatgagccgccgtgcccagccagcattcctgtttagacaatagataaagtgagagcagtcctggctgaagtggaggtggggacctgttccctcccaccttggtctcctccttgtccctgggcaggcccagcacagagtttaccactggactagaatatgcattcaggaactgttcacagcaacatttattagatggcacttaaatagaaaaggctgagcatggtggcacacacctgtaataccagtgactggggaggccaaggcagggggatcgccttgaggccaggagttcaagaccagcccgggcaacatagtgagaccctgtttctacaaaaaaatttaaaaattagccaggcacggtggcacgtgcatgtagtcctagctactggggaggctgaggtgagggaagatcgccaaagcctaggaggtggaggttgcagtgagctgtggttgcaccactgcattccagcctgggtgacagagggagaccctgtctctgaaaaatgaaaaaaaaaaatagtgattatattttcctgttattaaggaatatacattcattatacaaaacttggaaaacagagaagaaaatgaacttagcatatcactcaagtataactattacatgtgtttctttccaatcattttagactctatgcttaggtttggggttttcttttaaaatattatgatcaagctgtgtttagtgtgtgttctcttttccacttaactttataataggctttgagtaactgcatgtttctttgtaaacacttgttggcagcaaaatactccattaagtgaatatcttataatttacttaaccgtgatgccatttagaacaaaggaattttgaatggccagatgtgatttatgtctgtttgttccctaattagatacgggcagctgtatgttctcttcttgaggcatcattctcggacctccaacagcacaggagcggaggtggtcctctatcatctaccacggtagatttcatgctttgttttccctctctctctgattttaaaatgtgaactgyagcttgttgatctgttttttgctttctatcctacagagaaggtgcctgtaaaaagatgcacatattgaagttaaataggacgggaaagtttgccctgaacgtggtggacaacctggtagtcgtgcatcatcaggatacagaggtacaagctgtctgcgtttctaccaaagttaaggttgcttaaaagccttgtgaaaattggtggctgggcacggtggatcacgcctgtaatcccagcactttgggaggccaaggcggacagattgcttgagcccaggagttcgagaccagcctgagcagcatggcaaaaccccacctatataaaaaatacaaaaattagccgggcgtggtagtgcacgcctatagtcccagctacttgtggggctaaggctggaggatggcttgagcccwggaggtcggggcttcagtgagtggagatcgcgccactgcactccagcctgggtgatggagcaagatcctgtctccgaaaaaaaaaaaaaattggcaaaatgtctgaataagactagaaagtgcatttttatgctaagagttttggtcttccagatggaaatgggtttggtagtctyaagtagtttagaaaaaagtgattgtgtcagttgattaaagataattcaaaactatttcagaaactaacgcttgagatttgaccttggaagaaggtgggaatccgctccattccacgagtacttgaactctstgttgcaattgtgagcatggatgacagtgctgggggataatggttttgaggccgtgtggaccaggacaactagaatgggtcctgtgggctgggcctctgatataaagaagctgcttmcctcctctaccctcccagagggtggtgacgctaactctgtgacacgtgaggatgtttccagttgaaatgacagagatctgcttaggtcactttgagtgagctcatcaaaggaagcatgtcataaatgcaggaaatacttgtgagaggagataaaaatattaaaagagagttgtgatgttaatsacaaattccttctcaagtaagagctagcctgtagggwggaaatgcaaacacaggcttttaaactgatttaaacagcaagatgggatggaatgaaagcaactgggcaaaccatgattgattttggcctcagtcttgtctttttcccccccagacatcggtaatattcgatatcaagttacggggagagtttgacggctccgttaccttccaccaccccgtgcttccygctcgatcgatccagccctatcagatccccatcacaggtaacacgggttctgtagaggagtctgtgctgccctttcaccatgtggctgtgttctcaccatgatctttgggagtcacgttaaaagtggagtgaggaataaacagagattcccagatctgtctgattttgccaggggccatttgttccagttttgttgttgttttgagacagtctcactgagtcacccaggctggtaggtagtgtcgtgatcttggctcactacartctccacctcctgggttcaagtgattatcctgcctcagcctcccaagtagtggggattacaggtgtgtgccaccgtgcccagctaatttttatatttttttaaatttatttttttgacagagcctcactttgttgcccaggctggagtgcagtggcatgatctcggctcactgcaacctccacctgtctgtcacaaggttcaagcttgtgaggtattcaagcaattgaaccaagtattcaatcgcttaaatacttgtgagaggagataaggttcaagtgattctcctgcctcagcctcccaagtagctgggattacaggcgtgcaccaccacgcccagctaatttttttgtatttttagtagagatggggtttcaccatgttggccaggctggtcttgaacttctggcctcaagtgatctgcccaccttggcctctcaaagtggtgggattacaggcatgagccaccacgcctggcccaaatttttatatttttggtagagatgggrtttcaccatgttggccagactggtcttgaactcctgacctcaggtgatccgcctgcctcgctctcccaaagtgctaggattacaagtgtgagccaccatgcccagcctgttctagttttttaaaaaatgcaactactactgatcctataagctaaaattatgttgtgaaaaaagcattttctaagatagatgaatctcccttgggaggaaatagaataatttatcttccctgagctttagaatggatagttttgattagccgttgatggtgaaatatgttttaatattgaatacacccgtaacgttttctgtttgccttagctctgtaaygctgaaattaactttggctgtaggtttgttactgtaacctgggatcacttttctctttctcacattccgtgtgacagtgatgatgaatattgcattctttgggactgacagtcamagtaagtgcttcggctgtggctcttaggcttacccaaatcagtcctccttctgtctggagaggtggggttgggaagtcagaagagtggaggtcaggaattcaggaaaagggaaagaagtcatttatttgcttcgttttgcctttttccagtgtaattgattttaagatagaactgaaagaatattcaacacacactctctctyttttttttttttccttaaacagaactttattttctcacagttctggaggctagaagttcaagatcaagatgtctgcaggtttgctttcttctgaggcctccctcctggcaggcctctttgcagatggccaccttctcactgtgttctcacagggtctttcttctgtgcctgtccctcgcagcagtctctcccggctctcttttgaaggagattggagtgcagaattggctagtctgaggtttcagtgtgcaagacrtagtcagatggctcacatttggaaccctrgtagtaatgttttattctttgtccgatggcattgggcgggttgacccagcctgcagtcaggatttccttgtaccgttcacccgggagttcagaatcgcactctggctgaaagttcagcaagagcaccattgtcagcctgactgccctgtcttgctggaccagccaaaagcttagttactttctggcacagttggaggaaggagctggttcttaacagacgttcaattaggtcttttkgctttctgtgttctttcaagcttcttccttttcctttgtaaataatgttagtattgaaagaatagattttgccaagtgattgtcttgtgtctgctgcccacttggcatgaaggtaactgctggtgaattgggggaaaaaaactaaacatttagaacaagcctgtccaacccacggtctgtgggccacatgtggcccaggacagctttgaatgcagcccaacacaaattcttaaactttcttaaaacattatgagatttttttaatgatattttttaagctcatcagctattgttagtgttagtgtattttatgygtggcccaagaccattcttcttcttcctcttaaggcccagggaagccaaaacattggacacccctggcttagaaccttcagctctgttccggtggtacaggaccagttaggaggcatcaggttctaaccatctggtcataagggaacagatgcgaggcctggtcacagtaacagcccgtgcagagatcaataggaggaaatcaggaatccactgagggtctggggatctaggtagtgtgggctgcaaagcattttcagaggttagtgactctccttttgtttcctgctgggctgtgagccctggcggcttgatgcatccgtgtgtcttgcccactgtgctgccactgggtgggcgtgctcaggaattgaatgggcctgttgagaaagatataaccagcacttttgggaagagtcagccaccctttttctttttgttttgggcctgttagaacagtgggtctcaatctgactacatattaggatcatctggggggccttaaaaatgaaagctctcacctgacagtgtgtaggtcagccacccaaaggtgagggctrtgcactcggcgcagaccttgacacttaggtccaaagcgcgagtgctcttcgccaaagcttgtctgcctgggctctttcctacctttgggtggtctgttcacaatgaccctttctctgaccagctgattgaaacctgccttctgattgtacctgggtaattggaacagaaccaggagtcatggttagcttgtagggctgcctgcatggctcatgagcagtataactggttgttaacggtccctgtcatgtgaggttttgggggtctgcttcccagacgagctcactgtgcttggacctactctatgcaatggataatcgaactaattatttagataattaagtggctgggcacagtggctcatgcctgtaatcgcagcatgttgggaggctgaggtgggcagatcacttaagcccaggagttggagaccagcctaggtaacatagaccttgtcttcacaaaaaaaaaaaaaaaaaaaaaaaaaaagaaaaaaagttagggcatggtcacatgcctgtagtcctagctactctgaaggctgaggcaggaggaccacttgagccaaggagttcgtggttatagtgggctatgatcaactactgcactcaagcctggacagcagagcaacaccctctcttaaagaaaaaaaaagataattaagctacaagccacatttatttgaaacattctccgtggatgatctgggtatttgattttgaatccttcaagtaaatttctcagttccttaacgtgcatatgtaaacgatcatgagtcatctttggttattaaaaataacccaaaccacagtgattgaagccttgacatgctttctttttcttggtgagattttcctggattgtyagctccttcccccttcctccccgtacgtgctttcagtgagacggaacagttcatttcttccktgactacaattgaataaacatttcgtaatgacattaaaaagtattgacttttgtgtcataagtaccagcatttgcagcattttctgactgcatcgttgcacttatgttttctcaatttgtaggtcctgctgccgtgaccagccagtctcctgttccatgtaaactctgtatcctttactraggtgtggcaccgtgcacaacagggcaagtggtcaccctcagagagtggtcctgaagtcctcctccgggcagctgtgaataamactccgagagccaccccgcaggcagcttccctgactgtccaggggcctygcgtttagcgtggacycagtacatggtgggcaggggcgagtgctagcggaaactgggtttgctttttgtttycatcttttcctggtttagaatttcctataacatgtggattcttcatcttggattgtctttcaacctgacatcattatcagcgcaagccaaggtaggtcagcggggacagttgtcgtgttacaacatggtgcttgttgactttggatcccagttgtagccagggacgttttcaaggtgaatctcttagaaatgacccctcctttcaagcgtgggaatgggatttttttttttcactttatamgttttttactatatgtgcattttatcaagaacatatactacttttaataattaaagcaacaactaagaatgccattctcctgcttaagcccattctggaaaagccagactccaccccagggtggatggaaagccggactccaccccagggtgtctccctcatttctcccatcraccttcccaccggtgtccgtgcccttttctgttctgcatgagcccgggaggtgtgctcctctttctggccttgctgaggaagcctcctcagtctgttaattgtctcttcctgggtaatytctttattagagaaatcttttttttttttttttttttttttgagacggagttttgctcgttgcccaggctggagtgcaatggcgtgatcttggctcactgcaacctccgcctcccgggttcaagcgattctcctgcctcagcctcctgaatagctgggattacaggcatgtgccaccacgcccagctaattttgtatttttagtagagacgaggtttttccatgttggtcaggctggtctcaaactcccaacctcaggtgatccgcctgcctcggcctcccaaagtgctgggattacaggcatgagccactgtgcccggcctaaagaaatcttatttttttaaggcagggtcttgctccgtcacccagcctggagtgcagtagtgctatctcagcttactgcagccttgagctcctgggctcaggcgatcctcctgcttcagcctcccaagtagctgggcctacaggcgcacatcaccacgcccagttaatttattataataataataataattattttgagacggaatctcgctttgtcaccaggctggagtgcartggtgccatctcggctcactgcaacctccaactcctgggtttaagcgattctcctgcctcagcctccccagtagctgggattacaggcatgcgccaccacacccagctaatttttgtatttttagtagatacggggtttcaccatgttggccaggatggtctcgatctcctgacctcgtgatctgcccacctcagcctcccaaagtgctgggattacaggtgtgagccaccacagccggcctataattttttttttgtagagacagggtcttgccatgttgcccctgtgtctctaatacctcgccaggctggttattagagaatctcctatgttactctttaatcctctgtgtattttcctgcctttcctctggaattcctaagaactcttgaggagagaattagccctgatgctgtaggcatccactgtatgtaatgcattgttgtgccttgtctgtaacccatagcctcatgtgacatccactgtatgtatgtaatgaagtcatttctctcctgtgcatctcgctggtgttttcctgtacagctgctctgtacctgccttgggccaactgaaaagggggtcacccagatgattttttatgtggcacttcattctcctgtggcatcccaattgggaaaggccacaccagatgctggcagtgtgggtgatcagtacatttatgggtcgatgaatggatgagttatgatgttccattgagagcctctggagttaccttttaaactaatgagctgttgtaggagaaaccaaagcacaggactgaagttgatgccacgtgttgacatctttttctattttaaacgttaaaagaggggctaggtctagggaagtccccgtttggaatgaaggactaggagctacacctttgatgtgcccctgaatgcagaggttacttggaaaagagtcagccaggtgtgcggtggttgggctgtcatcctcctgtggtagacacgctcctgaattgctcctgaatggctcagctctgctttggttaggaaggaaaagctacactgactgtactttgcggctttttatcaccacctgccacccgccccgcagatgtttaggggaaccacttttgggcttttgttacggtttgcatcatactgttttatttgctgcctcttaaaatccaggttacctctggaacctccaagtgaaacttgagcccatagtaaatctcttaccagacaaaggaagactcatggactttctcctccagagaaaggaatgcaagatggtcatcctgtctgtctgttcacagagtaagttgaatccttcccccttgctctgattccagtgtgaggcctgtgctgcccaacactttttatcgggatgtgggctacattgttgtgtcttgtctgtgacccacagcctcattctttatgtgaggggtggctatgtgaccccctaggaaaggctgctaaatggaaagatgatttgtagagatactggtagaaaagaacaataaatgggatggttctgaatgaaagtgggcacacaggaggggagtgggccaccacccctggccttcacacacacctctttcaaaatccaagccactcactgcatatgtgtcttctttaagaatcccctactgaggccaggcatggtggctcatgcttataatcccagcactctgggaggctgaagcaggaggattgcctgagcctaggagttcgagaccagcctggacgacaacatggcaaaaccctgtctctmcaaaaaaaaaaaaaaaaaaaaaaaaaattagctgagtttggtggtatacacctgtggccccagctactccagaggctgccgagggaggattccttgagcccgggaggacgaggctgcagcgagccgtttgtgtcagtgtacctccagcctgggcgacagagcaagaccctgtatccaaaaaaaaataataataataatcccctaccaatatgtgctgttggtgtttgtttttgttttggtatagatggggtcttgccttgttgcccaggctggtctcaaactcccagcgttaagtgatccttctgcctcggcctacccaaagtgctgggattataggcatgtgccactgagcctggcctgctatagcttttttttttttttttttttttaaccgtaaccagaaaggggttgcgaatgacatctagctgtcaggtctttaaagtattgtatttcttaragtgtcctttaaaggtacttttgcattggtaaccttttgagattagtttttatcatagcaacgtgtggaaattctgaagctgacatgaagttggtttgatccgtgtgtgaacattgtgcctttccagtgttaagtgagtcagacagagcatcgctgcccgtgatagccactgtttttgataaactcaaccatgagtataaaaagtacctggatgccgascagagttatgcgatggtgagttacatggagtatgacaaagggtcctcctcccccaccccctcccgggtattttctaagtaattatgatgcaaaattgtttcctatatattagaataaggtcgctgagatttgccgcctgccatagggcaaggtggcagtagtggkggatagtggaggagtagtaaattcagggtccctgcatcccackagctggcggctgcatctcacttcataccttcactgtttttgtttttcccatctgtgtttgatcttgcctgtagatccttggtctactgttatagatgagaaaaatcagtctctgctttgcaatattttgtatatttttctgttatgccagagtgaggacttagaaaattaaattagaaatatttatatttgccacacctttcttcccttttgggaaagaatcctgttgagatagtgacgattcagtgttagcacttagcaggcgtgtttgtagtcaaggtaataaccatggcttatcgccaccaattcccgctgtattacttgtacatcatatcttctgaagccagaagaaaagtttaggacaaggagaatgaattatttcaattccaggatctgattagtcctaggctgaaaatggttttaaaccaacaaaagccccagaactccactcccctttagctgttcatggaagggtaagaggtctgagacaggcactgaagagggccagttgctgggacagtgtccattcctacgctgccagacgtgagggatggcyragtccttttggactctattgctgtgggtgttctgggctgtgggaatcagtaggtctgatcccaaatggcagtttctgtgccgtcccacacggtctgctgggctccataaaccgtcatgactcagcagtgtgggccactgaccagccacatgagcagcatctggagtttcttggaaatgcaagttctcaggctacaccccacagctattgcataatctgcacggatctgaactgcttttttttttttgagacggagttttgttcttattgcccaggctggagtgcaatggtgagatcttggctcaccgcaacctctgcctcctgggttcaagggattctcctgcctcagcctcctgagtagctgggattacaggcatgcgcacaggaaaaagttgtatctaagtagagaaagtgttttccgctcatatcctgggtccacatcgaagaattcagtccttgtggatgaactgtaaacagcacccttcctctaagatgcygaagatcatagtttgtggtttttttctttcaggcrgtggaagcagggcagarccgaagcagcccgctcctcaagaggccggtgcggacccaggcggtgctggaccagtcagatgtgtacacccatgtcctgtcagccttygtggaaaagaaggtgggcygcagctttccgcctcttctggactgagaatgctcaaaacaaggaagttgctgaaaacgaggagacttcatgtgattagagtcacttgaagtgattagaatcactggagtttccttgggtgaggccctagagctggtagtttggcttctaatgctgaggcctaaagcataattgttgacgggtggttctggagcgatktgtgcaaaaccagtgaaagatgaacactgggccattttaagatggaaacaaggtgggggttggatagrgagttatatgcagcctcttttgcacctcgttggtatttgtaagaccacatttttttctccctaggagatgcctcataaatttgtgatagccgtgctgatggaatacattcgttctcttaaccagtttcagattgcagtacaggtaccttcaaatcatctgggcccaagttaaaacagaaggaatttaaaaaaaaaacacagtcactgtcttagaagatgactcatatgctaagacaggtctgcctccctgactcagaatgctgagtgactcctgacattattagttggaatgggaagtgtamggtcaagttggggtctttacctgcatgacgaaaccacttcttgtaatgacagacttttactgtgttggttagaatagccagtccttggggagcctctagtctgttgtagctgaatgatttggaagtgttctttcactttttacttttgtcctcagcattayctacatgaacttgttatcaaaacccttgtccagcacaacctcttttatatgctgcatcagttcctgcagtaccacgtcctcagcgactccaaacctttggtatgcattgccagatttttacttccattgtggttaaaaatggaaaattttaaccgttatctttccaactgaagtgggtctaaaaatgtctttcaggcttgtctgctgttatccctagagagtttctatcctcctgctcatcagctatctctggacatgctgaaggtaactctgatgtgtgaggttttagactatggaaactaactctgttcctgttgtttgcactgacctggacttctctcccttactgctagcgactttcaacagcaaatgatgaaatagtagaagttctcctttccaaacaccaagtgttagctgccttaaggtttatccggggcattggtggccatgacaacatttctgcacgaaaatttttagatgctgcaaagcagactgaagacaacatgcttttctatacaatattccgcttttttgaacagcgaaaccagcgtttgcgagggagccccaatttcacaccaggtgagaatgcaatgaaaagacttggggtaaccatagcctcaaagagtagcagagggcactggcagctggtgggcgaggaccctgggttagcatttttgtaaacaacacaatttgataacagcccacctagcccttggcccattatttgtagtagagtgaattcagtatactgacagaatctgaattatgctctggaactcaccgaggaggtgtgttttgagtcaagacacatttaggacccagatcaggcacagcccatctcttatagcagatcttggaatatctcttaaagccaggaataagacggcaaatggtggctaagggttttaaagggtctggggcttattaaggtttcagttttatgaagtatacattggttgatcattctcattttttttttgagacagagtctcgctccgttgcccaggctggagtgcagtggtgtgatctcggttcactgcaacctccgctgggttcaagcgattcttctgcctcagcctcctgagtagttgggactacaggtgcgtgccaccacacccggctgatttttgtatttttagtagagatggggttttactatattgtccaggctggtctcaaactcctgacctcatgatccgcctgcctcagcctcccaaagtgctgggattacaggtttgagccaccgcacctggccctggttgatcattctcatctccaaatagttatacaacctaagacatcatctttaggatagggaaggatcagggctgtctaatgaaacttctaggtctatttctagctcaatgtaagacggcatttagttaccataaggacaggttagatagaatctcttccatttagcttttgtatttgtctctcaaagcagatagggtaaccccaaaacttaggaaaacaatgtattttattaaagaaaaataagttaaaacccagtagacacacctacgagatgctttctttgtccctcatttcatgccacatctaactggcaattaaatctcttcctttctaggggaacactgtgaagaacatgttgcttttttcaaacagatttttggagaccaagctctaatgaggcctacaacattctgaaatcacttgctgtttttttatataaaaatgtgtacaaagttaatttattgcattaataaagctctttaaactataaaatgttataaagtgtatctacaacctcaactgtcactaaaaatatggtatagaacttgtgggatggcttactcctaaaaggagagacagacagtgcattgattggcctttacagagtgtcagtgagcggatcacattcacagccatctagtgtcacctcctgcttgccaaagaatgaggtttctttcctgaagaggctgggagaagtttagtgtcctgtggttgcctccagatctagtaatactgcttcccaagtcarctgtgcattcctgagttcacaggcgctacgttcaaagctgctgccaaacaaccgatggttggcaccatccggtgttcaacttggccttgccgatgcagcacccgtccagtggtaaaccgaccgacccttagacacagttcagtcaggatgccctgcgagagggctagaaatttagaagccgttcgcgctctgttcctttgtatygctcttcagtggcacaacttttggctttatttactgatggccctatgagagagagagactttttcttatttctgcaggagaaagggagctagttggctgggcatagtggctcacgcctgtaatcccactttggaagactgaggcaggagaattgcttgagaccagcctggacaacagagtgagaccacatctctctccctctcttttggagatgggctctttgctttcttcctcaggctgcagtgcagyggtatgaacacsactcactgcatcctaagcccacccttctgggctcaagcaagcttcctgcctcagcctaacaagtaggtgggactgcagacgcacaccacttcacctggctaattttatttttgtagagatggaggcctcactatgttgcctaggctggtctcaaacgattctcctgtctcagccttccaaagtgctcatctcttttttttttttttttttcttaaaaggaactagtatattagattgtaatagaactactttctatcccccggagatgataaaaagcccctcattttcttaatcttctacttcagtgsttcaatttagtgacaaagctataaatgaagcaaatcagtattgytctttcaaccgtgggtcatttttgtgcaaggtgaagtggccatagaagtaaaaggatcaaggacagtctcgagatgaagaaaggcagcaagcactttgctaagaaacgggaaatccatgagggacataaaaagctgttctgcagcactgctggtgtgagagctggctgccagatggactccttcatctcagtggcagggaggagctgccctgcctgctgacactcagatccattcaaggactggctccaggcctttgtgaagcagacagatcaggcctccagaaaaaacatcgacaacttcctaataaagtagtctgcaccatcatgaatcccctggatgggttttttcttttagaagaaatttttttactcagtatcatttatcattatcaaatgaccattagtatgagttcaaatacttgaaaagaatgcctcaggatagaattccctttcagtaatgtccttcyattgtgccacccttttaagatgagaactcttacctatgtaacygagtaagacaggragaaatattaatccrtgagtggctyccagtaagaccatggccaaatacatcctgaagtagaatatctggaaaatttgagatttggcaaaagcsamcaccacaatccctccaaattttbtaagtgtgattccacygaacacctaaaagaagagatactgtgttagaaaccacttttaccaacctgtaattgaacaaaaacacttccttacraggatttctcccaggttcaagtgattctcctgccccagcctcctgagtagctgggattaaacaggtgcacgccaccatgcctggctaatttttgtgtttttagtagagatggggtttcaccatgttggccatggtctcgaacccctggccgcaagtggtccgccagccttggcctcccaaagtgctggggttataggcatgagccaccgtggccagcccttatggggatttcttaatattcaaggttcaaagcaatgggaactgaacccaggtagcatcatctactacctaacactatttgctgccttatgatcctgggggagaggtatgaccaagttaaaagctgtgtattctgcacagacactgcatcgtgtctcccaattgattatctttctttatattctcaggtgaaaacttaaatatttaaaagtgttacgaaacaaagttttagtttttactctttaccaggtattttctacagtggtaaagagataggctaagccagggtgtagagttgaaccaagacgactctccaggcaccaaccgcacatcacacgctgggttctggcccgggctcccctgcattttaaatgrgaaagactgccagctgtctcatgtttaacttgtctgttattttcctgcttcagcacactgccacctaaaaaggagccgtaccaacaggtacagttccacagaacgtccgttctgtccacgatgtggcagctaattcatgaattgcctgaaagcttgcaatccttagaagctgctttgtaagtacaggatccagactcttcagycactgaggaggattactttgtggtgcgactctgccggcgtggccctgctcagggtactcacggagctgcccatgtgggcaagtgcctcttccgcgcgctccacgcggctgcctttcaygctcaccgtgaacgctctggttatgtggctgcagaactccayggagatgccacagctctgaaataaagcacttcctttaggatggctctcttcctgttgaagaccctaggcagccaccccgttctgaggatgggtgctaattacccagggcaccctgggtgctagaggaggccaagcatcccattggacttacaaggcctccatcacaccaatcttactgtaccaggaactttytggggccctctctacacacagccaaaagcctggttttctgtggcacgtttgtgttgaccaggagaaattgctggaacccgttaaggtcaccccacccgcaccgagctggcgcattgtcacaacttcttttcttggacctcagtgctcccctatctgaagcagggctcatatctgagagtacggatacactgttctattttccatgaataccttctcragtgctctcatctttaatgattaaaagtacctgataaccacataggaggcaaaaggcactggtcggagagctcctggggyggggtgcaattttctaagtaaaaagtgaacatcctgctgtcatcaggctacaggcttgtgcartctctaaagaataacaaattacaggcagactagcccagaactaggccaggaaatcacatttccatggtcagaggcaccatcaggtatactagtatagccgcaaggaatgggacaagagaaaaaattgaacagaaattgcctgtaatgtgcctatgctcccagatgtccaactcaatgctcgctccctctatgccctgtcccaccaccatccagcactcctccagcactcatcctgcctctccatgtgtgccaagagcaagcgccagacttggtatcttactccatctttagggtttacatggaatctaagacagccaattcccccaagtgaaacaggagctagggacaaactgagactgtatgaggactcaccatcaccaggytgaccaaggatacagcrttcagactgatgccccagagcyacrtaactmcaaacatgwtgaccaagaccatggcgatggtggcacacatgatgactgcagaccagagctcacagcccaggaggamcatggtcaccagaaatatcgcgcccagggacacaccgaggttgaagatagtgtcgtcaatgatggtcaggtactgttygyagargacataaaacacactggaggggagaggggaggyctcattaaagctcgctctcactcccraacactgcgtgttcatcctgtcaccactgccaagtggtcaractcctttgggaaacatcccttgcagaaaaccttgctggctgtctacaagactcaccgaaagcaactcacttgacctctcatggccactgaccacccagagaagggcccagcagtgatgcaaaatgtatatttttgataaagtttctgtttataagcccaatctatgctattttatagacatttacagagagcattccacagcattctgaaaaaacacaaaaaaacaaagaatcctgatctatcctgagacactacctcaggctcagcggggtccgtgcaaggcctgaggaaaacatgctttcatttattttctgccagagctaaccggctcttaacttcttccaaacaaatccaggccttcctgctttaagcgagatcatggggaggcaggaaaaataaatcacttgtttctcctacctttctacagtttctaaattcagtagttcatacataatacttttcttcctgggaaaaaaaacccctaacaatataaaaagtctacatacaggcagcatcccaaataaccagcagttagggattctggttcattgttggccaagaatgtgggcygggccctgctctgagccgcctgctctccaagcgccccctgccttaagccattttccagtgtgtgtctcttgcagctgtgcagtggcgcagagatcaagttttgcgtctctagccctcaggccttcacagagactttagattctgaactcctttgcccagcacccatttcctttgatatactgccctgtgctcagaatggagcaggggccagaacccaacctgaaaatcagcatcttgccaagggaaccctccccactcccacccagtgtaggccctttgctgggtaaaccccattgaaaaagggcaggctttacctgtaaggaaatactcggtaggcactgccgttaatgcccatggtttcggtgacattactggctrtaagtygggctttcttcagagygtcaataaagtcagcagaggtctgcagcacggtgtggtaggtcatgaagtacrtgrctccgaccctggtgccatggccaaggaggatgttaactgcagaactataggcagcaygtcccctgaggaaagaatcctgggtgtcaagagagtccaggtcttgcaaaatatcagcagaatctgagcacttgaggctaagcaaaatcacctgaccctggactcagaggtcagacccagctgtacatttcagggatgaagaaggcccccagataagggaacrscaaaggtttagcttgttctctcccagactggcttctttttttttttattttgagacagagtcttgctctgtagcccaggctggagtgcagtggcgtgatctcggctcactgcaacctccacctcccgggttcaagcaattctccctgcctcagcctcccgaatagctgggattacaggcacctgccaccacgctcaactaacttttgtatttttttagtagagacagggttttgccatgttggcctggctagtcttgaactcctgaggtgatctcaggtgatccgcccacctcggcctccaaaagtactgggattacaggtgtgagccacttcgcctggccagatgggcttttctcgattgctctgggttctttggtacatagctgctgtttctccacctggtttcatgtataatcaaakgtacagggtttactcagtcctgttgtgtaataggaagcaggaaagggcaagggccctgggaacaacctcagccctgccacttactggtcatgtaaccccgagcaaaatgaccacctctgagccccagtctcctcttctgtaaatgggtatamcaccacctactcataggctgcgtgatgagaaatggaataatgtcagggagtgcctggcatgacgctggcaccctggaggctccccaggaacggtggctactgccttcagaaaaactgaatctacttcaacttattttacgtaggccaaagcatccagtcagtgagtaaatcaagctgcaagattca

SEQ ID NO: 13494 - DNA, 84409 bp, Homo sapiens
cagacacttagcctgcctataagttcataaagttttgtttataacctaatggggctcttcttcatcactcctcatagaaagtaactgggggcatcagagagaccattaattgctcaaatcaaggtaatggaaagtggctatgttaaaatatctgaaagagatctcattgaatttctctattgttgacataggtctcaacacctattcttaactgctcagaggcaaaaccacgtgttccttactcttattctttctccatttacaatgctaccaaaacattgaggctgtttttccaaatttccttcatatactctcctgtgagtggctaagacaatagacaaaggtcaatactctgcttcaataccaaagagatgtactgagagctacagtgaatccctccatgcaaaatgtgtgcttgctcaaccaaacccagaaggcagaggcaagagctcctagaccttaatctctatgatcatgtaggaatcactctaatcttgatgtttcccccaagtcctttctttgactttgagacatttccagrggaccctctaacagtggagaaggacaaatggccactcatgccccaatatttttaataataaatacattcatttgttggggatgggagcttttttcctcagcttctcccaatttgatttyaggctttgaagttttctatggccaaataagaggaaaatgctgcagccatagctgaaaattcaactatgagagtctgttatttggataaaaatatgctaccagggaggaaaaacatccactgttctgttggtttggattcatgtatgtgattagcttgctcagctaagggctgagggcaagtgacacaagatgccctcaaaagaaattgatttatgtatttactgaaaggaaggaggaagaaagtgacaggactctggagttaaatattgtcgaatgtttaatttagcctaaaacactttctacctttcagggagaaactgttcccaatattccccttataatgagccctcctgaaaatcaktctactggttttccccagtaatttctatccttaatgaccctctctttcatcttgttttttttttttaatcattcattcttgtcttcttgctgattttagatgatgggaaatgccccttgaatcctcacaggtaaggtagaaatgttttatgattgagtaaattttgctaycttaactttawaattcactgtaatatgtcagaatgattacatgcaatgcctgcctcctttttacaatgtcttttgcaatgtcttcttttctactctgaagtaaaatacacagataacaaatattctaattaaaatatamagtaggaataaaaygaaaagtaatttataataaaaacaagatgcaaaaacttaggcgctgtgccagtagatgcaatgaggtcatcagaagcgtgcaccttccacagaatcactaggaaagcaacgcccacgcaggtggactgatgggggaatgttgtattagtgactcaaagagcattagaactgtggccaacaccagcctaatttttcaacatrgtgaacaactccrgtaaagagtctgaaaacctgtgataattgtcctttgattcatatrgcaattgcattttaaagatgcaaaaaaatgcttaatatttacatgtaaagtgcttgagttccaggctcagagatttttaacctgtatgaatatcgagcagatattccaaagttatgtgggatgttggacaattcttttgtgtcctgtaccccttgctrtttataatctagcaatagttttcaaaaagggacagtatgcccccaagggtatttttttatttttgtaatgaacaagagttctactgacattgagtgggcaggaggcaggggtgctggatatcttttaaagacatttccgtcctggaggacatggaaatccttatatgaactctattgtcgtagacatccagcacccttgccccatacccactcaatatcggaagaactcttggttataaaaatcaaaaaacacccctaggggkcatattgcacyctttgaaaactatcgttagattatcaagtgttaatgccaagaattttgtaactacctcttgtcacctagaagaggttgcagcaacttagagggtataacaggtattyagtacataaagcatgaacaataacttagtgtgggtgcraaatgcaatgcaaattacccagagctggtaagtgggatatcgaatatttctttggcatttatttttctttcctttctaaagcagaattccaagggtggatggtaatttgtggtttctggaaatactatgtgttggactgtgttgtcgagaactaagcagtatattgttgccatccttgtgtttctgttctttagccacctaggaacatatggagtttttacaaacgctgcatttgacccgagtccttaaggtaagatccctataaagatatttttgaaggaaatagaacactagggaaaaatggaagaytataaagcttaacttttctttacataatcatatattaaattttaagtatgtattaaattttcaggcatgaaggaaattgtgttggcagtaggacacaggtatgacaatggagttacaaaagagttcacaaaaggattttcatttcctccaggacagaaatgtcctaacaagacataacttatttcaggatgtgtaacatttccattattaactgctaggtggtgatgatgtggccttgcctgcaaagcagaagtcaggactgctgaaaaatgtttacgaactgttatggartcaattccctatgctacctgctggaaaaacaaaaataatctgatgctatccctctcccaaaaagtgggtagttgagtgtcctacaaaaagcctgaatggcagaatattcgaaatctagaaagaaaagattatgctgcgcctcagggtgtagatatgatgagyaatttttttctttcttttatttttttaaggaaatgataattatttaaatttctttggtctcatttccagagacctgtccttttcctggtctcctcattcagcctccatatgatcctgttgtgaacatcaagtttcctgctacactggacttaactataatgcatttgctgcaggtttccataaacacccatgaatcaaagacatggaattaccttagattagctctggaccagcctgttggacccgctctggaccaaccctgtttcctgagtttgggattgtggtacaatctcaaattctcaacctaccaccccttcctgtcccacctcttctcttcctgtaacacaagccacagaagccwggagcaaatgtttctgcagtagtctctgtgctttgactcacctgttacttgaaataccagtgaaccaaagagactggagcatctgactcacaagaagaccagactgtggagaaataaaaatacctctttattttttgattgaaggaaggttttctccactttgttggaaagcaggtggcatctctaattggaagaaattcctgtagcatcttctggagtctccagtggttgctgttgatgaggcctcttggacctctgctctgaggcttccagagagtcctctggatggcaccagaggctgcagaaggccaagaatcaagctagaaggccacatgtcaccgtggaccttcctgccaccagtcactgtccctcaaatgacccaaasaccaatattcaaatgcgtaattaaaagaattttccccaaatgccgtgttcctctattttatggtttgttcagtaaggtctgtatacatcacattgtttaccatcagtgtaataacacacaattatggttgtcctatttacacctcaaccattcattcagtcagcaaatatgtatcgcacaccctacactgcaagagaaaatcagagaaatggaaaaattcttcatcaccttaatattttacagggaagaacaaatgtgttttacatgttctttaaatcccatgtttaataaataggtcattgaaagttatatagtatttatctggaactgatgttaaaaaaaatagagagccaaaaattatagtagtcatcttgtctctgtaaaatgyaattmaataaatatgtcatgtacactgtatatacataagcaaacatgcaaataaaaaagcagcctactcaaaggttacaataatgttgcaacaattctggtagtaaccttgggatttagggacacagtgctttcaaaacgtttctctgatacactgccagtagcatctctgactgcttatttaaatgtcaatcagtaggctaggtgttctaggactttggtctcaaccctgtttcctgagtcagaatctacattttgtaaaagttcccctgggaattctgatggtctgccaactttgggagacactgataatattgtagataaagaagtgtaagcaactgttcagttagggakacaatagatacctgcatggaataacaaaaggtaattaacatgattatataatttgaatagtgttgtaatagttcataaaatggaaaagccaatttgagcccagaatctgggagayagrcagaactctggactgtaaagaatggcccagcaaagaggaagaaaatgggcattctaagttggtgcaataatatcagcacaggagaaaagacagaatattggggggagtggggagggaggaagaggctgttgatgagcctgatatcattaacagagacctcatgtgaggtgccagattacaatttattgaatgtactgaatgcataaagcataagacagaaacctggagccatgcagatacagggaacccaggacaagtcattatgatgcctcagacaatataattcgcagattctctatcaatagcaaagtaagatttaaggtgctgtgaaacagtcagatccttcaagaaaaacaagaatacaaggggtcctggagacaggaaaatatgatcataataataaatttgtgattccttctttctctctttttctctttctttctttttctttctttyttttttttttttgatggagttttgctctcgttgcccaggctggagtaaaatggcaygatatcagctcactgcaaactccaccttccaggttcaagcaattctcttgcctcaatctctcgagtaggtgggattacaggtgtccaccacaacgcccggctaattttttatatttttagtagagaagggtttcaccatgttggccaggctggtcttgaactcctgacctcaggtgattcaccygycttggcctcccaaagtactgggattacaggcgtgagccactgcgcytagcckctgtgtgttaagtgctggaactatagtttacagtagcattttatcctcccaacataccctatcasgaaaaaytattattgtcatccttatttcacagatgtcaaaactgaacagagaggtacagtaacttgcccaagacaacacagctagtaagtgaaactgaaatctggacaactgatttttttcagccaagctcttcaagcccgctgcyatgctgcagcttagctggcgacaggcccttatcaaggcagaactgtgccttgatagmggccaggaaggcgattcagagcagtaggccttgtccatgtgtttgttccctgcttcttcaccacttgaaaatagtgtttcagtgcccagtaacagggcacaatactcttttcctcagattaaaaggggagccatctgcttaaggtggttgggtgccactgcactgcacagaaggttctccaagtgtgagcttggacccargcagscctcaggtcagtggtaacggacgactgcttccgtggtgtyggcaggtggaaatggagggatacagctttgtscggctcatgaatccctgggcattgtcccgcctgctagagcctctgatctctgccccttcttcacctgcagtaaaacagtcactagtttggttgctctccctaatacctctggtcactgggagctgtgatctcaccaaacccctgccaggaaaarccccagaaaaagcggagggagtgagagycagaggctgctgctgccgtttgcaagaactgcaggggaggaggacgctgccacccacagcctctagagctcattgcagctgggacagcccggagtgtggttagcagctcggcaagcgctgcccaggtcctggggtggtggcagccagcgggagcaggaaaggaagcatgttcccaggctgcccacgcctctgggtcctggtggtcttgrgcaccagctgggtaggctgggggagccaagggacagaagcggcacagctaaggcagttctacgtggctgctcagggcatcagttggagctaccgacctgagcccacaaactcaaggtaactcaggtgtggagtccgggtgggcttctctagagaggaaaatctatttcttttagagaacattccctttgcaatgtcatggctttttttttttttaacttcaggtaagtaaatataactaataggagagtatactgaattaaataaactgggcaaatgctaattttgcatccaacaatgtagtttatcattctgagggtttagaaagcaccctatttgattggttagatgctrccttcttttcaagtttattttcaatacagttttgttagtatgtttgtgttggcttatatattggttaattcaaaggcaccaggcacttgctccctcattagcccttcctgcaaactcctgttccagatttttagttgtatagtatttttatgagactcctagttacatattatttattccattgtctacatagcttcatcttctaaaactaaaaatgaacaccttgtgctttttgtcatataattttattgctgccttataaatgactttcaaaatatcatcagttcttgtatgtttttgtactttcaccttttttctgcttcatatttgacttatttatcctattgaatgtgactcttcatttttttttctctctgttcatcatgtcctgggatatggtttaccttggctacttaaaggcatatgtaactgagaggargtttaattcagataaaatactatccttgagttgcmaactattttttctaattgaaatgttaaaaataagacttctcagaaattaactaaatcatacagtctattcaatatttccagttagttattttttaaatggtaaacctgctagtgtgactcactttttttccttacatcacacttcattatgaaagatgtgttcctcttttacaattacaaaaccaaagtaatctgccaaaaaataatgtaatattttgagatcttttagtgtataatattaacctttttaaaactctcattgtaactgggttattttggagggtattacataccatcttggtcttataataagaagagatccctccttctcaaaaataatcattttaaatatcgtacttcaaagtgataatctaggtcacacccacaccctttgggaactgccgtaagctaaaaccccaaggaaaataacagtccttctaacactaatcttgcctgctcatgagtagaatgcagacttggttgttggctttcttgtagcatgctgggttcatgcttgggagttttttctcttgtctgtagttagcgttgaaaataacaagcaaaataccggaggcagaaccagatagggcaaaggtctgattcacatggtgagtacacagggaaccatgactggtcattctgtcccctcatcctgtgggtaagtttccaaagttctggagattcgttcctctggtagsaattgttgagtcaaaaccatagaaacacaacccagacaaactgtcatattgtttaaccctaaatcatatcatttctctctagcattttcttatgaaaaatctaatccatatatctggctgcttaaactaagaacttgttctaacttgtcctgcccctagagctatgatactcactaggtgaatatcaacatagccaaytccatcttttggcaaagtgtattttagcacaaagcagacatctatctacttatytcatataatattagcaggacaatgccttttaaaggtaaaatgtatctattattcttgctccaagtctaaggtgaacactttcaaaaatttccttagaaaacttgtttagtcactcacatgtatacaaagagatattgaagaaaagatatacatacattttccttctagggttctagctttatatgattttgtgattatgaacaaatcatctttaaacaatccttataaatgaaaaactcrtcrtacacattgtttgaattcatatsatctgtaactttttaatcagatagattattttccaatagaaattgttcagatcaaaatagacatacctcagtatgaatacacagcatacatagtaaaaacatgttaggaaacatctctctgttgaaattactccacgtaagagactgataytttttagtaaagattttacaccatcatctacatttctgtattaaagatctggggcaggggaggacaataacttttcaattgtactaaaaataaataaataaaaatggacttccacattagggacattagtatatagaatcctggaattcttaagttagaagaatgctaagagttcatttaattcatatkcaacttccacgctttaaccttctacttttcccctttccctcagcaccaatgaccttaccaagtagttgtctaatttctacttgaatgctkccagtgatggagaatccactaccttctctatctagctattctaaaagtacttacgtgcctcctttaattctgcccccacatattaacacagtytctgtattccacatattacaatttgtgagcattactgtaactacagatttgtttttgctttctgagaaaacctgaagggtaaagactaactcttattacatttacaaaataatattactagctaacatggattgagtatttctagtgtgccagctctatgccttttgcacatatcaacttatttaaaattatacaacaattctgtgaaggagatttcagtattaatctcatttyatagttgtagaaactgaggcacaaatggatgaagtaaacttttcaaagtaaaacaataagaggtagatataggcttcaagtccagagatactgaattcacagcctgcaccctagccaccgygctgtatagaagtcatggcatatgtgggtgctgttatgtcttgattatggctgggccactgtccccacattaggaagcaaaacaaagccactctgatcaactgatttagacatttgcaaggtattttctccaaattctctttccttttaccctcatctttgagtttaagacaaggataagactgatttgcctttagaggtacagaacaataacaacaacagcaaaaacaggaaagtaacccaccactcacaactctccctgttgtctgtcctctctctaattttatttaaaatcatgaatgcagtggtttcacattttttaatcttggttctgccacttatcaactgtatctcttggacaagttactgactctttccaraacagttttttcatttgtttgtttccaatatgaatccmagggcttttaccccattagccatctctcacctctcaactagaaataaattccaccaaatcaatactttttcacaatgttccccagtagattaaaactatatttgattgatcagttgaaaaacagctcatatatttattcataaaggatttggtcatattttaatcatataaaatctaaacctacagtttgggtttctactgtgatattgggttctttttagaaaattgattctgaggaatgatattagggtagattaacttgtgaacaaatagttatcacaacaggatatttttgaagagaccaataattatttcattaactttacttattgatcatatttataaaactgtggacttctgaaatacaataaagatactrgtattctactagaagtctgaagatatgagagatctactttttttgtaatgtgagaaatagatattgaatatgcctttcaaattagtttttgtattttatttccagtttgaatctttctgtaacttcctttaagaaaattgtctacagagagtatgaaccatattttaagaaagaaaaaccacartctaccatttcaggtaagcctgaaatatacttttttaattttaaagataaatttctatgggtaatttggcattcacatgcatctaaaatatccatttactgaaaatttatagaaacgtgtggttttttttttaagaagtactggctrcataatatgtggggcccagtgcaaaatgaaaatgtgagtccccttgttcatattattgaaaatttcacagtgactgcaaagcattaaaccaagcyaggggccctttggggcatggggccctgtgaaactgcccaggtcacatacccatgaagctggctctgtttttaaccttgattaaaataactaaataaaacttataagtgtttgaatttttattcattcatctaaaaaactgttattgagtacctggtatgggctgggcattgaaataggcattgtggatgcaatagtggacaagacagtctcatatcctgggttcatggagattatggtctagtttaatgagcatagatgtgccttcgcaaaatgatattttgcttccatttggctccctagattcattcaaaggaactatgtatggctgactcttttgcatctctktcccgtctattcttctgtttatttagtgtgatatatacaatagccataatttttaaagaaaatctcttattttttcctcatctcttcctttatcaagaagactgggttgaatagggttctaatatcttaaytatgataccatattccgcagggatgatagagaccatcaagggagaacttcctccagttgaatccccttgtcagtaattcacctgtccctttccccaatcagatgaagacctgctgtctttcccagaatcatcctagtctgtcctgcctcttctgatctcctttaatcttcaatatttagtcaatgggagtcttcctttcagttaaaaatcaacractaaaccaaaaccaaatcaaaccatgtccagttaactcctatctagaaaaagaaaaaaaaaaatctccccttgaccctgcctgccttttccttttctctcctttccttcactaccagttttctgtatgagaactctgtatcattctctacatttctkmgcctatattccttccctaatctgctttagtatgaataagtctactaaaattactctcacaaaagggcacctaggacttgaggtgccagagcctatgttcttttactactagacattactaggacatttaacaytcttcctttctgaagctctcgctttacctgttttttctagtgccacttccccttggttttctcagacttctcttaccactcctgctcagtatccccaccagatattcttccccagggttcsaatctcacccaaaaccaaggctttcactactacctacccagaagccactttccctctgaagctacattgacaccccctcaataccagcagaattaaatcttccctcttctatacatccccagtaccttgaattaatccctaccttctaaagatattaagaggatcaattgagttaataagtacaaagtatttataatgatgctgacacataataggcactcagtagaagttagctacattattgttattgttgctgctattactaatcataacttagatcatatatatcatagtattatggatatctatatatctatatttctccactcatttatatagtcttcacatgtgttcatttatatatttatttaattttaaacagatctgcatttaaatattcttttatttttaaataattgtgtattgaggccaggcgtggtggctcatgcactttgggaggccaaggcagatggatcacttgaggtcaggagttccagaccagcctggcccacatggtgaaacccmgcctctactgaaaatacaaaaattagttgtgcatgrtggtacatgcctgtagtcccagctactcaggaggctgagacatgagaatcacttgaacccaggaggtggaggctgcagtgagctgacatcgcatcacttcactccaacctgggtgacagagcgaaactctatctcaaaaaaaaaamaacaacaacaacaacaacaaaaaagtatattgagaacctactacattctaggctctgggataaagtgaataagacatggaccttgatttccaggagccaatcagctattggggataacctatggatagacaagcaatgacagtagagtaataaggaagaactatgatgaggattctgtagtaggacataggagacctatctccagtctggtggtcaggaaagtatttctatttctagattgatagctgaaaaaagagtaggatcttggaaagccaagtggggaggcaaggggttgggtgatagatgcattttaaaccaaggcacagaatgtttaaaagtttggaggtgagagtatggtatatttgtggaaccataactggatcagcacagttggaccacaaacttcagggaaggaattaacaagagatgcaactagatggggatcagggatccatgctaggctttatattgagaggaatagggagtccctaaaaggatttcagcaggagaaatatttgtcctttagaaagattatgttgtccaattatagagaatagattggagaaagaccagtccagagccagagaargtagtcatgggactgttgtatcaatccagatagcagagaagctgagatggagtccaaagatatttaggagctaaagttgattaaacttggtgactcattagatgcagataatgaggaagaaaagggaattgttatggacttcaaggtktctggtttgaacagcagaatggatagggtgccattcagtgagaaagaaaatgtaagaaaaggagatagtttgtgagagaaggtgataagtatagatttggagtctgaggtgtgtatagaatatctacctagagatgttaagtgagcagacgggtgtagaagtttggccctcaaaagagagatctgagctagctgtcaacatttgggagacatcagaacaaagatggcaaatgaagaatttagagggtgtgaactcacccagggaggatgtgatgagaagagaaggctgcagacagagctcaaagtagcagcaaagtccaagggatgagccaagaaagaaaagtttaccaaggagcttgagaaagcctgttcagggaggggagaagaaatctagagaatgtgttatcctggaggcaaagggtcaaatgctattaatataagggtcaaaatatggtccctttgttatggaatagtgggacaagaccagatggcagggtgttgaggagtgaatggaaggcgaggaaactgaagcacaagggtcttatagataactcttccctgaaacttggttccagatgggaggagagacagggtagtttcgggggtgggggtgggtactgaggagcttaaggacatttgagaattttataaaaaggaatacagagacttaaatatttaagggaagactctatagaaatgccatgaagtcctttccaatagaaaatgtggggataaaacatctgagagagaatgattaatggagacttagaagaagcaggaagcattgggattcaaaccttgggctggcttggccttaggtagaatggctaccaccttcatggggggccaggaaagcagaggataacgttgcaaataaaattaagtttgtagttatgagtaggaagttgaaggatgtcctgtcctatatcacagagtctattcattttcatagctccagctccaagcttagcatgtacaatagatacttaagaactatttaattaaattaaattgtaggtagatgaagggaatataaggtgggaaacatactcattagggccaggaaaagaggattggggccggtatttgaaggtgtaccttttgtggcttttgccaagctaagcaaattttaatccctttgctgtgtgagacattgtgctaaatgccataagagayggaaaggactaattccaggctgaagacttttaaacaataaaaaggcatggatagcttttgaagaaaagggttctgtgatcaaagtcctttcagatgattaaattttttagtgatttcctgatttaaccttgttagaggtagactctgacagttggtgagaacagtctccaatttatgtgtraggcctttgcacctttctgtcaacccctgtgtatctcagaatatatttgtttcatgtggacaaaggtgtttcgacgtccattttaatgtaatctcttcctgaatgtccaaagttgcttaactatgaacttatgaagtgcaggagtggtatcttattcacctttgtaactctatagtagttgatacaaggaggcaaatctggcgtgaaggaaaagccttttattttgactgagaagatctggatttgaacactgccattaactatgtggcctctcccattccccagactagtcctgtgttatttgtacctttcccctatgtcctgctccactcatctgctgggtgtgattctagctgagccctgaaaaagtcatgagcctcactcctgcagcatgaactattgttgttgttagttcttgtaattgtagggggctgggctgtaggattggaggtatgaagatgcccatccaataaggtttgtggacatttgggcaggtgagggagtacasctggggtcatttttaggaattctgtcttgggctttaaaatggctagtcttggctgggcatagtggctcatgactgtaatcccagcactttgggaggccaaggtgggaggattgcttgaggccaggagttttagaccagcctgggcaatgtagtgagactctgtttctatttaaaaaaatacatacatatatatatatatatatatatatatatatatatatatwtaaattagccagacatggtggtacatacctgtcatttcagctactggggaggctaaggcaagagggtcatttaggacaagagcatcacttgagcccaggagttggaggctgcagtgagttatgatcacaccactgcactccagcctgggtgacaaaataagacctcatctctaaataaataaataattaattaaattggctagttttgagtctgcatatttttcagggacaaattataaaatgtttgtccctgaaggagttttgaaatagctgcaacaatcactaccttgtgttatgtaatgcattgttcacctaagagcaggggattggattagttgaccttctgcagtcctttccagttccacaactgcactaaattgggtacatgctgtgctggcttccccaagccctgaagtaggccactcctttccccaatccagctttgggcactgaggagagggttagaaggkytttaggccatctggctgttggaggagctaaagagcagcttgaaaaccatttagccatgtgttttcctacatgcrtgaaagtatttggtatgcatttatgaaaacatmcttttgttttgccttaaatctgaagaagcaggaggggaggttgaataaatactccaaactgtccactgaagtaataggtcttattaggttaaataacttaggagactttctctgggcatctggtatttgcaggcatgtgatgccaacaaacaaatcaaccaagcaagagaaccatggcaactaaatgcggcacacaattggcagcatagtcagcaccctgttgggctcattggcagctggggtaggtgggaatagtcagtggaaacttccatcaggagccaagacagagggtagcagctggaagaggggggtcagtcagtggagtccgacatgtcaggagtcaaaagaggtgtagacatctggactattctataaagrtgggggyctgagcctgcccygtggaaggaatagggagagctttggctcaggagtccagagatctgagttctgatcccagcaatgctaccagatcactgactgaccttgggcaagtcacctttgtcccccgattcctacctcccaggctttgttaactaaaataaggactgaactttgtgacctccacagtcctgtgtaaagctaacataaaaacaaacaaaaagcttcaggcacaagatcagaataaactccagsagtaggagttcaaggaaaggaataggacaaccgtgggtggcaagacaggggtagggaaagataggacctctgtcccagaaatcagagtttaccattgcttctgtaaccagttactgcaaacttagtggctaaaacaacacaaatttattcttttatgattatatwtctgcagaysagaagtccaaaatgggttttattgggctaaaatcaaggtgttggcagagctgcattccttctggaggctctgggggagaattgtttccttgtcttttccagttactggaagctgcctacactcacgggctcatggccccttcctccatcttcaaaaccagctgagtagcatcttccaagctcttcctaactcagattctcctgcatccctctgataaggacctttgttattacatgggatccacctggacagcccagaagaatctcatctcaagattcttaatmatagatacacagtcccttttgccatataaagtagcatatttccaggtcccagagattaggacrtggacatctcagcagggrcacattattctgcctactacacccaccaaacaaagccctcccacggtgtcctccatctcagagaatggcaccctcctccacccagctccccaaaycagaacctcatcagccatccacagcaactgatgtcctttattctctaccccacatccaatccatcttcaagttccaactattttatctcataaatacatcactaatatattctctcctcatcatctcatcataatctcagtcaccaccatctctcctggagtcttctatctgttctctcaattgttctctgctcagtctcctccgagatcatcctccacaaatacagccagagattttaaaaccaaaatctggtccatgttgcacccctgatgaaaactctttaatggcttccagatactcttaggctaaagggaaaactctatgaggcttacaaagccctgcatgatgggactctgaggatgccttcggcttcaccttctgccccttcctttcacatactaagctccacctccccactggataactgtcagttctctaaaaaggccacattttctggcacctcagggcctttgcgcacrctactctaactttttagaatgtctttggccatcccttttcctctctgcctttggacctcagttaaaggattaattcctcgggaarggattccccaactcacctccaattggactagattccactgtcaaatactcttcagagtattccctccttttctgtcataatatttaccataggtttaaattgaatgtttttgtgatcatttgtttaaaatctgtctttcctactataaaaacktataaagttatagaactataaaaatgtttgacttttataaactctatgaaggcagggagtgggtgtatctattttactcttttacgcaccattgcaattctgatgcctaggataatataggcacttgatattcattgaataaataaaggaatgaataaaggaatgaatacaaggtggaggtgtagtataawgaagtggcttaaaagtcacgatctagagacagacatattaaactttaaatcatgatgctgtgtgatattaggcaagatatttaaactctctgaggctcagtgtcctcacctataaaatgaggatcttaatatctaccttaaaaacttgtgaggattaatgtagggacttacagtgcttgaatgtattaagggaaacagtacaggaaagccttattatgattatcatcaccactgcaaacaaatgctggctgaactccatgagtgcygtgacttccttctcctgcttctaggaygcctaatggcgagaagccaatcccatgacacttgtggatggctcagaaatgacagtagttgatttctgtcacttgtctggaatggggcttttggtcatagattctcaagatttcaaagacatcaagatcaccaaggagcacacgttaaagtccagattcccaagtttcacctccagaactcagattcattgaggctgaggtgatatttggaaatctgcctcttattaagaccctaggtgattctgatgcagagactccaaggactacactttggaaattctagtacagtcatcccttggtatccacagggtattggttccaggactactcacagataccaaaatttgcagatgctcaagtcccttatataaaatttcatagtatttgcaataacctatgcacatcctctcatatactttaaatcatctttaaattagttataatactgaatgcaatgtaaatactatgtaaattgctattatgttakagttttatttgtattgtttttattgtttattttttattgttgttttttgaatatttttgatccaaaattggttgactccatggatgtgtaaccatgaatatgaaccatggtcatggagggctgactatatayaattcctcaaattctgactcagccatcaactttttccctaactccccagacagaatttgtgcttcatcctctcttcttctgtaatattttgcccatatctcagcagtyrctcctatcatacatctatctccaaactagcttgtgagttccttcagtacagggactgtatttgatccaggtakccagaaactttctaacacagtgcctggcatgtagaaagtaaaacctcattcttgatktctgcacccataacctcctgtctctgctgtgttctcccattgcagtaactaataacatcatttacccagttgttctgataaaacaccttgagktcatccttgacttctgtctctcacaagccacatgcaatccatcagcaagtcttgtttgccttacctacaaaaatgtccagamtccaaccactactcatyacgttctgctacatgtgctggcccagtacactgcagtctctttcctatactgcctaatctctctgcttccattcttgtccctacacagactatyctctacacagcagctatgatgaactttttgttttaggatgaacttttaatacacgttatactatgtctctgctgtacaaagtggtttttcattttacttagaaatgctccatttcacttagacraggcgtggtggctcacacctgtaatcccagcactttgggaggctgaggcgggtgtatcacctgaggtcaggagtttgagaccagcctggccaacatggtgaaaagtcatctctactaaaaatacaaaaattagctgggtgtggtggtgcatgcctgcaatcccagctacttgggaggttgaggtaggagaattgcttgaacccaggaggcggaggttgcagtgggtcctgagattgcatcactgcactccagcctaggagacagagygagactccatctcaaaaaaaaaaagaaaaatgctccagtgatgtcccatttcacttagaagaaaattcaagttcttaccrtagcccatagggcctcccttgttctacacacctaccatccacctcatctcttctttcttcccgtactgtttttcttactgttccttagatacatcaagactactcctgcctcagagccagagagctgtgtgatttggttcctcaattcatctaggtctctgagcacacccatktcagagaaatctaaagtaactaccctctcgcatcamcctctgtaattgaaatgaacatctttcttaagcaaagaaagttattgctaaggaatgacagtgggtcaaagtgggmaagacttggycagaactatttctcctactctgttgacttcttttggstccaggacaagtgtttctaccattctattgtgatctgtgtacatgtaatgttgagttaatgagctgctaaaaccttctagattgaaaataagtgagtcagcctcaggaccaggaggaatggtagcaatcactcttggtatcatctgtttgtttttcttgcttagcaactctgcctttgatgaccctgaatacagacatagtttaaatatttgttttcacaggacttcttgggcctactttatatgctgaagtcggagacatcataaaagttcactttaaaaataaggcasataagcccttgagcatccatcctcaaggaattaggtacagtaaattatcagaaggtaagataaatctaatatttttctgaaaagggaaaatgtctaagtctttaataccagcatcaacatttaaaactatactgttaaccacrtgttgttagggaaatctcttgcaactggtaattataaaaattgttgctgttgtaagttttgagagaagaaaaggaaaaggttttggagtcctctagacctgcatttttcactgggttcttactctttaatgtttgggagggcaagttatctaatttctctgaattctcatatgttcatcttaaaatgggaataataatacatacrttgaaagatggtttaaggcgggggtcagtaaatttttccgtaaagggccagatagtaagtttgtytggcttygcaggccataagatctctgttgcaagtactcaactctgccttttagtacaaaagcagccatagacgatacctatttttttggctttggttacagatgycagaactaattaactttgttaccgtattctttccctcaagtcatacaccagagtaagaccrcctctgacaatacaattttatttacaaaaacaggaaaktggttgggtttggcccatgagccactgacatagtgacatagaactagcctgatataggcttcctggcacatagatgacactcaataagtggtatttggtggtggtgagactagaagcattaatagtattagacttttggacatagtgaagtggttaagaaagtaagcyttaaaggcagacaagttaaaattctagctttatcatttctgattctacgactttagcatctctgagcctcagttttctcatctataaaatggaaatgattataaccacccataagattgcctgaaatttaaatgargtcacttaggtagagtactaaacatggttcctgggatcggataagctctctataaataatgatgacaatgatggcaataatcataaagataatagtcatgcaagttattgtatcagccgctgaatagtaagtacctgatgttaatatggttctaattatcccattatgmygatgttcagatcattgtaagcatagtagagttccatcaggcactggtataaaaaattgtatccatattataatagttgttggtatgakaacattttaaaataatttcagacttttcatggttcacatttaaatatctttccttctacatgttccagccatcatacctttgagagaataattgagtaggagagtggtttatgtgcaggttttagaactagactaataagtgcaaatcctggctcagtgacttttatgaagttatttaacctctgtgtgcctcatctttctcatctgtaaaatggtaataataatcatgtctctgtcatacaggtttgttgtcrtgaaatcttagaataatgactggcatatracagataataaatattagccatgatagtaaagataattcttcaattaaaatgtgttcaaataatttagtatttatcttaaaacttgttagtttcagaaaaaatcagaaagtaatttttaaatttattrttttctatataaactgttgtcaaactcatacccactaaggtataagtgactgataataggtcaatgaactaccttccttaggagtacttgcattagcacttaatctttggcttgaggaaaaacaatgaagcattaactgtggcactgagatttcttccaaagtgaatttggcaagactctgggtgaggtagtgggaacaggagtttctcctwtgttcttaaaatcatacagtgacatagtgaacaaccacttcacctacttatgargcttctagacractgcatcagaagttcagcaatgtaaagaagaagggggagaaacctcaaaatatcaaaatgtcacatgcaggtttcatttcaaataagggaggaggtaagaattgtagactttggaccctacctgggctgtttgcacagtgaatgaaccttgcaacactatccctcttcctttactgtttatttgtccctacattccctacagccagcaattatttatgagcaattgcttaaaatgctcccacagctttcactggagacatgattattggcatataatattgcctctggtcctatgamtctaagaaaggtaaatacatattggtagggaaagtaaaattttaccttggaaatgagatgcaaayctagtaagcagatagtatcttttatggtaaaagacaagccttataagttgattttattatgccctctgcattaaaataaaacatctcctcctccatgtctgacactcaccctcacctatagcctccctctgtggtttgagctattttttkgggagtggggataaactaactgcatgctgagccagttacatgagaatccagattcctctatctcagaggtagatatttgagagataggtggtagggggttaagatagtattacactggcttgagaaaccacaacagaacataagagaactctggataaccctttttgacagaatggacaaacggtgatttgtaaaaatgcttgtaaggacatttcctttaataatgtatttaataagactgtcttagatcagggaataaagtatctgcaactgtaactaatcacttaaaarctgtcactaaagggtttcaatttgaggttaaattttcagaaactctgtaactagcatgcatcaaattgacttcaatgctgcacctttgagcaaagtttgttgttcagtaaaattttcaaagtcgttttggtcaattacctttaaaaagcttgtttcatggagaatttaatattattcttttcttttagttatattctcatattttaaatatatgagttgcatatgaatgtgatgtcacmaaattasttctataatatatagccatctgctggtaagccagctctccaaataaaacacrttttctgccagacattgttcgttgtatctaagtgttgccaaattctctatacaaaaatttgctcttctagatttttcyaaaacattccaatgcttgacttaatgtaggtgattacatyttttcacttctcatctgaatattttggccttatgtagagacttccttgagtatatgataaacacctgaaacaaactataayggctatagtttgtatatttaataaatcacaaaaatgtggatcccttttccaaagagacttgcaagtcctgtgcaatgaaatcagctctttataaaayrtcagcattgattcgcccattgcctacattatagcttctaaaagaatattctgaatctttgaatgtagtgaagsattcactaagtttattaacttaggagaggaaaagagttgttcacaaaaataagtaacaagggaagagttactgagtgagcaccctaatgagtaaccaaaaaggctctttatgtaacttcactttcccaaagcttgtatgcaccatttttcatttttaaaaaatactgagagcctttggcaagtaattagtacatcatgacaagaataaatacaatacaaagctgactatcgactgagcaggaaatgaacagaactgagtaaatataaatgaagagctacccttgtgtaaagattttattccagcaagcagctgaacaaggacttcttgtgctctagcacaatagttgtccctgtccatttctcttcttttcagtttagagcttaattttttttattttgattacaaagtcaaaatcacattcaccaaaactgcatctcacaaatgcttcctcttaatagytgtttgtattttatactttatattaatgtatgttgyaaaatcaaagatacaacaaacctgttttattctagactaaaggtaaaataatttgaagtgaaaagaataaaagcattgataaaattacaccccaattktctcattagccatctcactcagtgtaattatagaatatatcctatgtacaagtctatatcattcactgtttcaagatgctcataattcaacttttagtagtatactaaacttaattaacatcattcatttaattatttgaaattcatcttatatgtaactgacaggcgaatgtgaaattctgagtaatttagtttgatcaattaracagacattaatttgtgtgactagagtaaccyttcattatctatctcaaaatatcatgtacacaagtatatayaataattttttaagcccagtatgtgttaaaataaatctaggtgtgaaacattgattgtttacagataggttcaatattgttagaaaatcagtcaccctgctatacctagcacaagtgttatagcatcttgggcaatttttagatacttacattggttggttctcattccagattgacagtgtgttctaattgtagccctagaagaaatctagaggtcaaacctatcacaattagggcaccaacatgtaccctagagttaactaggyagagcccctcaggggcccaggccctktcttctttacatttgtactctggcatttagcacagagcctggaacctagtggatgatgatggtcatgatcatgatgatattaatcattactgaactaaactgaggggcygaggactgattagaaagtaaggactatgcattatttttcccttgctttaaaattattgattttgctgataattttgagcaggtactttgtcttacttattaccaaaaaaaaaaaaaaaaagtacttttaccaaaaaagtcttatttactttcatcgcctttggaatagatacatcactacaatggattggaagtttgtgtcctccaaaaattcacatactgaaatctaacctccagtgtgatggcattagyaggtggggcctttgggagatttttttttattatactttaagttttagggtacatgtgcacattgtgcaggttagttacatatgtatacatgtgccatgctggtgcgctgyacccactaactcgtcatctagcattaggtatatctccmaatgctatccctccccbctcctttgggagatttttaggtaatgaggatggagccctcatgatragattagtgcccttataaaagggaccctctcactcaccctctttctaccatgtgaggatacaaggagaagatggcagtctacaacctggaagagaccctgyaccagaacccaaccatgctggcaccctgattttaaacttccagcctccagaactgtgaggaagaagtgtccgttgtttataagccactcaatccaggktactttgttaacagcaacccaaactaagaaaatcaccaatttctatcttactcacatgtgttaccagaactcragcacacttaagatctatcttatctaaagtagaacataaaggaaagaggctgtattaattgcaacatgactgggaaagaaaatacttaaccaaaatgtgaacatgtattcccacaggctatcagagcatttgttaggagccagaaattttacaamtattttccagtcttcataacccatcaaaaaggataaagttatctctagaaaaaggattatattatcttaaattataaatgaaaaaactgaggtyaaagggacttcaagaaaccttcccaagttcccacagttagcaaatgatacaaccaccaagatattttcaactctgaccctgaagttcaagtgctttctcccactatctagcagaaaaaagtatcgttaaccatatagtctcacaaataytgaattacaaatggcgmtgagtgctgtcaaaaaaccaacaacaaacaaacaggtatcacaatcagagatcaagaagggtgtaagatgatatttgatctgacatctgaagaatgagcacacatttacccagaaaaakaaagggaggaagaacttcaaaagttatctcctaccctgcaaagaatataatgttttgcccttaggggagcttgtgaaggcagtggaaagaatatcattttctactatagaaaccccatgtgatgttttaacagttgaaacagtggaagctgcctgtccagaaacatcatttttcaactttatgaggccatgtagcaagaagcattgaagaagggctgtcatgcttgattcaaggtagatggtgcagctcatcaactagccatgctaatttcagttaatasacaagttctgacctgagagggcaactctccttatcagtcctgtttgtgctttgttaccaaagctcttttgtaatctttcacagataatgcttcctgcttattagtggagactttctccataaactttttttcttttatagactagaattatgttatmacttacaggaagtgacttaagcttttatcatttctcagctcttgacagttttattatcaaagtgaaagtacagcctagagtaaatattagttattagtgtcaagctatcctttggggtgtgttgggggaagacacaacaaagtccactttatgctagygcaaagttcacaaactcagatgcctatagtagccagataagtagttcagtgaacaaaattggtccagtaagdactgatcatcagaaagcagaaaagggcagctaagatccagatccaacaaaattctgtgcaggagtttggtcctgttgytaaccagatctccaggtttttgttttttaaagagaaaccagtaatccaaattcttatataatttctccggatgtttaatgttggcatttaatctattttaacattacgcaatcataacaacacacagccatgagctttgacttgttgacctaggctgtagcccataggaccttaaattttaggagtttaataaatattcactgagcatcttcttcatgttcatgttccatgcttctctaggtacctatggaaggcaccagagacactaagacaaatacaatccagcacttttccttgaggaactcacacttgggtgaccaaaatgtgcaggacacaaatacttatgatctagtagaagaaaatgaattagtcayataatctcacaggcatttaattacaaattgtgatgggtgctgtaaaagaaaaaaatgtgtatcagaattggagataaaggtagaagtgaacagatattcaaggtgatgtctgaatgatgagcacatatttatcaaaaggaagacgggaggaagagcactctaggcagagggaatggcatctgcaaagaccctgaggtaggacagaacttggatgtctggggaactgacaggggacccaagggacaaggagcccatagtaaacaagagaaaagacgtatgataagactgaagagagaagtagaggtaaatcatacatggacttgtggtccacgttaaggactttatgcaagaagtaaatctagatrtacctactcaacttatggtttccatgctcagaacctcatgagatacattgcacgttactgtagtacctgaatccttcattgctattgaatggatgtgccttattttccactcccacctggrgaatccaaacatatgctgatgccatgcaaactcatgcaaagcgttttgagtggaatagattttccacagttgggatggggaaaggtacaattaaagaagggaagctgacattgctgtaatgtaaaaaaatattttatatggaaatttagcatctcagactttggcttcagaacataaggaacmagatttaccctttttctcaacaactagacaggcagacaaaacatataaaacagaagttttcagacatcgaatgacagacaactcaagacagtaaaagaagwgtaacaaaccagatgtgccctatgagcacctaarcttactgcttgaagagtgtttccagggaacagcacaagcagggagaacccagacagagtctctatgggttgaggaaatagagtttggacttcggagaagctcaaatggctagaatttgtgattttagggcagagtcctgcagaggacagtataatcacagagaaagagctctagagaatctacagagaggttttgtcaagttgaatactgatctgcacatacatgtgaggaaagtactgagggtaagaaaaatgtcacttgaaaggaacaggtggaacagtccctggaccttactcagggccggtaatcgtttatgttcctaccatcaaacatagaaagacctcctaataaatgagcactggatagaattgtcagaaggatttagaaacagtgggtggataaaattagactacaggctgctgaggaggcaacagaataaaaaayaagatttgatttcaagtatcttaactgtgaataaaactcaatactagttaacaagaatgcaacaaacaacaatgtaaattcacaatgttaataaaaataaacaagcattagaagaagcagaaagagatgactcataaccaagaaaaaactcaacagattgagaagtgaaagagagaatagaagcagcaggcagagacagtaagacagctatcataaatcttctcaatatgttccagaaagcagagaaaagcatgagcatgatgaagatagagaatataaatatgcatacacagaacttctgtagatgaatacaattgttgacatgaaaagtaaaaaataaagcatagaaaagaaaggtaaaaaataaaggwtaaaaaaatatattataaactgaaggayaccactaatacaacaaacactggatgaaattaatagcacattagacactgtgaaaggaaatagtagaaaatattaatacattgcaatagaaactgcaaagtgaaatacagagattaaaaaggctgaagaaagtgaacagagcatcagtgaactgtgggaccatatcaagtgatctaacatatgtgtaattggatcccagaagtagcaggaacagaaaaagtatttgaagaaatratgactgaaaaattcccaaatgtaatgtaaactacaaaccaacagattcaagatgtttgacaaaactaagaagaaggaacatgaagaaaaccacaccaagccacatcactatcaagttgctggaaaccagtgataaagagaaaatattggaagcagtgagagataaaaacacacaccacatacaggggaacaaaaccaagaaatgatagcagacttatcgttagaaactatgcacaccagaagacaattagggacatctttaaagtgttgggagggtagaagataggggaatctgtctgtttagtattctataccaagtcaaaaagtcttttttaaatgaaggcaaaataaagagtgttttagacatacaaatgcagaaagaatttctcactaacagagcagaaaaaaatgttaaaggaactcctttagatagaagaaatattatgtcagagagacatttagattcataagaargaatgaaaagttccagaagttgataaatatagagaaattttttcctcrttttaatctattaaaaaggcaattgattatctaaatgttaaagcaaaatagtaacaatttattgtggggtatattatgtatatataaataaaatgtatgacaatagcacaaaggctgggagggaagaaatggaaatatattattgcaaggttcttacaagtgaaatagtataatattatttgaaggaagtttgtgacaagttaaaaatgtactatatattgtaaacggaagggcaccactaagaaaacaaagctaagaaggcaacaatggagattaaacatcactaactatactcaatccaaaagaaaacagaaaggaaggggaaaaggaataaagaccagatagacaaatagaaaataaatataaagatggcagttttaaattcaaccatatcatcaattacattaaaagtaaatggaaagaacactacaattaagaaacaaataagattgaataaaaaagcaatgctaaactgtatgcagaatttaagaaatccactttaatgagagagacaaagataggtaaaaaataaaggatagraaattatataccataccagctaacactaatccaacacaaaagggtgtgtaatgatgattccattgatatgacattacagaaaagccaaattatagtgaaataaagcagattagtggttgtctgggcccrgagggcattggctacaaatggcatgaagaaatgttttggaatgatggaactcttctctatcttgattggaactatagctataagactgggtaattgttttaatcaaagctcagcaaatattatacttaaaagtggtaaatgttattatatgcaaattatacctcaatgaggataatgaaaggaagaaagagagggaaggagggtggggaatagggaaggaagaagacaaagaaaggaagaaaggagaaaagaaaagaaactaggaaaggaaaaagaaaagaaagggaagagaaaggaaggggagggraaggattaatcatttcagttttcaaaaagtgtagttgcttcagtaagagkagttttattggccttttaccccatcatgtaaaacatttcaggcttttttycccagatccttgttgtctgcctacatccacactgatgttctcaccttcttctcktaaagaatttatcaagttattgtaccaaacaaaaataactgcatcccaaagagaaattctgtcaccagctgatgatagggaatctttcacctaattaaatgaggaattcctcaggcagaggaaactgttcattccacttggctmtctatggcactcacctctccccttcctgacctcacttgctccattttattattgaaaacctcacccaaccytctacacttcttttaatattgagtatctcagttccttctcttcaataaagaagaccaatttcttcatcctctccctctcctatcagtagggaaagtccaatatacatggaggtgttaatgatgtgtctttgggtgcacaaagtacaaagtaagacatctaagtttcaggggatggacacrtttcatattyatacagacaaccagcctgcataggggagttagacgctgtggctckggggaaaaaattgagataatcagatggctaagatgaaataaagagataaaacaaagctgaggatcacagcagttggaaagaagatctgaaatagcaaaacaaaataatacataaacagctctgactatcctcccatctcatgttaataggctaagtatgtcttattaaasaccacaaagaagatatcacccattcttatattctgagatggtttactaatcaraggcgattcaattctctgattatatttaaataataattgttcaggtaccctggaaaattaacttgctaaactttaatttacaaataacatttgttattcttaagatcaccatgttatcaaagcctttgtaastacatgagcatagaaatgggcatatgtgaatctttccaaataataaaagttcactattgaaggacatatgcatctccagagarctcatcttagctatcmccagatktgagagtggtgaaaacgcaatcctcagaaactgyccacatgtcttgatggctgttactcctccaggtgcttcttaccttgaccacacattccctgcrgagaagatggacgacgctgtggctccaggccgakaatacacctatgaatggagtatcagtgaggacagtggacccacccatgatgaccctccatgcctcacacacatctattactcccatgaaaatctgatcgaggatttcaactckgggctgattggscccctgcttatctgtaaaaaaggtaagaacacccccaccaaaagattcaacaactaaaygttggaatggtcaggagttctgtcatgggacaaagcttgggagcatcttggtaacttcttgtacatcaagcagaggaagacggcacggagaccagatcattgtttgacmagagaaaaaaacacctgctatttcagggtgtggatccacctctgtttcttctcattcctccttcatctcagtccttaaggttctcccaggcaaattcctgtttgagagtatgttctgatgtcatgcttgtatgatctgtaacatttacctcaaggccaaagtcttttagaaagyatacagtagcctatacyctgctgaaagagctcttggaaagaactttggctaacatgtttgacatatctgaggtttgggctggtaatttgctctataaacacgtgaaatgccagcttcctttcttacaaacaagttgaaaactttgggtggtaggtttcaaacacactcaagtgactttacaagaacttttattggctgggcttcttaggagcaagcttggattttcattttatcccatgagaatccagcccatctttcattaaaacaaacaaccrcagtgagccacagcatgggaaataacgtgatggactcaccatctgcctatacayacacrctcagrccatacctacatacatgcccaatgtatttactcattatacaaagactttttttccatttcctggtatatataagatactgtgatggtactgaaaaaaaccktaaaacttacaaaagactcttcttgcattttaccatcagcagcatgtttttctcatagtgagaatggattaatgctgatacttccacccaattatctaatgccccctttcatatacaaataagatgacagcattaaacttggggcatgatgctttyaccaactgagctaacgtatctatatactcttctattgagactggrggaaatggatacttgtacagagtcttgagagtcaccaaatgttttcttcccaagctggatgaaataaagcctgttccccaaagcaagaaggtatcaaagaagacagtrtggcaccagattttaaataaccctagaaccattattacttgataaatatgctattttaaaaaataagaatttcttcaagttgaaatcattatggttgattgcttgccctaaacwctttgctatccaggaaagctaatgagyrtcttctatctgcagtgctactgaaaacatgtctttcctttcatagggaccctaactgagggtgggacacagaagacgtttgacaagcaaatcgtgctactatttgctgtgtttgatgaaagcaagagctggagccagtcatcatccctaatgtacacagtcaatggatatgtgaatgggacaatgccaggtaacaygagggctgtgtaccattaaacaacagtaaaatcattagtaatttttcggtcctgttttcttcaaagcactagagaagttgaccatactcactgttttscaactccctatcaagaaggaaatattttctctttttttttttaaacaggaaatagaagagacaaattagaagctagagaagaaatgtgcagccttgttaggtataktgacctrrgtaggtttcaccttggcctgtactttgaataagaccttaaggtatcagctcagccactctctccgagttctgcagttcctctatatgatgaccatgscttcttcaaggacaagccctagcaggaaggatcagcaggaagattgcagtaaagatgaacagattaggagtaatcctcaacacacamaaaaamccagcatttcaaaaggtgacagaagagtaatattcartggcatctagaatattttctctttccatttgcatttgggcacttatgagaaggcaaaatcatagcaatcgttaagagaaaaaataactrattcccacttagaccacatctcttctatttctctctggtagaactgacctacaactaaagatccagggtatatgatactagcctgagggaaaaacattaaaaaattaaaatgccactttactaaataaaccatatttcaaaacactaaacttcttagaggttattctctaatgccatctgaaaatcacaaatagcttcacttactaaaacacaaatattgttaagakttgagatctgggtagtgtttttaaattgtattctatttcatttgactacattttccacttggktttctgaaaatatactcatatgactctcaatgttgatcccaagttccaatactaggagcttgtaaaaactggggcttagttaactgacctcgaccttagataatctgagttcagacttcagattatcagactaccttctgtggccctggataaattagttgtctcaatgtgcttacttacaaaagtggactaaccatttatcctaacatctatttcctggcagagtgaacaatctgtataagtatatggatgccaagaaaagcaaaaccatatgcacaaaaataaaaataaattgatctgagcttagagtttacgaatttatagttcccaaaagaataaytgggggtaaatgggacaaggtagggaaagaccatcagtagaaactaagaatagtaaacatttgtaaaaaccctctgccttataargcagaataaattgaatacatatgataaatgctaacacagrtatgttaattgctgaactcaatataagcatttctttggcatggataaacgcttccaccaaagcctcctagtgatgcaaggaatcctggctttgttgcaatggtctcctaaaaaaaacaagcctttgtgtgggtaaggaactgattctcagscccattatctagtatctagtgattatgtatctgagatgtaaaacagaaacctaaaagccaaggatggagtctccccacagagcaaatgagcattttcccagtgactgtaggagcaaagaaggagcaaaactaagtttttatattcagttatcactactccttccatgaaaagctcccaatggctcagcataatgaggacttgtacactgcattttaaggagagtgtgtaaccccaaagtgatttcgttgacttgtcattaaaacaatcaaaaagtaagtaaaaataacaattgaaaatcctcayatcatcttcacatcttcttcccttaggcagagcttcgaccactasagctagagagctgagaggattaagtgcttgaactcagccctattggcggttctggtgatttgactccctccagctgagatcagactggggtgaccaaacattccattttgccgtggactttttaccagttctaatagttaaagtcctgaatcttgggaaacccctcagaccagaamagtcggttaccttcttggttcccttcttggcctaatcctttagcaatccctgtgtttytgagttcacatccaccatctctaagctctgttgttacctgtataatgccatttatcacaatgagttrtcactgcttgtttgctggtcactcagatgtctgcttttgcagggcacaaactacaactggagtgtctgttccctcaaagctttatacaatgcctgacacacagcaggtgctcaatacacttggtgagtgaatgtttgatcacagagtacttgactgaatgcttattttggcctgtgtctctccctctttctcagatataacagtttgtgyccatgaccacatcagctggcatytgctgggaatgagctcggggccagaattattctccattcatttcaayggccaggtcctggagcagaaccatcataaggtctcagccatcacccttgtcagtgctacatccactaccgcaaatatgactgtgggcccagagggaaagtggatcatatcttctctcaccccaaaacatttgcaaggcaagaaactctcctgacagtcttgcttctcaatgcagaatcctttcttcccatgcactaactccctctttctccyttgccctttcaagccacctgcaccgcagacaaactttcctcrgttcctaacaaccaaacttagatattttgctcttagatttataacttgctctttggggatggagaaagcgaaggaattggcaaaggtttttttttttttttttttttttttttwaattaagcaaaagctaaagagatctctaacttcctcgaaagaagaaaagaggaagaaaacaaatgcatacatagagatattctttcttcgggttacttcatatgcaaaaaagacctagatgctagcacaagacaaactgcaaatttacagaagcactaagttgtaraaagtgtaaaagtttagcatgaaaacattaacctttacagtgggatraacacaaagtctagcacagagaggaactcaatgaatgtgtgttgaatggatcatacatggcatatactgaggggtgagctccaaagaacactggggaattcaggtgggaaaataaatcaacccacgttatgtggtatcrtgtaaacaaaataactgattgttctactacacatttttgctttaaaactgttgagattagagytcatataaatggagactaaaatctaaggaaatgatatcacaataggaaatcattttgttaccaaaataatgtataagmaacacatataaggaagagatactycatgagatcatttctgtttcttttcacacgagtagtcaaaattatatttgaagtaataaaaccatcatgatatccgtggaagatagagttcccaataatattaaaacaacaatgtaacttttgtttctttgttgaggataagtgcattatgtattgttattaatatttaatttttaacaacaattttattaggtactggtgctacttcattttatagattaagggacagatgacagaaaaatgagaatttaacaagacttaattcataaggtcttaagaagttaaaaattattagaaatttgcctgctcaagaagaaataaagggaatctttccaaattttttccctaacccctcctccttttcccccttttaaaattcttgccttttctggatgccacttaaagagttccaaactaaaatgttcaaaaattgcctgagcattactttcactcttattatattaatataaaccttccacaagttgatttaaaggatatgcatttcaatcaaccataatttcttctcttgagttatttcattgtctttctgtcctaactcagctgggatgcaggcttacattgacattaaaaactgcccaaagaaaaccrsgaatcttaagwaaataactcgtgagcagaggcggcacatgaagaggtgggaatacttcattgctgcagaggaagtcatttgggactatgcacctgtaataccagcgaatatggacaagtgagttgttggggttcataccactgggcaaaggttcaagacacattccatagggtcctagatgtttggggtgaaatgtaagttcacagctctcaaggggacacatgtattggtttctattcaagtctttttgtaaaaattaatcttgaattacccccaaatcaccaaagaaattcagcctaataataataaaaatgacaacagcrgctaccttttgttgaatgtttgccattgccaagcactgtattgtccctttctgagagcttcgcttcaactctacaaactagatactgctcttatttctttttatagatgaggaaatgggtctgagagattaagagatttggaaattcaaatagctcttaaacccttgaaaagttactcaaattcactcataataacagaaatgcaaattaaacttcatgggaatactacttttatctatcacattcacaagtccagatgacatcatctgttgacaaggctgtgagaaaaaagaactatcatatattgttcgtggaagattaaattggtaaaaggattctgaagaataacttggcaatatgtatcaaaattctaaatgcatataccctttgactcagctatctcactctggaaatctaactatacagatacacttgttcacaggtgaaatgatgtatgtacaacatattcactgttgcaacgttagtagtagtaagactggaaacaacycaaaatgtccatcagtagaaaactagtttaataaattaggatacattcatacaatggaatactaagcatcaaaaaaagaggatgcaaacactctgtatgtactaatacaaaaagttctccaagataygttattaaattaaaaagctgggatgtagtatagcgtgtatayatagctgccttttgttaaaggagtgaaagggataagaatatttatattttcttatttgtaagacataaaggtattctggaattacacgcatgaaattaatatatggctacctagaaaattcagggagggtagggaggtcattttgagrgtcatcagagaaaagtgagagttttcwctgtaataaaaattaygygaatgtaytttctattaaaaacaattaaactaggaaaaagaacaaaaaaaatttggccaagattatagaattgttgacagaactgagataggaawccaggagtgtttggcaacagtcagtgctttccactgggaaaaataaattcataaaatgatattccatcttaaaagattgctgggttaaatgatatttctgactttaggtcttggaggaactgccatactgtcttccacaatggctgaattaatttacattccaccaagagtgtataagtgttcctttctctccatgaccttgccagcatctsttctttcttgacttttcaatcatcgccattctgactggcatgagagggcatctcattgcgtttttctttctttttttgagacggagtctcgctstgtcgcccaggctggagtgcagtggcgcaatctctgctcactgcaagctccgcctcccaggytcacgccattctcctgcctcagcctcccgagtagctgagactacaggggcccgccaacacaaatacaaaatacaaaaaatataattttttgtatttttagtagagatggggtttcaccgtgttagccaggatggtctcgatctcctgacctcgtgatttgcccgcctcggcctcccaaagtgctgagagtacaggcgtgagccaccgcgcccggcctcattgtggttttgatttgcatttctctcatgawcactgatgttgagctttttaaaatgtgctttttggccgcatgtagttgcttttgcaaactaaggtaataaagagggmaggggaaaagtggttcatgtttctgctcccaaagtatttatcccagtagctacaaaagatgggtgaaggaggttgcttttcagtcagctcagagaattggctagatggtggaagagatagcccaatagcacagaactatgattaacaatgctagtaaatgtttcctggggttggaagttgcttttagggattaagaaatacctttaaaaccaaaaaggctatcatagaataagtgataggacagactttagaaaaattcctagtatcttttcagccagtataggccttttcccagagatatcaaatgtctgctgtagcaataagaatgacaggaagatctaagtagctgcttctaaccagttacctatgacttttatcagtgatgcaggagacaaatcagaagtttccagttttccaactagacagaaaacataaggactttgcaaactacactaagaaatttttagagaactagtatgttagctaatctaagagcagaatgtttaagcacaagggtttccccatcctaccgagatctctatttgagaaagtggtttaatttttttttacttcactttaagaaaatacaggtctcagcatttggataatttctcaaaccaaattggaaaacattataagaaagttatgtacacacagtacgaagatgagtccttcaccaaacatacagtgaatcccaataygaargaagatgggattttgggtcctattatcagagcccaggtcagagacacactcaaagtaagtaacacaaatacagaatcatgggagaaattacatagtaaaatattatggagtacctrgttattttttaattttaaaagaaaaagatgctcatataattttaaattcaaatgcaacttttagtttttatttagtatttgtatttatttacagcttrctcagtaatacaaaggatctgagacagtttctcaagttataaaggcataaaacaaggagtctatgtaattgggatagaataygsggacaaagaaaataaagccacagataagtagataccatgtgaccctgtaaggctgtcttcaaattttgtcctaagctttatggcagtcagtgtaaaaaaggaaatatgtcagggtgaagtttacatcatctacaaaaagaaagcaccatttatcctgatgttaagatctaagaggaacttctttaatgagttctacaaaagagagtgctgagtgatacagtagatggcatcctkgataaaattcttataaccagcataatagattaaaagttgcataaaataatrgattaaaagttgcattaaaatatttctcattatagctaagatataacagtaaacacaattgaatagaaacaatttttactcattttttaatgtagtctaggtatgcagctctctaatggttggactctgatgaaggtaaactccatgtatcaagagcacggagttttcctcagacaattctccttaaatgtcatgtcacttcaccaagatagataagaattggacagcagagaattaaaggttgcaatctttgacaaaatcctagagtgtarwtaatctacagacaaaggatgatccaaaggctttgacaatcaaccaaatagaagataggattaaggttctcttttgcagattaaagagcctaactaggactcctgtgtgttttatgcacctgacaaggtctattctgttcatttaaaatagccaaaggacaaaagcagttttttttctccatgcctctttcccttcttccatttctgatcccttttatgtgctctcagcaagtgtagacataccttattaaaagttcaggatctggctatttgtctgtgcctctcaagcaagtagcttttcccccycaccaagggtcttactctgtcacccaggctggagtgcagtggtgtgatcatggctcactgcaacctccacttcctgggctcaggcgattctcgcayctcagcctctcaagtagctgggactacaggcacacgccccaaygcctggctaatttttgtatttttttgtagagatgakgtttcaccatgttgcccaggctggtcttgaactcctgagctcaagtgatccamstgcttcakcctcccaaagtgctggggttacaggtttgagccactgaacctagctgagaagatgacttcaaagacagtgtcctaaaaaatctaccrggcaggggaaggkgatcatggtctagagatgagaagcagattcaaaatgagatgtggcccaagctgaaaagagaagggcaggggaaggaggacttgcttggagagagtgatactgtgaggaaaacgtcacttctcctaacctatcctctaaagtcagacttctctttccattttccaccttaatgtgtgagtgaaacactctctccaatgctcctgccaagtgatgaggggaggttactgctcagataaacagatctaattttccyactgtgtgtacacatgtatacacacacaccatccaaaaggtgaatatgcaaagctagtatcttatattatttgtcatgatcaaccttaaatcctagaataaatttgatttaactttgtagatcgtgttcaaaaatatggccagccgcccctatagcatttaccctcatggagtgaccttctcgccttatgaagatgaagtcaaytcttctttcacctcaggtttgaatctttcacttctactgaatccaactagtaacttctgagaggctgccacatttttctgctattctccttgcccggtggtgtcactactgcagtcaggtagtatacaygtaggagtatcctaaaaatcacagccaaacccttctcacttcaggagttttgtctcttagtggtaacaaaatatggtgtcttttattagtgtcatagtggcctctagtggagcattatctaatggctacatgttatccaggttccaagtagaatatttaaagaattcaattgaacaatgagaacatttagacacaggatggggaacatcacacacyggggcctgtcgsggggggggggtggggggcggggggagggrtagcattaggagatatacctaatgttaatgacaagttaatgggtgcagcacaccaacatgacacatgtatacatatgtaacaaacctgcaygttgtgcacatgtaccctagaacttaaagtataatttaaaaaaaawaaaaawaaaagaattccttttgcaatattaattggttccagcgaaagcttatttatttatttattaycatgaaataactttgcaaatgaaaacaattttgaatatattttctttcaggcaggaacaacaccatgatcagagcagttcaaccaggggaaacctatacttataagtggaacatcttagagtttgatgaacccacagaaaatgatgcccagkgcttaacaagaccatactacagtgacgtggacatcatgaragacatcgcctctgggctaataggactacttctaatctgtaagagcagatccctggacaggyraggaatacaggtattttgtccttgaagtaacctttcagaaattctgagaatttcttctggctagaacatgttaggtctcctggctaaataatggggcatttccttcaagagaacagtaattgtcaagtagtcctttttagcaccagtgtgataacatttattcttttttttttttgtcttgtctatttttatcagtaccatcactgccgaaggcaagtctagagtgtgataacatattttgtcttagtttcaaattccaggtctgttggtatyggatgtgttgagcaagttgattagcctttcctaatttcttccttttatcaaatgggtaataaccctcctaaaaatgttacaggtctgtttgggggttcagtgagataccatctggtaaaagtataaagctctttaccagtctttgctatttttagagacctgcaatagggagacagaggagagattctctgaaagcaaccaaatttagagacatagttcctagtgaaattggacccagattatggcccatctctgttgagactaaagtatacagaagaatgtgaacaaagatactgaatttctgagtttgtcttcattgaagaattgtagtctcatattattaaactaaaattcccaattatgctaaactgtaaccaaagaggtcttatctcaaggcatacaaaataaacatatgcctagaaaaagcagaaatgaatttctggacatatggamgatcctgatttattgagctaggaaaggaaacaggtagtagaagcataaggcttttctattgcaaccttctctttcatcctttgcacttattcagagcatattcagtcaatcattcatgttgaaaggtgtgcaattacagagatagacagactttcagctgccatagcgaaatgagatttttcttttgggatttgttttttttttttttttcttttgagacagagtctcactctgtcacccaggctggagagcagtggcaccattttagatcactgcaacctctgcctcctgggttcaagtgattctcctgcctcagtctcttgagtagctgggattacaggygcccrccaccacccccatgtaatttttgtattttttagtagagacaggrtttcaccatgttggctaggcyggtctygaactcctgacctaaggtgttccacctgcctcagcctcccaaagtgctggtattacaggtgtgagccactstgcccggctcttttgggatattttaatctctgaattttcttatctgttctgtttgcttttgcatattacctttagctctaacaagtgctgtgtacacaatggactctcataaatgcctgaattatatggcttcagtagttccaagaactatgtcactttggtttctgagaactcagtggtgtagataatttgctgcaatgttaatgactgaatacagcacttttttttcttttttttttactcttaagttcaggggtacttatgtgcaggatgtgcaggtttgttacataggtaaacatgtgtcatggaggtctgttgtacttactacttcatcacccaggtattaagcctagtatccattagttattttttctgatcctctccctctttccaccctccatcctctgataggccccagtatgtattgttcccttctatgtgtccatgygttctcataatttagctttcacttgtaagtgaaaacatgcagtatgtggttttctgttcttgcgttaacttgcttagaataatggcctccagctccatccatgtccctgcaaaggacataatcttgttctttttgatggtcacatagtattctatggtgtwtatgtaccatattttcttcatccagtctgtcattgatgggcatttgggttgatttcatgtctttrctattgtgaagagtgcgaaaatgaacatacgcatgcatgtgtctttataacagaatgatttatattcctttgggtacataccaagtaatggaattgctgggttcaaaggtatttctgactttaggtctttgaggactcaccatggtatcttccacaatggttgaactaatttacactcccaccaagagtgtataagtgttcctttttctccacaaccttgccaacatctgttagtttttgactttttaataatagccattcttattggtgcgagatggtatctcattgtggttttgatttgcatttctctaatgatcagtgatgttgagcgtttttttcatatgctctttggccacatgtgtgtcttcttttgaaaagtgtctgttcctgtccttggcctactttttaatggggctgtttgtttttttcttgtaaatttaagttccttataaatgctcsatattagacctttgccagatgcatagtttgcaaaaattttctcccattctgaatgttgtctgtttactctcttgatagtttcttttgctgtgcaggagctctttatttcaattaaatcccatttgacaatttttgcttttgttgctattgcttttggcatgttcgtcatgaaagctttgcccatccctatgtyccaaataatattgcctaggttgtcttccagggtttttgtagtttggggttttacgtttaagtgtgttgttgttgttttttgtttgtttgtttctgttatttttgagatggagtctcgttctgttgcccaggctrgagtgcagtggtacgatctcagctcactgcaacctctgcctcccatgttcaggtgattctcctgcctcggcccctcggcctcccgagtagctgggattacaggcataagccacgatgcctggctaattttcttttcttttcttttcttttcttttttttttttttttagtagagacgggttttgccatgttgaccagactggtcttcaactcctgacctcaggtgatccaccsgccttggcctcccaaagtgctggtattacaggcgtgagccaccgcgccaggcctacatttaagtctttaatccatcttgagttaatttttgtatatgatgtaagaaaggggtccagtttcaattttctgcctacggctagccagttttcccagaaccatttatggaatagagaatcctttccctattgcttgcttttgtcacagatcagatagytgtaggtgygcagccttatttctgagttctctattctgttccattggtctwtgcgtctgttcttgtaccagtactatactgttttktcctccagagggcagcagacatcgaacagcaggctgtgtttgctgtgtttgatgagaacaaaagctggtmccttgaggacaacatcaacaagttttgtgaaaatcctgatgargtgaaacgtgatgaccccaagttttatgaatcaaacatcatgagcagtaagtcagagtactatttttgttcatcagtttttcattcctgtggttgaaatatgactgtgcctagagtcagagacatggattaaaatctactcgctaaggggcacctccaatcctcacttccagtccaaagacttggtgatraaatccrtgggtgacatcatagcaacatttttaagcaagaggtcaaaggctcacatccttagaaatgcgtttgatcttctattccaagcrtgtgtgtgtgtgtgtgtgtgtgtgtgkacacagacatactctgcgtggtgaggaaaagggtgagrgagtaggactaatggaaggtgttatagtccatgtcaatagtatcctagactgagttcagggtgaatatatggcyaggacagaaasaaggcaagtaatccaaagatggattgacacatcaaagtagagcaaaatgagtatagggacccaagagtcttggaaaggcatgcatgaagacrtttcaagtgatcagtaagatkttcagaacaaaaggaattccctgaatgagggttccggcatttgctgcagttctaaagttcagtggccaaaagcactgccatggcagtctgagagaaatgtcactgagccagctggaagcaaacttctccacaacagccagggtccccctactgatcctcagagtctagagtcatggtaatcaccttctctagtaggtaatcacacatgtgaggatgatttctgcatgttctgttcatatagcttcagatgacygacagctagggattatcagagctgacaggtgccaggtcaaataattcaaacagaaaattactctcagctttctttgcataacttccttttggcagtgaatctatcatagttctagaccagtgctgtccaatagaaactaygtatgagctayatgcgtaatttaaaattttctgatagcaacattaaaaagtaaagagaaataggtgacattaattttagtaatatgttttacttaactcagtatatcctgaatattatcatttcaacatgtaaccaatataaaaattaatgagacttactttattactaagtctttgaaattcaatgtatattttatactcacagcatatctcagtccagtctacccatatttcaagtgctygataaccacttgtagccagtggctaccatattgaacaatrcagttatagaccatttagaaaaacatctagaatgaggtataaactaataatacatcatgtaaattattaaagtcacttaagtgrtttaagtaggtatttaaatatttgttaatgccagtcattatactggtactaaggctaagagtggtaatsgaggtagacatgagcccygcccttgtagaaatcatacctttggttttttactatgcttagtacataagtaaataaaaatattgcctacagcagtgtcccttttaacaataatgaaatgtatgaactggatactcaaatggaaactgtgaatactatgtagattataagacagcaataaaaactataaaatatgctaaatgggctttatttttagggacattacttcttacccaatgactaatatatcaaaaagatgaatttcttatattatgcttttcctccaagtggaattattagaatatctttaaaggcagagaatggagcacaaaatmtttactatacatttgaygaatgactaaatcaatgtaaatggaaggctttatctttttcctgagatttctcctttggctaattyaggagaataatctctcatttgaaaattctgagtttgatcttctagtcacatgttagactagataaagcttatcttggataatcactgctttgacacaaccaaattaacatggagacatttatcttaggtataattagacacatgcccttttgttggcatagacttggaattttaacagattttacactttcagctatcaatggctatgtgcctgagagcataactactcttggattctgctttgatgacactgtccagtggcacttcygtagtgtggggacccagaatgaaattttgaccatccacttcactgggcactcattcatctatggaaagaggcatgaggacacyttgacmctcttccccatgcgtggagaatctgtgacggtcacaatggataatgttggtgagtaagagtctggacactcacagaggaagcttgctttgaatttctggtctataaaggtctgctgcaactctccaggctaccagtgctcctctatktatctccctgaccccctgcaggcttttctttcaatgtttctcatgatttctctttgagaaattaatgacttaaatggatccagttctttagtgtgggttatatttttccttctctgggcaaagtaggaagtaaaaatatacaacagcagaaaaataaggcataactctgaggaagaagcataaatattttggccacaaaagagcatttcttttatcaaaatgccctattcggttttttgcaacagtcatcttcaatcatcaggtacagtgccttaaaggctgcttcagcaacagctttggagtttgtcagactggaatgcaagtcctgatctgccaatcgattgctgtgtaaccttacacaagttacttggccacactgagccacaagtcatttatctggaaaacagtgtaatcacatctcacagagttactttgaccattaaaatagtaatatgygccaagtgcctagcactcagtagacaccaacaatggtaactattggagactcaccaagaaatctttratgttccagcaatgcatgccatttcagagattcaaaattgtcctcgtgaattattacttagaaacatctaaatrtctcttatttgtggggatagagctcatcaccatccctttaattctaagacaagatgtgctgttaggatatttatgatattaaaagtccattttattcttgattcatccctttcttaatatattttaaaatagtgagcaactatctgtgctgaaagaccttttttcccctctaatctccactaagcaayacttttgktttttattctgttaagcgagatgaacgcactggtcatgtgyttagagtyacagcaatgtcaaattgctttagaaaaacaaragtttactaaatatttcattctcatttttctctccttrtgttattttgacccagtaatcaatagktcacagacaagcagtggtccacagcccatacttgaatattcctgacgaaagtttattagaaattacctgccacaatggattattgtgttttcatgtcttttcccagacttccagatctctcttctgtctgtctctcttctgtaggaacttggatgttaacttccatgaattctagtccaagaagcaaaaagctgaggctgaaattcagggatgttaaatgtatcccagatgatgatgaagactcatatgagatttttgaacctccagaatctacagtcatggctacacggaaaatgcatgatcgtttagaacctgaagatgaagagagtgatgctgactatgattaccagaacagactggctgcagcattaggaatyaggtcattcygaaactcatcattgaaycaggaagaagaagagttcaatcttactgccctagctctggagaatggcactgarttcgtttcttcraacacagatataattgttggttcaaattattcttccccaagkaatattagtaagttcactgtcaataaccttgcagaacctcagaaagccccttctcacyaacaagccaccacagctggttccycactgagacacctcattggcaagamctcagttctcaattcttccacagcagagcattccagcccatattctgaagaccctatagaggatcctctacagccagatgtcacagggatacgtctactttcacttggtgctggagaattcaraagtcaagaacatgctaagcrtaagggacccaaggtagaaagagatcaagcagcaaagcacaggttctcctggatgaaattactagcacataaagttgggagacacctaagccaagacactggttctccttccggaatgaggccctgggaggaccttcctagccaagacwctggttctccttccagaatgaggccctggraggaccctcctagtgatctgttactcttaaaacaaagtaactcatctaagattttggttgggagatggcatttggcttctgagaaaggtagctatgaaataatccaagatactgatgaagacacagctgttarcaattggctgatcagcccccagaatgcctcacktgcttggggagaaagcacccctcttgccaacaagcctggaaagcagagtggccacccaaagtttcctagagttagacataaatctctacaagtaagacaggatggaggaaagagtagactgaagaaaagccagtttctcattaagacaygaaaaaagaaaaaagagaagcacacacaccatgctcctttatctccgaggacctttcaccctctaagaagtgaagcctacaacacattttcagaaagaagacttaagcattcgttggtgcttcataaatccaatgaaacatctcttcccacagacctcaatcagacrttgccctctatggattttggctggatagcctcacttcctgaccataatcagaattcctcaaatgacactggtcaggcaagctgtcctccaggtctttatcagacagtgcccccagaggaacactatcaaacattccccattcaagaccctgatcaaatgcactctacttcagaccccagtcasagatcctcttctccagagctcagtgaaatgcttgagtatgacygaagtcacaagtccttccccacmgatataagtcaaatgtccccttcctcagaacatgaagtctggcagacagtcatctctccagacctcagccaggtgacyctctctccagaactcagccagacaaacctctctccagacctcagccacacgactctctctccagaactcattcagagaaacctttccccagccctcggtcagatgcccatttctccagacctcagccatacaaccctttctccagacctcagccatacaaccctttctttagacctcagccagacaaacctctctccagaactcagtcagacaaacctttcyccagccctcggtcagatgcccctttctccagacctcagccatacaaccmtttctctagacttcagccagacaaacctctctccagaactcagccatatgactctctctccagaactcagtcagacaaacctttccccagccctyggtcagatgcccatttctccagacctcagccrtacaaccctttctctagacttcagccagacaaacctctctccagaactcagtcaaacaaacctttccccagccctcggtcagatgcccctttctccagaccccagccatacaacyctttctctagacctcagccagacaaacctctctccagaactcagtcagacaaacctttccccagacctcagtgagatgcccctctttgcagatytcagtcaaattccccttaccycagacctcgaccagatgacactttctccagaccttggtgagacagatctttccccaaactttggtcagatgtccctttccccagacctcagccaggtgactctctctccagacatcagtgacaccacccttctcccggatctcagccagatatcacctcctccagaccttgatcagatattctacccttctgaatctagtcagtcattgcttcttcaagaatttaatgagtcttttccttatccagaccttggtcagatgccatctccttcatctcctactctcaatgatacttttctatcaaaggaatttaatccactggttatagtgggcctcagtaaagatggtacagattacattgagatcattccaaaggaagmggtccagagcagtgaagatgactatgctgaaattgattatgtgccctatgatgacccctacaaaactgatgttaggacaaacatcaactcctccagagatcctgacaacattgcagcatggtacctccgcagcaacaatggaaacagaagaaattattacattgctgctgaagaaatatcctgggattattcagaatttgtacaaaggtttggccagttttctccttttttattctcatttttccattactgctgmaaaaagtagctactacarttcagggggataattgtgggcaaattatactaagaacagtgtggttcccctattgcaagttggcctgttctttttcctttgtcaattccaagattgcttctttaccttagatgacccctggacaatataagaacaatcactgtgagaactctataatattctgtaattaagcatttttctgtgtcctctcctcttactacccatgtttctactgactcttattgctccaggcagagcccarcctatccatagctatatgctaatcaatatgatttaattgaagttagcctcaaatccaaacycaaatatgatgtagaaatctcctttttgcatttacttgtttagatcagaatttctaagagatccaaatcccttttttaaaagaatatttacaattcagttttgcttasgggtagaaagccatgttgaactgggctctttgttctgggatgaagatacagaaagagaagagagaggaggaaaggagcaaggcttagtcaactacaaattctcagggatatagcatgatgactgtgcatcagctgtctagatatgcccacagcttttactaaagctgttacactaatcacttaaaaaaccaaagtgtaattacagtaggcaaacacaatgtatggtgtgacttatgcatatgagttcattaatctgatgcctgacatctccacattagaactctgtttaaaacaccttttcctatgacttcctatwtaaatgttgcactcaataccacatgagaacaactagctacctgagtatttctaagcaaggccccgagggagtgagatgcagggcctgtccagagtgaatagggatggaaccaccttcaaaatcttgtattccattcaaggctcacaacccacttttatggcaktcggagttgctttacccactcccttgtgttctgtgagtttgcatgttatgctcagagtctggaaagatgggattagtaggggaggtagaccagaagaaaggcagaaggagattctctgttgatgactcacagtatatagcaaatattatgggtttgatgggtgagtgtttggcttgtttccacaggcttgggaaatgtgagagtcagtgggagaattcgacatgcttcagtcctagactgagccaatgaactagatggaaataatgtgctttatttatttatttataatttgtaattaaactttttattttggaacaaaaataaaatagattcacatacagtcaagagaaataatacggagagatcctttgggtatcctgagtattctttacccagtttctcccaggggtaacattttgcaaatctataatactatatcacaaccagcacactgatgttgatactgtcaagacacagaatgttcaccatcaccataaaaatccctctcattacccctttatagtcacatctgccttcctcccaccatagcccttccttattccctggcaaccagtagtctgatctccatttctrtaattttgtcatttcaagaatattacataaatggaatcaggcaacatgtaacctttggggactggtattttttcactcagtataattctctggagattcatctggttattgcatgtattccattatatgggtgtaccmcagtttttttgttgttgttgttttatacacatttatggtgtaaacatgatgttttaatatatttataaattgtgaattggctaaatcaagctaattaacctatgcattacctcacatacttttttgtggttagaacacttaaaatgtactcagcaatgttaaaaattcagtgtgttgttattaactacagtcaccatcttatacaacagatcttctaaatttatttcttctaactgaattttatcttttgaccattttctcaatgctccacctctgtatccctttgttaaccactgttctaccttctgcttctatgagctcaatgtttttagtttccacattataagtgagatcctgcagtacttgtctttctgtgcctggcttattttatgtaacataacgacctcctggttcagtcatgttgtcacaaatggcatttcttcgttttcttttttttaaatgctaaatagtatttcattgtttatgtagatcacatttaagaaatccattcatttgtttatagacatttgggttgcttccctatcttggctaatgtggctaatgctgcagtgaacgtgggacagcagatatctcttcaacatactgatttcattttctttgggtatatacccaaaagtgggattgatggatcatgtggtaattctatttttaatttttaaaggaacctcccatactgttttccataatggctgtactaatttacactctcaccaagagtatacaagagttcccttttcttcacatccwtgccaacatttatctcttgtcatttttataatagccatcctaacggtgtgaggtgagccctcattgtgattttaaattgcatttctctgattattagtaatgttgagcatcttttcatatatttgttggtcatttgtatgtcttcttttacgaaatgtctattcaagtcttttgctcattttttaatcaggctatttgggttttttgctgaattgagttccttatatttttaatattaatattcttatcagatatctggttttcaagaatattctcccattccaaaggttgtctcttcactctgttatttcctttgctgtgcataaacttttgagtttgatggcaatcccatttgtctayttctgcttttgttgcctgtactttcgaggtcaaatccaaaaaatctttgtccacaccaatgtcaagaagcttaagaataatggacattagcaaaaaacaaatgtgagaagagtggctacttttagggtacaaaacattcacccatccagtgactttcataagtgtgaccttctaattaatctgaccattgtcacctgatagccccaagctctggcactgtcccattacatggctttgtctgcctttgatcttaaaatttggtgtgttaacatacgattatatttatacattcatttatatgtttgacaaaaatttattaagttcctgctgtgtgtcagataatgtgcttaccactggagagagtactatgagcaaactaggcacaatggctgacctcatggcacttatacccagtgagagacagatattaatagataatctcacaaataaattatatataatctacaatatataytctagagatattataagaatactacaggaatttactatatatactataataatactatagaaatatgagaaattgatatagagacttgacctagtctaaaaggtcataggaagacttacctataaaataatatttgagttaggaattgaaagatatttactggcttttgtttttatccacttatatatttactcatttatccaccaagtatttattaaagaccttctctatgctagatgctatatttagaaagagacaatttcctaaattctgggaacagtctttaatttcttcttttacacaaatagtattattatttcagggaaacagatattgaagactctgatgatattccagaagataccacatataagaaagtagtttttcgaaagtacctcgacagcacttttaccaaacgtgatcctygaggggagtatgaagagcatctcggaattcttggtcctattatcagagctgaagtggatgatgttatccaagtaagtcttttgagcactgctaagatcttcggaggaatttccacaagcaccagagggttgtaaaggtgcaggtggcaagagagctataggtgatttgtttgttttccaggattaatgaataattacatttcttttcaaagactccttgccaagcaatttggcaatcttcgaactaaaaaaaaaaaagatctcattttttaaatgctgaaaactatataatctgtggaaaatctttctgtaatttctatctaaagctaacctatctaaagttaacacagaaaattaatatattcaagagcaattgaattgggtttcatagcagtggtggtggtggtggcagtagcagtgctagtagtaatagtaatttagaaatatcttcaggtgttttcctaaaaattaaataaaatgaagttaaataaaatgagtaaggaaagtaaagatgtctccaygccctccaaaagtgagcaagtttcttcagtgtcttcctagttctggtaatttctttcaaaatcttgtgtccagacccacgattataacttgcttttataacaaagtttacttccgccatttttgctaaccgctcacrttcaaaaacccagaaagaaccctgattctaaagtaagctattctagattttaaaatataatctactatacctgtgtaagcattcactacattttcagtgaccatttgctctttttaaaaacgtaaacaagtacatagggatataagaatcttaattattctaaattttccatgaagctatgggaggcaatattctcttttatgattaggggatcctttttcaagatgaacgataatttaacacaatatttaaaaaacttattctaagtaactcaggaatcaaaaaccagacactgtatgttctcacttacaaatgggagataaactgcrggtatgcgaaggcagacagattggtataatggacattggagactcaaaagggaacgggggatggatgaaaagctacctattgggtacarggtacactactcaggtgacaggtacactaaaatcctagacttcaccactatacaattcatccatgtaaccaaaaaccacttgcattcctaaagcaactgaagttttttaaaaaatttaaaaatcaaaattaatgcacgaaagccacaataaacaaaacctcacaattgtgaataaagacaggataagtaacaatgttgcattgagacatactggagccttaggcaaaaggaaaaaaatcaaatactgaatctttgttttagccctggatttcactagataaaaatgacttcatttgtgtatttttaaaataattttaacttttattttagattcagggggcatatgtgcagttttgttatctgggtatattatgtgatgctgttgtttagggtatgattgatcccatcatccaagtarmgtgcatagtacccaatagtttttcatcccttgctcatctccttccttcccccttctagaagtccccagtgtttattgccatctttatgttcatgagtacccaatgtttagctcccacttataagtgagaacatgtggtatttggctttctgtttctgcattaattcacttagcataatagcctccrgctggcatccatgttgttgcaaaggacgtgatttcagtctttgttatggctgcgtagtattccatggtgcatatgtaccatattttctttatgtagtccaccactgatgggcacctagattgattccatgtctttgctactgtgaataatgctgtgatgaacatcctagtacatgtgtcttttcagtagaacaatgtattttctgtctttctttcttttttttttttttgagatggagtctcactctgtcgcccaggctggagtacagaggtatgatctcaactcactgcaacctctgcctcccaggttcaagcaattctcctgcctcagcctcccgagtagctgggattacaggcacccaccaccatgcccagctaatttttgtatttttagtagagacagggttttaccatgttggccaggctggtctcaaactcctgacctcgggcaatctgcctgcctcagcttcccaaagtgctgggatkacaggcatgagccattgcgcccggctgaacaatktattttcttttttggctatatacccagtaatagaattgctaggtcaaattgtagcaggacaagccacagacaaaaacccctcagacaccaagttaaagaaggaagggctttattcagccgggagctttggcaagactcatgtctccaacaaccgagctccccgagtgagcaattcctgtcccttttaagggctcacaactctaagagggtccacgtgagtgggtcgtgattgattgagcaaggagggggtacgtgactgggggctgcatgcaccagtaattagaacagaacagaacaggacagggattttcacagtgcttttctatacaatgtctgtaatctatagataacataaccgattaggtcacgggtmgatctttaactaccaggtccakggtgtggcgccgggctgtctgcttgtggatttcatttctgccttttagtttttacttcttctttctttggaggcagaaattgggcataagacaatatgaggggtggtctcctcccttaaaatagtagttctgtttcaaattctttgagaaacccccaaacttctttccacagtggctaatttacattctaagcagcagtgtataagcattcccttttcttcacagcctcaccagcatctattttttgactttgtactaatagccattctgactggtgtgagatggtatttcactgtggtattgatttgcatttctctgatgattagtgatgttgagcatttttttcacatttgttggctatttgtatgtcttcttttgataagtatctgttcatgtcttttgcccactttttaatggggttatttgtatttcgcttgttcaattgtttaactatcttatagtttctggatattagacctttgtcagatacatactttgtgaatattttttctattctgtgtctgttcactctgtagatagcttcttttgctgagcagaagctctttagtttaatttgtcaatttttgcttttgttgaaatgcttttgaggaattagtcataaattctttcccaaggctgatatccagaatggtgtttcctaggtttttcttctaggattcttatagtktgaggtctgacatttaaatctttaatccattttgagttaatttttgtatatgatgaatccagtttcattggattcattggggttcagtttcattcttccacatatgggtagccggctattccagcaccayttattaaatatgagtccttttccccttgttttttgttgttgttgttgctgttgttgttgactttgtcaaagttcaggtggttgtaagtgtgtggctttatttctgggttctttattctgtttcattggcctatgtgtctgtttttgtatcagtaccatgctattttggttattgtaactttatagtatagtttcaagtcaggtactgtgatacctccagatttgttctttttgcttaggattgctttggctattcaggctcttttttgattccatatgaattttagaatagctttgtctaatcctgaggaaaatgattccagtagttgttaaaaaatagtgttgaatctgtagattgctttgggcacaatrgctattttaacaatactgattcttccaatacataagcatagaatgtttttccatttgtttgtgtcatctatgatttctttcatcagtgttttgtaattcttcttatagagatctttcacctctttggttagatgttttcctaggtattttgtatgtgtgtgtggctatgtttaatgggatttcgttcttgatttcgctctcagtttgaacattactgatgtatagaaatgctattttgtacatttgtacattttattttgtataattgattttgtacattaatcttgcatcctgaaactttactgaagtcatttatcagttcctggagcctyttcatggagtctttagggttttctaggtacagaatcatattgccaatgaagagagatactttaacttcttttcttctttggttgccttttatttctttctcttgcttgattgctgtgactagaatttccagtactatgttgaataagagtgatgagattgggcatccatgtcttgttccagttctcacggggaaggctttcagcttttgctcattcagtatgatgttggctgtaggtttgtcatagatggctcctattagtttgaagtatgttccttcaatgcctagtttgttgagggtttttatcatgaagggatgttaggttttatcaaaagctttttccacatttattgagatgatgatactgtttttgtttttaatgcggtttatgtggtgaatcacatttattgatttgcatatgtggagccactttgcatcctaggaatgaagcctatgtgattgtgatgaattaatttttaatttgctgctggatttggtttgccaatattttgttgaagatttttgtgtctatgtacatcagagatattggccggtagttttcattattcattgtgtctttgccaggttttgttattagggtgatgctggctttgtagaataaaataaggaacagacaattagggrgtctttaatcactagaagttatagaagggctgggaggagcttcatgggtctgactgctggggtgtgaagacttctcatatggcatttaagtcctttaccatctggccccaacctgctccttttctascctcatttctcaccaggttccacctgtccctgtgcatttcacagcccagttccaccgagatccttgctattccccaaactcttcctttactcccctgctcacaggcatccttctgcccttctgagagtctgaaatgtctttctagctcctgttcattctatgatggccaattccatttcctctaagaaacttaccttaattcttccaaccactcctaaatattcaaccaaattgttcctccagggcattgtcatctgaacccacttagactttgtatatagcacctgttgtctccagatttgtagtgtggatgcccatgtgcatgtctgtttcagcagkagcttaaaagcttcttatgaacaagaatcaagcttctttcatcttcacatctccactacctatcactctcatttcattagtagataatgtcagtactttagccttgagyctaagaacaaatatcttttggtatttctggagaaaactacttgggccatatctcacaggatggttatgaaaattaaatgaaataatatacataagttattttgtaccttatatcttagctccgattttataaycagccattttgacttataatgctgacatttttgtggtttagatttttgttaagcttaagtacatttgtggatcattccttttcctaggttcgttttaaaaatttagcatccagaccgtattctctacatgcccatggrctttcctatgaaaaatcatcagagggaaagasttatgaagatgactctcctgaatggtttaaggaagataatgctgttcagccaaatagcagttatacctacgtatggcatgccactgagcgatcagggccagaaagtcctggctctgcctgtcgggcttgggcctrctactcagctgtgaacccagtaggtactttcattgaaagtttttctcattcccctaacctcgtaatctgaagtccaccaaatggaagagtcrgggttatttcttgtcaaatgtctgtcttgcttttcatgaggaatgcataagggtgtggttaacagtctgcatttatcataaccagggactctccatgcagctcttcagatgacagagagagaaacatttattcagtggagaggaggaaagattacttgaatgattggccatgaattagaatgcctacatttacagaagatggcatttatttgaaattttcttgaacaagtattagctatgttctgctctttctttrtgaaaagaactgcaaagtcaagactcctttatctgwcattctgcaatgtatatatacttcaaaacaatatgtcatacacagtatatgcatacaattttatctgtcaattaaaaagagaaacaactcctccatttcaggcatagtggaaagagcacagactcagatttaaatttttaccctgtcaatgcataatcctaggaaattccttgacctctcttagcctggtatcagaagttaaaaatgagataacagtacatagtgcatggtaagcacttggtaaatatttgttcaatgaatgaatttatatttaccakataagatagttgtcaggattaaatgggagattgcaggcaaatcatttaatatagtaatagattctcaataaatagtatcccttatattatcaatttattattatcatcattgttactgggataaagatcaatcagaggaaggaggattatgaatacaacagaattaggtgataaatatccaggcttattaygccattcatttataatcttcatcttcaaattcagagcctatcagaaagtttccttttctatatgatgagtgattatcagaagagcaaggaaattcctgagaaagaggcaatacaatttactctgtttttccaggaaaaagatattcactcaggcttgataggtcccctcstaatctgccaaaaaggaatactacataaggacagcaacatgcctrtggacatgagagaatttgtcttactatttatgacctttgatgaaaagaagagctggtactatgaaaagaagtcccgaagttcttggagactcacatcctcagaaatgaaaaaatcccatgagtttcacggtattttcctyrgactttgatctaatctcctaattaaatcacactgggtcacagtgatttctgcccttagatattcacaagattagacatgagatgcttctgagacacccagagctacaactaaaaccrgttccttaacattccagagggctgatgtaatctggcaggtgacactgtgggtraggcaaaaagagaaagtctgaaagatagcacagagaagctgctgcaaaacaaaccaacagaaaaccacaacaacaaaaagccagtgtgcttcagctggtaacatacattgaaaaggaattaacattgttctgcaatttaaagttaataagcttgtttctggatctctaaaggcacaagtgtttatataaaagaaatgatcacctgtgtgtcttttctaaaataagaatgaygctaacagttttagctctcagcagctaccaggtggcacccaaagcatatgagaacaaaatgagataagaaacyaggtacccaggtaataggagaatagtggcaagagagcatttgggtggtcacactgggaaaagtgtgcctatttggaaattcacaaggaaaatttgccctgtaagctagtaactgaaacagraactgagaagagaaaggtacgagcttgtgttatgaatatgtagataggtgttctcacrcctgatataatttgaaggatgcccaaatgatctcaacccgtccctctccaaaaattcacctgcctggtttctgaaatttcacagcagttcctctaacttaagaaggaggaaacaaagcacttccytcactttggtttcagttaaacgtttggtaacactaaactttatctttacagttttgtgttacatttttaaggtgatcaagtttctcaggaactttttaaaaaatccgcgtattttactgtggggagagtmgataaagcctgagaaccctagttatctaatctgagaagtgggcaraggagttgtcataccaataagagaataaacaygacttgctatggttgctggatacaccaaygataaactcctaattttataaactcctagacttcctaatttgcctgaaactttctctgaatttagaaggccttaaggtgacatgctgcmtatctccttgctgactctaatccctggagtttactttgtctgcccatatttgtatttatcttttgtagttaaggaaaattaagactgttaatggaaagtatacacgggtaaagcacrgaactgtaaaagctgaggaaaagagtgataaactgcttggaaagggagttccccctgccttctgctgtaggctggtgtgaatgatatgagaaggactagtggttctgctttagcctctcactaatgtgacatacaagagggccctttccatggctaggtaggcctgggaatgcagaatcatgaggaacatgggtgttgagtgggttgccccatatttccttaccactcgccctctctgtgtcaacagatttttaattgatttcaactctttgtcctttcagccattaatgggatgatctacagcttgcctggcctgaaaatrtatgagcaagagtgggtgaggttacacctgctgaacataggcggctcccaagacattcacrtggttcactttcacggccagaccttgctggaaaatggcaataaacagcaccagttaggggtctggccccttctgcctggtaaagattgggtaatgggaagaggtccctgctaagaaatacagggaaaaggcaatctgtaactccttctcatttcttccttgtgcatatacttcctaaggggtcagaacacagggttctggcatagagcctaggcaaacccatagacccaaagtatatacggagtacaaaaatgtcacctaatttatgaactatttgcagcaccacacaggctaaatgtgtgacccaactcagttgcaacataacatgcagtttctcccaagccactgtrtgtcatacagatgaggtcttaagcagatgaaaaaatgaatcccacagggctcaggcagctacagctatctctgctgggagggtttccagattcttcagttctgctcctcttctaggccctatcaccctaatatctttgggcaagtgactccaggaatcacattcttaaactgacttatagactgtttgaagaggaaaacatttttaaaaaataataataaaagttaaagaataacaaaggtatttagaacttttcatgtgcaaaataaagataaatgtagatttaaacagtctacaattatacagaagggatgtttctgtgccaatgagttgtttgtaagtgtatctacttgtgcagcagtataaaaacctaggaagtcagttaaaatgcagatgtgaaggcagagggattttgttctcagagactttaaagtagattttgggcagaattccaaggagtctgtatttttaacaagcagccttccttctattttgccttctattaaaagtaatggcaaaaaccgcaattatagtttgcaccarcctaacacatgctgcctgaggagttagtgaaggcagcccctcracagcactttgggtgacgttgtgtgaatctgcctcagatgcagrcacagaagtccaaatggactggtttgattaagagcagggaaraaaagagggttcttattggtttttcmcatgccagtaactcactaatacatctagagagtattaattgtattatattaatatcatattaattaattaatataataattaatagataatttattgtattaaaatcagagacagaagagattcagtcaaatttactcatcttttcatcaagtattagaagatcagtcatccttcctatcagcctgcagacagactgagaagctaggattggctggtgtctctaaatctgcaaacctaaatacctgcattggagagaggaaaactggagacatttttcagtgtgtttgaggaagataatcatatctattcattttcacccacaatctgggaaacagtcataaattatagtcaacagaatttaaatattaactgccagggggtaatgttaaataccagaatkgatagccagaggttttagaaatctcattctttcagtgttttttctgagcaatttatgtaaatctctattcaaatatgtaagctttatggaaaacttgaaaacatggaggaagaaggttttatttttattttcttatataaaaaagagaaaaaagcaaaaatgaaaagagggaaaggaaacatgtatgatatttttgaagcccaatgatgtcattsgaggtcactttgataattaggactgtgaagctgtattgtatgtgagttaatttgtaacattatatttagataagtgaaagtttcttctagtgaggtgtggtggtgatttaaaattttttttagttatctctgtgtrtgtgttgttattgttttgtttttatctgttatactttcagtcctacctaaagaaaaatggttaaattctatttgaaagcctcttgtgaagcaggaattttaggattcttagagaactatcaaccmcaatatttacttgttaatttttgcaaatgtaatgttgttctttttattttaggttcatttaaaactcttgaaatgaaggcatcaaaacctggctggtgrctcctaaacacagaggttggagaaaaccagagagcagggatgcaaacgccatttcttatcatggacagaggtatcacaagagccatgtgatatttggtttggcaggagagtgcctattactagaatattaccaacttttagattggaaatattcaactctaagaactctgatgtgacaaaggcataatttgtagccataattgctttyattcyggcccatggtctgattgcattgaaaacacatcagtcagatcaaaagcattcctgtcaattgggaaacctgtgtaaagcatccttcttcatgacttgtgatccatggacaagtgcatataagaaattttccagcttccaagagttgaggagggaaaaggtcacaggaatttaacaatgactgagtcacyaaacttgacatttcagcatttaggaaacacagttttcatctgtccatctgttcatccattctttaagccattactaagcactgttgagtatgaagcactgtgccaacatccaggtagcacagtggctggtatcccttccttgatcaagatataaataaccttgtaactttgaggtcaacttttgagaacatagtctcatcaggrctagaactttttttcatatttttatattttgtatttttattttttttgtagagaagaggttgcccaagatcaaactcctggcctcaagtaatcctcccccctyrgcctcccagagtgctaggattacaggcatgagccactgcacctggccatggatggtacctaatgttgtaaaatagcataatttaagataaaagcagragaaaatcagtttaaaaartgattacatttcaggatttcagttgctttcttctaggatgccactatatctattaaagcaccagtcttgttagtgcatttaccattttataatcagatatatttaagtcagggccacacaaggtaggtaaaaatatctaattattgagtcagaaacataatccctaaccatggagttttactttattrtatatattttrtaagcaaaaattattcattttttttctgtttttcatagactgtaggatgccaatgggactaagcactggtatcatatctgattcacagatcaaggcttcagagtttctgggtaagttgtagcaccatggtctgtgaatggtaccccctacagttgtgcagcatgcagcctatgaaaccatacatgacaatcctatctatgaatcagtttttctctttatgcttttctctackacaatgtagtgaagcagctccatttggggtacatatatggtaaaggaaggaacactayggtaggagctaaaggcctgttagtgtgctcttaacactgccacctcttctggtgtataatgatcccaaagagtcttttccaggaaaaaccgatagctgggggtcattgatttctctacataaaaagcccagcctctctgcagggatttggcaaggatcagataccttastcttatgaccacrcgcccatttccaaaactctcctcagtcatcttttctgggtttgaccacacatgtagtatttcagccagattcacagggtcttatcagccaggcattatagtccycattaatatggccctttgcctgtggcaaccattcatctattcagaaaactttgttgaacctccactatatgtgaggaactcctccaaagttttcccacactgcctcaaagcccttcccaagatcaagaggtcatgatcaagaggatgatgaggctcccatatacccttccatgtcttcctgttaggcaggcacattcagcattaggaatataaacacaacagaaaaaatcaaacatgacctgtgtgcaagaaaggggataggaggtggttggcagttgaccaaacacagacctgaagcccagatttcatcatcaaggactggcctagtagctgaggcccatgcctagactcctgactacaacacaggtcctccaaggatctggttttccactggattaaactcacttgagaaattgctgggtttttaaaaaattcagaataaatctttttcttcccttgagtttaggttactgggagcccagattagcaagattaaacaatggtggatcttataatgcttggagtgtagaaaaacttgcagcagaatttgcctctaaaccttggatccaggtttgtcttaatagactgataatatttactgctatcgtaataataaaaatgaaagtgatttagtaattccttgttattgttcttgcaatgttgttaggggaaatagcaagtactaagtgtgaggcactgttctaagtactttatatccttaaaatcaaccctctgaggttggttctaataatatcttgttttatagattaaaaaacaaaaggcacagagatactacctaccttcccaaagtaacacacagctaattagtcattgagttgggattcaaatttaggtactctgtgcccaaatatgaattgcatgtagtcattgtatcagtttgctaagatcttatgtgctagctctttagttctraagaaagctgattgtataatgaatttaggcagtgtgtgacttgttgacaaggacagttctrtttactggctttcctatattgcaggtggacatgcaaaaggaagtcataatcacagggatccagacccaaggtgccaaacactacctgaagtcctgctataccacagagttctatgtagcttacagttccaaccagatcaactggcagatcttcaaagggaacagcacaaggaatgtgatggtttgtgtgcatatttctatctgaatctctagactctagacttggcctagaattattatgactatacctaatgattatgtattttaaaaaatacctttctgggtattagaaatgtgaatggctttctaagggtcatatggagaaaagcagtaatatgataggtctgtgtcttacaaattaaagagagaagcagggttactgaaacttcaaaaccccacaaaactttaaaaaatcattttatcatcaaacaaaatacccagatttctcagactggccaatggtatacggcagagtagaacatctggtcttgcrcctcaaggagctcatgctaaaarttggctaccaagacttttgattttactattgtagtttgttttgttctttatttcagtgtacctgaagtaaatagtagtgttaatgctagtaagcctctgaggcagtgtgattctcagactttttgkggggccatgcctgaggaatgacattctccttctggttcttccaggggctcagccataagccctaactcttctcctcctctctattcccttccccaaagaagtctgaatgcaaggagtctgcctgccattattataccaataaccttgagtctgtttctgcttatattttatatamaattatttactgtttattagttacctatttttaataattatttatactatgtctcagaaccattgaaatcctaaattatggttcttactaatcagtattatgagagaaaacacagattgcagttgagtccatagcataaagattttgtcgtctatgttcatgagaggatattggtatatagttttatttttttaattgtctttttctgtttttgataccacagttatactagctttcataaaaytggtaagcatgctcttttctacattctaggagaaaatgtctgcaattggtaataattctttaaatatttggtaggaatcactagtgaaaccatctgggcctgcagatttctttttgggcagtttttaaattacagatcctatgttctaaatagttacagggctattaaaattatctatgtcatattgggtgaattgaaatactttgtatatttcaattaactgstcaattccctctacgttgttaagtttatatgtgtagagttgtttgtatattcccttatcctttttcatgtttgtagtgattttgcctgtttcatctctgatattgtcatctgcccctcctttcttttttgtgtgaatcttgctagagatttktcgattttaaaaaaatcttcttggccgggygcagtggctcacgtctgtaatcccagcactttgggaggccgaggtgggcagatcacgaggtcaagagatcaagaccatcctgaccaacatggtgaaaccccctctctactaaaaatattaaaaaaaattaggcagggtggcgtgcacttgtaatcccagctacttgggaggctgaggcaggagtatcgcttgaatccggaaggcagaggttgcagtgagccgagatcacgccactgcactccagcctggtgacggagtgagactccgtctcaaaaamaaaaaaaaaaaaaaaatcttttcacagaaccagccttgttttattgatttttctctattgtttttctgttttcagtattaccgatacctgctccaatyttctgttttaaaaagttggctttttctgacattgctctgtcaggaaaaggggtagggcacagcctgtttactgccaagtgggggtcaaagtccaggttccccactccattgccacctaaraagggattgttccttggtggctgggtgggaagggaagttccccatttggcmtccactgayactgcaggggcaggagcttcattaggggctggagatgaaagccctaaatccctacatggccttttctgacacaaccccagtgagggtgtagggtgcctctttagcctcaggagcatagaagtctaggctccccattcagcctttgctgttgtgggttggggaggggcctcaggtttttctgtggtgtttgrctaaaggasagaagtcagygtccaccagttttctatcatatctcgctatgctgccctttactggtactttggttagagaaagcagattttatttgggctttttcagtctgtactcattggtgtttccaggttgccggcttcttcatctctaagtctgggatttatgaggcaaaaagaaaattcaagacactgatcaccattttgttccttccgagaaccctagccagtctgtcttctgagctcttttcagggtcttatgtttctctgagctataatgtccaaagtttttagttgtacttagcaggaggaatagggcaaagtacatatatacaatcttcctggaactggaattatccccaagtatattttataaccaaattgatttagtttggaccccatgaaaatgtagtattacaatattaaattagatcaaaattttaatataaagtcacttyatagatcattgttacataactaaactttcctcttttcttctagtattttaatggcaattcagatgcctctacaataaaagagaatcagtttgacccacctattgtggctagatatattaggatctctccaactcgagcctataacagacctacccttcgattggaactgcaaggttgtgaggtaaatggtaaggtacaaagatgcattattttctcactgccactcaaagaatcaagatttgggaggtataggagaatgagtagaatttttagttcttttcagtgacttaggctcctaggaaaacctttgtgaaacagaggttctactcaggtaaactctcagtgtgatctagaccaagartggttctgccartcagagtgccgacagcatctctgtgaagaaagtgcctggattatatagacacatcacaacyctccaaggaagggctctaatttsgaattacctccrtcagcccattttcaataagacctacctgagattcaaactaggcctgactcttccaaagtcctcaggtcactcaaacttcaatgtcatgacagtatctggcaacatcactgccatatatrtggtgttcaatgagtgtttttgaaatctgaattggcttcccaacttcctgaaaccacaattcttctttatattttctttcataccctgtgtaggtactcaagtcttttctatgttagctgctatttctcaggggctgtaatgtgacctgtggtayaaataaatccaggtaatcataaatggtcataataaaattctactatatatagcaaggatgtttaagagtcttaactgttcttcttggactcttaaagcagtgctttccaatattttttacttcaaagcacacaaagaaaataatatctgcctggcattctgaggtaaaagaatgaagcawtaaatctaaggcttggctgatccaggccccacttggctgctgaagggctggaggtgggaagagggatcaataaataggtgcactagaaacctgccrtgrcacacctgtcaggagttgcagtacttccctttgggtggagagaagccaccatgattcacaatggagaaagtagctgaaacctggaatcagtttcctgttgaagcagataatggcacagtatacccttggatggatatgrgtattttgccaatgtccagatagcagtagtctaaaacatctcccaaataaaacacagatcttgtatcggcaggaccactccttgaaacagttccataagtcattgcgtttttttctttccrtatggtataaatagatttgttcagatcctaataaactaccctaaaatgtgacattcaattctgctaacttatttaaaacatctattttttatacaagaagcattattttcttcttattcattttcttgatacttaggtaattattagcagtgggtattatttttaggaccctttgtttttttcatggagaaagtaaggcatcacttcaagaaaatttctgcatgatttaccaacaagaacaaagtgtcacagagatgatgggtggtcagccaggttcactcactagctgtgtttcttacagtcacaggtctgccttgctgcctatgatattcaaattacaccttggaaaaattccaaagggtacataactcgaattaccctctaagggttgaaacagaaaatattaaatagtgactgagggtccattgtatcttcttggtagcttttgttagaagaaacagagtatttttatatatagataatttaggattattgtcacctgaaagcaaagaccaaagtttccaagactctcagaaggaggaagtgagtttaaatgtttagaacatggtatttggtatcagattgtctgaactcaattcagtttctgattcttgtggctgtgttaccttagacaagttactgtgttttggctgtactaaaatggagatatttatgagcattatataatacatgtaaagcctgagaacagtatttggcmcttggattcaataaatcttcattgttgtggttattgtttttgtcatttgttggtagtaatattatttcttatctcctctgcagtgcatgaagccatgcagggaatattggtgtgtaattaatcamgttacttttcttttgataggatgttccacacccctgggtatggaaaatggaaagatagaaaacaagcaaatcacagcttcttcgtttaagaaatcttggtggggagattactgggaacccttccgtgccygtctraatgcccagggacgtgtgaatgcctggcaagccaaggtcaagtatactctatgcatggtgttctcttagggctccagaagaaagcaaaggccctcactaccacaaacatggaggatctgggaagcaggagtattttaatctgtttctgcagattaaaatcctaggtccaagagtccaggatgtctgtggacttgatagctttgactataactttgtctcagagagaagtcatttatcatctctgtggtttttggtctagtcttgatttaaaccaataataagcaaattaatttttctgcaaagggatagatggtaaatattttagtctttgtgggccatacattctctgccataactactcaactctgccattgtagcagtaaagtagccataaacaatatgtaaatgaatgagctggctgtgttctaataaaactttgtttacaaaaaacaggcagcgggccaaatttggcccatggatcatagtttgccaactcctcatttagacagcttacattagtgataaaaaaatgatttagatttgcaacatcatctcttattttttctttacaatttagcaatattttttcattttcctaaatgaaatgtcatctaaacttttttgttctcttccccgccctccttattttaagagctttgtgatattccttgaggcaactagaagcatagtaaaatgttgcaaaaccagagttataaaatcagtgatctaagttaaacaawcaccttccagagagttatactgtccctgatattagcccactgagtaattcaggtgatttaatttgggggtaactcttaatatttgactcatttttattaattctttaaatgacctgagatatcagaatggcatgaataacttgatgatcccttcagccaactaaatccaaattccctamtttctatcctcatatctccctcccttaagatacctacactccaatttcctggctttctatagaattccagggcctatccttaaattaggccactagaaaggaaaaaagaattgtggtgctggtggsgtaaatagaaaagattggattccacacagtcttgggaactgatatctgtgtcttgaaactcattctggcccaatatggaatcacagaatgttacagtagcaaggagcaaagcatctggtctagatttttccttttaattstaaatacacaggagattaaataattttagcttagtttggtagcagaatcaggactagaatcccattctcccagtaaacaggccatgctccttccaccatttgaagcagcccaaatacctcattttgcaattttgcagagggcaaagctgacacccagagaagttaaaataataaaaatagtgttatattacatttatataatttacatagcaatataaataataattaaagagatgttatccaattctttttcagatgactctttagacttgttcatggtataaccttgtcactccatacttcattttacaatcttttaaaaaaatttgcactctctataatttgctcttagtctttgtsatataacaagggyctcaaagataaaatgctaatttttaatggtgtcatttcaaagttagaattcgggatcagaaatatgtgttttacttaacccccttccattcacatgaaatgtctttatatggtctctttagagaggttgaaaatcaaagctggacatatgcagtgatgcacatagatgctgttctctccataactaaaatgtctctacctcttttatgcctgtgaaaacctctagctggttatactctgcatcactggtacaaccttgatatgaagacwcactaagataccacccagatgtcactagaggatgttatagacttaaaagttttctcatataatcattctaattcagttaatttgcttttaaaatacatatagcatgtgaatttttgtgtatacacatatatacacatacacctatatatacacatacacttatgtatgtgtgggtgatgttgaagaaacatatcaatattwtttcctttagaattgaatgaggttatggtagrcgataaatctcccaaaggtaaaaatttatcttagatgactctaaaactcagtttagaccttctgatctttctccaaacacatatcaccaaccatgtgattaggcattttgttaggccagagacaggacaataactgtactgygtatcaagctctacttatggttttatcaggtctctcaaatgttacatttatttgaaatattagaagaaattgaactatttctgmtctttgacattaacagggggaaagagaagttgtgttttgtaaaacaggtgaaatagagagagaatgctatccaattatttcccagataaccctgcagcaatattaccagagtatttaaagaaatttgcttaagaaaataatattcacagataatttagcagtttaattatttttccaaataaagctcatttattcattcatttattcaacaactatttattgaacaccaactgagtgtcttaacattgtggtgagtaccaggaaacaaaatgaaataagcctctacccttaagcagtaaggaatgctaagaaggaaacaattatagtacaatgtgtgaaatacttcaataaaaatttacacacatattgtggcaatgaagaagaaagagggaaagcttctaggagactgtgaatcctaagggataagatagaacaaaatccttttgagctctgtgcttttttgcataacttggtctaaaaaaaaagcaaaggttttaacmtcttccttatctatgtgtttttgtcattttcrtaggcaaacaacaataagcagtggctagaaattgatctactcaagatcaagaagataacggcaattataacacagggctgcaagtctctgtcctctgaaaygtatgtaaagagctataccatccactacagtgagcagggagtggaatggaaaccatacaggctgaaatcctccatggtggacaaggtagagtggcatctgggcaaagagaaagcaatctgaagactgtgctataatgagaataacagtattttgcatttgacaaatatgcagtgacatgtaccacctctttaagtcttctaaatcttagttcttmaggtgcctggtctcagacaaactcctggttgtctgttttggtttgttttatttctcactacaccaggttgccctcataggaggataaatatcattgtcataaaaaaaagagtgattttatttctggtgtgtgtaaaccttggggaacttgctgatgatggaagggggaaagttatacamtttagttgaggatataaggtacatgccaacaagaataaataaattaaaatgcatggtcacattttaaatgttagcaatagtcaaacatttattggtggccacttcctggcacttactatgcacttaygttgacatacatttttaaatatttacaatgacttctgtgaggtaaaatgttattatccttattttgccaatgaggaaatgaagaatcagagaataagtaacttgttcagtcatacagctaatacagacgggctgaaggcagaaatggttttgcagctgctccacagcaccatgtgagacttgtttatttttcactaatttaagtcagatcactggtgagatgaaatctatctggcatgtgatttcataactgatagaggatcatctctgtgagagtgttctatgtgttctttgatatgctcattttgagctaataggataaaaaattttctgggttgggcatgatggctcatgtctgcaatgccagcactttggaaggctgaggcaagaggattacttgaraggagtttaaggctgcagtgagccatgactgtgccactggactcaagcctgggcaacagaataagaccctgtctaaaaaaamacaaaaacaaaaaaccttagccatttatgttgtcattaaagattttctcttatttggctttcagatttttgaaggaaatactaataccaaaggacatgtgaagaactttttcaaccccccaatcatttccaggtttatccgtgtcattcctaaaacatggaatcaaagtattgcacttcgcctggaactctttggctgtgrtatttactagaattgaacattcaaaaacccctggaagagactctttaagacctcaaaccatttagaatgggcaatgtattttacgctgtgttaaatgttaacagttttccactatttctctttcttttctattagtgaataaaattttatacaagaagcttttataatgtaactccttgctaccagtaagtaagataatggctattacttctgcattaatttgaatacaggtaggaaaatatcaagaaccaacaagaaaagggcttatctttcttaatgattgaaaatgctatgaagtaatatttatgtagttaaaatgcttcattataactcttttaaatcctttacacactagtaaaacagatattactttaaataataattgatagacctggataactttcacaaacacatgattttttaatggtttttcttgagtgaagagaaaaacaatattatcaaatgaaataagtacttaaaatatcctgtctttcccatataacaatgatttttctgactttccatgagtaaaaaaacagccaagcatctttccagtagccccattgaaattgtgaatccgtcctggtctccctaaggactgcacacattgatattcaaggttggtggtcattagatatggaacagaactgaaataaccatggtagaactgaatgtgtaatgttggctttattctagctggtactacatggcacacagtttcaaaacataatttcacctactggaaagctcagacctgtaaaacagagcatgggaactgctggtctaaatgcagttgttcctgctcaaagagacctctggccaaactggcaagcagttaaagttttctttcagggccttcctctctatggcctcaacttcctcytctctcttcttccagcarcttcccctttcatcattcctttccctggggacttggcattcagtgatcctgtagatattgcacaactggggaacctttagacatccttaaaatcacatgagatagacagtcatttggggtgtctgaaataaaccaccccaaaacttagtgttaaaagagcaaccaaaaaaaatttatgtgagattatggatttgttacttagcttgatttaatcatcctgtaaygtrtacatatatcaaaatgttatgtataccataaatatataaaattttatcaacgaaattcataacaatctctcagaccacagagaaatcaaattagaactgaggactaagaaactcactcgaaaccacayaactacatggaaactgaacaacctgctcctgaatgactactggrtaaataatgaaattaaggcagaaataaataagttccttaaaaccaatgagaacaaagagacaacataccagaatctctaggagacagggctttgcttttgctgcattctattcgttgtgaacacaaattacaggccagtctcgatwcagtgtagaagggaactgcataaggaccacataccaggaggcataattcactgggagcatctttagaaactaccagagttacctgttgcccataccagtggggtaagccctatgaatgtatatgagagtttcaaacatccacaaaacattggctttctaatattygtattcccactattcctttcttttcatgattcatgtcattgtcccatcaacatttctaagatttccattccgttaagagcaaaagagaatgttggaaggtgggggaaaacatttctttgttttctacagggccagcttcttggatgtgtgtgatctgttcagttgcaaagggtcacatgctcagaaggaccgcatgctaaatttaatgctttgcagttaccctcttgaaatcctttattttttaagaaggaattcgacatttccatttttcaatgagccccacaaattacgcagctagtcctgggcttctctactctgaaattgggcaggatctctcttgatctagaatttactaaggcataataggggcaagaaaatcttatgaaataatggggggtagggaagagatgggaatggagcatgagatccagcttcgttattctctacttgagaaaaataaggccccaaagattaaacaacttgcccaaggatattgcttgttagtgtcagaactgaaaccagaaaccaaatgatcatatccctagacttttagtctgctttctcttccataaaatgaaacttataatgtttctaatccattgctcagacaggtagacatgaatattaattgataatgactattaattgatctggaaaatacttgtttggggatcaataatatgtttgggctattatctaatgctgtgtagaaatattaaaacccctsttattttgaaataaaaaagatacccactttttatttctctctctgawctcacttagatgaaattacaagtttgactacatagtacgtctccagtgacataawccactgtttgttacaactgggtgctttggaaagaagttaaatgactcacggtagaatcatgacttaagagaaaccaacagataaaattctaaacattattagtcattctaattgcaatttggaaaagaatagctgtgaatgtatcaaaaatatgaaaggactagaagaaacatgaaattatttctccagaattctttcaagttattaaaagaaataacaaacttcatgccatttttataatcattttgaataaacaccatattttgagttcagggccattttggcaaacccagggaaaagctcttgccaaatagcttggatgttcccaagagccatgaatatttcaccatttacttctctggacagaccaggaaggaacaatttactaggcagtgaattttggttttacgaaatattggcacatgccccaatgcagtgggcctaacacatacttaaaaatatctgatagctccatgttagcatttttcttgttttatatttcctaatggagaagtattttatggaaaattctgaatgcctaattctcccaagttcatatattctcatagcctagagatagggaaagctgtagacaaagacaaaatgattatgtgtggaataatatttacatggtcaatgcccagataacaaggtttttcatatccaagtacttaaattgttgggagagactacagagctttaagattttattatctctggcttgtatgaactgtccccaccaaaacatatacatgtattttgcatttggtacatgtaaagaaaacttgatattaacctctctacatgtaccatcattttaattttttaaaaagtattaagctcattctatcgacacagcaaaccactatgacaggcattgtaggggagagtatataaaggaaataaaagacacttctctggcttattcaaatacatcatctagttgcatagagaagacaaacataagaagcaaatagacactatgagcctattaagcctaacagattacaccctgagtagtaaagaaaaagacaattagatgagtagccttgtgggatggaatcagactgtgaaarcttttggagatgatttaacctaggtcatctgatattagatgtgtatgaaggcaacctgtgcagaactccaragaagagaggactgggataaggatcaataaaaaccaggataaataagagctttatgctcaaattcagggcccagttaagctttctctgacatacctactcattttccctaccctctctatatagtctaataatgacttatccacctccctccatctcctgtaccatgcccataaatccagtgtatgtgcaaggtcaaaacaaataagaattacctgggtagaactgatgatgtgagggtggggaaagacacaaaaacagatacaatacatatccctaatctccaaatcgtgaattacagatggtagtgaccagattaaaagtgggtcacctttggaaatattatagaagacgcccatgaggaacaggattctgacttgcttagggtgataggagaatgacactggagtggggagaagacgggtaaaagtaygttgtatgtgagaaattgactaatggagagatgagacaatcattgaggatgtttggacaatgacaagagttcaaagttcttatgcgatggttttatttttaccactggtccacatctaaaccacttctacctcatctgtactttcatgttttacacttagaagaagcttctcaatgtcttaggaatggtgtgcagttaatttcataccccacctgctttttattgacaggaaatttggtaatggctttaccgtcttagttatctccaccttgtattgaagttccttcctgctgattaaaaagactttctgaaagtctggaatgtggcaaccttgtttacagatgtgacaagtaaaaatgtttaaaaagcttttcttttatgaatagactgggagaaatagtgacaaaggctataattctatgattgcaatagtattggtacatagtaagcattctatcagtatttattattagcattataatgaaaatatgatatactatgaatataatggtattaattactaatattaatttctactattctctaatgctttttaatactgctcattacctctttagaaattgtagtaaaatacacataaaagttactctttaagtgtacaattcagcggcattaagtacattctcattgttgtgcagccatcaccaccatccactgctcattactttttattgcagctctattttctacccatacttgatgctcttcccagtaggtggcatgtctggttcaactgtactyagccagagttctgaagacattcacatagaggtcaagctttaattattcaggctaaacaaataattgaacagcttgcatggacttttttcagtgggtttaactgacctaattatgtttttctcagggrtagggactattggcattagtttacatcctgagcccacaggcctagtataggattcagaaattatcaaactatccacaaatttgaagatttaaataaaatcaagtaaaaattttctctccaaaaaaaaaatcaattagttgccaatgaaggagtttaaatgggagaggtaaataaattgtgccagaaaataaactagaaagaacagtcagcatgctaggttatagtagatattgtgaaaactgtacttctctgcaatacacaaagtaggttattaaaaattattggctggtgatgatagtgtggtttcatatttgccagcattatgaataatcttctctgcactcctagcagctagaattttaaataaaaagttatcatatttcttcaggtggmaaaataattgtgaaacacaatgttcttggcagaaaataaaacccaaatgactaaatacaacatatttttaggcatgtgtgaatgaatatatttctctctcatcttgtccccccaagacttaaggctgcttaaaaaaaataaaaaatactactagatgacatatgttagaagtagggaagaaagcaaaaccggaggtagaaacataaacaggaagcagaraaaagctaacaggaaaatgcatatcataaagctatcgaccttgctatgggtgaacttgggtttaagtgaactttttaaacagccaatgcacaaaaaaaccttatcagttataccatatggtgtccccaaaaaatgtacaaaaggagcacacttttattgagactgaagttaaaaataaacttctcccaaaggtccgcagaaagaggtcactatgtaatgagcagaatgcctctaacaagagcacattatataggctgctttctgtgcagaaggtgctgaggacttcccaccaaagcacagttcagtaaaaacaagtcttcagaggccactgctgtgtggtccatgtgcaggggctctttgctggtctggcttaagccaaaggtagattttacagcctctaaaaatcattttccttcaggcaaaggctcatatcataaatactgtttctctaaggcatgattttgttakctactctgtgacaatgagctcaagattgtgtattctgcaaggtgtaacaactgcatttttacaaaattgttatgttcttgcacaagattctatcataagcaaatggcaatagaaggcaaatgtttcagaacaattaatgcaaaaaaacgtaaatagagaaaattatt

SEQ ID NO: 13495 - DNA, 195235 bp, Homo sapiens
agcccttattgaatgtttctttctgagaaactggacttgtcagcttctttcattggcctctcagcttccttggcctttgggggtaggtttgcatagacctgcttacctcaaccaagtacacagatcaggagatccaatttaaaacaacaaactaacaaacccctatgggatcagagagaccaagctcaatactgaagttaggttttggactcagagacaagcttacctgtaggttgaaagcatgaagcatgaaacccaatgcatgggcaatgttcagaatctgttggtttcagcccaggattgatagttgcagtgcaatttcagccattatgcgcaagcagtgtcacatycattcagctgacaggggcgagacactaatctcagtgggcatccagcaactgaaactgcagctggccttgggamgtttctgccaactctttaaatctttacaggtacagagttgctgcgggtgaccaaactttgtagccagtaagatcatgagaaagttaagcagtctgttactttgagggaatttccttagaaaagaagagaaaccgatttttttctcctttctggtgagaatgactcacttggcagagctgattgctttagggcccacttgacatgacaccttccccctgcaaatgactctggatattataacataccttcgttttcattgatttactttactatctttaaaaacaaccctctaggccagaaacatgtagctgcactgctatgtgtgtgtgtgtgtgtgtatgtgtgcactgatttttacacaatttcacaatgtcctggaagtttgtggccccctaggttgacattcggatcgctcgagccagttgaatagttatatgacaatacatgatctaactyctttaactgaaaacaaacctaaagtcatcactgtttttggaccaataggcattgagaagttgtaagcttgatcttttaaaaaatggagacatccactgaccagcagctaattctgtgyagcactccacagcagacagggagaggagggaaagagttctacagggagagcatttttcagtctctagcctgctgtttacaaaggaagtgctggatgtcactgttcacagcctccgtgtagaacagctgcagggggctccatggtgcctccaggagcaatgtcctcaccactatttaccctctaaaacattaacttgaagtcagtggttcatctgtaccacaagcaccaagggacttgttaaaaatgcagattcctggtctgcattccagacccactgaatcatgtaatagggactagaatcaatattttaaataacacctgaactgatccttctcaacaacaaaatctgacaacccatttgaatcgggtttatttcacagcttttaagttctaaaaaatgtactaaaataaggtactaagcacatatgaaacatatacttaacatgtattttactttcaataataatagcattaagcctgggcaacatagggagacctcacctctacaaaaaaaaaaaaaaaaattcaaccgggcatggtgttgcatgcctgtagtcccagctactcatgaggctgaggtgggaggttgcttgaacctgggaagttgaggctgcagtgagccatgatcattgtgctactgcactccagcctgggygaaagagcatgactttatctcaaaaaaaaaaaaaaaaaagaaaargaaaaaagtgttacctgttccagaatctgattgttgtttttttcaggctttatttacttccctgttcatgacccttgctggcatggatggcattgtggccaagcaggattgggagatgctggagggagtacagttggtataaaaggggtacatggaataaaacatgtatttcttcttaagtctactgatttaatgtaaatacagatgtatgagaattttcagagtctcaaagtcaccatggttttttgatattatttataggtactaacattttaaaaaatgcagtttttttgagatcaaattttcacttttcctatttgggtggctatttaaagatgcatccrggcacaattcagacatacaagatacttcagttcagtggtttcttgaattacacctaaaatccaaaggaacgtgtttctgaaagtggctgccaatttttttttttaagaggacaatcagcaccatctagtggacacaartatctcctcttctagaattcggacccctgaggagatggagggcaggctttggaacctaggttggaatcccggtgccagttagttccccaacgaccttgggacaattacttaccctttaggtgctctgcttctcaactctaaatccaggtaatactagtgccgactcatagaatgttatgaatgaagtgaaatgatgcttggaaggcaagtctgaaacactttgtaaatgcagtttttcaataacactaagcatagattcacaggacatgggaactatccagtggtaaacactattatctgctctccagtaggaatggctattatacacaaaatccagtgtgtagaatctacgatatgaggcttaatgagatccctctcctaccatattgttacattcggytgaagtttatggtgaggaaagggcaaccggggcaacaaggctgaaatggtagttggtgcccagatggcaaacaatgctcttgctcgctttcattcattcaaatctgactccactcggaaggaggatgtcaagagtagggagagactgcaaacaaaaacaaaagctaactccgaaactaacactgccactgccatatgtcaccaacctggaatgagaccagggaaattttagcttcaaatatcttgactctagaagaaatttttatgaatgactttgaagggcacaacactttccaggatgtgtttgcgatttttgaaaatggaactgcagaaaacacagtatagacatttggtgctctcggacttatatccccgtgctgttttgagggtgtcacctgcaatagctgacacagaagtatctggggaaattaaaaacaaatacacaacaaatgcaatttattaaagctggcccttaaggcacacacagcctctcrgcagtttacaaaatggaagcakcaggaggtaaataaacacgtgagagtgacacagagacaaaacaattcaaaatgagataaatagttttatgcaaatatagtcaatagggacttagtctggaaaggttacaaacagtgaagagacacaaagtttacgtggaacccgaattttattttcacttgctttatatgcatcttatgttgcattttaaaaacaacagttaaaaaaatgaaamcagcagtaatcataggtccgctttttcttagttcagccccttccccccccgagaaattgggaaggtattgttttcttagtggacactattagtcaccaaattaaaaactggaaagaatggccttcgtttatggtgtatgagaaccgtgcaggcacttggcaatgatctcgtcttgccgctaggtaaacagcggtcggtggacggggagcattggcatcatctaggagcctgttagtctcaggtctcacctgatactgaatcaacatttttttttttgaatcagcatttttaacaagattcctcggtgatttgtctgcacattaaagttgagaaggcctagattcatttgatctcaggtacacccctggttgtgtagtttatgaagtctccccaggtgattctaatgctctgtgcagttaagcactgcaaaactagtccaacttcatttttcaaatgaagaaactgtggcccacaaaagcttatgtatttacctaagataacctagctgtttaatatcaaaatccaaataatgtcatctctcttcttcataaaaaaataaagcagggttgaggggacagagggtagggagtgtggagatggggataattattttatacagggtggttggraaaggccctcctgaggaagcggacgcctgaggaaagagaggagcaaaccaggtggatagctgggaaactgtatttcaggctggtgtgtgtgtgtgtgtatttggactggaggaacaacaagtgtttccaaattcctgacagatactgatctttgggatgcagaaacaggaaatcagaattaccagctgttctcaaaatcttattcttaaaatattctctaccttcttcatattctttactcattattacaagtatctgaagcctttgtttaaaaaatgagaactattaaatttagaagtgtttacaagaagtggggtttatagcaaatattcaaatgctggaaaacacagagaacattattgaggagtattcaaataatagatctcctagcagggttaactgtactacccagaatcatgggttggaaactgtcaatttaaggatttactttgaatccaaaacccgttacttttttgaacactgctcatagaatttgtataaagtatacaatgagtatcaacctatttatattttatttgcaagaatgactcactgccagcggcacacagggccaggaacataggctttcatggcaccaactacaaacaagactgactgatgagattgtggccatgtctctcccaagtgctcctgacctggttcctgaaaatgttcacctcaacctcgaactcagcatttcctgtgctggttttcaacttgacattggtgaatttcttcagtaacatctctaggtcggctgctaagttttaattctcataggaggattaggatactttctcccattttcttcagtttgcaactttttttcttttgagatttggaaagccacataaattccctgagaaatgctgggaagaaatccctgcacagaaacactaacaatgaggacagtgaggctggaaccaggtttaccaggggaaagcagtaggtaggagtggaggtcagagagccaacagaaagccttatcatttagagatgatgtcagtatgaacctgaatggaagcactgaagttgtgacgaatgtttggattctgaatatattttgaatgytgagctgataggwcaaatwgattgtagagtgagagaggaagaagaattgaggatgactccaaggtttttggtctaggcatggcaggctgaaattaccatttgctgagatggatagaaagtgggtgggggactctggagaagttgttttttcccgtgttaagtttgagatgcttacacatctaagtggatatgccaaataggcagttaggtaaaggagtctggagttcagggaagtctgggctggtgataagatgcaggattcaggagcatagggatggcatttatagccaggtttttatacccagcactcgcctagactgcagctgtgttctttcggcaactcagcctacgactatttgcttcgctgaaaaaaaaccacatcgtacctagttaaaacaatgaggacaaaggggccatgaatgtgaaaatgccctgtaaacggtaatgtgctgttcagactggaaagcaggagaaatgatggcaatggaggtgaggaaaatcagtttgtggacgtagggaaataattttcgtgcactgagaattagagaaactacgaaatgaaagaaggtgcaaaaagcaattataactctttttggactgtagccgaatctgtgcaaaactcatatttttaaaatttccatagcaccccaaatttactagagcttcacatacrtggtctttttgagctgcacaagtcttgtaagaagggaattattattgttcccattttacggaggaggaaactgtgctcggagaggataactgacctgtaaggcatcacagcaatatgagggacagagatacacaagcatccagacgtccgcgttccgaatccaacctaaagacgaaaaatcgctcccaacccccaccgtcggcagcgaagacggaaggacacacgccggccgtcccagctcgcagggctccaacagccgccggccccggtcccatttccggatggtacagccctttccgctatcgcgagaccggaagcatcgcgcatctggttgccagggaaacagcggtcccacaggcaggagggatctggaccggcggcttcttccactaccagagaggctgaggtggcgggagagacccctctcctctgggggtaagtggctggcgcggcgagtgtctgcggcgcgcttctgcggccatctgcgccctgactgacggcggccagttcctcgaggaggcccggcgggaaggtgaggggccgcgcagatgagggcggagctcggtcgcggggcggtgcgccgaggagtgggcggggcggagctgcgtcgggccgcttggcatgtagatggactgtcagggagagcggacagggccaatgagagggcgggggcgggctcattgggggcggggccccagcggcttctgcctccgcggaggctatttctccaggaatcacctaacattaggacctgtaaccaaggcttctactttcccgagatttggatcttcccaccaagatctagaactgatcaccagccatttaaactagaccgtaaacggcaaaggatgcaaataggcatttcacaggaaaaataaaaagatgcaaacagcaaacaattgattagagactcaacttttctcgtgaagaaatgtaaaccaaattcacagataccttttacacctatgagactggagaagatgaaacagctttgacataaccagatgggccccagcccagtgtaggggaagtagtgtaatttggtgcagcctttttggagtacaatttggcgaactaccaaaatttgaaacataagtgttctttgactcagcaattctaatatattttatggatgtatgagcataactaaagaaagattggcacaaatatattaacttaaaattgaggtataacttacttatggtaagcctcacccatttaatctacagttctgtgagttttgacaaatgtatacagttatgtaattaccaaccaccacaatcagcatacggaagtttcatcatgaaccccaaattccctagtgctctttgtatttaatccctcccctaacgccatccctggcaacaacttcctagttttttgttcctgtaattttgcctattccagaatgtcatattgatggaagcaaacaccctgtggccttttgaatcaggcttctttcagcttagcatcatgcagttgctattcattcatgttctgtgtatcagttgttcctttatgttgctgagtaatagtccattgtatggatctacggtagtatatttatccatttcctacttgaggcatatttggatgagttctttccagttgttggctattattgatgaagctggtataaatattcatgtacaggtttttttttgtgtgtgtgaatatgttttcatttcttgggtaaatatgaatgagattgtggagtcatatggtaaatatatgtttaactttataagaaactgctaagcagttttgaaaagtgatgattttgcattgtcattggcaatatgagtgttacagttgctctccaactttgtcagcacttggtattgtcagttttctaaaaaattaatttttgtcatttgaataggtgtgtagtggtatctcattgtgatttttattttatttttttgaggggtaatgatgttgaacatcttttcatgtgctcttttgccatccgtacatcatctggggtgatgtgtgtgtccaaatcctttgttttcttgttattgagtcttgatacttgtttatatattctggatatgagtcctttgtcagatatgtgttttgcaaatatttgctcctagtctttgggttttgttttccttgtcttaacatcttttgaagactacaagttttaaattttgatgccttccaatttatccatattttcttttatgaatcatgcctttgatgttgtatctaagaaatttttgcctaacccacagtcacatgtattttttagaaattttatagttttggccaggcacggtggctcacccctgtaatcccagcactttgacaggctgaggcaggcagatcacttgaggtcaggggttygagaccagcctggccaacatagtgaaacctgtctttactacaaatacaataacaataacaacgacaaaaagaaaattttatagtgtgaagttttactttaggtctgtgatacattttgagcaagttttagaattgcttttaatagcaaatattctatataccacctaagtgaactgatgaaaaaagtgctgcatctatgggatattatgctgttgtttgaaagcatgacrtatatctataaatggtgatatagaaaaatagataaaataaatttttttttctttttttgasacggagtctcgctctgttgcccaggccggagtggtgcaatctcggctcactgcaagctccgcctcccgggttcaggccattctcctgccttagcctcccgagtagctgggactacaggcgcccatcaccactcccggctaatttttttgtatttttagtagagacggggtttcaccgtgttagccagggtgttcttgatcctcctgacctcgtgatctgcccgcctyggcctcccaaagtgctgggattacaggcgtgagccaccgcgcctggccaaaattgattgttaattgtgaaaaagcaagttgcaaagcaccatgccatttgtatgtgtgtctgckttggggaggagtcgatgggtataaaagatagaaggtttgcatatgcctaaaaaaatgagacctgcragtctctattaacactaattcttgggataagccgaattttgacttaaaacattttgatattcacctgtattatttgatgttttttctgcatgggcaagtattccttacagatacacaaatatataaagtaaaaaaactgaccatacataaataatttttagacataaaaataatgaaactaaatcagtcccactttttaaagtcttgctactcataatgactaaacagaggaggattcattttcttttgattcttttattcacctcaaaataccaaattatagcagccatatgtccccattttggctttaaatcatctatgttgattgcatttctcagaagcctctatgaaraactttaatcttgtttgaaatgaatgttatataagttggcacttgttacagtttagaatctggtcatatatctaatctatttaatcaagtatcatgaagtaaatatgattctattttgaagtgttttaatgtcataagaaaatgctcattatgtactggtgaaaaacacattagtccaattttgttgaaaaagacagagcaaaaatgggaaagatgtaccaatagcgtwtagctcagggtggtgggatgttgggtgatttttatttcttttcaaataccttttagtacattctagagatctttctataataaatgaattctttagttataaatacaagatatagttaatagaaaaacagaaaatacagataagcaaggggacaagaacatccagaaacccaccaatccagaacccactactcttacttccttgatgtgtcatcatytttcaggtccctttgtgtatattcctttaataagagaagttggactttttaaagcaggattattggcaacttgtatgtctttctctattttttttgatatgtgcatttctgtttaaaatctttacccagttttctattagaattttcttttcttactgattggtaagagctctataaatatgtgaatatattaaccttttgtatatcatctttgttgcatttatttccccagtttctcaggttccttttaatttcacttagagttctttttcatgtttgagattcaagagcattaactattacgtagccacatctgttagtcttttcctttttgatttatattcttagtatcacgcttactaagtcattaattccataattatgaaatttatctttacatttatgtttataaatttatctttatgttccttccagtctgttagagatttcatattttttattacttataaaattagtttttacttttattaaagtattatgtttaactgttgtttggctttatcaatttctggacagtctctttgatttcctgtggtaacagattacatttctgatactactcgcttccttttgtgcactcctcacgaacaytcaatataattaaggcataatatttggttaaatcaacattcaatgcttacgtaattataactatttacatattgattgcttttttcttgtacaatgctttatttttcttgtggaatttctttgtggcagwtgcaatttcttctcaaatgcttaaatacatctataagatccaattttaataccctttaccaatacctttttctagatggccaaattcataagatagtctgttattgagtccccacctacctcaggaactgcattttatttaatttattattttcaggagtgaacctaatagaacagacctatttctagagcaaaatgaaagatttgtggagctctttagctgatccaggtcattgttggttgcctgtgcctgtgcytttattgacatgtattatgcggytctgcgcatgcttccatctcattgctccctctgcaagctgtaataagtctcccttgacaggctgcttagggcgtttacaagacatttggccttttggtgacttatgctttttggttttgatgtgaggggccagggtgatccatcatcccacaataataatgtcagtgctttcctgagtgagcccaaactcttttrcagagtttgaataatgttgagatcaatgcttttttcatytgctgagatgggaagagctgacctcctgatctcttaaacataagctttggcaccttgaatggttggaagccaagccrtaacatcrctctgtgtacctaggtgaagcctcaggttgtttatatttgtgctttctcctgtgtccacagcttctctggaccctgcctctgctgttcaaaaaagcaaaagaaagatgagtcattttgtagggtaagaaaaggacattgttgggtagaggcaattkcctttttcattctgttatggttgaatgtataattgataggaatttaggaaaggatttgttggaagacacccattcacatgtaaatccgagtatgagagggcaaaagctggaattaccctctttcttccatttgactcagcatgcgtgttgccccagtgtcacaggacagatctggaatggtcttagtcagccacacagtttggaaggatcaatgtgcctgcatcgctcactgtgtctctgtagcttatgccaccctgcctagtatttcttgcttccggaaatagcactagttatagagcagccagggtggtgagaagcctgtggatatatcacatgaagaatagttaaatagattggtaatgtgtagccagataatgaaaatctgtcctttaataaaggaagtaggttttgttctcttgcttcagagggcagaaatagaattatgggttttagaaggggagggttgataaaatgagagcagtgcctggagataggtactccatgaaaatgcarccccacgggggagaggagaaatcagagctgagagggaagaaggctgaactagagtggacaaggctagaaaaaagaaggcaaaaccgaaagaaagtagcagggggactttgggagaccgaggtgggcggatcacctgaggtcaggagtttgacaccaacctggccaacatggcgaaaccccgtctctactaaaaaaaaaaaatactataattagctgggcgtggtggcgggctcctgtaatcccagctacttgggaggctgaggcagggagaattgcttgaacctgggaggcagaggttgcagggagccaagatcgcgacactgcactccagcctgggtgacagagtgagactcattttcaaaaaaaaagagaaagtagcaggagggccttagcaaatcattaagatgaagtggatcttgcttgagagacgggtgcccctgagtgttccctcggggaagaccagggacatgtaaatgttttttcctggaggcccaggaagcaaccaagatggcattcacttctgtgttctcttytagccatattcagtatctaacatcctgggcagtatattttatgcatactgtggcataagattgaacaatccatgtacacaagatgtcttttggtgaagctggggaacccttaagtgtgacttcagtagcaacataatctttaaaacaaagcctctgagtaattggatattaatactaactaatgaaagatttaaatatccgagtcgcttggtattaaatattttatttgttgtttcaggatttcaatggatattataaagggaaacctagatggaatttcaaaaccagcttcaaattcaagaatacgccctgggagcagaagttcaaatgcttctttggaggtgctctcaacagaaccaggatccttcaaggtaatttacgtttagaaaagatttaaactcctttccccaacctctcagcagttgatgaaactaaggttgttgttaacatcccattttaaattttctccttagacggtgtgtttggggagcacttgcagatttcttggattttaatctagattaatatgaaaaaactctactccattccttccctccctccctccctccctctctctcctccctccgcccctcccctccctctgctcctcccctccctctgctcctcccctccctccctccctcccaccttcctttttttcctttctttttttggagtgtggtttatttctctgcactgtactttgttaaaacttgtgtatcgactctttttttctttataaggaagttttgtattccaacatctaatataccaccactgacttttactaaaaacacttactcaaaaagattcagtattttaaaaaaaccgtttggtaaaggccatgtgatgtatattgggtaggtatattgtattagtcctttctcacattgctataaaagaactacctgagactgggtaatttataaagaaaagaggtttgcatggttccacaggctgtacaggaagcatggctggggaggcatcaggaaacttagaatcatggyggaaggtgaaggggaagctggcacatcctacatggttggagcaggagagagagagagtgaaggaggaggtgctacacactttcaaacaaccaaatttcatgagaacactgtcagaagaacagcaatgattcagtcacctaccaccaggcccctcctccgacactgggaattacaattcracatgagatttgggtggggacacagagtcaaaacatatcagatattatctggctgtgaccttattttttttttcttcagcagtcccttttttttccttaaaatatctagacttctagacttgatttttttacttaaagcattagttttctcatttatttcttttaaggttttaggaaatgaataattgaacattataatgaaaaattttggcaagttaatgaattcatactcattttttttttgtttgtagactagattctgcattatggaactctwagaattctgtctgtcatgatgtggttcaggaatagcattctatgtatttcaagcagaaggggattgaatacaagagttaaagcctgggcaacattgtgagaccctgagtctacaaaaaattaaaaaaattagcaggacatggtggcacatgcctgtagtcccagctacttgggaggctgaggcaagaggatagcttgatttcaggagttcaaggctgcaatgagttgtgattgtgccactgcactgcagcttgggtgacagagtgaaactstgttccccctccacctcccccactgcaaaaaagagtttagttcctcaaaatcaacagaagacctcaaaatcaacaggtgaccagcaagaaagggagttcagggaggggctatacctggattatgggttctcaggtcacgccaccagagctgtaatccagagatcagaaagttgctgctgctgcttccgccactgccacaagtccctcagaaccacaaagctggtgactagacatgcagagatggctgcctttgatatttttctgccagcttcctatcaggaacttaggacgatgcttctacctcacatctgctttctaaatcttgtgcaggttcatctaattggattatcctaacgtacgtccagaaccctagctataagtgactttgtacaaaatatagttttgtttcatctagtcctgcatcattactatatggtgtgttaactcttacagctttgtaataattactgatatctgatagtggctcttccatattgtttgttttcaggactgtcttaactatccttggctttttgctcytctgtatgtatttttttttttttttgagtcttgctcttttgcccaggctggaatgcaatggtgtgatcttggctcactacaacctctgcctcctgggttcaagtgattctcctgtcagcctcccgaatagccggggcyacaggcacacaccaataggcacacctaatttttctatttttagtagatatggggtttcaccatattggccaggctagtcttgaactcctgacctcaggcgatccacatgccttggcctcccaaagtgctgggattacaggcatgagccactgcgtctggcctatatgtgctttagatcagttttttaagttctgaaaaatccggttgrggttttgattgaaattgctttgactttacagattaatttggggagaatttctaactttgtgatattaaatcttgtcatgtattaatattgtatctcagttgatctattaacttttaatttttagttaaaaaaaktcacatacaataaaattcacttttttggtgtatagttctatgagttttggaagatagattgagtgatataactaccattacaatcaagatatggagcagtttgttccatcatccctgaaaacattttttcattctattcctttgcagataatcccatgtcacccttaatcccttacaattactgatctattccctgtctctcttctttttccttttccagaagtttrtataaatggaatcatacagtatgtagcttttcacgctggcttttatctcctagcatacttaatacatttgagattcatccatgttaatacatgtggctgatttcctttttaaaaaattttaagtagagacaggggtctcactatgttgtccaggctgcaaattttagagtagcatagaattagtattcctgcttatttatttctgggtgacaatttttttaagcagcaacttcatgatattgataacttacacataytttaatacacagattaatattacttcattcaagacttattaaaaggagaatatcagtgatcacgtaaactcagattttatttgaacctactaagctacaggttaaactctagaatatttattagccaatctggactttggcacttatattgaaagcaaagttttcaaagttgtgatttgtgttaatcaagttcatagaaagtcagtaaggttcaccttagattggggaagaaagctacaaatatattgtatgctgactgctgattgcaaatcattcagcatctagaaaaccttacatattgtttgactaataaatcttggtgtgctagttagttttattgctcagatttgtcttttattaaattcttaccaaagatttttttcacagcagaaaatgagcttaaaatattagtgttttagtgacatgtatttagtgataatatatttctcattctaaaaattttggcttgttgttgcttattaattttttttttaaagagccagtagttgtattttgtgtaaaaatcccatgggtttcaagtaggaatctaaatactagtaaggggtttcatgaggtatttgcgtttcctgtgattaagataaaggtatggaatgggggaagtggagccatgaaaaatggaggtggggctgggcacggtggctcacgcctgtaaccccagcactgtgggaggccgaagtgggcagatcacttgaacccaggagttcgagaccagcctggccaacatggtgaaaccccgtctctactaaaaatacaaaaattagctgggtgtggtggtgggtgcctgtaatcccagctactcgggaggctgaggcagaagaattgcttgaacccgggagatggaggctgcagtgagccgatatcgcaccactgcactccagcctgrgcgacagagtgagacaccacctcaaaaaataaaaataggctgggcacggtggctcacatctgtaatctcagcactttgggaggccaaggagggtgggttgcttgagcccaggagtttgagaccagcctaggcaatatggtgaaatcccatttctattaaaaaatacaaaaattagctgggtgtggtggcatgcgcctgtggttccagctagtcagggaggctgaggtgggaggatcgcttgagcccaggaggtcgaggctgcagtgagccatgatcatgccactgcactccagccttggtgacagagtgagaccctgtccaaatgtatatatatatttatacagagatgggatgtgatgttaagaatgaggaagagagaaaaatcatgcatataggccacagagcagaagagcagggggttaggaatagagaggccagtgggcaatgggttggggaagacagttggtagctagtggggtgggaaactatgggaaaatttgtgaaatttgcctagttctccagcttcacctttgtacctcattaccttctgctctttctgagttaggatcatatgagatgatggatgtgaaaggtcttggggtaygctgaagtgtgctatccatctagttatgttttgtatattctttattcccccatgtgaaacccagccgcagaggaaggtctgctaagttsctttataccaatataaatgacaggcagaacttgtgtgacttctcccagaaatgttagcattttcacaggacggaaggccttaaggattaactggatattgtggaattacagactttttctggcatttggcagaaatatgtttttgaacagggaaccctgtttaaccacctccyggattacataaagtagacactattttgcttatttataaattgggccttcactagtttcgttttctgctaggtctgttttcttctctgttaattcatggtagagaaacttacaccatagggtcattgtgggaagcgaatgaggcaggccatgactgatagtaattcttcaataaatgatggctatgattattaccactgagtcagctcagttccgctgggtttatgtcctggctcaggcagggacatactcacgcaggcctgcattcctggcagtttcattctcagcactgtccatcttccaccctggggattcacgaggggactgcagattgtggtggagagttgaacatgtggtgcagagaaaacacaaaacctacagagggctgagagcagatgggctggaggagacagtctctctgtkgggaggggaaaggtgcttctttgagaaagggctgactctctctctttaaggtctttcctgtctcccttgggctgtgttaacttctgaagtgattttcatcacagtttacaaaccccagggcctatgatccctgcttttccctcacccggccatggaggtccttttctgttctctcttaggaaaacacagctgtgtcaattggtgttttcaaaatgaactttgctaaaatataaagggaaactaaaatgaaatagaaaaactgtgaataacatagaaataaataaatgaccaaagcacagggttctgattaggagactctccctagaaagcacatctcaactcagactatccacttttcawccattctgtagccacatgtggcaagtggctgtcgtattagacctttgactgcccatcccagtgtgagctcaaggagcaggcccgtctgccttatcccagagcccggcagatagcagttcccttcaggactgaygtagactcttctccattattgctagggattgctggaraatggtgcaaatgttattacatggaattgtgtagttaaattacatttaattagagtgttatatttctagaatactttaatgctagtgtatgcatttatgtacattctccatctgcttccattagtgtcaaartattctagaaatgtaaagtttaaaaaaaracagtattttcggaaaytgttttttttttdaaattatttttaggtcgatactgcaagcaacttgaactctggtaaagaggaccactccgaaagcagtaatacagagracagaagaactagtaatgatgataagcaggaaagctgctctgagaaaataaaattggctgaagagggatcagatgaagatctggatttggttcaacatcagataatctctgagtgttcaggtaggataatcactaggtgattggctaatgataattacaaatgttaatgattattacaaatgttatatttaaggtgttagtattacctgtgtttttatcaactaaatataaataataaaccaaaaaaaagacatagactatttgtgagcaagcaatcactttttatttataacaatattaagagcccttaaatatattagaaatataacaaaatatgtcatttaataaaattgtggtcattgtgcattaatcaagtagggagtatttctgcattttttgatgcaatttattgattttttgatgactaaaattgtacaatataatatatgctctaatttatagggatagtcccacccaataacatttggattttcaaagatgacattttttatgctggtaaattaattctagtcagattgaattagaatagtgtttctcaaaaagtggtctgcagagccctgggggtatggtgggagatggtgkccctgagacccttgcaggggctctgcaaggtaaaagctgttttcatagtaatgctgagrtgctatttgcctttgtgtccaccatactgacatttgcactgatggtataaaaggaatggtgggcaaaattgctggtgctttatcatgaatcaggacaatggcaccaaaatgtactagtagtcattgtattctttgcaaccaggcactggcaggaaaaagamatagccagtgtcactggctatgaatcagtaaaaactatcaattttatgaaattttgacccttaaatatgcatcttcttaacatcctgtggggmaaaatgggaagtatacataaagcaattatgctgtgtaccgaagtttgaggttgtgttgaagaaaagtacttttgtgatggttggagttgagagctgaactggccacttttataatggaacaccgtttttacttgaaagaatgactgacaaacaattctcattcagatgggtatctggtagacttctttttaagaaaataaacatgttacttcgaggataactactgacagtatttgttgccaatggtaaaatttgagctttgaagtgaaaattacagttttggaaaactgcatatgtcactgtgaggttgatagctttccagtacttagacttttcttttttttttttttttgagayggagtctcgctctgtcgcccaggctggagtgcagtggcgcgatctcggctcactgcaagctctgcctcccgggttcacgccattctcctgcctcagcctcccgagtagctgggactacaggcgcccgctaccacgcccggctaattttttgtatttttagtagagacggggtttcaccgtgttagccaggwtggtctcgatctcctgayctcgtgatctgcccgcctcggcctcccaaagtgctgggattacaggcgtgagccaccgcgcccggcccttagacttttcttataaaaattggtggcaatattaactgatgccgttgtgtaatgaaatgtgttaagaggttgaaggtctgcataatttagttaaccacttttttccaaatgattaatgtaggataaaagatccattcaatgtaaaatatagatccatggattttaatggaacaaatacataaagctcactgatttgattacaggtttcacttaacagttaacctgtaggaaaccacccctgttaagttttggtgtagtatcaaagaagactgtccaattatctgaataggctattaagtttcttcttcctgttttaaccacttgtctgtgtgaggccaaattttctgcatatactttagccaaaacaacagattacaataggatgactgtcttcctatgagaatatgagaatccacctgtcttcccttcatccagatattacaaatttaaacaataccactcttctcactaatttktttgagaatatagttatttgttataaaatgtgatacttatgttaacataattagtaatagcatgttttttatttttgaaagtgaattaataagtaaatatttacttttcagtgttgatttctaatatgttcattatcaatagctataactcacataagaaaagttaaactatttttaaggccgtaaaggggagctgagaaaaagtttgagagctgtgatttagagtatgtttgggatgagatcaactctcactgttaggtcaggtgactcaggattatggttttcaggaaacaaagtggaatgggagatttcccttatcgcccttgaaggacgtgtgacaagggtacggctcacttcttcagtgcttccctgctcaaacccctagagggggcaggcagatgagcaggtgcagaggccatggggagtgcttttgggctctgatcccatggcagtgtctaagggtgagtgtttacaactcccaaatcccaagtgggagtgttccagtgtgctctttcagctttgccgtctgctggcggcttgtgttaatcagctcaatgagaccctctgccttatgacaagggcagagggctttctgtatcctgggttcttgccctggtataccagaagaatcgaatcacatgttggcttggaggatgagtgcaaggttttattgagtggtagaggtagctctcagtgagatggatggggagctggaacggggatggagtgggaaggtggtcttcccctggagtcrggctgcccagtggctgaactgtcctctgactgcctctggctgaactcaccttcgcatctgcatcgttccgtagtcactggtttgccagtgtctgctggtgtgttcctctgctcctctcaacgtccagccacttgtgtcttgtacgcttaaggtctcgggtttatatgggcacaggatgggggcatggcaggccagactgggcttggaaaatgcaacatttgggcatgaaaataggagtgcctgttctcacttaggtccatgggcacaggcccaagggtggagccctcgccagggactctacctttctctacccagcacttccctgtccccttcctgtctcaaagatattataattgaaattagctgctgacacagtttacattggatttgtttatattgttttagtactgcatgagttacttcaaaatgccygctatatagactacctatgttcayggagcctgagaatgctaggattggcagttgggaatgagaactagaaggtgttgcttttgaagtacataagcaataagattcaaggaacctccttattaataatatcctttttggataagttgctttcctctttctttttttcctctaagaggaaatgatggaattgagagcagtagctcacacctgtaatcccagcatttgggaggcccaggcaggagtatcacttaagcccaggagtttaaaaccagcctgggcaccatagtgagacccccatctctacaaaaatttttttaaaaaattatccaggtatggtgacatgcacctgtagtmctggctctggctgttcagaagctgatgtgggaggattgcttgagcccaggcgttcgaggttgcagtgagctatgatcatgccaccacacttcagcctgagtgacagaatgagatcctgtctcttaaaaaaagaagaagaagaagaagtgatgcacattatagagaaacatcacttaaccctttgggttttcaaaagttgataaatttggccttacttagcacaatatgccacttctaatgatctaatctggggtggctgagacttactgtttgagcattcatgctcattcattgctggattatcasctttcatcagatttaaatggagagaatattatctgtggctaagaggctaagaactttggctctgcagtcagacagatttgggtggaacctgactggcatttaccagttatatgaccttggacatacgtgtaactcagttaaaaattagcttcagtttactaatttgtaaaatgagaacagtgattataccacctcagagggttaatatgagcattaaatgatataaagtttaaaaataaagcacttaaaactgtgcctatcaggtaactctataaatgttagttattattatcgttaatcataagttaatgacagaagttctaaagagtccttaatttcaaataagtgactatcaattgtactttaagaaattagaacaaargaagcagcatagaaaaaagatacaagctacatagagtacttgttttgagtttttttctttctatatgttgcaaccacttygtgtcactgaagacttacggctttctactgtagccatttgtgtacacgccttctctttcagttagtctgaagcagctttaggacaggattcttgtcttattccttatttcctattttttagtcatgaacatagaaagtataacagaatgaaggagaaagaatttgggatttaaaatcacgaggatcacttctgagtccagtgctataatttgttacatatttgaaaggacccagttatctcaactgtaaaatagagataaatgtctgtttcatagggttgttagataattatatagacaaacacatgtgaaagcaccttgtaaaytgagatacatggtaccaatgtagtagttattactatcagctataaatatttgttgaatgaaagaacaaattgtaagaacaaaacaaaactttatagttttactatacttcaaacctatttttactttcaacacaatatagatgaacccaaattaaaagaattagattctcaacttcaagatgctattcagaagatgaaaaaacttgataaaatattggcaaagaaacaacgcagagaaaaagaaattaagaagcaaggtctagaaatgagaataaagctgtgggaagaaattaaggtaagaattatctaaccttatgctgacatgtaagaaataaattctcctggctgggcatggtggctcacacctgtaatcccagcacttagggaggctgaggcaggaggattgcttgaggccaggagtttgagaccagcctggacaacataaagagaccccatctgtacaaaaaaaacctaaaaaattasccaggcatggtagtacgtgcttgttgccctagctacttgggaggctgaggtgggaggatcccttgagcccaggagttcaatgctatgcagtagctatgatcatgtcactgcactccagcctggctgacagagcaagacactcaaaaaaaaaaaaaaaaaaaagaaagaatttcctctaagatgagtaagaaaatcatggaccatggtgttactgtggcctgccttgattgctttattttgtggaggtagtggcagtggtatgtatatgtgtgtatatgaaggagtcatggggtgatatttttctggaacctgagaagaaaacttggtctgcaacattcagatttcaagcactgcgctggcrtgttcatctccccagggacaggcccagggtaccatgtctcttaccagcagcaggctggtaaagtgctgggcccctccatctctggaataggaaggggtgtaatagctgctttcatcaagtatgtatatctgctttttcttcagcagccttatagtttggagataaatagacacagtttaaccctctggttagctttattatttgggtaaacctttgtgacaaacaagttttggggagttgactgtttcctgtgctggtcaagatctttgggargctgtgaagtgcttgaggtctgggaccatacttcatttgcttctgtctcaacaaattcctggtgctcaatgaactttccttggccttcttggacctcttattctctataatattgagggcttgaagttgactagatgttggcattgacttggtatatagccattggctcatatttcaattttgaccctcaaaggaaagcacctttaaggtaaggaaccttgtcataagagattggttatttttgataaagtcctccttgaacagttgactgacttctgggaaagtttcmtaggcaataatgtgaattaaaaatgtagtaattaaaaatacatttttatgaggttcccaggaagtccactgggatggaaagaaagaaacatccaaaatgcaatgctttaaactggagaaatcgtttctggaaattttagcagaaaaagttagcctatcactttttcctactgaatctcaagcaagtttttatttcctttgaagcaagaattataaatggaaacataataaaacatagtaacaatgttgaaatgtctgaaatttttaaattttatggtgtatctttaggttactcacagattataaaaatatcaagcagaaacttatgatactttaagcaaagtaattatcatataatgataggcatatactctgactctatctgggaatacccattgacagaattttgtgagaacagaggagatttacagatttcctcaaaaaaaaaaatagcctgagacttctcgtttgtacgtatgtgattgggagccgtgttggagtttaaaaaatcaatgattatagttgccttcttttcccatgtttaaattttaattttcctttcattagtctgcaaaatatagtgaagcttggcaaagtaaagaggagatggaaaatacaaaaaaatttttatctttgactgctgtttctgaagaaactgttggtgagtagatggagatgtcattcaactttgtttttatctgagtcatggaatatttggattaaagtaaaattcccaatccagtttttctgtcctgttctttgtgagtttgactgttctttagggaaataattgatcacattaggtaggattatatgaaactactccgagcttaggtatgttttggtgtctttaagtgtttgtgtctgcttgatggtaagggggacagggcagggacaaactgggaaatagacaaaagtatgtcattgcctttacttccttgtctcttttaggtgtctttagaccccactttctgcatacaattccctaactgcttatgagcctgtggaactccttttgttaaaatctatgaccgatttgtcctatttcctggtctctcacagtcctatatttttgagatgagccaattctgcatatttatttctgcctttctcctttgtttgtatgtatatttgtgaatcttcctttttgaaaacagaaatattatggagtcatgtaacctttaacccatttatatgatggtgaaaattttagggattagaaacattttgtatttttgtatattctagttgaaacatcaaaaaatactagtctggcctatattaaattcatagatcatttactttttgcatcttctgtttygttacggaggtaacacatgtataatctatataagaaaatattgrttaaacaaaaaaaattactatcagctaaattctcaacttgtagagataaccactattaatattttagtttactctttatcttttgagatgtgtttaatgcaaatatccatgtatatattttgagaataaaaatatgatcaaattatatatgtatatggtattttgtaacctttcccccactaatttgtatttcacgagcacctttacctgtcaataatagatgtgtgtggtagtttgtttccaaacggctgccattagttccttccctttatttgtgttcattctcctcctcatttagagatggagtccatgtttccctcccatttcagtcttggctatcctggaacaactttgattgatatattacagcaaaaatgatactatgccatttccaggccttgtctttaagaaaacaggcagtttctgcttcccttagaatgctcactcagaggaaagccagccattatgtaagaggtcaggttacccaaggctgccatgctgtgagaaacccaagcaagccatatgaaggggctatgcagagagaagatgatggtggccagttcctggctacagtgattttggtaatgtctctctcaaattcatgtccacttggaacattggaatgtgtctttatttggaaacagggtctttgcagagacttagttaagatgaagtctattggattagggtgggcctttaaaaaagaggagaggacacaaagagacatagagccacagggaagaaggctgtgtgaagatagagggatgtagctacaagccaaggaatgcaaggattgctgtaagccaaaagaagctaggaagacccaaggaatcattcggaaggaatgctctgctgacaccttgatttcagatatctcttgatttcagatatcttgtagaactgtagagaataaatttccgttgttttcagccacccagcctgtgataaattgttatagcagccctaggaaaccgatacactgactgttcaacagtttcaatgcagacactgaataaaagagcaagcttggacatttcagctccactaaacacaatgcagagaataaccaagactagacatacggccccctgacctgctccaggcatctccagccaaagggagctacccagccatctgaggccccattcatagtggagcagagataaattgttcctgctgtgtccctcaaattcctggcccacagaagcatgagcataataaagtgttcactgttttatgccattaacttaaaaatttttattgtaaattgacaatttrtatttatggggtacaaaatgatattatgatttatgaatacaatrtagaataattaaatcaagctaattcgcctatccatcacctcaaatacttaacatcttttatggtgagaccatttgaaatttagcctcttagcaattttgaaatgtacaatacatccttattgatgatattcaccacaccgtgcaatagatctcaaagaaaaacccttattcttcctgtctaactgagactttgtaccctttggccattattttctcattttcccatcctccagcttctggtaaccaccattccactctgcttctatgagtacaattgttttggattccacatataaatgggaacatgtagtatttgtctttttgtgtctggtttattttgcttggcataatgtcctctaattctattcatgttgttgcaaatgatagaatttccttctttttaaagactgaaaagtactccatggtgtctatacaacacattttctttatccattcatctgttggtggatacttaggttattccataacttggctattgtgagtagtgctgcagtgagcatgggagagcagacatctcgttgacaaacgaattccaaagcttttgggtaaatgcccagaggtgggatttctggatcatatggtaattctatttttagttttttgaggatcctccatacacttttccataatggctgtagtaatttacattcccaccaacagattgcaagggtttcctttaatccacatcctcaccaacaatttatcttttgtgtttttggtgagagccattctgacaggagtgagatgatagttcattgtggttaatttgtatttcctgaatgattagtgaggttgaacattttctgcatatttgttgtatgccattaagttttattttttactttttattttgaaataattttaaatttatggaaaacttgcataagtagtacagaattccatatacccttcccccctgcttctcctaatcttacataaccatagtgatcaaaactcagaaatcaacattggtataataccattaattaaagtatagactttcttaaaaatttaccagttttcccactaatgtcctttttatttactagtatccaatccaagatcccatgttacatttcgttgtcatgtctccttaatctcctccaatctgtgatagttcctcagtctttccttgtctgtcgtgatgttgaccctttgggagagtattggtcagctattttgtaaaatgtccttcagttttggtttatgtgatgttttctcatgattagatgaaagttatgaattttggcaagcatactctggaagttatgtgcccttctcagtcaatcacacttggtatacctaatgctgttatatattattattggtaatgtttcaccttgatcactttgttaagatggtgtctgctggttttctgcactgtaaaattactatttttttcttttacaattaatacatatcttgggggagatgctttaagactatgcaaatatcctgtttcttctccagctttcacctactaatttcagcatcaatcagtagatcttgcctgcaataatttttaccatatgccactagatttgggtgattttgtaatccaacaatagataactggaacaatgtgcatcagcattatttttaatgattatatattaattcattagatggatgtgccatcatttgtttaactaatacccttctattgaacatttagattattcccttagtttttcaattttttaaattacacatgttgcagtgacatccttagtcaattattgcaatgattaccttctgtggttggctgaaaaaaatccaccccaatcccccaagagatatctatgtcaaatccctagagcctgtgaatgttaccttatttggaaaaagggtctttgcagatgtgattaagtcctggaatattgagatgggccctaaattccatcataggtagccttatcagaaagagatggagggagaagaggtagataaggaagaggaaaaggtgctgcaaagacggaggcagagattggagtgatgcagcctcaagcctgctggcaaccatcagaagctggaagagggaggaacagaaattcctctagaacctctggagggaacgtggccctgctgacatcttgattctggatttctggcctccagaactgtgagagaataacttctgttgtttgaagccaccaagtttgtggtaatttgttagggccgctatagaaaatgggtatactttcaaatacattcctagaaragaaatacttagtccagggttggactttcacaagatttttattcacattgacttattgaaatcaatttagactcttacccacattgtatctgaatattatttttctatgccaacgatggattttgtagttatttttaagctttgtttatttaaagtggaatcacaataatttgtatttctctgattatcagggaggttatagatttattctttggtttagctaagttgtgagttacctactcatgtcttagtctcttttataaagtgaggtattctttattgatttgaaagacttttttaatattaaggatattaattatttgtcacaaacaccataagcatttttctaactttttttttaattttgtgacatttcttgctctagttagtcatttcttttatgttatcattcattggtactctgctttaaaaggccttttatgtctcaagattgtataaaaaatatatattttcctttcatcagttataatttaatgaaaaaatttaaatattaacccacttgagatttattttggtattagatatgagttagagagttgattttgtttttttcccccaatttgctaaccagctattccaagaccctttattggataatctgtcatttccccacttatttgaaatgctagctttatcgtgtaggaactgggtttattttcagattttctattttattccattaaaatttctgtctgtgctgatgttaataccactctattttgattattgtgtctttgtaatatattttattggggcagtattttggaataacatggttttctcaaacctattttttttctgagtttagcaatgactacattattttttaaaaaagagattgtaaaagcacctctaaagctatagcttatgaactgcttttttatttatttaaatgtctaaagaccagtatatgaacgtagtctgcttggaaaagtacaacttactaatatatttcattcaatgtttatcagtaattctataccttcatagaaatgagactataccccttattcccccccctcaaaaaaatccatggacagtgtcaggaatgagattctggatattatagtatctcaatgtctatagtttggaaaccaggagtcaaatactgatttttctagtgggtagggcttttctgaaagaccaaacctgcttgtggttgactctggagcaagcaatgtaagacaggccactctgtaagtggatctatggtggccttttaacattaagcttttcggtcacagagttcactacccagtgaacttttggtcctggaaggcaagacatttgttttcagttgcccttttttcaaaaccaaatcaaaactgtcaaatatgtttaatttttaaagctcctggcccgtatatttgacttaaatctatgctcacattgtatttctggagttatgtgactgctgtaggccctgtagacacttcccataaygttagattagtcctgatgttctaacatggaaattaagtggacttaatgatatgaaagctggagctgcaaggggcttgaaagctatgttaagagagaatcattgttttaaacatgatgacattattaaagcttcaatttttagattcagacttcttagttattatgtattggcagtgtgtgcaaagcaggtaagatgcaaaagtagggtcaacgtaaaaggaaaagggaatacaagatactgttaggtgaaccagatgtctgttgcacttcactcttgctactgactgtcttaattagttcacacttgaccagttcaccaaaatgaagaggtaacattattgtattactggcttcttcagatttaattagaatctttttttgatgattgttcttttacagaaaagccaaattccttaatgaaatttcctgcttgctgtttacttcatagacatatgttttggagtcatttattgccacacatatctgttttttttwaattcttaaaaacaaaaaagtagttagcatttactttaggctgcattattaacctaattatattaatttgttttttggactacataactattaccttattctaaaagaggaaacttttggaataatcagcttaaacttggtattattagcagaatattttcactgcaagtatgaaagaaataattagaaacacaacagtccagtttgacctcatgccacggattttttgaaagtctcatattcctggtatttcaacataagcactatcataaggtggtacgaagctactttcatctgttctacaatgaaatgaatttcccattactcattagatctcagctactgttttaattagaaatgtataaaaatwtaaaaattattttaatcaatcatatatagccatacatttctaaataagatatttttataagtattattaggaaaacaggaaaattttgcctttttttcctgtataattttttrttgccagcacagtttcaggcacttgtaaattgtccagtaggtggcagcatctagttacaataagtactttaaaaagccttaaagcatttaaaaaaattttaaagctcctggcatacatttttggcttaaacctatagagttcacattgtatttctggagtcatgtgactgctctacaccctgcagacacttcttgtaatgttagattagtcctgatgttctaacatggaaattcagtggacttaatgatgtgaaagctggagctgcaagggacttgaaagctatattcagagagaatcattttaagcatgatcacgttattaaagccagacctatttcagcatacctatcaatatacccaaacctactttctttcttttcattttttgtctttaaacaaagggagaaattcttaggatggatatttttcttttctagtcagtttttcttatcctcttatttaagagttagcttcaggttgggtgggtggttcatgcatgtaatcccagcgctttgggaagtggagtcaggaggattgcstgaagccaggagttcgagaccaacctgggctacttagcaagaccttrtctatacaaaatatttaaaaattagccaagcatcaggaggctgaggtgggaggattgcttgagtccacgagtttgagactgcagtcatgccattgctctgcagcatttgtgactgtgtgaaaccctatctccaaaacacaaacaaacaaacaaaaaattaaccttaaggactttgggctgatggctgaatggcaatttccaacctgttttcagcttccaaaacacagaacccatcccagttggcttataacatcacaaataagcaacagcaaataaatgaagaaaataactgtggttggatagtgcatttacttttatttataggtgctaaacacaaaagatgccttgactccaagagaaagttgaaaacaacattaaattgatttatatcacatttgaaccttataatccagacatattaacctcaagtttactgggattttgaagtaaacaatattgtacttgctagagatctctgaagtattttaaaagtctgtcccatcccattactgaggggtcacttttgggtttttttagaggcatgttgcaaaaatcaaaactcttttacatcgccaggagttttcccttagtttctatcatttatctaatgaatacaggtagaattcaatattctttgagacaaatacatctagtgacagggttgctttttgatagaggttattctttttgtctttgtcacgtttctctcttgtgtttctagctccaaatatagaaatgcatataaacacaaaacatcaacatcataaccaattaggctttttcaaatttgagaatacttttttctaggtgccttttctgtgagactcagatatatgatacttctgctcttggatgcttgggttaaatactcaaagaaaatctggtagtctctttctactctgatatgcagagggtagagggaggaaatcacataactgtgctgactgacacaggcaaggattttggtttttaatttctgttggagtctcagcattgtttagcaatctcttgcattctccwaaatggtgattccaaactattactatgtgcttcatctcccatcttctgcaagaccttcactgtcttggttggtcttcctttccagagaaaatgaatctacagggtaggaattccttttacattcatttcttctgtttctaagcttcatcctgactgtgttcattcatcctctgcctcttgcctctaactttagatggagggaaggtactcttattctctgaggccaaaatcagtaacatcccatccctttcactgtgttcctggctgttggtttgttcgtcattccattttttcatctagagcttcaatctctctggctctttccctttaacttaccatgtttaactcttctagtcctaaaacagaatcaaaaagccattgaaccaatgaataaccaacagaacatacaaataagcctttttcctcatttttttttttaatcttactctaaaacagacaccactcagtttccctcttctccttaaaggtcagacttcttgaaagaatagtccacatctcttggtgctacctggtcaacttccatttacttcttaacttttcagtgtctgtattttctactgtcacgctgtggaagctgcttcataagtggtcctcctaaatttgaaatctaatggcatacctccagttttgattgtacttgacatcactgtagaatctgacacagtgacctctcatagcatagtgcaatttttactggatttgttattccctgctggttttcttctttttctttccttcttcctcctattgttgaaacttattccttcttttatatgttttctctgctttagttaatggtttcatcacccacctagtctcctaaactagaaattgaagagccagcctcagttcctctgttattgttcttttacacttcttccttgagttccccaaatgagtatttgttctgccctatctgtatctgacctgttttttttttatccccattattaaatggtttggtctcagcatttctctatcagattattcaaacagttttcagtctcgcctccatggtgtcattattttcctgcaagatcattgtactggttatctagtgctgtgtaacaaattacccctaaaacatggcaacctaagccaacaaacatttataatctcacagtttctgtgggccaggaatctgggagtatcttagctgggtggttccgactcaagatccctcctgtcaaatggttgccggggctacagtcatttgaaagctttattggagttggagaatcggcttccaagctcactcacatggttgtttgcagacctcagtttcttgytgcctttgggttggagaccttaatttcttactacgcaaacccctccataggatgcgtgtatgtcctcacaacatggtagctgacttctagagcacttagtaagtgctcaacaaattgagttattattagtaatcctgtgattactagacgttactgcatcaacaggaacatggtttgtgtctcttatattatcatttatatgtcaaagaatttcttcaggtttcatacatctgttagctatgcataggtcttatatatctttttattgttattaccctgattggtgtttagcccatcatatttataaagggttattaatgacatagacgaaagttagtgactttttagacatttataatttgttttctatttgtacatttaactaaattatcttattaattttaattatttttacttgtttaccttttttttagtttatgaacacataaccaggaaataatgttaatttttgtgtcctttttaacaattattcctatgctgagagctgtaagaacttagtgttgaaatttattgaatgcatttcaatatatatttaaattatcataaatttttatttcatgtccaacatatttaatgttttaaaattaatggatttaaataccaaatgagtcttttattcctgggccaacccttcttggttatggaagattattcttttaatttagtaccagatttaaatgaatgaatttattcagattttttgcatctatatttataagcaaggttagttgtgtttgtgtgtgcacacacaggtgtgtgaaatgtttgttatggtatagggggtgaagttgagggtggagagtcgatgtatgtgtgtttgctttgtcaggctgtgtgaacttcataaaatgaatggggatggctgctcacttatttctatgatttgaaacagtttatataacacagggattatctgttcccttcaaatttgaaagatttcactggaaaaaccatctggttcaaataatttcttggaggcacttctctgactcttttctcagctgccttcatatttgctattctatttcaggttactagctattctggagtcaattttggcaatgcatccatgtcactaagattttaaagtatccacttcatgaagatttaaaaatttactaacatgcaatctcagatagtcttttaaataataattctttttcatattgtttgtacatcctctttatctctaattttgttaatgttttctcaatctttttaacctggaagttttttctaaactttttatttgggcacagttttacattcatagaaaaattatgaatatggtacagagatttcccctatacccacccccagtttcccttattatgaatatcttgcatttgtatggttcatttgtttcaactagtgaaccaatattgatatattcaggtttccttaacttttacttaatgtccgttttttgttccagaatcccatccaggatgccacattccatttaaccctcatgcctcctcagtctactcttggctatgacactttctcagactttttttatttttaatgaccttgacagttttgaggagtactggtcaggtattttgtagaatgtccaagagttggaatttatctcatgcttttctcatgattagactgaragtatgtgtttttgggaggaaaaccatggagttacagggtcattttcattacattacatcatattattaacataacattgctattaatgttaactctgttcacctggctgaggaaatatttgtaagatttttccactgtaagttaccatatttcmccatcctttgccacactctactctttggaaagagattgctatttgcagcccctgcttaaggagtggtgctgggaaaacttgctaaccataggaagagagataaaactggatctctaacttaccatgtacagaaatcaactcaagatggactaaggatttaaatatataaaaattctagaagaaaacctaggaaatactcttctggttattggcctaggcaaagattttatgactaaattctcaaaaacaatagcaacaaaaacaaaaattgacaatgggaacctcattaaactaaatatactaatcgttatttagaaaatgatgrtgactttcttttcttctccagaattttgtacaagtcctatattttaaaaatgaatattgagtctcataatattgtggtcatggttttgatattcttaaaaataaattttattgtgtatatttaaggtattacaacatgatatgagatacatatatctataaatatatatggtaaaatggttactatagtgaaacaaattaacatatcagtcacctcacatagttacccatttcctctccccaaacccccatcatgggaagagcagctataatctcatttagcaaaaatcctgaatgtaatacactattatcaattatagtccttgagttgtacattagatctttaaacttgttagtcctacatatctgctattttttatcctttgacctacattttcccatttcctcccagtgttctctccccaggtaatcattgttttattccctttctctgtaaatttgacttttttttttggattccacatataagtgagatcatgatcatgcggtatttttctttctgtgtctggcttatttcacatagtattatgtcctccaagtctacccatgytgtggcaaaaggcaggttctccttttttaaggctgagtaatattcctgtgtgtgtgtgtgtgtgtgtgtgtgtgtgtgtgtttatgtattacagttgctttatccattcatctgccaatggacacttggtttgtttccatatcttggctattatgaataatggagcaataaacatgggagtgcagatgtctttatgaggtggtgatttcattttctttgcgtttatacccagaagaggaattgctgagtcatatggtaattcttcctatttttaatttctttagaaaccttcatattggtttccataatggctccaccaatctgtattccctcaaacagtatacaagggttcccttttctccacaccctcaccaatagttgttatctcctgtctttttgataatagctttcctaacragttgttatctcacagtagggttgatttacatttccctgatgattagtgatgttgagcaccttttcatattgttggtcatttttatgttttctttgaaaaaatatctatttactttgcccatttttaatcaggctatgttttcttgctattgagttgtatgagttctttataaattttgaatattaacaccttatcagatatatgatttgcaaatgtttttcccaatctgtaggtttttttcttttattgattgtttcctttgctaggcagaaccttcttagtttgttgtagtctcatttatttatttttgcttttgtattctgaacttttggtgtgatacccaagaaataattgcccagggtgatattaaggcactttccctctatgatttcttctaggagttttgtagtttcagattttatgttttggtcttttattcactttgagttgatttttgtgtatgaggtaagataagagtgtaatttcattcctttggatgtggaattccagttttcccagcaccatttattgaagagactaccttttccccattgtgtcttcttgggcccttgttaaaacttagttgactgtatatgtttggatttatttttgggatttgtattttgttctgctggtctgtgtgtctgtttttatgccagtattatactgttttgattacattagtaatactaatttgatcacctttctgtgtgatgccttcaactttagtttttctttttcagaattgctttggccatttggggtcttttgtggttccatatgaagtttaggacttctattgctgtgaaaaatattattgggattttgatagtggttgctttgggtagtgtggacattatcacaatattgaatcctttgatccatgagcacggagtatctttccatttatttgtgtcctcttgaatctctttcaccaatgttttatagtttttagtgtccaggtcttttacctccttggtttaatttattcctgagtactttatttgatttttttgatgctatcataaatgagattgttttcttgatttttttaggctaggttgtttgtgtatagaaatgccacagattttcatatgttgattttgtactctacarcttttctgaatttatttattacttctaatagtttttttctggtggaatctgtgaggttttctacatacaaaatcatgtcatctgcaagtagagataattttacttcttcctttctgatttggatgcctattatttcttttccttgtcagattgctcttgctggtccttccagtactgtgttgaatagaagtgatgagagtgggcatccctaccttgtactagatctcagaggaaaagctttcygtttttcccccttggttatgatgttaactgtgaactttttataaatggccttcaggaaattttcttctatacctaaactcttgagagtttttatcaagaaaggatgttgaactttgtcaaatgctttttctgcatcaattgaaatgatcatgtggtttttgtctttcaatctgttaatgttatttatatatcacactgattgatttacataagttaaaccacccttacctgccagggataaatcccacttgatcatgatgtgtagtctttttgatatattgttgaatttggtttggkaatattttattaaggatttttacatcaatgttcatcagagattcctggtgtgtaattttcttttttgtgttgggtctttgtgtggctcaggtatcaaggtgatactggcttcataaaatatgttagaaagtatcccctcyagcctggtttttttttttttggaagagtttaagaagtattggtattaattcttcttggagagtttggtggaattcagccatgaaaccatctggtcgtggggttttctttgcggggaagtttttaattactacttcaatctctgtgtttattgtagatctgttcaggctttctgtttcttcctgatttaatagtggtagtttatatttttctaggaatttatccatttcctctaggttatcaaattttttgacacataattattcataatagtcccttttgatactttttatttcttaggtgtctgttgtaatttctttgttttcatttctgattctagatatttgagtcttctgtttttttcttagtctaacttttgttgattttgatttttcagaaaaacaactcttagctttattgatttctccttccctgtggcttttctatcctctatttgatttatttctgttctgatctttattattttcttccttctgctaactaggtttagtttgttatttttgcagttccttgaagcataatgtcaggctacttatttgagatctttcttcttttataatgtaggcatttattgctrtaaacttccctcttagaactgtttttgatattttgaattggttgaaattttctttatagcttattagagaggttctcaattgtaggagacatttggatgtgtgcatttttggttgtcataaggatgtgctgcaggggagaatgagggaactactggaatttatgccactatgccaggggccaagtttgctaaaggtcaggaattgcataaggaagctccacacggagaattgttttgcctgtaatatgattaatacccccagggaaaattcacctaatatatgattaacttttataagtactccgtggacacttgaaaagaaggmctgtttctctctgtggagaacaaactttgaaatgtgcaaaatgtccttattacttgtctatttgatttgcattcatcttagagagttctgttaaggtctttcagtataattgtgcttttattagtttctgaaaactgattggaatccttcaatatagtagaaaatgcgtattatttgtgaaaccaaaaaagaagaactggaagaaagagtatattaacatgaaatgacaagaggatgatttaaaaaagaagctgattaagatgagaaaggattacaaggaaaaataggaaaaatgcacttattggagtaatgagcataattaagactgcaggagaatcaaggcagtgaaggatgctccacaacatgaagggataaatagatgaggaaatgatgaagtaaatgataagtgtggagatagggaataggaattccagttaaaaattatagaaatttctgagaaagtaaactagtataactattatagaaacaatgatcacaggaaatttttctgatttaaaaaatattatatatgcactattaatgataaaaggccaatacccatatatacacaggtaagattctgaaccatgggaaggccctaagaaatcttacaagcatccaggcccaaattagaataatcttattttacctataaaaatggaagctgarttcagatatctttcttgcaataaaggaaaaatatagtaactagggattacatattgcttctgttattgttttgtgaagacaacagaaagacattcttagatatggtagagtggataattcactgctcatattgtttttggaataaatgtacttgaaaccatactctaggcaaccagcagatgagtcacaatgtacaatccaggattagagaagttgctatataaaggaatgatctgtgagcattataaccagccaaacacagaggtgaacagaaagaaatgtatgtttataaatccaagaattactctatgctagaagataagaataaccataggtaggcctaaaagtccagattatattaacagaggctgaaaagtgggagaaaagtgagggtaagtaaaacaattctaaattccttgtattactttagaggagaggcagaaaaccattttttgttcttgactttcttaatatagaaaaaatatgtttatataacttagacttcaaattaaagtgcaaactttccaaattgttgtatagttaggattatggtttataaaggagaaaggaaaagaagacaagaaaatgagcattaaaagaaaggaagaaagggagagagggaggaaagaggaaggaagaaaggaagaatggaaggagggaaggagggaaggagggaaggagggaaggagggaaggagggaagcccaaacaggaaaaccattagggtctaacaggaaaatcactaatrtgtctagtgatgtacatgttaggtgaggcaatgagtgtactcttttgaactagcctgttaaaagatacactctcacgttggttttcttatcatctctccttatttcactcagttcccccttcttccccctttatttttataatcccatcctcttgtctttttatattcatcagttctttcctgtgacttactcctctagtttcacaaatgtcatatattttgatatattgaggatgccaacaagtttttagaaattttatgatttttttatarttattttcaaaatgtctgctgtcccattgattaccaggatgctgtttcatttgtttttcattttttttccttctgtgtcttcttatcctccaatgaggtaaaatccatccacacctgccatttaccaacagagcaaaaaggtacatctgccttgagtctgctcattgtccatctgcatgcttttaaaattgtgatcttcattgctgatttctgcttcctttctgtccagttgttttctaagagttgcagcctctgaagagatgtagaaagaagtatgacagcggttgagtaacagcatttgaactgcctcaagaaacagtgttgttgctcaaggagatggggactctggtttctggttgtttttttccttttatctctgagtcaagggggtgctttccatctagatctaagtctgcccctgcgctgtttcagtaggcaaagcttacatgrccactgattgcttttctctttccctttctatcatttgtgttggtggcaattttttccagattctggaaatagagaacattaggtcgttgaatgaaattgtttcattcaacatcgtgtttttttatttttaattttttaaatttttattttttagagatgtgatctcattttgttgcccaggctgtagtgcagtggcatgatcactgctcgctgccacctygaattcctgggctcaagggatcctcccacctcagcctcctgagtaactgagattacaggtacatgccaccatgcccggctaatgtttaaatttctgtagagatggggtcttgccatcttgcccagtctggccttaaactcctgagctcaagagattcctcttggcctcccaagtgccaggattacaggtgtgagccaygccaggctctgtcattttattataacattgatgaaaaaaaaatggattcccagctagggccactgtctgtatggagtttgtcttccccctgtctgcatgtgttttctccagacactccagtttcctctccatctcaaagatatgcatgttaggttatctacgtggttccactgtgagtgagtgtgggtktgtctgagggcaccctgccatggcatcctgtccagggtgtgttcccacctgggactctgagctgcmcagatagactctggccacttgagactctgaattagaataagctgataaataattaccttgcttatttttattaatttttctgaaatgtacttatagcccacatttatgtgagttttaatattacaagtgttttggtctttatttagaagtttaataatgtttttgtttccrgaaatgtgccacagaaacttaattcttatttatattaattagactatggtaaaattggtttccttatatgtcattttgcttaaagtcgcagtttccaagaatctatagatgacattaagagaggatttactatactcgtgtagggcatctaaaaattgtatggcataattcagtattcagaaatgaggctctttttccctttctgtttcttcctgccttttctcaggatggtgtctgggttcgggaggacgcttgtgtagcatcatggcctggggatggcggggtggggggcggggtggcgcgtgaatctggtccttgctgttctstcagaggcgtatcttgtcctgcttggtctgtggatatgggaagccagctggggcatctgctgacttgtagctggtcccatttagcctttgtcatctgccagcagatgctgatgttgtatgtggtccctgccacatcctctctggtggaaggctctatgccaccccctcatcacgaccccagtcttcttcacaggggcatgtgagagcttctgttctccttcaagccacaggctggccagctrtggggaactgtgtgtgtgtgtgtgtgtgtgtgtgtgtgtgtkactgagggggagagagagagagagmsmgacagacagacagacagacagactacttcagcctctgtctccctgtaagcatgccacactgcctttgcttgtctgcagctgtcatgggtggttggagagcaccatgttcctttgtgcggggtctcccctcagttccaggtgtacagtgaggcagagctcactctgctgtgggtttctccagcctcttcaggttctctatgcacctccaggatttcacctccaggggctgtgccggggagcagcttaatacctgtatcacttgtgtctactctaaactcatcccctctgctggtcttccaggtcctctaggtccttatttgggatgggctttaatttcttccatgggtggcaggaagcaatttaaatcacatcctgcaatcttcctctttcaggactcatattaaaaacttgctcaatcatcaatgttttggctcatgatctctaaagggagatttttttttccttctcacatgaatgtttgtagtgaagagaggaatttttaaaattttcttattaactttgaattttgatcagatttaaagtcataggaaaagtacaaaggattctcaaatactctctatccagagtctccaaatgttaacattttaccacattctcttttctctttccctctccacacaaggacacacatatacacacatacatgcacgattatacatataaatcaggaaatgattattttgcaattatctataggctttattgagattttgccaattgtccctctaatatcctttatagcaaaagaaaaatctcaggctatgcattacattattgtcataccttttagtcttggtgttttatgacacaggcatttttgaagatagtaggcctattattttgtagcatgtcctctagtttgggttggtttgtttctgctcggttaggttcaggttatgagtttttggcaggaatcccacagaagtgatagtgtccttctcaatgaatcagatcaggaagtgcatgacggtgattgtcctgatgctcacaatgttaactctggccactttaaatgaaaatggtgtctaccaggtttcttcatggtaaagttactatttttcctttggtaattaataaattatcttgtggggagatagatactttgaggctattatcctattattcctcaaactgtcacccactagttttatcgttcattggtgatacttacctgagtcagttatgatggttactaaatggttaattccataatttcttctacgttaattgtttttgaaaaagaaggaagaattttctaaagggagaygtggaattcagaaaatgttttttttttcctccaagggttaagctcttgcaattgaatgcccaacttttaaaactgttgtcttttaaactcaaagccgattgatggcacctttgttgtatgtagtacacacctctctctgaggcaatgaataccactgggaagatgggcaaagagccacagggtcacaagagtaatttcaaattcttcttacccacctgcatgacactggtctcagatagtcgctgatcacctgtgagggttttccatattgtaaattttcatatttttgtgtctttacaggtgttttaatataaaattgagtaaactgttatcataaaggaattatgggatagaaaaatatattaccacttcaggactatgatgtaaatgtaacttaaactgataataaaatgttgccaaattgctgacttgctgagcctacttttaatgaatattgaagaccccctaataatagtggttgcaacaaaaaactgaaagttcagaaacagttttaaatctttttgttttctaagtagtttacccctctctccccaggcttacaccacaaatttgcttgattaactcatcaaagattgtacaaagactaacagtgtaatgttaaccacagttcataattcattattatgaattccaaattagggaattggaattgatgaattagtgtttgtagcagaagttttgtgttttgaattaggtgaatgtgtgttgagggtgaatgtatcttctgcctgcttcctttgtctgtatcagctcatagagggtgtctgaacttggtttgctttctgggagaggtggtggatcctgtaatatcctcaagacttcccatattttctgaggcaaaaccatttctgtgctgcaacctggcagattccctcacattagggtayagagacacacttttaataaaacgtttatgttaacrgcgtcttgcaaatatacagtgtccgaattagctaataggagaacataaaaataaactacactgaaacaaagttaagttgaaaaacacaatgtcctatctatcttctttatggaggtgccaagaaaatacatcagaaaagaagaaagttaactgctaagagtctcccaagttctctctcacattcctttatcttaatgactgatcgcatatttgaagtctccaccttggggacctaaaataaaaagagaaaaccataattatagttactcagtatgcatattctctgtattatgaacatcaagatttggrtgcattatctctggagagttaatgtgttattttagcacactcttacacatcctttttgtgcttaagttctagggaaatgctgtttaactatcttagcttctgtagtttgtttcatttggctcctgtatacaaaggtgattgtcatttctacttggaggtgacattaacattgtcttaagaaatttatgtgtgtggaggggactgaggaacactggagagaatattaaatgttatctttttaaaacaattttgtagacaactacttaatttattttgtgagcattgaacaagtgattttttaaatcaacaggtccttctcatgaggaggaagacaccttttcctcagtgtttcatactcaaatccctccagaagaatatgaaatgcagatgcagaaactcaataaaggtatatttaaatttgtgtgattatacacattttcacaagggaatactggctgtatacagaaatattcataaatgaaataagttcatgtaatttaatccaaaggtaagtggaagcaagtagagttcaagatgacacaagattggttattgttgcagctagttgttgagagtttgttataccattctactttggatgtttgaaattttgtataataataaagagtttttaaaaaaagctggctgcaagtaatgaaaacctggcttaagcaaaaacaagtctgtgaaaatgattttggtgggaggcagctttctttggttcccaagagcatatgctgtggttagtcattcagaggttggctcagttctgcaatcctagagaagagcctgagtgatccagctgggtcaggggcctacccctggctcaaccaacttgtccaacccagcaaggtttggggtsactgtaggaacatggcagctatgtcaataccagactggagaggagaagaggacatttccagtgaagacagttctggccagataacccaatgtgttttccctactgtttattagaaatatgttttaaaggagctctgtgataaatgtaaacatggctgcattcagtttgtattttttaaatgttgtattggttaagagtatatgaaacttcaactgaatgaataaacaaacctcatatttcaactaaaaagactgtatacaacttgaattatggaaagaagtgttatattttgtatctattaggccactcaccaaaaaagtaactcatacgttaactatgggtagttgatttaaaagataattacgtgattgttaaaaaataaaaccccaggtataaagcataggtttatttgcctatataagctataagcttatataacttaataacttaagttataagcttatataacttaaatttgagtaaaatttttttttactcaaagctacttctgtttgaaaagaattttaatcaagagatcttactctttctctcgttctttccagctattttcatcaaaaaaattttaaatggttatatctgtattgactctttgataactagctataaacacaccagttgactagctcctttaatcctttatgttcaggtaacctcccttataaaacaaaattaaattttatataaactttgtctggattgagcttgtgactggtgtttttttcctttgtggacttgattgtggaaatgcatcctgttttgtagggtgaactgcatgtgttrtataaggagacattccttcttcgtgcatattttcagagctttaatgaagggttcacatgatcttgttttagaatattttaatgcgacacatagaaaacaagatattttataaagggaatacgagtccacaagtatttttcttattcttattttgagcactcggtgtctgaatatctcagacattgactcaagcctcttccaaaaggttgaggaaaattggccaactgagatgggctctaggggtttgtgcagatgggagctaggacatgggacgctaactcccagaccttgctcaaaagacaggcaaaacaaaatgcactgttcagaaagggtaatggcaaattaatagaatagcagggatgacctagcctttagggaaatttttgttttgtgtcaagactgaaataaaaaatatattttaaagtctccctaacatcagcgatttcttcttctcatgtctgtcttgaagttctattgatatttcccatcattctcatggaatcaacaggaagaagtttgatacatgataatgaattacacaagaagttttatgagaacttcatttgaagttacagtagcacatttatctttttaagactagatctccattatatattaggtttctggatctggaatgtagaagttagttcttctgtgtgtgttttagttcttatatattttaatatatgcttaaagtgaacttttagcataattgacacttttaattatgaaaaaattttgaacttttttaatattagattttacctgtgatgtggaaagaaatgagtcattgatcaaatcaggaaagaaacctttctcgaatacagaaaagattgagctcaggggtaaacacaaccaggattttattaagagaaacattgaggtatgtacttagaaattcagaagccagaatttggggctaaatgagttgaaaaaaatggcaatagttttgttcagtgtctttaaatatttttcaaccatcataaatgtataaatgattgaattagtagatataatgaaagaaaacttttatraaccagtacttcattatttctatgttcaacccactacatcctatcctatcctatctctttttaaaaatggtaggtgcatctatcatttatttcactatccagaaatagtctgtttcctgcaatttgcaaaacatttattcagataatagctttggacaatgtttctcagattttaaattgcatattagtaaaattrtttttttttaagtaatgagactgattttgtagccagtacatttagaactttgaatggaaaatgctcctggcagagcagcagggctgggctggagaagccaactggttgtccgcctcttctctggacgtcccagcagctggtcactggccttcattagcttctgcttcaagcacctatctttggtcttacaggccttgcagcctgtctttaaggcagattcaaactaaacaagggcgcaggggttcctgggttagaccagaatgtgaattaattaatttacaacaagaaatgtagtgaggaggacagaagctctgcacacccttgagcagagtcactagaaaactgcatgggcgagtgtggagtattgacaagagagagttaagtaattttttacccttcaagcctgatgctttccccataattggcacatcatttccaggcaaactggattcgtggggcagcctgccactgccaggactggcctctgggactctcgatttttgtgctccacattcatatgatcttcttcaggaaacctccatcttgttctstctctgtctttgcagtggcctgttgtatgtttattttctgttcaattttcctagaggagtagagttccccccttatccaggttcttgctaacacagatagcaggtctaccgtagatttctctttcccctttttaatagtaactgaatatttaaattcctcatatgatagtcttgaaatttaaaagcactttcatttagtggataagtaccccaaagaaagtggcaagaagatttcttccaaatgtctcagcaagtatgtttttgcatttatattttttatctatagtagagaggtttgaaaactgctcatattattttttaataaaatgtctgttggagtggttaacagcagggcctgcttatagggataatatctttggatattagagaatggccctatataaaaattttggtataaaataaaattacctagaaaatgtaaaatgcctaatcttgcaacttttctttgtgtatctgtagtgtagaagtctcagattccattttttttttcctgaactgtgaatttcyttgagtatatgatrttttccattaataaattctgtagttggccaaggaatcaagaaacccagtggttatggttgacagagagaagaaaaggctggttgagcttttgaaggacttggatgagaaagattccgggctctccagttctgaggtacgtaaactctgatagggaacactacacttcttaatttagattttaaaaaataatattattggcccagtatcataaatttacaataatttttcggattctgagacattattctttgattttaaaaaaaccctgttttactaacacaggaacagataacaaaataccgcgggtgttctcacttttaagtgggaactaaatgatgagaacacatggactcatagargggagcgacacacactggggcctgctggagagtagaggctgggaggagggagaggatcaggaaaaataactaatgagtactaggcttaatacctgggtgaaaaaataatctgtacaacaaagccccatgacacaaatttacctgtataacaaacctgcacatgtacctctgaacttaaaatacaagttaaaattttttttwaaaaatcctgttttatacaattatttttattgaggttttcaaatttattcttggtcaattcattattgactttcaaaggattatttaatgtcattctaagcagtgtttacacattggttatcacagtaacttcttcctgtgatgtgatgtgcttattactgatgacatatgaatgtgtttttctgtctccttttcttattgtccctaaactggttttgtggtatttcagtgtagtcttcttcagtaatcctaaagaattccgtcctgttcctgcccagttaactttgagcacacagttccctggagagtcctggggttaacaggagggcctgcttatggtgataagtccgggtgggtacagactaaagtgaaagaggggaacagcatgtaatgggggtgaggtggggcaaacgcaggtatttatagggcccgggaaggtcacctaaagagtgctgtggcccaatgtttgcacttgtttacatactaaacttgagaaatatcctttgcttctrtgaagaaatacactgtcctatgttccttgaagcacttagctctattgtatatcttttattcccctgcatttaataaggacatgatggagtgaatgctgctggccccctgcccatatcccctttccctgaaactggtctgtgcatccacgccccagccctgtgctaagggtgcacagctgtccccttcccctgagaatttccctgagccaaacagcccaggatatcactccctccccaccctaggccccttacctaaatgtgagattagctctctggtgcagtgtgtcctccatagcttccccagggatcagactgaagctgagcttcagctgagaccacatcctygcttggccctgtgcccttgccctcggctgttttcctcatgtccctggtcccaaaggcactctcccagtgaattacttgaacaagaatccttgtcttagtttccacatctagggacacagagattcagagcgtagttttttttgctataagtctaaaagcagtgcatgtgcagtgatccctgtggcccacgggggaggagggtgtgccygtccagtgggaggtaacactcaatgtctgctgcatggaaatcccaggccaggcctgcctggatcctccagtttttcaagggaagctagaaattcagatttttttgtgagaaacattaaacttgtaaaatgttcacaactgctcctatttaaaaaagttctgtgtgggcaaacaaaatatccctcccttccaccaaaaarcaaaaacatatctacagaatatcacacataataatcctctaaataatccttcctgagatggtgaggtcccagcgggggctgtgtctaggagcaggtgaaggtgttgctatgcctggggctgatgaagtaggggaaaggggtgggtgagggaaactgctaaatgcccacataattctgagatatttyagcttcgctggttcatggtatagtcatgtgccacataatgatgttttggtcaacatgcatacatgacagtggtcccataagataataatggagctgaaaaattcctgtcacctagtgacaccgtagctctatattttagagtgtgctccttgtacttacatataaaaaagtgaattgtaagacagcttcaggcaggtccatcaggaagaatttcagaagcaggcattgttatcataggagatgacagctccatgcgtgttactgcccttgaagaccttccagtgggacaagatatggagtggaagacagtgatattgatgatcctgaccctgtgtagacctaggctaataggtgcatttgtgtcttagtttttcataaaatcttaaaaataaaaaaagaaaattttaaaataggaaaaagcttacaaagaaagaaaatatttttgtacagttctatactgtgtttatgttttaagctaagtgttattataagagagcgaaaaagttaaacaaattyaaaagttttaaaagtaaaaaagttacagtaaaaattcctttattattaaataaagaaaaatattttaaaataaatttagtgtagcctaagtttacagtgtttataaagtctacagtagcagccagtaatgtccttggtgttcacagtcgctcaccactcactcactgactcaccagagcagcttccactcctgcaagctccactcatggttaagtgccctttacaggtatgccattaaaaagatttttataccatattttattgtaccttttctatgttktaatatgtttagattcacaaatacttcctattgtgttaacaatcacctacaacacagtaactacaaaacatactgtacaggtttatagcctaggagcaataggctttacaatgtggcctgggtgtgtagtacactctaccatctaggtttgtgtaagtacacccaatgatttttgcacaatgacagaattgcctaatggtacatttcttagaacacatatycctgtcgttaagcgacacataactgtaatttgtctactttattaacaaaagcttagataccagtaagaattaagggatctgggtttcattctggttttgttattaattgtaaaattgggtaaactgctacccatggtctcactgcgtatcaaactatggcgatagattttcttgatacattctaggaatgctttcataatgactttttgttaataatactgccttttgcatattatttttgttagtatttatgtctcatctttctagtttaaggtcatctctatcattttagtttttgatcttttacaagtactatgtagctgggcttttgctgttgcttttgtgtctttatctttaattgtttcttcatcctttatcttttgttattatcaatatgagcatatttaatttgctcatattcattacgaccgcatactttttgaatcttttcctgacatcaaactttatattttatttatcatatttgtttttgtttatctccctatcctcttgtggtttggaaacttaatatcctatttctgatctggtactgttaaccttcaagttttaaaaatacattaaaatgcgtattttcttttcaacttcaataattagtttctaaaatttcatattttaacaagattggatctttggtgtactttcatttcccttgtgtttcattttctttcctccaggatatattgaaatcatctggaattttagttctagaatactacacattttagtttttacctttaaaaacagtatgcttcttgtatgttaggaatctctctaaacaaaatttagccaaaatttttagccacatcattaactgtgtatttggactcaaygaattatttatttgtataaatcattccttgaattatttttctggaacttttttgaaaaattttgccccaagaaatggtgaagtgtggataatttttgagtgtttgtgtattcraatatttattttttcctcatttgaatgttagcttagcagatgactaaattctacttgcaaaatcctttttttcttgaagcatgtaggattttctccttattttggagttcacaattttatcagattatatttgtgtgtgtctttaaaaacatttcagttcctgcttggtaccttgtaggctcttttcacctgaaggttcaaatcttccttcagctcagaaaattatcttatattatttcttcctttccatcatctcttttttctccttttgggaggtatcagttgagaatgtgattggctgccagtaayagtggcttaaacagtaaagagtttacttttttctagtaacaagaaatccaggagtgagcagctcatgtctttctgtcctcctgttctacattcctatgcggattttgtctttaggtttgcaagattgctgctacatctgtaggcagtgtgtccattttccaagcagacagaaagagggaagggtaaaragcaaagagactgtcctctgaggctttgctttttcactggggatggaatggtgtccccaggacttctacctgcatctcagcggccaagctgtatcgcgtagccatttgttcagtatgttgctgcaagtgagaagggggattcaggtatatgacttactctttttttgtagtagaggtagaaatggggatcatgtcagtcagtagacagtgtctgccacaggtggctataggacctcttggrtttctcttccaggtcttataacatctttctcataatgttaatcgtttttgtcattttgtacatacgagctcmttctacagttttctaagttgggtttcaaccatgttgttctgctgcttagccatgyagctctcttttgagatttttaaagrcaattgtttttaggcccagcgtggtggctcacgcatgtaatctctgcactttgggaggccaaggcgggaggatcacttggggctaggagtttgagayaaccctggccaatatggcgaaaccccatctctactaaaaatacaacaattagccaggtttggtggtgcatgcctgtaatcccagctacttggcaggctgaggcaggagaatcgcttgaacatgggaggtggaagttgcagtgagccaactgcactccagcctgggcaacagagagagactcgtctcaaaaaaaaatatttacactaatatttactgagagttctttctgcaagtcctcttatctgatgtgggaggtaaacatacagaaattctagagtccgatggatggtgacaaatgttagaatagaaattcagaggaagaagcagtgccgcaggaaaagtttaggaaaactttgaagaaggaacctatttactatattctcaaatcataccgaacttcttgctgttcctcaaattctctgtgttcttttaaatctctgtgttttcaaatgtgccctttcctttatgaagtgccccacaacctcatctttgacaaataaatgcacagcttaaagaagactaaatgatatgactaaaatgataattatgttttaattcccctgaactcttgttctctagttgttttttttagtagcatgcataattttttttttttttttttttttgagatggagtttcactcttgtcacccacactggagtgcaatggcacgatcttggctcactgcaagccctgcctcccgggctcaagtgattctcctgcctcagccttccaagtaggtgggattacagatgcctgccaccacccctggctaattttgtatttttagtagagatgggatttcaccatgttggccaggctggtctcgaactcctgacctcaggtgatctgcccacctcagcctcccagagtgctgggattacaggcgtgaggcaccatgcccaaccgtcatgcataattttatggatgtaatmttctcttgaatctctctaggacggggactggtaccagttgggcccatggcctgttaggaactgggctgcacagccggaggggatgagcggtgggctagcgagcattaccacctgagctgtgcctcctgtcacattagctgcagcattagattctcacagaagcacgaaccctgttgtgaactgtgcatgggagggatctaggttgtctgctctttttgagaatctaatgcctgatggtctgaggtggaacagtttcatcctgaaaccatcctttctaaccccattccccccagtccatggaataattttcttccaggaaacctgtccctggggccaaaaatgttggggacttctgctctaggatacttacttagaatttaagaaatattttcatctatgttgggaactcacacttgcagtgaatggcacccgctaagctagatgtctctactaccaccctcaccagtgaaatgggtttgcatccgatctcaggtcactcacatctagtagtattgagtcggggagtctggtggtggacccttagttacctayctgaaccctggctataaaggttgctggtgaaaagcattttctgttctgtcttgggaaggtaagtttcctaaaagctagaagttccccacacatagcaagggtgtatagaggtgctagacagatagaaaaaaatgatgatgccatttactaccttttacatatatcttatttctgtaacggcatagtgcataaaacatatacatttctggtgaatttcgtctgacatactcttttaacttcagtgtcatatgaaaataatcccattcagacagaacttaaaatttattagccactatttcatcatcgatttcatagttttacttttttgtgattctttattttttatcatttaggctatatggtattgacatcacttttatttaggaaaaattaccagagtttgtgagtaattaggtaatatagtatattttaaaaattatgcataactttctttttttttaagctgtccatgtttattttcaagggagagcaatagaatttaaatcagaacctggaattctgtcagtttatcagagttgtgtgcctttagctaactgaacctcactgaggatcaatttctttataccaacttacaagtgtgtttaaaaacatttatgactatatcataatccttatattgatatactacaatctacccactttccccctatttttagacgttttattataaatagtgtgacaataaattttttatcagtcacygttctgggttgcaagtaacaaagatggactttggctaaagcaacagaaaatgaatttattgggagtcttgagtagtccatagactcagtgggaagtttggggaaccaggtttgtacaccgrgcagatgtccaggcagccataaacatggctttaggaacagcctggttaggggctggctgctgtggctccgcagccaccagaygtttgctttccacgagatgctcattgctgccaccatcactgtccctgttaatcatttccctgcacctttgcttctgtccctcaaggtttggggtgtttgctttcaaatagctgaatctaggtcatttgtttgtcttcctgatatcagagggtggggaggagtgtcttgtcgtgatcctcccctgccaagactcacacactgtttggtttcactgaaatggactgtgaatgccagggtcaagaggataaaaatataaaagtytttgtgcataaagtttttacctataatgcctctgattatcacctagggcttagttcctggtattaacatcgtgaaatcaaaatgtatgaaataagtttctttgccctctacttgacacgttattccaaatattcttcatgattcttctgtcctctttttgcagtaatgcttccctttatgaccttatccattctcatagcccccagggtttgaaccactgtagatatgtgggtaagtcaagtgtgtttatttaatcccaagcctctatcttgaatttcacataaacatatttaactgcctaacataatctgtggatatcctagggggatgtctgccagtttcaaaaggtcccaaacaattcattatctttctctccaaacctacttcatctatagamtccctagtttagataatgtgaccaccataacctacttcacaaaatcaggaacttgttcttttttttttttctggtaaggccacaacaaagtttattattttttaagttgtttattttaaatcaataaatacttttattttaggttcaggggtacacatgcaggtttgttctgtagataaattggatgtcacagggctttggtgtacagattatttcatcatcctggtaataagaatagtacccaataggtagtttttccatcctctccctcctaccaccctctgccctcaagtaggccccagtatctgttgttcccttcttgtgtccatgtgtactcaatgtttagctcccacttataagtgagaacatgcagtatttgagttttcattcctgtgttattttgtttaggattatggccttcagttgcatccatgttgctgcaaaggatgtgatctcattcttttttatggctgcatagtattccatggtgtgtatgtcccaaattttctttatccagtctattgaaaggcatttaggttgatttttgtgactagtgctgcgatgaacatacgcatgcatgtgtctttttttttctctccttaagacagggtcttactctgtcacccaggttggagtgcagtgatgtcgtcatggctcactgcagcttcgacctctcaggctcaagtgatcctcccacctcagcctccttcgtatctgggactacaggtgcatatcaccacatttggctaatttttaaaatttttttgtaaaggtgaggttttgtcatgttgctcaggctkatattgaactcctgggctcaggccatacacctgccttggcctcctgaagtgctagaattataggcatgagccactgcacctggcctgcatgcatatgtctttatggtagaatgatttatattcctttgggtatatacccattaatgagattgctgggttgaatggtgcttgtgttttaagttccttgagaaattgccacactgctttccacaatggctgaactaatttacattcctaccagcagtgtataggtgtttttctctgcagctttgccagtatctgtgattttttgactttttagtaatggcctttctgactggtgtgagatggtatctcattgtggttttggtttgcatttttcaaatgattagtgatgtcgagcgtttttttcatatgcttgttggctatgtgtatgtcttctttagaaaattgtctgtttgtgtcttttgcctactttgctctttgcttattaatttgtttaagttccttatagattctggatattagacctttgttgaatgcatggtttacaaatattttctcccattctgtaattgtgtttaccctattgatagtttctcttgctgtgcagaagctctttaattaggtcccatttgtcaatttttgtttttgttgcgattgcttttggcatcttcattatgaaatccttgacagggactatgtccacaatggtatttcctaggttatcttctaagggttttatagatttaggttttacttgatttttgtatatggtgtaaggaagaattctggtttcagtcttctgcacatggctagccagttatgccagcaccatttattgaacaggagtccttttccccattgtttgtttttgtcaactttgttgaagatcagatggttgtaggtgtgtggctttatttctgggctttctcttctgttccattggtctatgtgtctgtttttgtactagtaccatgatgttttggtgactgtagccttgtaatatagtttgaagtcaggtaacatgatttctccagctttgttctttttgcttaggattgccttggctatccaggctcttttctggtttcatatgaattttttaaatagttttttctaattttgttaaaaatgtcattggtagtttgataggaatagcattgaatctgtaaattgctttgggcagtatggccattttagcaatactgattcttcctatccatgagcatggaatgtttttccatttgtttgtgtcatctctggtttctttgagcagtgctttttaattctcattgtagaggtctttcacctccctggttagctgtattcctaggtattttgctctttttatggctattgtgaatggaattgcgttcttgatttggctctcagcttgggtgttgctggtatatagaaatgttattgatttttgtacattgattttacatcctgaaactttgctgaagttgtttgtcaaatataggaggttttgatcagagactatggggtttttaggtatagaatcatgttgtctgcaaacagagatagttgaacttcttctcttcctatttgaatgccttttattttttttctctttcttggttactctgattaggacttccagtactgtgttgaataggagtggtgagagtgggcatccttgtcttgaggaacttattctttatccttgatctttatgtctgcctttactcttccataaaattatctccaggttctgtaaattctacttcctgtgtatctctggattctgttctgtgttcccagaaaacattccttagttcagccattcagcacttgtgttctagattatagctattgcttcttaactggtctttctgcttccactcttgctgtcagtagttccagttttaaaatacagacctgatcatgrtgtttctttgattaargtcttgttttctccagccccttcctgctcacagaggttagttgatcctctctggttcccatggtgcccagagcttaccagcactcttcacaccttgttaaaattgttgctgccaagaaattgagaactcctcgagggcagaaccttgtgatattcatattgaatcaccagtgcctagcataatacatatgttcagtaggcattatttttgaatgaatgtaatgaatgggtttkatgagataatatggaacaaacattagttgaatgaaagatgatcaattaagtttgtgaaacccaagcaactgattttatagatgctatgttacttttaagggacagagtttgaaaataccatgtcccattacagggtaaacctgatttcttcctacttaacatgtcacaaaacattttttgaatgtagataaatgagaatgtcatgagaaccagactgtgaaactaaaagatttgttccacaggggaaaccccccttaaaatattagaggatactttatacaggctggcagataacaaaaccagaaactatttcatattattcttttactaacccaatgttaattctgtttgtgtgtgttgtgtgtgtgtgtgtgtgtgtktktgtgtgtatgtgaagacctgggcactgttatagccacttgaaaggtatattttggcaaaaatatagcctgagaatgacctggtgacccttgtttcctcttagggtgatcagtctggctgggtggtcccagtaaaaggatatgaacttgcagtcacccagcatcagcagcttgctgaaattgatataaaactccaagaactctctgcagcctcccctacaatttccagtttttctccaagacttgaaaatcggaataatcaggtatttgaagaacccatagactgttcaagttaatgtgtgctaaagctgttcacataattttacaatctggttgttaaccagttgctttttccagtgatcatagtttcataacagtgtgtatattcctttggttacttccactttctactcacttttctttcatttggtaattttctgggatgcggtcactgaggaaatatttcttttaatattattatatctctatgatttaagctaaatctcgatcatgatcaagagagaggggagggaagaaagcggatatggcactcacgagtcctttgagagccttatttttctttattcctgtggcactaggtattagcaatgacagccattgtcccttactccaccacattcttttatctcctttaatttaacatcaagcagtgaagctcattatgttgacttctctcctatgagagttttgaaatgaatgtgtttcttctctcagtagttccctcaaatactcttttacaaagcaggtgcggtggctcatgcctataatcccagcactttgggaggccaaggtgggtggatcacttgaggtcaggagttcaagaccagcctggccaacatgcaacatgatgaaaccctgtctctactaaaaatacaaaaattagctgggtgtggtggtgcatgcttgtaatcccagctactcgagaggctgagacaggagaatcgtttgaacccaggaggtggaggttgcagtgagctgatatagtgccgctgcactccagcctgggcaacacaacgagattctctgtcaaaaaaaaaaaaaaaatctggtagaaggtatggcatatcagaaaattaaatttctccctcaaccctatattttagtacttcatggaatctggtttggtttgggtggtagactgaggagaaaatgtctgattgcataagagagtaataaccctgtagcagctttgtaaaacttttcaccaaatcattttctctacaattgtagatgaccatgatctttgtggaccatccaaagatttaaatatcastwgcctataggtaatccttctgattcatagtaagcactttctctaagctgtcacttgaaggctggggatctagcttcatgccagttgaagcaacctcaggggaaaggagcagtgtgaaggtgttccaaggaaacagttttgtgactggttgtatttctggcggacaggaacagctgcttctgaccctttaaacagcagtagtggtgctgttgttctcactattgatttgaaattctgcagtgggattagaattcttggaaaacagagataattggaatctttgtcttcactcaaatgtgtcccaggactttgtattttattttattttgagacggaatctcgctctgtcaccaggctggagttcagtggcgcgatctcggctcactgcaagctccgcctcctgggttcaagtgattctcctgcctyagcctcctgagtagctgggactataggcatgtgccaccatgcccagctaatttttgtatttttagtagagatggggtttcaccatgttggtcaggatgggttctatctcctgacctcgtgatccgcctgcctttgcctcccaaagtgctgggattacaggcatgagccactgcatccggccgtatcccaggactttgacatgagttaggctagtttatttatgttactgaattctatttttcaaaaaggaggaaccctagatgggataataaaatgtttcacagatactctattcttttcatgtttcagttgatttttgttgttcttgttagatttcaagggtagctgaaatctcagagctgaactgtggtcttaaatatagaaaatgtttcatggctgtcaaatgaagtgaagtctgtgaagtccgaggcactgatatagccatccaaaagatgtatttttggcaaaaatataacatgggaatgacctggtgacctttatttccttctcttcttaaaagagacagagaattcagagatttgtttggctattaggacttcaaataaaaagtatgaatatgggccaggcgcagtggcttatgcctgtaatcccagcactttgggaggctgaggcgtgtagatcacgaggtcaggagatcgagaccatcttggctaacacggtgcaaccctgtctctactaaaaaatacaaaaaattagctgggcgtggtggcgggtgcctgtagtcccagctacttgggaggctgaggcaggagaatggcgtgaactcgggaggcagagcttgcagtgagccaagatcgtgccatgcactgcagcctgggcgacagagtgagactccgtctcaaaaaaaaaaaaaaaagtatgaatatggtcccattttcttatcatcagcaaaatcacattttcagagttcacatttatggttcagataagatattttaaaaataatgaaagggaaaaccagtaccttacatttttgttacatactgagattacgtgtttttatgtgaaataacatatatttggaaagaaaagggaaaacaacattttgggactcacattggatgtaaaaacaaaaatgtaatgtagttgttaaaaagaaataatttatgcttcttgcatgcaaaaataaagaatatcttttgagcttttgttcaatttccctttggcatttcttcatttctaactaaaaccagcattacacattgaattttcaaagcaggaatgctaacatggcaaagtattttagggatattatttttggattggactactttttgtataaatacactgtatcttgaataaaccctgtgtatctatgtagttgatgaatgagttccaatcagttgctaatccacaaacattcatagttcatattcactttaactcttctgcaaaccattaactcaccagtaatttttctccatactccttaagaaagaatttcttttgagtggaatataaatttctgtttttgaacaattgattcracacatattgagtgctcctggatgtaaggaattttacagaacttaaagatgaatcaggcaaayaaaatacttyggaataaaaaagtctcacttcaggctgggcatggtggctcacgcctgtaatcccagcactttgggaggccaaggcagacagatcacaaggtcaggagatccagaccatcctggctaacatggtgaaatcccatctctactaaaaataccaaaaaattagccaggtgtggtggcaggcgcctgtagtcccagctactcgggaggmtgaggcaggagaatggcgtgaacccgggaggcagagcttgcagtgagccaagatcgcgccactgtactccagcctggaggacagagcgggactctgtttcaaaaaaaacagtctcacttcaaatttgacttttgcatttactagttctgtggacttgggcactaattagaagctctccaaacctcgttttccttatttataaaataatagtaatattctttaaggttctttaggtaatgggtagctgagttaatatacataaagtgtttagcacagtgacacagatctcagccaattatgttattataagtgatataaagaacttatttccttatgggaggtattgagtatacgtagaaaactgtggacaagacagcacaggcaggtgccatagaaagcttttttttttttcttcaagagacaaggtctcgcttgtcacccaggctggaagtacagtggtgcaatcatggcttgctgcagccttyacctcctgggcccaagtgatcctccaacctcaccgtccccagaagctgggactacaggtgcatgccatcacaccagctaattttttaattttttttagaggtgtggtctcactgtgttgcctaggctggtcttgaactcctggcctcaagagatccacctgcctcaacctcccaaagtgcccagattcatagaaggctctaagtaaagtgctgtggtggtttagagcagagagagagagagcatatccaaggagtatccagaaagtctatttccataagtgaggggcaggagaaggaagaggaactagggaaggaggcagagggatcagagacacagaagaaaaccaccattatgtatcacgaggctgaaaactggtggcctacagcagtggtccccaagtattttggcgtcagggactgggtttgtggaagacaattcttccacgggcccagagagggggatggttttgggatgattcaaacatgttacatttattgtgtactttatttctattattattatattgtaacaaaataattatacaactcaccataatgtagactcagtgggagctctgagcttgttttcctgcaactagatggttccatccgggggtaatgggagacagtgacagatcaccaggtattagattctcataaggaatatgcaacctagatcccttgcatgtgcagttcatgatagggttcacactactgtgagaatgtaatgccgctgctgatctaacaggaggagggagagctcaggcggtaacatgagtgatggggagcagctgcaaatacagttgaacttgggcctgccgctcacctcctgctctggggcccggttcctaacaagccatctaccagaaccgtccatggcctggggggtcaggagcccctgacctacaggacaaattaagctcccagatgggtctgcttttgcttacaaagggtttaaygattttttttagccaacatttaaaaattaggtaaattcctataaaaatccaaatttctagttctctcttgaaaaattcaaattagaaaatatgtcagcattagacctaacttcttgcttgacaattaccgaattgagatgaatagcaactgctctttctatggggcacagattctccggtttgctgcagtatccaccactctatattgtatggcaggccctaaggcccacttcatgcatttatgttacttgtycagcctttgcagagatcgtcaatacatttttgaatgcctgcttatttcataggagacactgtagtggttgatgtagtgtccagactagtrtgaagcttgatctctgacctcaaggtagcttgtaggataccagaggatatgatgtaaacaatagaacaagttgtggagtractgtgcaatgaaacaagaaccaccaccagatgggcactgatcrgatgaaaagtacggaaagtgtatgctgcgggagcacagagaaaggaaaggttatttgatgaagrcatgatattttaaaaattcctttgaagatttatcttyrttggtcaagaaaacagttttctgaacaagttgaaacatagactttctgacttatctstgtatggtaactataaggtagtaagttggtatgcatatagatttaagatgataaatgtggttgagtcaatgtggttaagtcagaatagtttgaggaastctaggaatgtggctcagagatgaaggaggtgttggtctttgtgaaaagggcrgataagaagtcttcttttccttatgggctcactgattgtgatgttctcatatagatgctctggcccagcacttaactttatggcaatgttttaaaagcagcatttggcttttacgtatctgatttccttagcataaaacaaagcttgtggtcacagtcaaaagaaagaatggcatattactgctctttctgtagtgtgaataatatgtggttgcagtttttacatctgctttttattttcattttgtcttagcwagagaactaattgaagcaattttttcttaagatctgtggtttaactgtgcatacttttctttatccatctcctaaccctcaacaaatcagttcgttctttccacrtattgtaaatcccaccataaaactgagtgatgttctataatttagttaccrtacttcttattcgtagaagtatcagattccakttctctccagaaatatctaagatataggagttatgtaagcattcagtttcttaaatccttagcaaccggattcaatagtaaattctattccatttggctgttatatacaagtatattttattcatctctcatgaagtcagctttactaaatctagaattccagttcaccgttagattttttttctggttggggagggcctcagaaatggctctccttgacaggaggcattgctgtgttcttaaactaactagtttaattgaatataaaggtcctccttaatttgatttattttcttattcttgaaatattgattcaattgtacacaatttgataagcttgagaaaaaattagcaaacatttgattgaggaaaattgtagtttgtattgatctcctttcttgccaagatcatgctattattgctgacagcaacaattaatttttttttgatgtcttcctgtctcaatattagctaaaattgaggaaatacagaccattgtttgacatgtaattctgaaagatgttttattattgggtccagggatttgtatagttccagtaagggccatggactctacttgaccccaaatgtacttaggtgtgtgttggttgagggcaggaatttaggattttttaaatgtatgctagtcacaggcacagaaatcttattgaccatctgctcatttccaaaacccatagaagccacaggagcatgcatttckgggtttgaggaacaaacaagaagttacttcagagctctttacctccagtgccaatctgttagatctccagttaaatctgggaaactgcccttgccacctccattttacagattactgtgaagtttatatttctttgctttcctctgttaagcttctgatgtagtcaaggtttccttcattttatggcattattccaaggtgataaaaacaatctgcctgaagtatctttttccctgcttttggtactgccagacacacgatccatctaatgacaagaaatagcaggaacctacagaaatgtatagcattgtctcgaaaacataggacaagctgtctttatttaggcaggtttgtattttcccaatcctaacgcatgccttatttgcatatcagataacttacgaagctgcgggtaatttsctgtttttgatttttgaaaatgagtttattttgcttcaaagatcccttttggcctagtcaacaccacagataatttttctaaggataaactcagaatctcttggcaaccaattagtcaaatcaacaagtatctattgatcttggcctcagggacagttctcttcttgtggcatatggaggagagcttttattgaattctccatgaaggcattcctgtatgacccagaaacacagaaatgatatgttggtcagataatctgattaaatatttctactatgagaaatcaagatatttcctgatgatcacgaggacagatagtactggttggcactttgttgtgaaaaaagaatctttcctggcaccacagagctttttgcagctgggcaattttcatcagcatcagtggcaaccttttcttgccccctcttggcctctgctttcatcatacagtatttttcgaatatttgaactatatggttatgccatcggaggccatgactgaagaaagctgttatatatcctttgggtctaactgtagagaattatagactcataagctattagaaggggaaataactttctcagaagtaactgagacccagaaagaggaggtgacttcctcaaaagtgcacagctgattggattggaagctagaatccaaccttcgggtgtatacctcttaggtatggagagtcacattgtcagagcaggacaaaaatggctttggcagaaaagtttattaaaaataaaaaatcagtggctcacatctgtaatcccagcactttgagaggctgaggcgggaggatcccttgagcccaggagttcaaaatcagcccgggcaacatagtgaaacccatttcttcttcatacaaaaaaaatcagccaggcgaggtggtgtgcacctgtagtcccagccacttgaacttgagaggctgaggtgggaggatcgcttgagcctgggaggtcgagtctgcagtgagatgtggttgtgccactgcactccagcctgggtggcagaataagaccgtgtctcaaaaaaaaaaaaaaaaggtttgtctgcttatgaaattgataacatgtttattgtaggaaattcaggaactacaaaaaaataagaaaaataagattaaatcatcaggatttttgccaagttaattattgttaaatttccttccagtctatttctctatacgcacacagactatatatatatacacacatatatatgtacacacacatatatatgtatataattatatttgtgtgtgtgtatatatatgtgtgtgtgtgtatatctatatctgtatctatatctatctatctatctatgtatatatctatgttagagtttttgacaagaaacagaaggaatacctagcttggatttcgaagataattatatgaagggactatttatatagatttaaaggagctaacagtggatgttgggacaccgagagactagccaccgtggatgggggaagaaaaagtgtgtgggagctcagcaagagctggaattgtgggagaagaactggccatctgaagttgtaataatagaggacatgggcaaagggttagccaaccccagccccctcagcgtgagcgcttgagcggtaattagtttcctaactctgtttccttggcaatctgagaaaagttggcatgctgaatatgttaggaggcgactttgcttatgcttaaaatgatccctggattgggagaattataaagacctgatggagaagctgtattttggccatctctgactgcagtgattcttgtggctgggcacgtttcttgctgggtccttggactcggtgtgcctatggggccatttcaagagataatggctcctgtaggatatgaggattttaagacagtcagcttatagctgttttgctctttatacctatattgttttggcatggactgtagcaaacactcccattgaaaagggatacctgatactggcctgctgtgtttcctgtcttataaccttctgagtagagtggctctaagtgtgtcctctgttagtctttgagcatgaatatgcagttgaatctaagaaaactcagcacatctcagggatacatcactgcccaaactgtgatgcaaaagcattaggggaaggggaaaaaataccctaagctctctctccttctgtcctgtactctcccctcactttgactaaacctaaccagaagatggagctcaaggagaaacactctgattgtcccagctgtggcaggtgctcaccatagtttatcatacttctattgatggacatctgggctgttttcagtttttagctgccatgaacatttgtgtacaaggctttagttatatattttaatttctttttgataaattcataggagttgaatttttggatcacatgatcgacaaacatttaactttttaagaaatggcctgttttggcgtggtggctcacacctgtaatcccagcactttggaggccaaggtgggtggatcacaaggtcaagagattgagaccatcctggccaacatggtgaaacccygtctctactaaaaatacaaaaattagccaggcatggtggtgcatgcctgtaatytcagctactcaggaggctgaggcaggagaatcgcttgaacccgggaggcagaggttgccgggagccaggattgcgccactgcactccagcctggcarcagagcgagactccgtctcaaaaaaaaaaaaaaaaaaaaaaaagacatggcctgtttttcaaagtggttgtacctttgtatagtcctgcaaacaatgtaagagagtccctgttgtttcacacatttccaacatttggtgttcacagtttttttcatctgggccatgctagtggctgtgtagtagtgtctcattgtggtttaattgcatttccccagtgactaatgatgttgaggaggttttcatgttcttatttgtcatgcacatagcttttatgaagtatctgtgcaagtctttatagaatttgattgtcatttgattaattattattgtctatttgattatttttattatcgagttgtaggagttccttacatattctggatamaagtcctctgtcagatttgtgtgttatgatcattttctctcagtyggtggtttgttcattttcacagtggtggttttgattaagcaacatttaaaaatgttgttaagtgcaacttataatttttttctttctgkgccttctctttgcttgccccaagatttagaaaaaatcatagttgtagattattaaaataatttcaatttaaaaatgaaatccggggtgttttgcagattaccatgtgtcctacttcatagctggtgtatcttcatgaaagtttatraaatgctgactgcttagcattgcaaagagaccttgataccattttttccaaacttccccctaacattagatttcctttaaaaaatatttctgataataattcagcctctagatgtgtattagtctgttctttcactgctataaagaaatacctgagaatgggtaatttataaagaaaagaggtttaattggctcgcggttctgcaggctgtacaggaggcacagcagcttctgcttttggggaggcctcaggaaacttacaatcatggcagaaggtgaaggggaagcaggcacttcttacatggccagagcaagaggaagagagagagaagagggaggtgctacacacttgtaaacaaccagacctcatggtaactcattcactcacaatcatgagagcagyactgagggatggtgctaacccattcatgagaactccacccccatgacccaatcacctcccaccaggcgccacctccaacactgggggttacaattcgacatgagatttggtagggacagagatccaaacgatatcaggatgcttctagagattgaaagctaccagaagtgagaaatgaagccaaatataaaataatcacttcttgaaattgacgcactcttaataatttgcttggtagaactgtatacaataagaattttactgaaattcattgctagtttgatgaaagtttcgaaaacccaaattacagtctattggccagtgcttacacagcttcaggattatagtttgcattgggatgcagagaatagggtcagccatgtcactgtctaggtggtgacagtgtggtaagtgcaataaaggagcatgtggcgtggctgagagaataatttgtcctttgtgggtatgtcagggaatattatggaaatatgcttgaactgggcccaaaatgggtaggagtctcaggagttggagggttggaattgggggaactggtagtagtgaatattgctgcacatttgagtctgagtctcaagcagtgggaaatgagatgaagagattggcagggcctaaagcatgaatactttgcaccttgttctgtgtcttccctgcaaagaatggaatcaacagggtgactggtagcatcaagaccagccaggaggctctggcagcaacctaagtcagtagttcttgaattctcaagtaggtgtgcttcagtttattagtccttagtccttttttttttttttttttttgagacagagtctcattctgttgcccagtctgcagtgcagtggtgcgatcacagctcactgcagcctcgacctcccaggttcaagtgatcctcccacctcagcctcccaagtggctgagactgtaggtgttaccgtgtctggctaattwtttttttattttttattttgtagatatggggtctcactgtgttgcccaggctggtctctaacttctgggctcaagggatcctcctgacttgacctcctggagtgttggggttacaggtatgagccaccaggcctgtcctgtccttcccttttgaatcagaacctcctgggtagaggctggtccttcggattttttcctgggctctggaggtgattctgaagctcactggagtttaaaaactgctggtgaatgatgaggatatcttaactaagacggtgagaaagaaacaagtgccttgattagagaggtattagggattggcaactagatagtattcctggtgaccatctctatgtaaggaatgagggagtagcaggattatggcttgagtgatttcaaaaatgtcattactgcccatcacttatatggcaacacagagcagatgtatgtgagaaaggaagtttaatcttagatacaggaccaaattcctatcaagaaatgcccatttttatcacccagaaataacattaactttgggaaaatatggttctgtcaatataaatattgcagacaataatgaagtactttcattatgtaatacttagtcttttcaaaggacatattcagctcgcatttgtttggcattaagatttgttgcttgcctactacatactgtgatgacttttagcctagatctattattactgttactgttttacagatgatgaaactgaagctcagagaggttaattcatttccctcaggtcagtctagtcaggaaccaggcagggcaaagattcaaaactcctgaccttgccaaatccagttttcttcccattattacacagctgcttctaataatatggatgggcagggttttttccttcttatttatacatgataaacttgaagtccaaagaaaagtccaaggtctcaagctggtaagtatcagagcagggaccagaacccaggttcctgtttcctggctccagctgttttcactgtctccttctgcttcccaaatgattacagaagttgggttcctttcctacttgttatatgtacagttggacatttacctcctaaaatgggaagactttaaagcrttatacatattgttttgaagggaagaaataattgtttgagaagcaaagctaaccctcaaggctcagttgctttgaggtggtatgtgacagcacatttccagcctgtgaatgatgttttttttttttctttaaattagaaacctgaccrtgatggtgaaagaaatatggaagtaactccaggagaaaagatacttaggaacaccaaagagcaacgcgatctgcataatcggctgagagagattgatgaaaagctgaaaatgatgaaggaaaatgtggtaagtctttttgttttaattaattttttttaagaaaaaaatagaggcaggttctcactatgttgcccaggctggtctcgaacttctgggctcaagtgacctgcccacctcagcctrccaaagtgctaggattacaggtgtgggccaccgcacccgtccatctctcttatttaaagtttaattgtaaccaacacttgtaccaaaaaaggtttcagtctcttttgactgttttatgactgttctcatgtgttaaatcagccatgtgaatttgtcagtaacaatgtgaataaaagctaaaaatataattcgtaggactttgatattattcttaatttaagcaatttatataatataaaacattaaataacatataaaacatattctgacttcagatagtgtgtaagatactatgtgaagtcagaataataatccataatcctaatattctgacagtgacacaaatatttgtttttcgtggaaaaatttggtagttctccctaaaatcttccctatgttttgaacttatagcttaaattcthtttttgtttgyaattactaatatattattagtaactagttaattttaatgcattccaaatctttcttggcctacttcatgtttttcttgctcaacataaagacatgtcattcctgatgagtgaaaactcttaaagcaactaagttgtgagctggttgatgctctgaacctcttagaattgctctgtcatactatgattttcccactacccatagaatgttttcagctggatacctggattttacctaaaattaaacatgtcaaggctgagcttgtgattgtggtcttgcggtaattacctgcagtaaccccttttggtctcctactaaattctgtcatcttgggtgatcttcaagcttctttgagttttaaccaatgtgactagtttgttgccatattcttcctgagtttcttaagactcaaaatctttttttttggtccctacttttatcacccttctctcagtgttgtcacctcatgccttagccacttataacctggtttttgtaggatttcttgtttccagtcactcccttctctcattattccacttaatatgctgcaccatggagtaaacatcaggtgagtgattttaaaatgtgatgcccttcagagcccctgagagtgtgccacaatcccatcttcacaccttgtaatcaagcccagctgaactgccctcactgcctgcaggcccactgcagcagcactgacacagagcctacaggagctcaggccccctaatgagagttaggcagcagatctaaagggaatgaatacatcgtgctttttttatagctcatttttatttgctttgcatgagaaatctcatgggcrttatatttcagggagacctctatttccattttcagagagatttctctgattctgttgatgggatgaagtagaagaagtaggaatggkctgggtgcggtggctcacgcctgtaatcctagcactttgggaggccgaggcgggcagattgcctgagctcaggagttcgtgactagcctgggtaacaaggtgaaaccccgtatccactaaaatacaaaaaaaattagccgggcttggcagtgtgcgcccgtagtcccagctacttgggaggctgaggcaggagaactgcttgaacccaggaggcagagattgcagtgagccgagattgcrccactgcacactccagcctgggtgacagaatgagactccgtctcaaaaaaaaaaaaaaaaaaaaaaaaagaagtaggaatggtagggaagtgtaaggaggctcttggccagtcattgtagtggtaacgatrgtacattgtgaattcgatgtgataaatgaaatgttttggtttgattggttttgaaaactgttggtacttcctctcactccatatctgccaatccaaggcgggctaagcctgtcactccccatgatccattctcctgatttctgactgctgtggtttggatgtttgtgacccctcagaatccctgttgaaaccctagtccccaaggtgatgggattaggaggtggggaatttgggcaagtgattaggtcatgtcagtgaagccctcgtgagtgaaattagtgactttataaaagaggccccaggggactcatttgccccttttaccatgtgaggacgtagtgagaagtcatccctatcaagaaggaaatgggcccttactaggcaccaaacctgccagctcttcgatcttggacttcccagcttctagaactgtgagaaataaatttgtgttgtttataaaccacccaaaataccattattttgttgcccagacagactaacacattggccatttatcacataccttgaacatgtagctgttactttctaccacatctctaccattatttaatttttggctcaaaaccagggtcctttaagaaatcgtatgtcattccagtgccttatggaatttggctacacttaaagggatatgacaaatgtcaagagttggttgttatccaagtggaaaagaataatacatgagtagataagagcaattattgaataccaactatgagccaggcactgtcccaagtattttacagatactaaagtatttaatcattgcaactgctccatgagataaataccacagtcctcattttatagatgaagaaatggagygaaagagaggttgactaattccttgaggttatacagctagtaagtggaggaggtaggattcaaatggttaacatttaataactatgctattactgcctttctgagacttgatttccttttcatgattaatgtctttttttgtgaattaaagtgtgataaacttgttataatcagtaatcatgagcaaaatgtttgggttcccctatacaaatttaattttcatagttttgtgttttatagtcaacactttcagaggctgttgtctgcatgataaaggcccatgaatgttgatctgtactgttttatgttttttttttttttttttttctgagacagagtatcacttctgtcgcccaagttggagtgcaggtagtcctcccacctcagcctcctgagtagttaggactacaggtgtgtgccaccatgaccagctaatttttttatatttaggagagacgggggtttgccttgtttcccaggcttgtctctaactcctgggctcaagcaatctgtccaccttggcctcctggagtgctgggattacaggcttgagccaccatgcctggccctgttgtatgttttcattgcttagtgtttcataactgtagattcataactgatttcataattgtggattcatgttgtgtaccacgtgacctgttgaggggaagatactgtgtgtttcaaactctgaaaacgcactgtacctcatagatgactagatattatttcagccgggaatctggagacctgagtccttgtttcagttttgttaatagcctgctctgtgaccttgaataaattacatagtttcttagagcaggggtcccccacgcctgggccaaggaccaggtactgggccgctcagcaggtggtgagcagcaggtgagggtggcttcgtttgtatttacagctactccccatctcttgctttacctgagctctgcctcctgtcagatcagtggcattagattctcataggagcgcgagtcctgttgtgaactgcacatgccagaggtctagtttgcatgctccttgtgaaaatctaatgcctgatgacctaaggtgggacagtttcatccaaaaaccatacccctcccccamccctccccctattgcctaaagggttrgggaccactgtctgagagacttcatttcattgctttaaaatcaagagagtagtgcaagatgacctctgttcttttgccagmgattcttggcacacttatttttgataagaagtgatgttatttgtaatatatagtatctaaaactagtttgtgtttcctaaatatttgttattaattggattaaatcttctattgaaagttacttttgaaagtttagtaacactttttaggagaatgcgagattgtcttttctatatacaaaattagtctactgccctccaaccagagaatgtggtttctgaatgataggaaatggccaactttgcagttttgccttattctgcctcctgcaatggaacatcctttcaggattactggtggaagaggtaatctgtggccactgaattggtgatctagggatcaaacccatatcctgttttagcsatgggagaagaaagagtgagctaaggggcagtataggaaccctgggggttactggaaacgcctgcatctaggattgatttgtcagtaaakgctggaaaagtagcttaattctgtgtttcagggttaggctgaggctgctgatacacatttgtcttggtcaagactggttgaggaagtgggatttgatttagtctgtaggaggtggtagtgttggcatcagtggatttagctattaggagctaggggaagtagacacaatggaatgaggttgaagctcacacatttaatatgaaactcagtaggcatataggggccttgaaaagcagctctgagagtggaggaaggatgagccttgggtgctggaagtagcatgtgtgaagcacatctgtaggatttccttagtgtgagtcaacagtgtcatacagctgctctgggacacattaagagagaagtaagcaaaatggatcatatttagatattagagtgaccaagatgaggaagagatgtaaaaccaggtcatatgaaggattgttaatggggctacatgtatttatttagcccagcaaagaagggactagtgtgttttgtgtgtgttggttggggtaggagggaaggggagtggtttggtagaaaaatcacagatggtaacttcccaaagagatttaaagggctaacatgttaaatgttaatttgattctttatagtggaggaggaaaatgcatggtgattgggaagccaaaaagagacgtatttctggtaaatattgaggaagaaagttagaattatctcattggaaatggtctgtctgggactaagtattcaaagtagactggagtgacactggctgggtagagagagtgttgaagtatcatggggtgcctggatggtttaggtgagtgtctcaggcataagcaggcagcctgtagatggtgagtaggtggaggagctgtgctttgagctcttttcacatgtcagggagtttgtgctgagscacctgcwgcttgcctagttggttcccatggtattaggtgtagtggctttagccatggataagagtttttccaccaggttaactacttgtatggagacaatctgagatgttagaatgaagagataatgggagtatccgctttcatagaataggcaccataagacagcccccacagacagtctctycatcatttcccataccagtgatgtttgtctctggtacttcaaaccagacaaacaagagagtagttttctgttggttggggcgctctacaggcttctctgcccatccagtcttctaactccactctgctctaaatcatttccctggtccyattatataagctttatatagggggcttggtggttaagggccagactgcttggggtttgaatctcacttagtagctgtgtgaccttggcaggtcccctgagcccaatgtgcttcaattcactaatctgtagaatggagataattacaattactgtaacactcacctcatagggctgttatgaagtttaaattagtatatataaggtacttagaagagggtctggacattttaagtgctatatacatttttattattaacataattaatatggcatttacataagcttgtttccaggataaggggggaaggacatcgtatggagggcaacattgaagatggaggggtaagccttggagaagaaccarggtacccttttcctgacttggggtgaaagaaaggaagggtgggccaagaaaggcaggatgagagatgaagagaaggtgggtgaggccatgtttgaatgttctctacttactctgtaaattagcgacctctccgtatggtcagagtgggagggtagagtggggattgaagaagggtaggaagggactggaatagagctagtgaagatgaraaaaaagcaatggtaaacaatcaggtagcccaggggaggttggaaaccctgctgygaaatggagccagtcaggaaggctgaaagrtttctctgacagccctcagcagtccaccaaagctggagatgagggttgatgagttgaggcaagggtgaggagaggttgggtgattgcagtgaaagatcaagggggcagaggaactggtggcagatacctatgggggcaggggaactggtggcagttacctatgagaccgtaactgaaaaattgtaatgtatatacctcagatatcagctgggacccttttgccttgctttgacccagtttcataacttactgtacacagattagaataccatctgcctatcaaaagaatgagataggtctatgtatcttgaaaagatgtctgtgatagagtattaaggaaaaagagcctgttgcagaagacaatgatcagtgtgattctatttttatagaaagaaacataggaaagtcctggaacaatatacatataccaaatgcttaacagtaattacttttagcggggatcgggatggatggggaggcggagaaaggaaattaactttttgtaacacacagtatttaaagggaaaagtgtgttgggattatgggtgatttttatattattcttgtgcttttgtttatatctcagactgtctgtaatatacatatgttgtgtctataaacagaaataaattaatgtttaaaaatatggaaagcatctacatgtacaagagatcattgcttattgtatctcagtaagtggtttttatatatttagaaaaatagagtgagtcatcacaaggaataatattcagccttatcagcaattaaaattcatattcagacaacctgtaggaactatatacacccgttaggccagccaaaagaatgacaaatgtgatatcattatgtgtcagtaagagtggtgtaaagattgggacagcgatatttggacattattggtagctgtttgaatgggttattttttctcctggaaaacaattggtcaataaatgtaacaacagctataatatgattcatatttttgacctgtataattctacttttaggaatattttcaaagtaataatgcccgaggaaaccaaacaaccaaccaaacaaaaaacccaggaaataaatgttctcaaagaagggaatgtcaaagcaacttatataatattaacccatttaattctatggtaggatgataaaaatgacaagtacgtggactttgtcaatagaagacttttagaagatttttttttttttttttttgagaccgagtctcactctgttgcctaggctggagtgcaatggcatgatctcagctcactgcaacctctgcctcccaggttcaagcaattctccttccttagcctcctgagtagctgggactacaggcatgcaccagcacacccggctaagttttgtatttttagtagagatggggttttgccatgttggccaggctggtctcgaactcctgacctcaagtgatctgcttgccttggcctcccaaagtgctgggattacaggtgtgagccactgcacctgattaatatatgacttttaattgaaaatatatgatacgaaacataaaaataaacatttaagatagatttttatcaactatgttatatatatatattcgtatattggcgcatatatactaacaaccatctgaagggaaatagaatatgtgctgtaacttacctttattagataattttctactttctattaaattgcctttattcctaaagaaaggggagccataattaaggcaattttattatatcattctcttatttaaagatattttaatccattaacataatgatggactttttgagtaatttaaatgaatagtaacaataattcatgatttgtctcatttttcagaggtgtgagtgttccactgtgacaataaagattttttgttttttttaaaaaataaagaacatttttgacttctagggttaggtaaaaatacctttgatgaagttgcataatgatcctatctttcacaaatcaaaagaattccattttagtttttgcattttaaataaaaaataatcaatctgaccttatcccattgatcccactaatgataaaatactctcaaagatgttttattagtattgttaggaaaaactttccctggttctagtcattccaaatgcattgaccacactttttaggtcttttttctgtctctttttgattctcagtttgaacttcattcattttcttcatcatttgaagtctctactatttctatccacattctttctcttttcagtttcctggaaaccactgagcttggccttgtttggtgaactgcattgtcattattgcatcaaaatgtttagcactctaagccctgttgctgagcattgaggataagaatgtggctgacaaaggatgataaatcctctcattytgattcttatttcgacatgctcttgtcatttaacctgatataagcatatatgaaccccagtcagaagactggagtgttccttctgcttagagaatggggtggaaagtctaccttcaattgttacacatgctatagattcagaattcttgaatgtgacagctaaaggggcttggaggtcattgggccagttccatggattagaaaccaaagtcttgagcagctaaatgatttttcagaaataatcagaaggccaactcttctgacacctcagcctgtgaacatttcaataaatccaacctctctaagtcacgtccgtatagttcagccaatttttagctaagatttgtggccacccacaaatgtaggctttattctaaaacctttaagctgttaccaaccggatatacatcttttccacattcaacactactccaaacagacctgacatgtttgtggttaaataggaagaccaactagtgtgctttggcattcgtacattaatgaaggtccgaattggaaaaatagttatactttggtgtctttgtttagaactgcagaaattattttaatctttttttcacttgtaacaggttttagaaatgtggataaaataataacactgccacatacaattggtatttagagtatacaacttttgttctttctgtaggtggtggcaggtgtgtgtaatgatgcaaaacatttggttgtaaactttggagagtgagatttgtacattaacagagaaacgttaaaaaatttgttctcttaatcacaggcccattttgaaacaagcaagtagaacataaaattttcagaattatatatttctacatcatttaatgcagaaaccttaacaaaactccttgcaatggaatattatcatttaatagttgagaatgtagtacagttataggtatttcgctgatgatcatgaattatcctgcaatgaataaatgacccagtaaccttttaaaagttattgactacadcaatataatttatgagaaatttaaaacataattagctggagttctttgagaggaaaatgtttttatttatttatttattattttttaaaattttactttaagttctgggatacatgtgcagaaagtgcaggttgttacataggtatacatgtgccatggtggtttgctacacctatcaacccatcatctaggttttaagccctgcatggattagatatttctcctaatgtttgagatgaaaatgttaaggatagttggatatttttccattaacttactttgtttcaactatcatttataatcaakttataaatatattagtaggtttcagtttcaaatttattttggaacaagagaggttataaatatactttgtattctacctatactgtaaacattttaaaaattattaaagatgtttggttctggattatggtttttcacatgtgttatgataatgcagatgatatgttatagaaggtgtaggcattgtgctgtttctgaataataatgtgccatatcttgagaggcaccttaaaaatgacaattatgagctgggcacggtggctcacgcctgtaatcccagcactttgggaggctgaggtgggtggatcacctgaggttgggagttcgagaccagcctgaccactatggcaaaacctcatcgctactaaaaatacaaaattagccgggtgtggtggtgcatgcctgtaatcccagttattcgggagggtgaggcaggagaactgcttgaacccgggagggggaggttgcagtgagccgaaatcgtgccattgcattccagcctgggcaacaagaatgaaactccatctaaaaaaaaaaaaaaaaagacaattatgatagtaactttgttttataatattacttatttttccttaaattcttattgttgagcagaggctctagaaataggtaatacgactagttaggttttaacataacttaccttttgctttctgaattggtttttaaagttcattggtagaggccatgtgctgtaggtgtgattacatggaacaagtacaggtacttgcttcaagaaataaataaatgtgaatataattaagtataattatataaaataattattgtaaaaattataatatgtgatacacactcacaccatatttaaacagtatagcattgaggtaaaagaaaaatgtatacataaacattatactgattttagaggttgaaatgaagcctgttatttggatgttgacccagggtagtaacatgccacatgggactgtttacagcccctgtgcaaatctctggacgggagagttctagttctagctatatggcagactagatgttaagggagaccgtgcttgggaaagcaagcctgaacatgctagataaaatattttttaaaaagtagttttgaagagaaaatccacctagctcaagagtatttggtagggaaagcaggtttaaaataaaaagacaacccaccccctgcccttttgcttccctcccatcagtctggttgacaggaagaaaccacaccatcaacaccaacaagtttctgtgttccttttacagcaaaagggactttttatataaccaaatgtggtgttttagtgactttttgataatgtacagttttttgtgaatttaaatttatttctttctatatttttaggaccaatctcatttttaataaggttaaaaagaaaaaagtctagcgaaaaaactcctgtttttgccatgtgatgttccacaagtgcagctgtagaaaagtgcttgtcagttgttgaataaaaaaaccacatttgatagaaaaaaaaaaaaaaaaagtagttttaaaagcatggctgagctggcagaaatgtaagggaattccttggagggtaggaatgamaagacactatgtgtcaggaggggtaagtgaccattggaacaagcattggtccccgtggtatctgttaacctctaaaggcctaaagtgtgggttttaaccaggcatgtgtagggagcacaggaaacagmgcccaagacagggtaaaggtcaagtcagagctcccacatagagtcagcacaccaaatggttaaccccgagtggaaacactaggaagaatctgctctggagagggcatggtggggacatatataactgtctctgctttggttgtgggaggaatggaaaagagaagtcccccatgagagttaccaacgataagcctgcatgaaggtaggctytgggtttgagttcataccacctgtagggccaagttgaatgttcagttgaaaatggtcttggattggcagtaatcccagctcctggtagaaggaaagggaaatctctctggaagaacacaataatttaaacgtagaccttaataaattcccacaaataaaactgaagggccttgaatccacggtrgaggactcctcccatccccaacacataaagaaataaactatcatgagcaatcattaattgaaaaaacacactatagagtcagttccacgtagactgcagagtttggagtggtctatttcagaatgtaaaatatgtctgtttaatatatttaaagaaataaaatgagctttgagaatatgacaaagatttgaaatgaaaccagatagaatttgtagaaatgaaaatataaygttaagtggacattcttggagttagaccttccttgatcctttaaacaggatcctggcmcttacatctattttcccttcatcaytctatagcttttttaaagctttgcaccatccctctagtgagaacaacatcagtttttcaaaccagtcagagaaaagttgttatatgtttctctagaatagcacgttagcctctgagacctggggcagaaggaagaaaaagagatacattataatcacacacaacctacatgtgcaagaatattatttttttgccaataaggtggatttttttccaactttttttttgcccttcttattgcccttcttagcttctgctctttgttccttagaatgttaattcttatcaccccaactttttacattgaacagtttattaattggaatacatgctatgtttactaaataagtgtgctccctgatccattaaaaaattttttttaagacagggtctcactttgtcacccaggctggagtgcagtggtgcaatcttgactcaccgcaacccctgccccttgggctcaagtgatccttccacctcagccccccaaatagctgggactacaggcacgcaccaccatgcccagctaatttttgtattttttgtagaggtgaggtctcactatgttgcccaggttggtcttgaactcgtgggctcaagcagtctgcctgtctcggcctccccaagtgctgggattacatgagtgagccactgcatccaatcaaagctgtattttaaatgggaactcacctggaatggcacaaagattctgtgtcccaatttttgggttcaggaaatctattcatcctttgcagatgctcaagaatcgttgtgtaactggattcttctgctgaatttatatggrgacctatgggctgcatagtggagtagtgaaagccttgtatagacactggggtgggcaatctttcctctgtgctcaaggccataggacatcccttcatatgtttgtagtaattttctctggagctcaaartggaaagcaatgggctgattattattttgacagtcataatttgtgaccagactttaaaaaaacattgtggtcaatgatgttgcacaattactttttgtctgtcacawaracaaaacaaatccagatttaattcartgcaaacaaataaataaaatgctctgctaagagtatagagtcaagcttttgatctagtgggagaggctgagactgatcgaaaatataaggcagaaataaatgacatgagagaaatagaaataaagtgctrtatttgatcaaaatagagaacagttatagcagagcgatttggaaaggctttgtggaaaatgtgaartcagaattgarccttgaggaatgagtagggtttcatttggtatagatgggggtgggtgttacagaaagaagacactttgtggaaaagggccagcttttggaaagcttgggccattacagggaacagaattgatcagtaacatttatgarttaatcatagaaagttctgactttttgccaatgccataaagatatatgacattttagaaacttgaattttgctgaaccaagaacttgaatcaggctttctgcagggctcttgtttgggagtgaatcacgtagtgagtgagtgagtgctcccagctgagggcctggcatcctcaggcagtgcagctctcccattctcagcttggcatggtgtaggccttaatacttgtgaactactgaagctatgtttctatgtcttttaaaaaaatatcttctagtggyagtgattgaaaaacagacagtggttcttattagcaacaacagtgcttcagaaatttgagtggaatgctgaatttggtattggatcagatgggtgacaggagtgtggaattttgcagatgactcaggaagaaactcgttttcacattggaggtctgctttcatccactcyggatgacaggaaatagaaggaagtaaaattataaaagtagagtgaggccatgttgaatagcaggctgtgactggtggataaagttttctaagcagctatttgatttaatatgaactaaacttttagaaaagatattactggcaggttgattatacttttactatcaacaaagatacatgctgaaagttgttgtaagaactattcaaaaaagtggacgttcaataaaatgaaatgatccacataatagacattatattctcaaagtttccattctcccaactttgtatccaacattaagattgtgaattttgttggatttttctttaatccccttatccctaggcatttattcgtatctctaacaaaattgcaataatatttgtgaaaatatagctatggtacacattaacaactgcaaatccatttaccgttcttccttactgataaaattctagttaaaaatgctgtctcagactcccttgtaactagggtgaccacataagttagttctggccagtcagataaaagcrgaagtctcctgataaaaagaaaaaccgctgacatgtgccttttgcccttcatcttttcccttcttagttggagcatagatacactgcctgaacattcaggaggcatcttgagaccacaagggcaggtcggaaagacagaggaggctagggcagttgtcccatcataaagctattgcwtcacctcttatctgtttacctctgaccaatttcttaagttggaaaataaaccaaccttggttatgccaggcaggtcattgggtttcttttatgaaagcaatcctaactgatacagtaggccacttttgggcaggtataaaatggttaacattcctcctggtgcactgggagaattcagggaatgaatgagttttgcaagggaattgtggtggcactttagtgtgtttgccctgtgggaagcgagtttgaaccccaaactgaaagttacgccatccaccagcattggcaaactataacgccactccactgctcaagtgtatgtggcacaaaggggcagaacaccgctggggaaaacactgatcacgaggagtgcagagtgctcagattaaagtagagctaaagcttctagtaagcacagacgttaattttggggaaaaggagtaactagtggcaggtgttttaccgagtgtggtagagggagcaaatctcttgagtaatgccactgatgaagacctattatttaaagagaatactgagtatttgcagagttacagaaatggcagtaagaatctcgacatgatgaactagcattccagaccagcaccatccaacagaaacacaatgcagccacataagtaattttaaatcttctgctagtcacatcaaaaaggcaaaaagaagcagatgaaattatatttaactcactatagtcaaacatcattgtgacatgtaattaatataaacattattaattgtatattatatatatatatacaattaatattttatatatatatatatttgaaatccagtgtgttttgtacactttcaacacatcttgatttggactcagccacctttcaaggtctccattgccccatgtggctagtgactattgacagggcagtttcagagtagaaaaaggtgatttatgtagcactcagatacattggtttatttttttttttaaagtaaacatttccccaacattctaattttctaggggtatagaagaaacaggcattagtaagattctaggagagtctaaaaatagtgaagagagaggtcccatagaagtgtctagctgtgtgtttttaaagtgagtctgacatgggttgttagatttgatctaaaaaatgatggccaagaaatgaaaattgaaataaaagatttattgaaaccatatgtgtaatcttggaaaagaaagaatacgctcaatttcacatcttggacatattgagaagtaggagaagtgtgtctttgtagaattattcacaatgtctatctaaaatgatggaaactttcttgttttattatttttctgttataggcttttcttaacttgggagtgacgagcgaagacgaatttgggaagcacagggcagagtgtcttacttcattcttatatgctgctgagcttgatgtcgactcagtttgtatttgattcctgaagttagaatatctcagaaatctttctttgggcagtatttgctaatgtaattattatttatcccagttcattccatacattaagtattctggaagggyatttaactcttcacattcttattggccaaccagtatctaatacatggaatgaggtttcaggccctgcctccactgaggcgcttcccactgggaagtactagagaatatttttaaagagtctctgyggacacasagcaagtwttaggtttttttgtttttgtttttgtttggtatatctagaaacacactttgtgaatgtgaaaggttctcttgtacccaactagaaataatcactgactgcctctgaagataatgatggagaatttgttraaagatttctctttaattataaagtggctatgcaaatgtgattacagtttaaatttattttcgtagtgaaaatagcttttgggggcattcaggcattctagaaaaatataaagaagaaaagaaaaattatgcatacaagcatagttaacacttggtcatgatcctgtctgaggttttccctattcacacataccccaaatgcttacctycccccatcccwwcacacacacacacacacacacacacacacacacacacacacacacacacacacagacaccccttycccctcctcctttcctctcttcttcaatctccttccctctcctctccttccttcctcctttttttgtctttttacaaaccaggatcatattctacatacattttatagcctgctttttcacttaacaatacattatggtactatatgagtgtgtctattgaatgaggcctttctctgttcatttctagtaatgtccaatattgttattataaaccatgacagagtgagcatttgtttaattattgtcttaggatatattcttaagtggaaktgctgagagtgtatgtgtagagtttggctgtgtgttgccaaattgtcctccagagaggttgtgtaatttattcttgcactaagaatattctagagtgctatacctatagtgttagtattctttttctgccaatctcagagtttaaaaatgatatagttgctttaatttatatttttttggttcctagtaaatttggacatgttttcagttgtttattggcagtttgtgtttcttcttcagtgcattgcccatttgtatcttttttcatttatttattttattaaggtattcttttcrttttgtattggaaagctgtctttatatatttaaaacatatactctttgtcacatatgttacagattttactacctctaaagtgttaattttatttactgttctacaatattgaaaagttttgcaaggtgctatttttctytcttattttcatatggagtcatttgtgagaaatatatgctgggtattgcagcctgctttttgtttcttgaagtgatccatcaaaagcatttatatactttcatgtataagccctgcatcatctctagagtgtgttttgagtaagtaatgtcaatgaaatcaccatctaattatgttcttgygaaagcgcctgctactacctttgaagtttgctgctaatctcttcttaccttcatttcttagtatctaaggtttagataagcagtgacaattaaaaacatagaggaatgtaatttttttcttgagtgagtctacttttaatatttgaattgaatgttagcaagaagtagtaagctcactggtttaatttttatttattctatctctacgttgtgtgcaaacacacatgatcaacatcaatggcctaagattatccttcagaaaattttcttagcaactcaaacaatgtcccgtagtcagtgggctcctaacagtgtattaagatttaactatctgtcaaaaagcaggaatttgcatagtgtgggaagtctacccattgtcatacttctgcatatgaaagtaatatggtaatattgaatttgactgtgaaaaatagtaacattaaatttgtgtccataagaatttaaaattatataggggacacaaataaatataactcatgggagtatataaacaataatttaaaggctttgaagggtaaagtgtgtaaagtagaatgtgatactttggcaagaaaactttataggcagagtgtgagttatcatttagagagaaggagcagagtgaggcaagcagaagaggaacagttgggtactgggtgccacggggtacagatggggattggcagccatggaggggaggctgacagagaacaccaaaggcaattaaacaccaaaggcaatgaccagaagtgtattttgatgtagaggtcaaggactaatcccaggtaggcagctagtaccttttcaaaatggtgggcatggcatgcctattgcatgcagtttaagaaaataggtgaaatgctggcatatgcaaatgttagggaagtacaacctacataaaagcaagacagagctctaaaaccctattgttctatgattccgtttgctgggaaaatgtaaaccctactgacagcacatctctgttacagatgtatgggcagataaatgggctaagaaagagattatgtgattgattatgacctttctatattgtacctgacttacattaagtatgtttttaatactyaaaactagttkactaaaaatgcctttaaaaatgagtctttatatatatatatcttttttttattttttattttatttgtttgtttattttttttgagacggagtctcactggctggagtgtagtggcgtgatctcggctcactgcaacctccacctcccaggtttaagcgattytcctgcctcggcctcctgagtagctgggattagaggcacccaccaccatacccagctgatttttgtatttttagtagagacggcgttccccatgttggccaggctggtctcaaactccttacctcaagtgatccacctgccttcgcctcccaaagtgctgggattacaggtgtgagccaccatgaccggccaaaaatgagtcataatataattcaaactttgcacgtaaatatgtataaagtcatgaacttacatagtgactgaggattttgtgtatataatttgagtcttttaaaagttgactttgttttataatgcttgctggttttagccatctattttaaaccatatgttccctttagacaaatttcataattcttaaaactttgatattctgatttctatattcttgatactgagttagggaattcctagtgataactcatagtaaattagtaaatgcaattagatttcaaggtctccatggctatgatggttacatactaaaatccttgaattagagtggccaaaaaaaaaaaataaatctcttggtatcatttgcagagaataattattcctttatttatatagtgcatcatagtttgcaaagtgcttgttactgcagtttttaaatttatttgacaaataatagttgaatatatttatagggtacagtgtggtcttttgatatgtatatatattgtagaaagattaaatcaagctgataaatatrtatccatcacttcaccttcttatcattttttttkgtgatgagaatatttaaaatctattcttctrtgttccttcagtttttgtttcatcttcatgaaaaccttagaggcaggtggcatagctatcactacctctattgttacagatarggacaccagacatagggctttggtgacttgtccataacccacatctgacttccaggagagttctttaaacacacacagcctctatcactattatttgattacaactcctcagttagatgatacctgaaagcagttttcttgattttcttctcctttgtatatagtattctattttgggccttagcagagttgatattcaaatacaatatttgaatgaattcttttactgagaaaggtagtaatatagtccaccttaaatagattgctaaaatacttaaatcttattctggctgatgttttggaaaaattggatatagggacaggtcaacaaccatgcgttcagcttgattccttcgcagagacttattgtagcagtcaaacacagcgaataaggtgggcagacaaatcttttaattggcccatgatcatggagtgtgcctcagtcattaaataaatctgcaagggcacaagaagtggttgcttcaaatcatttttatactgtttttgtggcttatatacttggctgttcaggagctaccagaccataaaatccagccagtgagagcattggaagtcacggagctcaaaggttgattacgtggtgtgaaactctattgttttgtgcatgtgttaaataattgctgtcagtgcaagactgttaaaaattcccgactagtaataacatgaatgcactttatggcttcaaaaggagataaaagaaatttcttagtcagcactttggcggcatmacagctaatgtcagttttgttattgtgaggactttacttttggcagatgctctcccttctggcagcagagctctaattaccatataaattaagctgggaagtgagcggagggcatgcaactcagccccttctgccttgtacccaggtttccagggctgcagtgccaggcaggcgtagcgtgggctgacgccatggrgagggctccactccccttctcccctttcttcccattcagatccattagagggacattaagcggcttagctgctgtgcaaacacaaagatcattcttttttcttcttcttttctttctttctttctttcttttttttttaaacctagggtcttctctctaatagcattccaggaattagcctaatccatcctgctttaattcataggcactaattatatttcagcatacattcttacacactaaattataagtatccttactttaatcagttgtaactggtccttaaattgagggtttagtactctccttttatcggataacaggctttgctgtgttatgtgatgggattaaactgtttatttaggatgtagaattgaagacgtggatgatgtgttattttttttccyaaagtgctctgtattttcttcagccagagtgtatttcagaacttcataatgaccttttataatttgtaaaatggtgtctaatgtttaggtccttttgggatgtgaactgacaagcacaatttgtagaaacataattataatgcaggtgaataatcgtttatagttgcaaagcatttcacacataagctattctgtttggtatttaagtagccctccaggtgggtaactgaaggattcctgtgaggtggtcactgaaggccacatagttggtagtgcagctggtgtggcgtacaagtctcatctccctctgggggttctttccttccacctcacactgcttattgactggagttccccctacattacaaagcacctaataagatgatcttttcctatcagcattaaaaatttttttttcgactttgtagaaaataatcsttttgcagcacttaaagagaatcacttgcgggcattctgtaaaattttacattttactgacagcacaaaacaggaaattgttttttctttttggtgagtaattgctagtctagcttttaaaattctctatctatcactcgctctctatctatctatctatctaccccctcacagggctttaagcctcttgaaagaagtayaaagaagatagactgatgactgtccccctggtaactggcacttcagagagggtgagagaattcacagataattctcttttctgagctaggaaggagtcacattagttgagagactttatcactttcagtccagtacttccccagccccatgaaaaaaagtgtacccatcaaacartccccttctgccatctttatcttatcaggatctctcttctttaatagatgagactctttggaaaggactttaattggctgatgccacagactcatcccggaacctaacttcttgaagaagaacattctgccttagtttcaggcaggacgactgcgtcactgtacactgtccagaggtgactggctgagggaaagaagtggctgaaatctgctgtgttccatttgatgaatggtgcttgctggmacactgcttcttcttacacaggaggctccagtcactggccaagccttgcagtggggcgactttcatctggggccactgccctgttgctggcactcagaacaggagcagttgcatccccatctacttagtcactaaagacagacatttcacttctttttttcttttcttttctaaattgtgaggaatgtccaggcacttgctctttaggtggacatggaaagtcacccttccccaaagactggacttaaccctattaattatgcaaatatagtgcaaatgagtaaccatgattctgggagaagagtgacaggaaattggtggcgagacaaagtctcacagtgctgattgcctgtataggggccaaggaacttcctggaggaaaggcagtccaactctagctcctttctcttttttsgctcagttttactcgaacctctctgatggattgatgttgtcccagcagaggtcccttggaaagaaaggactccaaggggcccaaagggaaactcactatggagaaaggagaatgttgaactggctagcattagggcctttctaggctcatgaaggagggcttgtggctgagcctgggtttctggcacagtatcgatcctttgacagtgtatatgagttaaggtaaagcagcartcccctgggatcccaagtgtgaggcatcacagttgtctttgcaggkatctggaacaccagggtttgtggcagcaatggacaaaagtaacaactctatggttttaccaggagctgcagcagctagaaatgtggactcatcttggactcatcaggctttctattctgtttcgacctggtatttggaaccaggacagacctcagcatttttcaacaatttggggtagggctgtggagcagcttcaggagggagatactggaattgttgctaataacatagactaatggggtctcaaaaccaatgaactgggaaaagaagagattggactatatttttaccccacagttatgaagggagtcatataagtgtattcttcctccttaatgtctttcaaatcctttatctctgtcttaccacattaactsctccttctgcaactagtctcctcagtccatttccacactgctgcaagaatgatctttccagaatgcaaatatgatatgtcactcccctgattaacatcctataatggccctgtaaccatttaagatgaatccagattccctggctggctgtacgcttttcagtctcatctctcgccatagctcccagtccacccagcgtgcccaccactgtgaactacttgctgttccctaacatacaaaccttctttatgccactgaatctttgcacatgttattcttccctgtttttcactttctcattcttaaaggcttattcaaatatcttcccctttatggtagaaaaactccactccatatcatckgaatcccaacattaaagcctaatacatgggtactgaccttctacctaaaaggctggttttgaatgagtgattttcagtatgagaaatgaatgactcaagaaaagccrtatcagaagaagaaaggtagaaaatgataatggactcaaatgattctccatttgcttctaacattttctttttgaggacttcagtgatttatgccatttgtgtggacatttagataactaatcttactattattataaatacagtaatttgattaagtatgtgtgatattgtgatataataagaaatacatatttagtctttgtccccagttcctggcacagaattcctaaaacctttgtaatatcctgagtgagaggggtgataggagcaacttttgttataatagttggtcttggtcttcggttcctgacacaagactttctaagacccttggactctctggagtgaaaagagtgtcttgtttgctaatgagatgactggtgactggaggctcctakataatttcaggatgaaggctggtcactggaaagaccaragcatgattagaaggttggaactttcagtccaccctagatgtccagggaggggagagggtctggagattaagctcatcaccaatgaccaaagaattaatcaatcatgcctatataatgaagctttcataaacacccctaaatcatgggttttggagagcttttgggttggtatacatgtagaggtgctgggagggtggggtgcacagagaggacaatgacattctgtgctccttccacgtayatctccctatgcatctgttccgtttggctgttcctcagtagtatcctttatagtaaagcagtaatagtaagttaactattttcctgagttctgggagtcattctagttgttgaacctgaagagtggatcatgggaacctctgatttataattagtcagtcagagagtccaggtcagagaggcctgggatgtatctacctgacatcttcatatgtcaaataactcatccaaactagttaatgccactgaaaattcttggtgaaacagacctctagaaaatacacttccccaattttaaattgttcttagtaattcactaaaatttagcctatgaaaatttttccagtggtgggctctacttagcaggcacaaaactggagaaggacaccacctcacccacaggtgttaggcaaagagattgggtgctgggtcagagccacatgaagcagggttttagagggcataggcctgtatgtatttggacactcaatgtggaacagggctgtgcttctgcataggacttagaatctggaataaaaatagatatttttctctgcagtcctatacctttgctacccagttttaaaagtttgtggctttctagaaatcatagtacagatggtccctgatttattatggtcaatttaatgatttttcaactttatgatggtgcaraagccatatgcattcagcagaaaccttaactcgaatacctataccaacattcttcttttcactttaggtacagctttcaagaaattacatgagatattcaacacttgattataaaataggctttgtgttagatgacttttcccaactgtaggctaatataagtgttctgagcatgtttaaggtaggctggactaaactatgatgttcagtaggttaggtgtattaagtaaatggatttttggcttactgtattttcaacttacaatgggtttatcaggatgtaagcccattgtaagttgaggagcatctgtattctgatcattgtcatctccctgaagttgtggtttcttttaggtgtgtattttgtgaatgcatacgattgcatcgactggtctgattttrtcagcagtgactagtctgtctacttctactttgtattcagagasattacctataagcagagttggtagcttcctaccaatatagttccatggatgcttggcaggccccttagcctaataatatgcctctcttctgattcctagtgcttgaagttctttggcttggtttggttccaaattttgggagttagagattcctttaagaatctcattaaggctgtgaacctctttcctggaaaaatgctcatatagatgtacataaaaatgtgttcttgaactctaaaattaagaactcctgtgttaggtagaggtaaagtctttccacagttagagaagaggcttaaaatgtaaatcaggcaaggcaagaggatacattcattaaacaagcattgattaagggcttaatgtttacaaacaccatgggtaggttttgggcatacagattaagacctggtcttctttcttgacaaacttttagcttggtagaggaggccctcatgtagacagagagttacaatgtgaggtattcaggcctgaaaaagaggtggatacaaagtgccagggaaccagatgggaggtagggaccaactctgcaagtgactggctcatgtttaccttagaatagaaatggctgattctagacgcttgcctcagtcagtttagaaaggtgaaagctgggtgcggtggctcacgcctgtaatcccaagactttgggaggccaaggcgggtggatcacctgagggcaggagtttgagaccagcctggccaacatggtgaaaccccatttytactaaaaatacaaaattagctgggtgtggtggcacatgcctgtaatcttagctacttgggaggctgaagcaggagaattgcttgaacccaggaggcagaggttgcactgagccaagatcacgctattgcactcccactccagcctgggcaacaagagcaaaactctgtctcaaaaaaaaaaaaaaaaaaaaaaaaaaaargaaaagaaaagaaagaaagaaaggtgaaagggcattgggtgtcaaaagcaggagtgttattgagtaagaggctgcaaagcagggaaggacacagattggagagaaaaggagagattgagattgccaaggagaaacctcacatttaaaaggtttacttgggacccagccatttgtagctacctgaaactgggatgatattttgcaaatagatacagacaagtaggcagaactgtctgccccattctcctgccaacaacaaacaaaacataaaacataattccaaataagggamatgcccattactcaractttccctttgaatctaataatgtcacccaagtcttgaggaatttgctaattgtttgtagatcctacaaggtcataatctagacctgttttaaaaaatcttttaaaacttcaatatrtttatttgaaagggatgaagaaatgatatacattctacccagtctgcaggattacttgacacttgccgtcataggctgggactcaagaagtattagaggccaccatttgttttttcagttagtcacagcctttgctcacagggcttttgaaattattttaattcagttacacatatagttgaagctacaaatttatctcagttctacattgtaatactggaacaatgcattgccaaggggcgataaagtcagaataccaatttatattgacagtttggtgagatattcttctgtgattatacaccaaagccttagatgtagaaattaatgggaaaagtttttaattgaaaatgtattttctcattttttaaatttattttttgttaaagtgaggcacctgggtttgaattttatactgctaatactttgggaaggccatagtggaggtggaaatatggttttgagatgaagcagtgtgaaggtgccacctagtggtcacataatcacgtctgtgttctctttcttgccagtggaaattgggtacccgtggtgggtttcctagagaatcccyttataggtggtgaattcggttagcctattgctgtccttgataggataaagtttttacttttactttgtggtcactgaaattatcatcctccaaatttgttatttgaaattagttttgttaactggacagctcttgttaccctttttgctaatatttttagctaattatgtcagcaaaaacttgggttaaatgttaaaattatagtgtartcatagtttcccattccattggaatggtctgacatgtaatgtacagagagcatgcagaatgtctggagtgtatcgtgggacacagctaaagcctgggtgatggccagctgctgtgaggtttcattaaaggcctttcttgttgttttgggattaatctctctttagtagaatgctgtagaagaaaaaagatcaatagaaaaactcatcttttgtataaaaatttttttttcagatgagatgtgttcagtaagcacatacctcattagagagatggcaatggatggctgactacagtcatttcttttctttacccttaaacyacatgtaacccagaattgaaacatatacttgtattgaggttttccaaaacaattagtgatagagatcttaagaaggaccagaattcctggagggtgttgtatgttttgttttctcagtgcaagacatctttgaggtttcctttgccatcaaaggctttctatgtgtgtttgytggggatggyggggggatttataggaaaggactttcactgagatataaaataattttccccaggaggatttttactttgctagtcttgttttggtatctattttgggcaatatttacattaaaaacttaacatctggtaagtactaacattttatctttatcacacatgaacaatttttttttgtcatggaaatcctcatggtggaattaactaaaacattatagaaagttcaggagggctcttcagaacaacacaaactttaactaaaaactttccctaaagatgctcttggaatttgcaaatgcagcccagatagcacaccagtcatttagattttaaagtatgtgctgcatacccaaccttgtcctaggtggacattgctgagaaaaatacacaaaaatagtgtgatttgtaggagtctgggttctcaaggtcctcagaagaggcagtactgaggcaagtacggagccagattgcctgtgtttgagtccctgctctgccctggactagctgtgtgaccttggagaagttacttgaccctctatgccccagtttcttcatctgggagaggggatactaataacttgctttgcagggttgagtggaaagcacttagaacagtgtcaggatatatggcaggaactccatcaatacaagtcagctatttccatcctcaccacatggtaaagcccaggcaccacacacaggaggacagtttaacactgtatttgattaagaaatgttaaggccacttactagaggagttcataaaagagaaagcagtgtaggctggggtatttaggaaaagacattctattttaggatttgacattctaaaataaaatttatttttaaagcagctttctctatttggttttcaattaaggagatcaattcattaggattcttggtgctatttccttctatagggttaaggaaaaagagtaagatttcccttggtgcgtcattcactttttattcattgagcagctatttatggactatgtgctctatgccaagcattgagtttgagtgagcgaatgagacaggcaggaatcacagctgtagtgtctgttctccagccttttaataatgttccscatgtgcctcagtgacctttccagattccttatatttggtttattttaaattttatttttaaaaattgtttatgatgaaaaatttcagacacacatgtgtctgttcctttgccaataccacactgtctttattgctgttgctttatattaaattttaaaatcagcttatatgatttttccaatcttatttttcctttatcaaaattgttttggttattccagttcttctgkcttttcatataaattttagaatcagcttgtctgtacctacagaaaatcatgctgggatttttattgggattgcataaatttatagataagtttggtgagaacagatggctttattatgccgaattgtccaattcatcaacatggtatgcctctgtatttatttagtcttctttcatttctttcagcagcattttgtcatcttcagcatgtagatcctgtatgtgctttttgagacctgtacttaagtataamttgtaacactgtaagtggtattttttcttggtttctaatatgtgtgttttttcttttggtttctatgtatacaagaagtgtatatatagaaaaatggttaatttttgtgttgaactttatcctgtgaacttgctaaaatgacttattagttctagaaattattttccccttgattccttgggattttctccatagccagtcatgttgtctgtgaataggaacaacttaatttatttcaaatctgcatgccttttatttcttttccttgagtttttttcttgcattggctagaacttctagtacaatgtcaagtaggtgtggtgggagtggacatttttgccttgtttctggtcttagggggaaagcattcaatctttcaccattaagtattatgttagacgtaggtgttatcagaatgaagaaggtcccttctattcctaatttgctgagagtttttttttttaaatcatgaatgtatgttgamttttgtcaaatgcttttctgcattgattgatgatgactgtttttccttttaatctgataatctggtggattacatcggttgttttttgagtactcatccagtcttgcattcccatgacaaagcccacttggtcatggtttgtatcaagttttgaagttccagctggaaatctctaataagggaccagccagcagagaacaagtaggcttgkgtttggaccagtgttttggaaacagttggctcactgggctagtgaccaccctgttaacttctgctgacctgttttccaagaacccacctggtaccaacatgcctttactgccagtgtattttgtttccacccttcttttgacttatatttattgttattctctttccctttctgtactggaccaggaacttccatcaactggaatcatctctgggcatcttcgtcttccatttgtgttttaatttatagcaagagagtttgggaataatcgtattttaagaaaccaacatttatttaaatataaacacatgtgattagagtattaaaatttaaatgctattaaaagtttttgcaatttttgtcatttcatgaggcaagaaaagaaaatatacgggtgtcttgttatatgtagtcttctaagatctgattttaaattgcaatttattttggaaggtagtggaaacaaaccagaaagtaatgtagatgtttgcttgtggttaacataatttgcctgcctcctcagaggctaaattccaaggaattttgttttctgtattcttaagtctagagacacaatggtccagagatccctgtgaaagggagccctcatccggggagccccagcttgcacagtcaccccctcaccccttcctggggakcagtgagaatgccgtgggctgtgcctgcactgagaatgctgcttttctgtgaaaacacagtcaagtgcacatgataggttttagttcccaagcagtgttaaaagcaaatgtgtggggttttatatttccagctgcttttttttttccaaagtaaaatatgtaggttttggtttgcagcaggccacatttcttctaataaaaacagttagaacaaaatgtgttttataagcatataaaaatgtcagaccataatgattttagtgttgcatatttaaaaatggtcagtaatatttaagacataagtatctgcaaagaaagtgaattatggaaagtaaattacagtatatcatttgtataaaggagaaggtggttggaracttgtccaggaactatattgagaccattttatttgcatttctatataatatgcatgcctttcagctttcmgttaaattttggcccccaaattattaaacttttatacttgcaactgggccccaacatttaaaaaaaatcctgtttgtgtctggacacacaattcattttgtgaaaaagcaccttcattctgtggactcattagagaaagcatctcagtaggtcctggtgccaaaatcagttgtgcttccttctgaaccattcacttattattatctgatggacactctgagctcctttttgccttgtctgctaggaagcttagaaaaaaaattcagggtatctgtaacaaggctacagaacctgagcccatgtgttttgcacactgactgtacatctggaatcattttcatcttatttctttcacctttactttcctttttgctttcaatttttttcacttaactctccttctgtgttatactgtagttgttgttataagctgctttaaatccatattggaataatatagttggaaatagatttttaaaaattggtatgtttcttttattattttatctctataattacatttctctagcactttgacacttttaatcataacttacaattgcattctcataaaaaataaaattccaagcaggaaaatttctgatacccattatgacatgttttaaaaaatctttattgtctctttagatgataaaagtaatactggatgattataaaaatttcaaaccttataaaaacatataatgtagaaaataaaggtcctctataatctcctcctgctgaaaaaaaacaaaaaacaaaaaaccaaagccaaaaaactataaaccttttggtgtataactttatggcatgactttaagttgcattgtattggagtggcagtgggaatgatttctttttcccctgtgaatcttggctgtataactctttcttcatttctgtgctatgatgcaattttttttttcttcttcacagtcctgaagatatgccagttaaatctgggggacataaaactcaacgttcttggaatgctttgtagaagggggtcgtggctggtctccatcccaggcaaatggaatttattgtgtatgtggctgtggctcacagcctgaccatggcatcagcatcagataggcctatgttcaggccctagtagctgaatgactctgagaaagttatcttttctccataaggcctggctttctgaggataggaataattgcttgaaactgttactgtcttgagcaaatgagagagtttatataaagctcttagcacagtgtctggtatgtagtaaatgccaaataaatgttagctattgtattattttgactaataattgttatttatagagaaaactcaagtaatcatggtacaaacaagatagatatttatttccctactatctacatggctagaatgaaggtccaggcctgactgtggttctacagttaccaaggacccaggctccttgtaccttgatgctcatgtatctactatttcatggcctaagatggctctgaccatttcaatcagattctaactagggcaaagatcatgactgagaagttgtgcgtaatatgtatactcacatcccattggccaaatcttagtcatrtgaccatacacagcagcaaggaaggctgggaaatgagtcttgagttaagtgactgtatgggcaactagaaattatgataccatgtcaaaagaaaacagacattgggaggcaactcacagtccctgccaccccatctatagcattgtctgtcagatgctctgaataaatacactctaagaactggttcctgctctattatctatgcatttatcagatacttttgtaaacttgtttatattctcatcttttgttggtttttgagatagtgattgctagatgtttattaatagaattttttttcttacattattattattttttttgagacagagtcttgctatgttttaagatctccccatggtctagaatttcaggcctattctttgcatttccccagttctatcactggcatgttttaagaggtgcactttcttcactgaaattagttaagtactgtgggagcttgctcaagagttcactacttcagattaatgttgtatagacttcagttacgtggttataaacgttcaaatgaatgctaagtttcaggcctgaaaaagctgaaggtttataatctataaataatatatttggtaccttgtggctatttcaaatagtaatgttaaaatttgcatttgtgacaagtggaaaattaygtagctagggagatgcctgtgatgacgttgtttgtgataatgttgttttccccccttaatcaattaatactttttttgcattgaataatcattaaaatgctttagcataaatattcctgtcagtaactgcaatattcttgcatatagtagtaaattctcctgtttgatcaggttatctttacatgaggatttttgttttttgttttattttgttttcagagacagggtttcattctgctgcccaggccagagtgcagtggcctgatcatagctcactgtaacctcaagctccttggctcaaatgatcttcccacctcagcctcccaaaatgctgggatgacaggcgcgagccaccatacctggcccagaactcttatttttaagttagattccaaggttgtctcggctgaatagtagctgagcctatgaccagaatttgggtattctcttcccctgtcagtttgtcggcgcaacaggtcagacaaatgcacaaggccttacaatatttgtcttgatgtctttggcttgtaaagctagattttaagatwttcagggttccttattccttagccgttagcgtttttggacttcttggctactgtaataattattctgaaccattctccatctttcttaaaagtttaatataggttatctgagaatagaacttcctaagaattcataaaaggcaaatttagcttgttttaattaacaaagagaaaaactgattcaaagacactaaacagcttastaaactctgctgaagaatgaacctgtgtatatggatagctgaacacccagacaagatccattcttttcaattctgttttgagacctttgtagtagggactttccctggattaaagaaaaaagataacaacaataacaaaacaatacccaaagaattaaaaaacctaaaaaccttttgctggcctatcagtgaatcaattctccactgtttaattttagtagcttttgtggtttggtttgtatggactatacagggaagcagactsaggctatgtgatttcagattgttttccaatagggatggaatgttttcatcagatgagcccagaattctgatacagttattgactttagggagtgataacgtaaaacagcattaaaaaaggaaaataccatacccttgttaagaattagtagtaggattttatttttagaaagtaaaatttggaaacaactgtatttgttttctagtgtatattattttaaaatattttagaatatttttgtaaggtatgtttcccgattacattactctaaatacgaaygtttttatatttccaataaaatattcactaatatttacctttccaatgagatattttacttgcatgactatttttaaagtatgtgctcattttggtggagttgctcttgtggtggttaaaccatatttgtgtattttccttttccttatgaaggtctcatttctgaattataagactaaatatcaaatgcttttttgtggttgtcggatagtttctagatagagcacatacgcaaatggagtatgtttattaattaaaattatttatatttcatttttaataaaattttagttacttttgtaaattttaaagtatatcagctaagttctatttattagcaaaatatgttaacaatttggtgtattttcacactttttttcctacagatataaatatactcatgcatatgtatataatacattagaatctaggtgtatatatgtattaaatatactggacatattatgttacattatgaaaattttccttgtcaataattatacttcgtaaacagacttttttttttttttgagacgaattctcgctctgtcactaggctgtagtgcagtggtgcgatcttggctcacggcaacctccaactccctggttcaagtgattctcctgcctcagcctcccgagtaactgggactacaggcatacaccaccacacccagccaatttttgtatttttagtagcgacggggtttcaccatgttggccaggatggtctccatctcttgacctcgtgatctgcctgcctcggcctcccaaagtgctgggccaccacgcccggtcgtaaacacacttttaaataactgcctagtactacgttccttgtgtgatttatgacattttatcatttctctgtgattgaacatttagattttgtgctattagatataatactctaacaaacatcctgtatatgtgtctttgtgtctctggttatttccttcagataaattcctaggggtagaaatactggtttaaaggggtgtgaaaataattttaaaagtgcttggtatataataccaagttcattcattcagtcaaaaaatattttctaagcaccagaattgaatcacacccttgggatacaacaaggaataagacagtccctgttcttaactcacagcccagttgggaggacagaaacatatatggggaagctcaagcctgttctctccagaaagctcatatgaattcatatgtcaccaacattgtcaatacatgcaagtggttttggaatgtgtatgtttgttcttttgaaatctactgatttcatcatggaatacttttctgaaaagaaaaatatttttattttggttattgcatttaatgaatcacatacgtaatggtttttgacattattgatccaaaaaacctaattcatttcgatatccttatttctgtaacaaggaatttgtctacctttgtaccatattctcatttccatagttttatgggggcttccttaactgccctctcctagtgtcttgatactttctgccactcacaaatagaacactactctgacacttgcaacagttaattaagaactcaactcatattgtttaaaactatcttaccactattttgttctttatcaaaggcagaaaagacactaattttatgcgtattctttatcagtgtggataagtcatgtaagaatggaatctaaatacctatagtaagtgaaaactcatggtaatcctgttacatttaattttacagattctccagcatctgctatgtacttccttaatatttaggacaggaagagcagattttccagttttcaggacaataggctgagtggctacatctctatatatgtataactactatactaaatatctggctattaaagacagttgtttattatcagaatatgctaatgacatttaggaggggaaaaaactcatttttagtatattctgagagttgggaaggcaaatgtgcctttcacggagcactgagctgctccgtgaacacacagtcttcaggaatatatccagagcacacagtcttcaggaataattattctattcactgctcaataggtttctcacatgtgaaggctgccaggctcctctggcttctaatttaggagctaaagagatttccttactgggcccaaaaattatctttaagcaaatgtatgaccttattcactcaaaaatggtcacagatggacactgtattgtggcaagatgaatgatgtgactgagctgttttccagagtgtgctttttcaggataatacacctagtatttttctggtccactagtttctcaagactctttatgactgagtgtatgaggtatgatattcattttttttttttttttttttgagatggagtctcactctgtcacccaggctgaagtgcagtggcgcgattttggctcactgcaacctccgccttccgggttcacgccattcttctgcctcagcctttcaagtagctggaactacaggcacacactgccacgcacggctatttttttttttttgtatttttagtagagacagggtttcaccgtgtagcccaggctggtctcgaactcctgagctcaggcaatccacctgcctcagccttccaaagygctaggatattcattcttaagtgagcaggcaaactattcctaataaataatgagagagggtgtaatatctactgctgtacagttgtggttttatctatttgcatctcacttcatcttgatgaaatgcagaactttatcacatgaaataagtgaaggagactgcatatgacaccatggaaattctggaggtttgtacttttaagatcagtttttattgaggtagggatttcagtttgattgttacgttgatccctggtttaatatatccttacattttatatttaagtttatatttgataaaagagtatcttggtattggtcatctttcaggagttaatttttcagtctgtattatgctgccaagatctatctatatttttgtatgcagtggtgcacccttttttaggactgtataacattccatagtgagaatgtacctaaatttatttctgcattttctcaratagacatttgggttattttcagattttcgttatgaatgctactgtgataaacattcttgtacatgttatctgctctacatgtacaaaatttcctctagttttcacagaggaatggcatttcacagaggaatggcacagaggaatgtatatatacagatatagagtatctgaatgttataagataatgcaataatgccttccaaagtagttgtaccagtttacattcctaccagcaatatttaagaaatctggttcatccatattctcttgaaacactggctactatccgacttaaaaatttttgccaattatgtgagtttataattgatgtgcatttccctgatcactaatgaggtcaaatatttattcaaatacttatgtctaatatattccaccccccctttaaaaaaaaagcctattcatgtcttttgcccagttttttttgaattgtctgagtttttcttgttattatagaagttctttatatattcttgattctaatcttttggtggttatacagatgggagctatcctctcccagtttgtagcttttttycactttttataaggtgacttttgatggtcgtatgtccttgtttttaaaagagtcaaatttactaatactgtatcttgttttataatgggtacttttgtgtctttaaaaaatacttttttatcagattcagaaagaagtccttaaaacatattttccactaaacattttaaagatatgcttctgatattttaagtccttaatccrtctggagttaatttttgtgtaatgtaaaatggaggttcagttttcatttttattcacataaactcaccatctctgtcatatattaaagttatgcatatgtgtgggatttttttttttctgggccctcttctactccataggtcaatatgtctctccctgtccagagttagattgtcttagccttgtaagaaatgctgatatctgatagggtgcaggtcccctccttgcttttcgttttcaraagtatcttggctgttttaccatgtgaattttaaaatcaccttctcaagttccatgaacgacscatgtacgattttgactagaattgtacttaattttggccggatgcagtggctcacgcctgtaatcctagcactttgggaggccgaggcgggcggatcacaaggtcaggagatcaagaccatcctggctaacayggtgaaaccctgtctctactaaaamtacaaaaaattagctgggtgtggtggtgggtgcctgtagtcccagctacttggtaggctgaggcaggagaatggcatgaacccgggaggcggagcttgcagtgagccgagatcgcgccactgcactccagcytgggcgacagagcgagactcygtctcagaaaaaaraaaaaaaattaaatcgggtcgggttaaggatgttcccttctctatacttaatttastaaagtttatatcagggatttatataaaattttattaaatgcttttatgaatctatttatatgacatcctttttctcctttaaayttttaatgtgttaaaattaaaactaaaactaaaaaaatgcttttaagatatatacaaaatatatgatatatatatagaaaaataagccaattattattattcatgatagcagttaatgcaggtgggttgaagagaaacacttgataggtgtaaatttttaatgttctagttcttgtgtcaggtggtgggttcatgagggtgtatcgtattatctaaaacatacaaatacatgcataaaatataaatgattaaatataaaggcaggccatgcatggaccattaaggagagataaatgtatgtgttacgagccaggctcaatggctcatcttcgtaatcccagtgctttgggaggctgtggcaggaggattgcttgaggacgggagtctgagacaaggctaggcaaacaaagcgagacctcgtctctaccagaaataaaaaaaaataaccaggtgtggtggcgtgtgcctgtggtcccagctacttgggaggctgaggcaggaggattctttgagcccaggagtttgaggctgcagtgagctatgattgggtcactgtattctagcctggatgaccaagtgagaccctggctcttaaacaaaaagcatatgtgttacgaactaaggattatgattaatctaactttgtagttaaaaaaggaaatttgatatttgcttttatgagactgtgttgcgtttactcctaggttagtaaaaagagaattttaaaaaatgtccgtatttgttcttcattgttattcttaaagtttctctttttcagaaaccttttgggcagtttttggttgtgagacttgatgtcatgactgacatatgcgttagagtccatacgttctaggactgacaagttccgtgattatcctgtggtctcagttgtttgatcttaaaattaccagatgattaatggccctcattttagattgacactttgtgcggaatgttctgtagaaggcctgaccatttcttctggttttttaggccacatagttctgtattgagcatgccatgagtttccatcctaccccatctcatccatctgattccatcatgtagtggttttgtatgaggcttctagcttgttgggaggacacttggaacagattacagtgattatgaacatttggaatgaaacagacttagattctaattttggctcttctccttaccagctatgtggtcttcagaaattttaataactaccgtgagttatctgaaaaatctgtgtgatattacctctgaggttgttgtgttaaagtgtatctttattactattattattatatcgccatcaaatataattaatttttgcatttccaagtatactggatgcactttcaagccactgatctgattttcccttgagtgtactcaaggtgccaattgctttaattcctaagtgttataaagaaccgcagtgccaaaatattcttacctcttagttctcaaccactgactcttctatcttgtctgtactattcctggagagaagggagagacagtcaatagtgttgctcacagccaagccctttctaagcatagctgacagatgtaggtgtttgggctgatcacaatgttgaggacgacagtaatcacagcaatcgcctcttcatggagcactgctaaggcagccgctgtgctgaatgccctaccctcagcatcttgctggattctcaccgaattccctaaagcagatcttcatcttgacgccttcatcttgacacagggaagctgagcttggacagattcagcaactagcccagtgtcatacaattagtaattggcaaaatcaggaggtagtcgctagtctccttgactccaaaacccacagtcataaccgctgcttatgcaaatgctattcccccaggtctttatctcttcctatattttctggakgcaggaaagtttgtggaacctgtatctggtgagacctggtgggtaggtgactctagttggattctctstgctctttgggaaggctagctccctgctgaggcaacaggttctggaaactttgggggctatttggttattttgcactgaaaattaaatctaaaatgatttaatgatgagaatggtaactttgagagatttttgcattattcactttggagcaggaatayttagatacgtgggcttcatgactgtattttgggtttttaagtcagaaaactaggaaggtttataaaaacctttggaaaatatctgttgcatgctaaactaaagtgagagcttaataaaaatatgcattaatkcaggactccactgccctcagactaagcacaagagatctctgttgaaccttgggaaaaataaacttactcccttggcatttatgagggtggcactaaaatttggtggttgcgcccaggagtggggtagtagcatagaatgaaaacagtctgcaggagccttcaggttttttaaaatataaccaaattaaacattaacatagtcttcatataattagtctctgattccctcattccacacagttggttttctttttaaaaaaaatcaacataaaaagatagtttacttttctccttttatcaagtatttaattcatcataatgaactaaaggataaaataataaaattttctgtttaaaattgtttgggagtgatggaaaacgtgaaaaaaaattattttcttctctggaacaccaaaaaattgacaaataaattttaggaagaattgttaaattttgccttttgcccttctgctagttccctaccttaatccagttaatataaaatgctcaaaaagcgattatcattcatctttcaacttgatgaacaagtattttctttgcaaatgaagtatgtcctgtaaatgattacacattaataaaaacaagaatcaacctgatttgttttaacacctctrtttctctgcaggaggtagcatttttctgtcagtttgtcaagtgttattttttcagcctccctctggcctgagtggtatatatgtggtttggttttgaatttagtgaagaatatgactgaattctaaaatgaaaaatagtatcatacttctcagattttgcttataaaaatgttgcgtaagtgcttacgacacctttagaagtttgtgactctccagaatttctgtggcattcctaaacactcagtatttacaatgaatgttaagtgattggtaacatttgaatgacatgcagtataacatggcagccctattgggctttccatttggcagtcttagtaagacagcagttgaccaaaacctggcagctgtttctgcctatgaaataagtagggttcaacattccaggctgacctttcttcagtattcttttggacaccattaagaaaataatattgaggctgcagtgagctatgatcgcaccactgcactccagcctgggctacagagcgagactctgtctctaaaaaaagaaaaagaaaaagacaaaagagagaaaataatcatgaatcttttgtttgcatctaatatatggttcttttcatttatttttaatatgtaggagtatattttttgccatttcttaagtgtagggatcttttggcagaatttgtttcctgcattcctgtttctgttcaccaagcaagataaccactatcggaatagctctgcctacccagacattgactggcacatagttggtgctcactaaataatatttgaatgaatacattctggacgttgaatgaaaggaccttttgggctctatgcatatctrattcagtggtcatattatttaggggtttagaatgaccatttcacttgttatcaccactatccatgtaatgttttaaaacttatcctcacttggatagcttaaaattacagtctttaaacattacctccagatttagataaaagtaaaattgtagtgttggctataagcaagcagagaaatatattaatttccagtttccgggagggttggaagaaatacttttccagaacgagcatgattccactctgatatgagaactaaattaagtgacactagttgtataaagctttggcagtgggcctaatatcccttgttggttttatatgcatgctgctggctttgctggcaaaaatgctggttgttaatttattgatgccaagcacttatagaaccagctttgtgtaacacattaaaaactagactgaaatgtatttgttgtcactgaaatgacactctaattatattagatgtcccaatttagttttatcctttaatttttagcctcataactttcttccaaagttatctgggataaaaacttgaatgttcaaacttggcatataattaaattgagattaaaaaaggctatcaactaggacttgatttgtttaaaatatgaaataaagatatctttctgttaattaatagaacaacttcaaatcaagttactcaacaggcctgttcttggcacttcaaatatgtaattaagttttatgatgacctagttaatatctccaaagtaagaaagcacagtgtcatggtttgggttctttagaagcactgccaagatagaatttggggtacaggatgtttattaggaatcattacttgtaraaggaagggggaggaagcagttttggrtagagagaggagctgaactgccatgcaggcctggcaagccttgtgaatgcagcaagggtttctagtcagtggcrgcctgtgtaggctgaagtggacagcccttctgtcacccttgttcagggactgaatatgggccaccttggaaagtgggagagctcaggcaagyagcactctgcagctgaggctggccctaaggttgctgcctcctgaaggctgtctgctgaccacccactccacagctgggcacaaaggcctttcttgaagggcatggagtggcacctctctgtgtctactgcttagaactctcattactaacaataatactcataattcatatacttatatcattatcttcatctgaccaacgaaaaaatagaagcagaatactttgcttaagatcttatggttaattctgggccacactagaaagaataacctgtgtcttattcctagctttcagcaaactaacatcatgctgcagtggacgtatttattatttttaaatgggtggccagtcaatatatgtgaagaaaaagcgaggcgaaggaattgtagctacttgagaactagtgtggtaagcaarcaaggaaaggctgggtttagattccaactgacctgatctcccagttcatgttctctctggctctgtgaccagacaagtgacacggtcactctgacctctagggagctgatctggcaataaaaggaatgaagttggcatgtcatttaaatagtgtagatgaaacatagtatggcacctggtgttcatagcaggaaacacaatataggctaattttcttaaatacccaaaagaagtcaagctgcaaaatgctggttagagacatgaaaatttcaacttgaagacagagagaatttttctccctagtatttttcctttgtatcctcttattcctttagtgtcgacatattaagatatgagttgayagatttttgttctggagaaattgcttctgcaaggtgggtccactccagacagacctggggaggggacttcacaaaaaaggcgaggaagaaggaagaagcatggaatgaagaagattaactgaatcaacaaatattcatggaatgcttattacgggccaggtttttttttttttttggaaatttaatgatatagttcattagaagatcatcaaaagtactgtatctgagatcattaaaaacggcccacttctctcttttccattgccaccctcttggtttaggctaccattattatcctaagtttactgcaataggccagccactgttttcctcctgtctgctgtaggtttattttcaaccccgttcttcactctacagacattctggtcatgttattctctgcttctcaggactttaataaagcctgaaagactagacatgaactgtkgcctagcacccaccagcctcaactttcactagttacattactagacaccaaccctcaacacctgccttttcaaactcaytaattcctctgacaggctttgcccctcttgcttcaggcctttgcctaaattgatttctaattttggaatgtcctttccctttccttttatgcctggttaacttccacttggtgtaaacatttctccctttgggaaagctttccctgatccctrgaatagattgggtctctctctctcactctcccgctaagactgcctcctagaactgctcatgggaggtaataatgtgttcctttgtgtgattgtctgtttccctcagcaagcttcagctccagaagggcagtgactgggtctgtttcggcttacagttgccaagcacggtcctgacacagagtagggatctgataagtctttttgaataaagggcttaaaagggtcacacaatcctcttctgataagcctatgctttccatctcactcctgggggcatctaaggatagacagagaccggkgtaaatcccacttaagtcaagctctacatgtgctaccagagactaagaaccaggcctttactctgatgtctacacttaaattctttttttaagctttgtactcttcatgatattatagtgtatgctgttgtgtcaygttaaaaaaaactcatggtacttttgatttattaaaaaaattattttctttaatcaagtcattgagttatgagaagtgataacctttaaatgtaatatcagttttctaatgcagcagtttatttggagggggaagggaaagtcaagcactcgtccatgtttgtcctcagagctctcctgatcaatggtttttccttgaaccactaggccatcttttcacagcgcccactgtcttgtgatagtaaggaagagctgagaagcagatttagggtggagctgaagaatggtaatctctagagtttgcttacaagagcagatgtaaacctcacagtcataagtgtgcttcttggctattttatgctggtatgagttcaggctggcctactttaaaatggacatctatttttataggaaactcatggaatgtctggaattctgcttagaaaaaggaatctgcatcctgctgtgaaggagcaaagtacttgctttttgttagttgtggtcttaagacttcaattccaaaggcatcctaaaaattggacttgattgactctgaagttcagtgctgccgctaagaaaacacgagaacacttagatgtggagcagctgaaaatgagggactctgtatagtttgaaaaattaaaaaatttgggttcattcactttgatagtgtgatttaactggttattttgtcattctgttttattttgaaactatttactttatgaagctttccatatgaatatttattttcactatgaaaaaatttaaacaattgggagtttarttattacctctgtgacattctagtacttcctataaataagtgcctgaacgaatggatgaaaaaatagttcataatcattcatgcaaataacaatattgaaatcataataggaataactttatttggaaccttttcttatctttttcatgtcactgttaaaactacttcttgtaaattgcggacttatagataatgttagtctttccaagtcttgaatatgccattctgccatatctgctagccagaaactcggctggctagatttttagtcacacacaaaggtttatcttattttgtttttcagcatagttcaccattttcactttaaggaaacacagaatgacagatcgacatagttgattaacgcagagtttcttgcttcactgtttataccctttattattaaccagaggctccaaattgctgatgcygtattttatttaatttttaagtttactggggttaataagtaagtgagattcttctaacagtttcactttccacattgtgaatataatctctctgggaaatataagaatccaagaaaaaaaggaaattaggtgtttttcttgcttgatcattatcttgtaagaatctacagagaaaagcagctcttgtactctgagggagttttcttcaagtggcttttgttcagctctctgtggtatagcccagaagaaaacctgtttgttcttttaatagctccacccacccctgcacttttattcagtataattaattaaaactttactcttcttttactaatagacaaaattatcaactacttccataataataaaaatcttgaaatctatggatgtgggttggtgggaaatgaaagctctttttggtgttggtaagataaagagtagttaattgactttgccactgccttagtctgtgaccttggggaaaaaccattttccgttttctcattacaaacttagactatctttccattaaattagtgttaagtggtaccctgcttgtctacttcatgactaaataacttctgcaagtaaagaaaagtaatattttgttatttattaaataggtattttatcttacatatttcttttgaaaaagtaggggatgagttagaaatcaattcataaagtagtttggactttctcctcagtacagttaaagaaactctcttgagctcattcaggcattgatttaggatctaataaccgataaataaggcagtcgttcctcttaagtaccttgttttatagtgtggaatgagaatcggagttaggaagaatgtatataaaaatgtctcttctgtgttgtaggagggattcaaatgttatgggagcccaaaagatgtagtaattaattttccytggatgcagctggggtcatgctaatgaatgaagctttcgatgggagtggtgggagaaggggaaggcttaatagaagataggacttgcaacaaatatttaaggaatttttatttcacagctccaaaaatggacacccttgcatgtgttagacagccaggtgaacaagataatgtctgtgctctcatggagcttatattctagtgggaggaaatagctacattaaaaaattaggtagtatttttacagttagagaggagggagatcacttccaggcatccctgcactttcttccctaggatgggtcttttgtgctttgaggaaggtcgacagcacatgtaggggagcttagtattgtttggagagagggacatctctccctggtaataggagggggcaaagggacactggaaatggatgctccaaggtttgtaacttgatggtggggattgggggagctcttacctaaagggttttgttttcccagtgaaatgtaaggtcatcatctgagattggggtcaggtgtgtgtgttggggtggttgaaggagagaagagcaggtattggggtggcgataatgaatctaaaataaaatacattcgcttgcttatgtgatttttctctatgaatattcagctccttggctacaggttgattgctggattttgctgtagtcctaaaggaatgagctttggcttggctgtaaataaatatgatgaatggatggattctagaccaattttatataggtctgagggaacttaaatttttcttttaaaaaccccttaaaatgtgctcatttagccaaaattttagcagatttcttaattctaattcttttcaagcataaagaattttgcaatttgacattaaaaatatgactcactcacttttcaattgacttatcaattcattagttgcttttctaagtagaataaattaccttaggtgaaacagctattgcagaatatttttagttgttgaaaactaacataattttagtagtattaaaaaaacctgctttcttgccagtgctgtctaaatgtgaagacccttcccccacccaccctggctggttatgctgcgggatgtactgctctctgcatttgtttcttttaacagccctttaatgttttcaattcaaaaagcttttagttaccattaggaatggatccaaaatcagtgacagaaattaataaacaataccttggagcaatgctttgttacattccattgcacaatatctatctgcatgaaattcttttcttgccgatgaagtagagtttaaatagagcataggatcactgaataatgcctgtaagaaacattttaaaaacctagttgtccctttgagacttttgtctatttccttttttatctccccttggacagtattttatcstggaacttaattctgcaaccccttttgtttcacaccttatttttctcaatacgttgcacattgttacttctgcccaagttaccttcaatgaaaatggtttagtccattttcattcctaaccttatattataaggctgtattatgaktgtgccaagtacagttcctattgttttgatttgaatataactgcagctaccatagaggtctaagggaattttcattaccttccctttactccatgttggaattaaatcggactgggtattgagttggatatatttaccgtagatttgaatacacatagacagatatagaggttatttgtatctgtttagatacaattaagatttatatactatttatatttatatcttatgttctctggggagtacatttcttcccttgtgatatcaattatttgtggtgtacttagaaattcaacgttggcgaatctgtagattttgttgaaaacatatacacaagtgtcagtgggtttaataatgtgcgctactcgttttcaagtaggaaaaagtcgaattaaattttgtcactattatatggtatttagaggatttgaaaacaacaataatagataacaataataaacaacaatagaccagtaagggattttttattttgcacattatgaatcttgttattttgggcagaattaattttttcagaagaaaattttaaacaaggaagcttgtttgagtttagcaaggttgctgtctaagattatgctttgaatatgtcattttgggtttttgctagtttttttgccagtgagaaaatgcatagaatatacaggacagtaatgctttagctgtattttgatttatggtctcttattttatgacattatattcgtttatatatgcaattagaagtgaattgtttgcctttcctgagtgctatttaataggattcacacttgcattctgttaccaaattaatggactttcttttaaagttaatacaaagcattaattrtagtctttttttttttttcartgacttagtgggtttttcttaaccttwcagtctagtgttggatagtaagataatcatccctatccagctgaggcagaaggaagtcgatttgatttctcagtactgttgagtgtggaaggctrgagaagacctcactgctgattaatgtatccacctcattatttttcattgagcaacattgtgcaaattaattgagagttgcagggcctgtgactacatatccttaatttccagaacatctgttacttcaaaacatcttacctgctaaatctttccgcctccttttttgggtagataatggaactataaaagaactcttctaaagaactcttctgggtgctgggttttcaacttctctaaactttatacttgtagctaaactttaaaactttataattttggggggcttgattacatttattttaggtatggcacatctagactcctgctaaccagtataactttattaattaatattttaaaataatacaacttgcctagttttttgcttgggtgcctttgaataatgatcttcctcccctcctcacagccctttcccccactccmactatagccagaaagagaggtgaaagcagttgaacattagaaaagaagtcttttaatgtggtagttaactgtatttctgaaaactagatactgccctgcttctagttagtcctgtgactcattcatttgtgttatagttctcttctgggggtgatctaataatttttcaaagacattctggcctgtccaagaatataacctttacaatgtttatgctgtattagaaggtgttaatggaatgcaggagagcaggctcctgaatggctgattaactaatatttttatatcctcaagtaatgttaaaaccatgcagtcttagtggaaraaaagagtgacttccagctgggcagaactctacttgatatgacccaaaaattaatatgtgtggttaggaagctgtatctcttatagaggcagttttactctggtgtatgacttgagggaaagaataaggtaataaagttaattagttctgcaatctataaccaaacccatagtgctttgggactagattgtcatattttcagcattttgggcaaaatgaatttccactcgtactgtccagaaaaatacctggtcatctttgaattcaaggtgaatgaaccaaatccatttggaattattttctaattttcatataattcatattttttcttaatgtaatcatgttattaggtcctagtataaaaaatgatccaagtaataagattgtacaaaataatctgggattaatttaagtggtaaacttttacattagctaagctaggctcagatgagtcaaaatttgtagcagatgctctgcttcccaattatctgtccagatctattgtatacagaaagccatctcatcatttggatgtgacgtaagtagaagttaaccctgttctatatattgaaatagagtttgttaagaaaataaatgggagaaaaaattgccagggaaatatgtagctccttaatattttgaagtccctagtttgcataccaacaatctagtgtgtttttccactagagacgtcaaaagctgttcaaatggttaattttctaattattgcatttatttattgatttatttatttattttattggagacgcagtctctctctgttgctcaggctggagtgcagtggtgtgatcttggctcactgaaacctccatccctgggttcaagtgattcttctgcctcggcctcctgagtagcttggattacaggcgtgcgccaccatttccaactaatttttgtagttttagtagagatggggtttcaccattttgaccaggctgatctcaaactcctgacctcaggtaatccacctgcctcaacctcccaaagtgctgggaaaatcacaggtgtgagccaccatgcccagccaattattgctttaagattaaggtgtctacttcacataagaaaattcactaaactttagcaggaagatattaaaaatttagataatactaatttccagttttctttttctaaataaataaaatgttactctaaataatcttttgttttaaccaagtaagttcttacttatgtactttatcttttggacttttatcagccatttttcatttaagctagaaagtgcattaatgttactgaaatctgccaaaagttacttgctgattgaagaaatctaattgtaagatttataatcaagaaattgatccattgacttatattcaattaaaactgttacaacatcataaatactcagtgatctctcctccccctacccttttctgataattcaattcagctaacctttcttgagccttatytgaatgtcgtgtgggctagagaatatataaaaactgcctgcatttactgagtgcttctgtctgggaggagattgttcttcctctctctaggcatggggacagaactcaaggacatgttgcccctttcttcaccctctctagcctcacctagaaggtggggctgctaatccactggttgaaactacgggcaacagtgtgctacgttttacttactacgttgtcaaggcagaaatacaggcccctccttctctctttcctctctcaatcctagggcatgctggtcattcttgcccctggagttagttgraggttggccatttttctgttttcccatggatgggtactggttttgtgaggatgggagaagggatagaagtaaaaaagaagtcacactaagtcttgtgtttatttcatattttgaaatgatccttggacttagagatactgcatatttagaaaacatttcagaagttcttgctgtcataacagtacccaatgacactgaattttctacattattacgttccaattttagaagcaaaattgcaataaaaattccagaatgaacatgttatagtgatatacacactgacaaatctctcatatttattcctgtaattatttttatttattatatatgaggaaattaaccagacacaaataaaaacaggcaaaaagaggccaaggaagttcaggaaggatttgaaaagccattgctttttttttttttttttaaaataacagctttattgagatataattcaaatacagtgaagttcactttttaaaaagtgtgcaattcagtgttttttttttttttgaggaggagtcttgctctgtcactcaggctggagtgcagtggcacgatctcggctcactgcaagctccgcctcctgggttcacgccattctcctgcctcagcctcctgagtagctgggactacaggcgcccgccaccacgcctggctaatttttcgtatttttagtagagayggggtttcaccatgttagccaggatggtctcgatctcctgacctcttgatccgccagcctcagcctcccaaagtgctgggattacaggtgtgagccacsgcgtccagcccagtgttttttactgtactcacagagggtacatccttcacyactatcaaatactggaatactttttttaccctcaaaagaaaccttatatccattagcagtcactccccatttcatggcataaccactgatttttttctgcctctatggattttcatagcctggacatttcatatacatggaattatacaatatgtggtctttggtgtttagtttctttcactaaacataatattttcaaagttcatcagttctgtagcatgtattagtacttcattcctttttattgccaaataatatttcattgtatggatataccacattttgtttactcattagtcacttggacgtttggattctttccactttttggcgattatgaataatgctgctatgaacattggtatactaattttcatgtggacatgtttttagttatcttgggtgtatacctaggggtggagtttctgggtcatacggcagctcaatgttttgctttttgaagaatccattgacttttaatacaacttctaaataggaagcagtcaaatatatgcaagattttggaattagatcattcaggatgagctacgtattgctatgtctatcttaaaaatcttatcttagtacaacattcttattttgtaattatagagaatttaggcaaacttaagttatctttattaaagaaatagattatcatgtctgtttaggccagttgcggtggctcacgcctgtaatcccagcactttgggaggctgaggtgggcggatcaccggagatcaggagtttgagaccagcctggccaasctggtgaaaacccgtctctgctaaaaatacaaaaattagcttggcatggtggcaggcacctgtaatcccagctactcaggaggctgaggcagaagaattacttgaacccaggaagcggttgcagtgagctgagatcgcgccactayactccagcctgggtgacagcgagactccatctcaaaaaaaaaaaaaaaaaaaaatcrtgtctgcttaggttgaaagataagtcaaatttccttatataatattggttaatttgcattgattattcatatttagttgcctaagatggtaacctgaaaactaatgttaatggattcttcattttttaaaggacaagctaaaaaacacagaataaatattaaaarttgtggaaagatagtcacccattttattttatgttaaaagtacacagttaatactcttgttaagttgcaaattaagttagtgtcagagcgtttttgtattggccatccatcacaggccctactatatatgctgttctcgaaggaatggcccaaaccttgaggcatttttagaattttttgttgatgacttctttcctgtgtatttgtacagtcatcccagtctttagtaactttctttttaccctgaattcatgatttttgacatcagtccacattgcgggctataattttttattaatattgattttatgatcagagtgtagagactttggttgttttcatttttatgtcctccaggataaaacaatggtggcatatcctgggtgctaccaatgtgtttgttttatgaataagtgaaaggatgaatggaatttggcactgtaccatattaatttcaagaaggaggaatggtggggtaacattttatttgctatttttataaataatatttaagcctcctcaaaaatgggaasttcactactgctttaaaggtgtgccaagtttttctccaagaacagaagaaacggaaaaatcaagtaaaattttttgcttaagacaatagaaataaacatgttgtttttgttggagagtgtttttgggtcataatatcaatctagcatggtgaccatgtggatcaaatatgatgtgtgtgaagtcagtttgtaaattgtgtaatcttgtccctgattttttctttgaacttctttccaaattgaagacatgaagtccttggtatgaaatagatctacacaggaagacttagttgattctttctattgatcctgagctggattactgcttccctcttttcacttaagtgaggtctctcacatggagagtgagccttgtctcagagggtagcaaaggttctgaggtgtggtgtcctccatcttccctgggaaatgcccggtctttgagacttgtgttagcacattgcagagagtttgtggaagggtcccaggtgctgctttccaaagaaggtgctgttttagctggctataagcattatcaatgaagtttgtagcttttaattggtgaacagatctgggagccacaaggcctgggctcagtttgcctttgtcagcaacacacacgggccctcaacctgtctacttttcctcctctgcaaatgatggcatgaaatggaggcacacatgatcctctgagtttgagtagttaagaataaatgattgycttgttcttataaacattttttgatttttttctcttttaaaatattaatagttcagaacccttccaaaaaatgtcacttactttagtaaacttctgttgtcttttgcatattaatgcaagtccacaagattgtgttagtgagaactcatgggtaacagagtgmtttccacataattgttttgattcttacaaaaactgtatggggtaggttattctgctgactttatagatgaagaaattgaggctcatattgatcaagcaatttccctaagtctccagctagtaagtggcagagtcagagtgtgaacccaggtcttttgcttgaagtgccacactctcagacaatcgttagttttagaggaaggaggttggaagacctagaggtgtcgaaaagccagaaagaggacaagatttagaacaatattacctgggtttgtaacttcgttttggttttactttcattggcgctataggtataaggaatattgtacacctttaaataacactatgataataacaacttaactttgtaaattgtttacaaatggcccatgcaatactcaaggctgagaagcatggtattaaagcattatgctattgaagccttttttcttccttacattcttatgtcaactgtgaccacaaacttaattggcttcacagcctccactcactccctaccccagtccagtctgcttggtgtcgacaaacatctttttagggttcaaacctattcatgtcttcccctctctgtgtacagatgttttcatctggcattcagmgccctttgaaatacacacagctgccctttcagcctcatctaatcaatagttgccattctagttatgtgattytatattgaattcttcctgaacacttcttttaatcatttgttaaatgtattaattttctctgtctgtatgcaacagaaatggttgcatttagtgccttggtgagtgatccttgttcttggaacagtggaaagatccagagcaacctgcttgagattctgtgtcctatcctaagatcatttcaaaatatatcatagtcttcctctaggttgacccacgcaccttcctcccagtagggcatctgaataaggaggatggggtttctctaggttggttcataaaaagtagctgcataccagcaactagtattttaaataaggataccgaaacttgagagtttaagaaacttatccaaggtttcataggttttgagttttggagccatgattttcagagcctcagtcgttacaacactgaactttgtagtgggcattcaataaatgtttgctggatgaatgaatgaatgaatgaatggattgttagtcttattagaatgttgaatcagcagaagaattgattgggtgattgcatctgcacagaagagttacattttgaggcttgtttttctgaaaaatattctaggatgaaaatgtccttttgatataataggtctctagttcagtacatttgcacataaaagctaacagctactggaggagggggatggtgtatatccatggagacccttaagaaatccctgtaagtttacatttcttttccagaaaggattgttctcatatgacaaagtctatgatagattttaaatctcttttcatatagtattccttctcaccattgccaataaggagaaaacagatactgggaaaacttcagtttgagggaacacaaaagacatggaatttccttgggatttttctctaagttttatcaacttccataccctaataaactttggttgatgaaagtgatgagaaatagagaatgccagctcaagcaatagcacataattayaaatattttgatgtttttaactgattattggagaaaccatgtttttatcagctggtgtgtctttttccagaagacacgtgatttcatgatttgcctttaagcctctgggcagacaaacctccctttaaaggaaaggaatttacatgatcagaagatagaccagttgctttcttgccattcatcatttaccatacttggggtcgcagaattttgtttcctgtttagtccatgagcacatgagagccattgggtcacaggtcttcctgactgatgtggttgtccttgtgaactagctccagccagccagtagtcctgcaactgctgaaaaacgaatatacgtgttatatctgagagaatatatsctcttgcttcctcttaaaacttctgaaggggttgtctttsctctgactgggcagactgaattggatttattgtctctcaaagagctctagcagtttttctataaatgatccatttaaaatttctgctgagttgcaatatttcaaacatttagtacacaggtatcacataaggatgttttggtcattgaagtactgcatatacgacggtggtcccataagattataatggagatgaaaagtttctatcacctagtgactaggtagctgttgtaacatcrcagcacaacaggttactcacatgtttgtggtgaagctggtgtaaacaaacctactgtgctgtcattcgtataaaagtatggcacatacaattatgcatagtaygtacttgacagtgataataaatgactatattactggtttatggatttcctatactatacttttaatcattattttagagtcttttacttattaaaaaaataaattaactgcaaagcaacctcgagcagttccttcaggaggaattccagaagaagacattgttgtcgtaggagatgacagctctaggcttgttactgcccctgaagaccttccagtgggacaagatgtagagtggaagacagtgatgttggtgaccctgaccctgtgtaggcctaggctaatgtgtgtgtttctatttagtttttaacagtaccatttaaaagtaaaaaaaataaaataaaaatagtgtattagtctgtttcaygctgctgatgaaggcatacctgagactgggcaatttacaaaagaaagaggtttaattggacttayagttccacatggctggggaagcctcacagtcatggcagaaggcaaggaggagcaagtctcatcttacgtggatggcagcaagcaaagagaaagggcttgtgcaaggaaattcccccttttaaagctatcagatctcttgagactcattcrctgttatgagaacatcatgggaaagacctgaccccatgattcaattatctcccacccggtccctcccacaacaggtgggarttaggggagctacaagatgaaatttgggcaggaacatagagccaaactgtatcaaatggaaaaaagtttattgaattaggatataaagaaagaaagtttttttgtacagctaatgtgtttgtgttttaaactaaatgttattaccaagacagtaaaaaagttttaaaaaatttaaaagtttagaaggtaaaaaagttatgttaagctgaggttaattcactattgaaaaaagaaatatttaaaaaataaatttagtgtggcctaagtgtacagtgtttataaaatatacattagtatatagtaatgtcctgggccttgactttcactcaccactcacccagagcaagttccattcatggtaagtgccctaatcagtaatcaggcataccatttttcgtttttgggtttttttttttttttttttgagacaaagtctggctccgtcacacaggctacggtgcactggcgtggtctccactcactgtaacctctgcctcccaggctcaagacatccttccacctcagcctcccaagtagctgggactacaggcacacaccaccacgcctgagtaatttttgtattttttgtagagacagagttttgccatgttgcttaggctgatctcaaactcatgagctcaagcggtccacccacctcaacctcccaaagtgctgggattacaggcatgagccactgtattcagcctgcataccgttaaaaaaatatttttaactgtaccttttctgtgtttagatatacaaatatttaccattttgttgtaatttcctacagtaatcaatgcagtaacatgctgtacgggtttgtagcctaggagcaataggccataccatatagcctaggtgtatagtaggctacaccatctaggtttgtgtataacaaatgaaataagaaagacttagaaaaaagtgtttgagaaatgtcacagataagattactttgtgtttgcttttgaagttattgaaattatatccagtagaaaggaagcctgcttagataagtaggatccaagattaagaaaaaaaatggaaagaaatgtttaggtagatgaaatcttttgattaatcacccgaaatgtgcaaaatctayagcaaatttttatttcaacagctcttagtcctatatatataagttgaacttgcttctataaatacagatgcaagttcaaaatataactaacaaagtactgctctgaatgtagcaaatgtttagaattcacttttaatcaaaacatcacttcttgctctcttaataaatgtactggaaagcatttatctaagtaaatgagttgaagttgtattccaaaggactgagaattaaacttcattcttgaatagcactagcattcttttttaaaatggtaatatttagcccgatcctccccttcagacttaactttacagaaagcaacagtgtgggctctgaggctgagctggaagggaactatggaggtcatctattctaatagtttctcaacccactcagagtcacacagctggttattgacatttatgggagtgtaacttatgcctgctgcctaggaagaaaaacatctcttccattcacccctttatttgtcctccaatctgtgtgtcaagaattgagctgactgctttaatgtggctttgtctaatttcatcttaacttctttccccatttaattgcattaagctttctttgatgatgtgaattgggggagatagatacgtagtggttgaaaggaggaatctattaaaggcaaaagagaccacacgattttmtgggcttttccaacttgtatctaacaatttgtataggttgacttagaacagtgcagaaagaattggctttcaaatcgaagtgaggtaatctccagaggtttaatagaattctttctaactgtcctttttataacaataacactagtcaaacgataatcatagtaacaacaaccataagcaaaaaagcaataacagtcacacaatgatgtgttaagtgttttgaatacattatttttttgaacacccaggacaactctatgaaataagccccattttacagatgagaaaactgaggcttagagaagtaacttgcccaaagtcacacacctgctstgaggaggaaataatgcacttttcattcattagmgctttcaccagrtgtcatatttatctattttttacagatggttaaaagaataatatggaaatttgagttgcttgtcattttgcattaaacattgtgtgaaaatcacatcaatgtcacaaaatttattggaataatggaatagagattgttttgacattcatcatttccagagtcttagaattgtgatgatctttttccagtgggctctggaagcttaagaaatttaagatttgttaacttaggaaaccctacattataaaacaaattggttggttggttgttcatccactagaacctgaagtataactagatatggagacacatgacagctgtttttcatgggttcatgtccatgggttcatgcccaccctcccatcagatgacttcctctctctgtggcccatgccctctgggactccatctgaccagttactggctgcacttgggaaacgaaggagcactgcaggtgtggctgttgctgtgattgccgagtcattcccttccctgtcaagtaaagcctgtgttaactcaaagccaaatgacaggaaacctaaattaataggaattgtttttattcgaaggaggaaaatcataagaaaacaagctattattayattagtaagaaagcagagcacagagacttccgaagaatgttctgggggtgatatctgattgtttagctcttacctttataggattgtacagtgaatacttatttaagaatcacaacgctgagatgctgtacgatagaccgtcagaactgggaagttcccttcttgttcagatgaggacgctgaggccagggaggtggtctacataaagtcgttttcaaaagtggtgctgttgtctttttgccatttcaacctgtctcagccatcaaagatccattgattgtactgcttactaaggcagggaggtaaataaatacatattagaaaactttccccaagggttgagacagtattttttggtttactctttacttttagtcataagggaggacttaatattttgggtatttgaaaaggacaaagatgtatagaaagaagacagagaagtaacaggatgataccatatagccagcaatgtgattaagtgataaattgtgtggtaccaattttaaataatagtaggcaacatttcccaaataagattgtcctgggatttcagcaattatactgtaaaatttttatggccaaggaattttgtgaaattctgaatattatataaccctcttaggaattcacaactgatggtagcttattaaagcctctgagaattccatagtagagaaacctgtccaactgagtttgaaccagagtttccaaatttatttgaaacagaatgtctgaaagtattctagaaaagtgctgtgtgagttcaggttgcgaatgctgatgtggggaatcccgaggataaggacgctgagtggggaatcagcacagctgaagagagctttgtggaggacttggcatttgagccaggccagcaggaacaaaagtgtggggccagaaatgagcacgaggcctgacactcagctggcactcaataagtgtttactgagtaggtatgtgagtgaaaacatgatttctatggaaggcaatcgggatattggcttaattagaatgaaaaggttggggaacgtggaaataaagttgaagaggcagattcttctgattagagagggtcaagctgagtgttcaggacttgatccracagggaacgctttgttggttcctgggcagaggacgacggcasagtagaaaaagtgtctgggaagaatagcctgagagtggtgtagagtcaggcagggatggaaaagaccaaagtacagtgaagagcaaggagccttagaaaatgatgctaacctctgtctgggtagtagtaggtcacatattgatttttatatgtgcctagataaatgcaaaagcaagagatctttttaaatataagaagtaagctagagtaaattccatctcagtcatttctggtatcttgaaaaacaaagggatagtaaagtattatcagaataggtgggacaaatgttcttggagattgaaaacttgaagcatttctactcggaaacttatagtgtctttatgactaaaatatatttgacccttatgcttgcaggatgtgaaatttaggataaattactctgtcaggaaacattaccagctagagttcctggagtgggagccacactggctttacaggtgtttttggtcttttcatattgcaaaacagtttatgtgaataaacataatttatccttatacatcttattccagctgaaaactcttaagactcttaagtccctcctcttaaagaagactgaaatcgtgtccagtcaaatgtgtaggtgtttatggtactcagcttttgagctattggttgtttccgtttgcttagttctcttccactcactcttaggctggataaagatttccattcctttttgggtgaaatattttccataagttacaaaaaacccaaataaaaaaaaaaaactttgcacaagaaatcccagtctgaaatagctttcctttttaaataatgatataaaataaagatagaacacatgataattatagtcattattacttggtggcttgaatgctcagattatttgaaggggtcatctttaaaatgcctgcctctttattctgtgatttactgactcttgacctttataattcagtttataattaagactttcccaagaagtctccctgataggccccaaactaccaattacatcacacatttcaccatttccaacctacctttacttttgggcaccaatgttagtatcttatttacatcactataattttaaaaatctgtttaacttacttcttctgagttactcctgggttcttaactgctatacttgtgttttcttttcctaacaaggtggggtcttggaaagcattggtctgtgtcagtggttcccaaccacggcagatgagaatcacctggagaacttttaagaacttacgatgcgtatgtctcaccttctaaggttatgatctagtttgtggaaccactggtctacatcaaacccaagttaagcaaacattatatattgttagtgagtagtacaaaaccttcaattctatggacatttggcaaatatcttatattaaggtagagactaaaattaaaatttagaattctagaaaatttcaagctgccagtacaatctcaagtttctctaatttttctttttttttttttggtagcaattttatactagattctttttttttctttttttttttattatactttaagttttagggtacatgtgcacattgtgcaggttagttacatatgtatacatgtgccatgcttgtgcgctgcacccactaactcgtcatctagccttaggtatatctcccaatgctatccctccccgctccccccaccccaccacagtccccagagtgtgatattccccttcatgtgtccatgttatactagattcttgtgtgcattaaataccagtgactaacttacttttgattaaagggcaaagcgtagtgatattaatttatttttggatttcagacattctatgtcatgcagtatttttcccaatataacagtttaatatctatttgtccttatgcagtagattttgttagaacatttaaacatagaccttttggaaaattgaccttaagaagtcttttttttttaatgccttccctctcctattcatggtacatgtgtgttttcattctattaagtgataattttttgaatggctgttctgaagctttaagtgtaaatttttttcctatgtcctgagactgttagaaaacaccaaaatctgagtaacataccagtgatgtcatggggtagaaaagatgtggaaagggtagcacaagtctcttctgggtgtaggtttggcatgcccagggccagaagggacagaggtggatacctgagccctaccataaggcagagtctcatatgtcaagtggaataaaccccagatgatgcatccacagggcttttgtttttgtatctcttttttttgaccaccaaaaaaaccacttttttaaaattatatatatttraagtatacaacatgatgttttgatatacattgtgaaatggttattatagtcaagcaaattaacacattcatttcacatagttaccctctttgcgtatgtgtggaaagaacacgtaaaatctactctttttgcaagaatctcaaataaaaggcagtattactaactatagtcctcatgttgtatgttagacctccagacttgttcatcttacatgtctgcaactttgtatccttttatgtatatctccccatttcctaccagtctcaccacatccctggtaacaactacttctatcacccctggtaacaaccactttattctatcttcatgtattcaactttgtttttctttttttagattccatatataaatgaaataatgcagtatttttctttctgtgtctggtttatttcacttagcataatgtcatccatgttcattcgtgtggcaaatggcaggatctccttttttaaggctaaataatatttctctgtatgtgtgtrtatcacagtttctgtatccattcatccatcaacagacatttcagttgtttcagtatcttgactattgtgaataatgctgcaatgaacaaggaaatgtggatacctttatgaagttaagtggtgatttcatttccattagactttttttttttttttaagagacagtgtgtcrcagtgtcactctgtatcccatgctggaatgcagtggtgcaatcatakctcactgtaaagctcaaactcctgggctcaagtactcctcccatctcagtctccagggtagctgggactacaggcacacatcaccaaacgcagccttttttttttttttttttttttttttttgtagagatgaggtctcgctatgttacscaggcctgtctcgaactcctggcctcaagcaatcctcctgcctcagcttctcagagtgctgggattacggcccaaaccagtagtgttaggagatctcttgggtgtcgatttttctggkgggaaacctctgtggccccagcacctttgcccgagttcttgtcctgcatccaggaaaaatgaggtacacagacaagtgaagggtgaagaagcagagttttatttagtgttagaacagctcaaaggagtgagtagctcctctctactggcaggtcatctctgcagctctcagcagtgagggtactcctctctgcagctggtcttcccatcgtctccagctatcagcagacagggtagtcttctctgcaccttgtggtctgctcccattctctctgccctcttcgtccttagccatcctctgccctgctctggctgagtacagagcttttatggagttcagagaggacagagtgcatgccagttggtccatgggcaagccaaagaggcaccatgagtctcctctcccgtccacaggactggcagcccggcccccagtgttcaggccagggacggcctgaaagtggggccttactggggaccctgcccccttccrccccggactctgtctgcctcctgctgccgttcatggccctggggctcggccccaaccccgctccgagattggagctggggactgggagcggagagaggccaggcagtgggagcagacacccctgagccttcagggacaggggcagggaaccttcctggggtgcccgagggtgcaggctgcagagacgccctgcacgtgggagggcagcagcagctgcagccaggagctccsgcctggccaactcggaagaggcagggctcccgcttgtccccggctcctgcctgcttcccaactgggagttccagatctgcagccaccagtgccgtggctccagctgcacccaggagggcagatcctgactgttcctggctcccccaagagcacaagggaggcttggattcacagctgtagtttaggtggcctgtagcctcacccaggagggcgaggctcctgcttgctcactagagcaggaggcctgggtctgtagctgcagtttgggtggctgcagaggcacgtagctctctttccaactcagaagaggcagggctcccactggctccatggagtgtgcagccccagccacgcctccctgctgcagctgacatgatggcagcagccactgtatcagtagttctatttttaattcctttaggatccttcatactgttttccacaatggctgtaccaatctacatttccactaagaatgtagaaagtttctcttttctccatgccctcatcaatacttgttatctcgtctttttgataacagttatactaacaggcatgaggtgatatctcattgtggttttgatttgcatttctctaataattagtgattttgagcactttttcacatagctgttggccattgttatgtcttctttggataaatgtttttatatctcttaatgacagctttgttctgaaaagtttcttttgactataactgcctgatgattgttcagctcacttatatgtggatgagaaatggaatgataccattttacatcagcaatttgaaaacttgaattaaatcattttattttctcaacctttgatggcagccggccttggaatttcctgaacaatgagatgccagctataaaacaggtttacctttagttacaaattcaaaaaatcctcttggctaagtttttttttttcagtacttgcctgtaaatcatagtgctgaaaagtgcttttgaacattgtgtatctagatactgctcctcatccatggtggagatgctyatttgtcccagcttctgaatttgaaactactttggcagaagttctcatgagttcttggagaccataaagcaaatcatgggcaattaaaacaaaggtctctcccctcgtgtctcagatgcacacctgaaaagaatcatcctggcaggtttgactgataaatgggctggaaaggggatgcatggcagcctggttcagcaggatgccttgactggtggcgataacacagggtctggggtgacctgtccccgggaaacgaaaggtcttctcatttgcagtcattaatcacctcaggaacagccgttttaaatgctcaagcctaattgatacggacatggcacactcggccgggcagctggaagttaatgcattttcctgtagcgaggggargtgttcgggacagtcgcaggcattcagctgtgatgagcatgaaatttcaggagggaggtgtgtttggaaggatcgagcstataggcgaaatttcagaaattgagtttttaaaatactaaaagcctgatgagaaatctcaaagtgtaactgggtgtctgacagaatattttaagtgatagagagtttcagctaaggaaaattactgtcaccaaggtttgttactcataaacctcatgacgttaggtcctttgtaggcttataaactatgtagggtacattcagatgttattttaatttatggttggcacacttccttagcattgcagaattttccagtcataccaaaactaaactggaaggttgaaaaatgtgattgatactaagttttgaagctgagattcaatttgagtaccttgcttatgaaataatatatgctgaagagtaaactgcaaaggcacttttgttatggatgtagcaacttgcaggcaacctcagaaataaagaccagacttgatgttcccacttatttgggtaacacctactgtttttttacaaaaagaaagaagtacattgtctcaatttccccagatayatctagragctccagaataaattcaggcaatttgagactcacaagtattaaccagtctctaatgggtagttggcaggcttatttctgatcagaaaacactctatattatttgtttctccatcttttatttttgttttatcttttctctgacaactccttttaggtacctcaggatttggtaatgcccgcattaacctagctgggaaactccagataagaacatcatttggaataggtctagtcaggctttgtgtgcacaaatattttctagaattactctcaacacttaaaaactcatttttcattttctctaacaatttcagttttgaaaccgtaagaaggaaacaaacttcttgtgatacatcatttcattcttgtctactcatcttttaaatgttttcctaaacatataagcaatgttgaaataaaatagcagccacttcatatgttggatcttcctttttttccttttatctttcccactttttattgaacttaattctgctctgccagtgcctaaaaatgatgttattattcggccacatttttaacctcaggtgcaaaggattaattatactgctacaggattttctctgaaggcagagtctgaataggaatttattgattcaaatgtatggctaccacctaataatgaagtgcttcgaggactgaacaattgtgtcaagaaactgtctccattagaggaattttattttctctctaaaactcctgggaaaaaattatagtacaacattgttttagagatatgctcaatgatggtggatgaacacaatgacaataaccagtgagtttatacactttgccataggaatcaacttatatataatgttagagtccccagtggagcttcatggatgtcatcttgtgatactgaccactacttagcaaaacagacaaacaaaacaaaacaaacaaaaaaactttgaaagtttgttttgtatcttccttgaaaaaaggtttcaggttttcgtacttttactgagacattttcccctaagaaatgaaaaatgagtttataactttgatcttgtaagctgagtcacagcaggcctgaatatgaagcagctgaaaacacgtgtgtgcattcctaccccatgcagcattctttattctgcagatccctgtcactaaagaattcagttaaatacaaagaccctcaggtagaaacaggctgctaagagccgcccccaagtctgtgagtgagctggagacagccactcatgtatgtcagccctgctggaaaggccattagtaaatgcctagcactccaggctaggaaatggtttcttggaccagaagcaggttaaaaataattaaataaaaaacaggggtgggagaggggaaacttgcgttaagactcttcggtcccattaaaattagcaagcatgcttagggctttattcattgtgatgactggatctacagggaaggtcttttgtcctatggcattcttttttgcaccatgaatacttgcagtattatataattgtgatattataataatatgagtcatagatagtatctgtgactcatttcagtttcattaactcttgacaagtagaacgttcaaactggaggctttatagcaaaatatcaaatgtcaggtcaaaaaatgaaggttgatttcaagagtcccaacccacatcctattcttgtgactgcaatttgcatttctataatacactataatcaaggactgctcaataattttataaatattactaatattatgaaggcttatagactgctgtaaatttacacagcagctgggtaatctgtttagagctctggtgttttccgtttttacgtttgctggttgctgcaaagctctaggatatgggtagtgaggcttacgttatagtcttgcgcggttttgttatgacataggaaggagagcagattttggccttaaatcatrtaaatggtaaagtggcaaccagagacttgaagctatgactcatagttcatgcaatgaacctctgaaacatttcatcaggtaaaccaggaaamcgactttcactggaaagtcagaacatcaagtcggttttacatcatttttatgcatcatattttattatatttgtcatagtgcttatttgctttcaaatmccataaaccctgttaattatagtcaataaacagtttcgaggatttttttgcttacttatacagctggttactatgcgatgagaggcaaatgacaggcatccagggaagtcgtgtgtttttacccaytggtgaaattgacrgtcaccagccacccatgttgattctaaaatgagggcctgaactttgcttttgtgctctagtggtgggtaatatgctgacaccacagctcagatgtagagaacaattyttgctttcctctctctggagaatgacaggaattaaaaaaacattttttttttcagtttgaattaggcatagaaaaattttgtatttgtaatgtgttagcttccttatgcattcccttctatggctatttgaagcatctttgtctccaaagatttccaggtgtctaatagatctttatattcagtaacaaatcatttctgtccatgagccttttgggatgtataagttagtattctttgcagtatgttaaagcaaactaaatatggcctgagaaggactctgtacttttatatttgagtgcttgtggtgaactgtaacctagcttaaaggcagatgagattgaaaacctaatttagtagtatgcacctgtaacaatagccaagtcttggccaatcccagtggccagaggccagatttcaacctttcatacactgctcaatgttcaaacgatgttcaaataaggcatatacactgacctgtaaccaaccggcagttctgtactctccttccaatttctgtatgtcatttccattttttttttttttttgtctgtaaatcttcttctaccacgtggttgcactggagtctttgtgaatctgctgtgattctgggggctgcccaattcgcgaattattcattgctcaaactcctttaaatttaattcagctgaagttcttcttttatcacgtaccccagaactctgtggaacaaaagaagttttctttccgctgcgacccggggcaaggcactcagaacctctgggaaattactcatcagtgaattaaggaggttgaattagatggttcatgtgtaaggctttctgattctgtgacattaccacaggtcccaaacataatgcagccagatgagacctcattgaatgttatcaggataatggagcaaggaggagaccactaattatgcccagagaaaatgatgtctctggaggctgctgtggctattccagttgaagaaattctaataggttaaagatgagaattttcaaggtgtcatgaacaatggataactgcttacaggaatttccagagattaagtgacaattctctgtctattttatgctttcatctctcctcttttctcacctttcagcctctccctgttaattgacattatttggggtcctaagcgtgttttagtgtatgttatgtacatacatggggttaacacaagtattcatttaattattgttttacacgttaagtatttatttatttcatcaacaaatatttactgagcatcttctctttgctgggtaccctgttaggtgctaggattacaataatacaaagacaaacttggctcttgtacaaatgagacttacagtctagtgggaataaaatactatatttgttgttttgagatgaatttgaaatgactaaacttttataactaagttactctgcttatttgtgggctttcatttttttccttttacagattgttaagaatttatatgaaaaaatagtccccgttcttccctgttgtacatttttgggtatccagagtgtgctactggatactcaaccctttacagtatgttcttatttgcatttgtgattttaaacagtaaaaatgctctccatatactgctgtatactttatggtagaatccaaagaactctttggaagacagaaggtttctgagagtcacaggactcatgagaaaccctagcatattcacttgtgttgcagagttcctatacaaaatatattgtatgtagttcctgactgtagccttttaaagaaacataattgtggagttttgtataccaacttcgaatccattttcgttgttactgcttttatcgccttgaactaaaattgtttgtttcaattacagaccaagcttgtggtttcctagattgcttttcacttgctggcaagggcttgcaaagaagacctacaagagccatgttaaaaacgcttgaaaaaaaaggtagtcagaggaacaaggaaaatgctgcttctgcttcatcacctccagtgctcagtcatttctcttaaattcctctggactccccacaggccttctagctttggcaatgaccactatctctgtagcctcagaaaaaagcaaaatggtgaactttggtctttggtgttagttgggaaccaagagaattcagtaaatttttaacctctatgtaaaagccatttgctcttttttctctttgttttcttttattgcttttagtattacttctgatttcatgatatatctccgatatcatagastacatttcaaatctaaatgtatacctttatatttttcttaatataaagcactgggtcttaaataagtattagcttttatacttagmaataagaaaaaaaggaattttgaagtttaaagtttctattgaaatggagcaaatttgctaggcaaaaccrccccccaccacacacacacatgcacacacacacgcgcacacacacatgcacccacacacgcacccacatgtgcatgaaataggaaaatagtatagtctctttggttccctgtttgcctccttgttattaccttcttttcccctttcttctttttcactcttccttatggcccatctaagcacattttgttaagttatttgtcttctagatgttgtcaaaacacacacagtgaaatggatgcatatatccaaatgttaacaaatggataaattaaaatacttatataatactctgaagattgtagcaagagagaagactacatacctgcttaagatgagaaatcgccrtgtgtttctatagcttccagatcctcttttttaacaaggagaaagaacttccctgctcctcaccaatggcaaagygtctaaaatcactgagtactcactaattcctctgaccactcacatatctcctgtcattctcctagaattgaatttctggttctccagtgttgctccattggytctcctcttagttgcactttttggagggcagattgctttaacatgctttgctataatgtactctaaacatgcttaacgggaagtgtgaaatcaggttattataagaatttttctgttctttgatgctcaaatccattctaattggtagcaaatgttctcttgtcagtccttgtagaattttaaaatattcttgggaaatcctaacagatattataaatactttttctgaatcagccttattgagggcagaaaaaagaatgagggatcaagagtattatttccagattctctaatttgcatggtgaaactcaagggagtcttttctctttacttgctttctttttattcactataaaatatcactaactgccatagatgcaaaacacctacaaataaatgaaacttttgcaacattctgtttttcccttagcatgaaaattttccaactttggctcacataaaaattcatcttctttttctgtaatgatgcttmcccaaaataccaagaagatacctacaggggtatttgtctttttttttttcctggttgccttacatatgatttctcttcccttgtttgggaagttccccagtttgtgaatcttagcaggattcagagcttgcctctcatcattgaatctaggaagttccactattcagtatcacagccaccttggctacaggacatgtgctagacctagcctatcaggaatacccactcggtactaatggacagactacagagaatgggtgatggtctactcaatgtgtacagtgatgatagaaacatcagtttactgaagtggcagtggtggcagttccagtagtcgcatcctgtctctgcttctgatgttggtgtagttagctcagctagctagctgagtggtccagtggaaggagcagccttaaattctgtggcatgattttggttgtgattgggtagcctactgttgttcctgattgttttccagtaccttccrtagccttctcartgattatgtgggaatatccaccatcgtttcaattaattcartttctgcttaaagcagccagtcttagttttgttatttctgttatttgcaagtaagaacctagattgatagggagtttgaaaccaggaatggttccgggaaatagaaccacagaaaaattgggggaagctgggattggtttgtctgggttagttggagctgaaggtagtgaaaaatccagctgcataagggataagactgacaccccataacatttggtggaaaattagcaaataaatcatctgtgaacttctagaatgagttgctaattgaaagaaaaccttttgggaaccaagcagggacttccatgcaacaattgcataggaatgaggacttgaaaaactgggctggtgtgatggctgcatgtaacggtggcagacagcttaaagaaagggaatataagctcagattcctaaatattcttacctaaggatggattgaaaaatagggactttctaygagtacactaaaagaatctcttttgtactatatataaatattacaaatttattttgtaactctttcagggttaaaaagtcaaaagccaaatgcagtaatgcaagttgtcaactaaggatgtcatttgaattcacagctaggtcccttattttggtatttggtttgggtatttagagaaagagtgggactctgggaactagaacaggggatatggtaggatttggtgaattcagggcaccccgaatccctaaagtccatcaatccacccttgccagttrgagcagccctgtgrccttctctgatgaggctattcgtgtcttgatggaattttctgccatctgaaggagttrcattacaaaggtaggtcagttctccttctgccctactcccagatgtgtaactaaacttagatcccagaatgcctcaaracrccaatgacaaagtcaaaggtaggaggtgatagcttatggtgctaaaaakttgcaagactttcccaattgatactggaaaatattctgggggaatatgtatgataatggattttgaaagttttaggtcaaatagagaaaaataccactttagatggcttgaatttattgctataagagcacttaaccagaggttctgaattcagtgtactagcataaatagatggcattgatctatttatgttttcttgactggttgaccaaaactgggactgtggcaccaatgagctgctagaaattctgtcacgtactactataagagcaagaagtccaagcacttagggagataatattgttggaggggatatatcatrggtatggagagctgtattccaattgttttccttgagagggtcctgatgagatgctcttcaacaagagcctaagagatacagtgaggagggaccaactggcttcattggaaaaaaaaaatttggctgttctctgtagacctctgatgcttgtgaagtatggtaccrttgaaatgggactccctaatcttactagggatattaggatcctggggtaatagagcttaagcagcagcaccttaccatcagaaagcaaggtgggtaggcagcatggcttccataataggcagcaggatgggtatttaatcrggatgaccaggaatctttgggaatggctactgataatgggattcctgtgactgaaatgcataggtgcttagctatgccacctgatttttacaaccaaaaaactctgggtcttctggcaaatggaggcttgatttaagctattacaataggaaatcatagcccccatcygattgttcccagacaggtcagttcataagcccaacatcccttacatggaactaaggtcaagaacttgctagatccggccctttgaaagagtgtacttactagagtaattggrgaaatggaaatatggagagattactggaacatgtgtcctsttcaggataaagtttctagtaactcaatacatgccttgatctttggtatgcatgtatctatctggcaaatggattttttttttttttgagacagagtctctctctgtcgccaggatggagtgcagtggcatgatctcagctcactgcaacctccgactccctggttcaagcgattctcctgcctcagcctcccaagtagctgggattataggcatgcaccaccatgctccagctaatttttgtatttttagtagagagggggtttcaccatgttggccaggatggtttcratcttctgaccttgtgatccgcccgcctcggcttcccaaagtgctgggattacaggygtgagctaccgcacccagcccaaatgctttttttactaaaggcacataagcagagaataaacagtttgcttgtacctcataggggcagcagaataacttcattgccttgcttttaggcctctrtcttctttttggctctgtgttaccattttgtctgcaaggtttcacacagggcaccatgttagtccaatatattgtgacattgtgctcataggatcctgggagtaagatacattaggtaccactgatgtcttggtgtaagatgcacatgtactagtggaaaggagacatggcgtccgcatgacagtgaagcttcattctctatgcctcaccattttcacagtaatgatcactgtgttttagatactttattttgttctgagaagtagctctaaacaggycacatgctagtgtggtgaagacaatgaagaaaggggaaaatggtttgagaaagttgcagttcttggccaaaaaatgaaattgctggataaatcaaagtagaaagttacattgacaaatagggctgagttatgaaatgtataatatgctctatccaggtgttgccagatgaagagtgttcagctgtgttatacagtgctgagaggtccagtaagatggagactgagaatgaacagctgctgtagaaatgtgcagggcattggtgtgatagacaagagcagttttaacggagtggtggactaaaccctgtttgggttgagtttaagagacaatagaaggagagggatttggtgatagtaagaccaattattttaagaaattttattgtaaagaaagtaagagaaatgcagtggtgggcagagagaggaacgggatcaaaagagggcttttccttaatattggagaatagcagctttttgtatactcatgggaaaaatccagtagagagggggaaagcagtgacgcaaaagagagtggggagattgccaaagcgatgaccttgagtaggcaagacaaggtggtctcttgtgtgcaggtagaggggacagccatcaagaggagcacagggagtccgtttagtgacatgagggatggtggggcactgggtacaggtgctggtagatgggtggtggagcttgtggaagaactgagggcctatatgtaagtttctgtatctgcaaatttggaggctgtgagaatctttagatcgtttaggaatgttgttggtttactctgctgttggagttttttcacctattgtccagtgtgtatgacagcaaagtctggtgtttcattttacatgaagatgatataatcagcgtctattacaacattttaatatttagcacttaaatatgaactataggttgaaataaattagaataatagtatgtgatggcttcagttttgaaacggaatgtttaaatccctaatgaatcttcaaatttatatatttattcaattaactacgtctaaagattttcctctccactggcttcacagtccatattgcaagttttagtgtagaagttagttataatacagtaattatactgtgcattaataggttcatggtaatttataaatgcaaaattgattttaacgggtcagtcatgaagaagtcacctggcttaattaactgttgaattcagttaagaaatgcattttacgaataaaaaaaactagattaagttaattaattgtttggacatttaaaaagtatagccaggccgagtgcagtggctcacacctgtaatcccagcactttgggaggcagaggcaggcagattgcgaggtgaggagatcgagaccatcctggccaacatggtgaaaccccgtctctactaaaaatacaaaaattagctggacgcaatggtgcgtgcctatagtcccagctacttgggatgctgaggtaggagaatggttgaacccgggagggggaggttgtagtgagccgagatcgcaccactgcactccagcctggcgatagcaagattccatctcaaaaaaaaaaaaaaaaaaaagaagtatagcctatgtggggaagattttggacattaaaaatgataattataggagtgaaatttatgtctagcaaagggaagtacaattctgagtccatatctctgtgttttcatttttatgctccttgtatttcgacctatcacccttcaattaattcttattacccgatttgagagaaattgtgtttttgccctgcctacttgaagttaaaacattaatttgaaattagattaaaaggaaataaaggctgctcattattttgtctgacttccaaagacagttatttatttatttttttttgagacagagtctcactctgtcaccaggttggagtgcagtggccgatctcggctcactgcaacctctgactccctggttcaagcgattctcctgcctcagactcctgagtagctgggattacaggcacacgtcaccatgcccagctaagttttgtatttttagtagacacagagttgcaccatgttgaccaggatggtctcgatctcctgacctcgtgatccaccctcctcggcctcccaaagtgctgggatcacaggcttgagccaccatgcctggccaagacagttatttctatattacaaaatcagaagttgccgggcgcagtggctcacgcctgtaatcccagcactttggagaggctgaggtgggaggattgcttgagctcaggagttcaagaccagcttgggcaacatggcaaaacctcatctctacaaaaaaattaaaaaattagccgggcatggtggtgcgtatctgtagtcccagctacttgggaggctaggtgggaraataacttgagcccagcaggtggagattgtagtgagccaagattgagccactgcactccagcctgggtgacagagtcggaccctgtctcaacaacaacaacaacaaagaaaatcagaaggtataaaaatttgaagatttaaaacaaattttcagccaaaatattttagcatatttaattaggtgatgtttccgacaaccaccacattgaacatctattgtactcgtcagtctttatataatccataattccattctaaataagtgactcagcaccaccatctagtgcagaggccagagcttgtgctagctcattggaaatcaaaggagaaaatattaacatgacatgattagaaaaygttcacatgaaagatgggggctcttttttggtttgctgatttgaaatatttatttaaataaagtaaataaggagagctttccctgtaaatacttatgaacagaaatggttttctgccatgtttgtgaggctttctattaatatatatgtacttgaataggyttctataattaaacctaaccacaatcaaagactgtgattattattcagttctattttcacagcagaccaaattaaacctctatgtcagacttgtagtgaatatcacagcagtaggcccagaatgcaggctttttattrcgcttgggcatttttgcaaatctgaagcattttttccatggtgagtggacatgaagtctgggaagaggtgtcttcgttacttcgcctctgcctgtaggtggggtgagtcattgcctatacagggtgatatggagaatactttcagcacccttcctttcaaccagtttgtctgtctgtctgcccttgctgggatctgaggtttctcacattggggagctctccaggagttaaagcattgctatctgctgtgcccaaatcataaacaaaggttcattaattgcttaaaccattgtcatacaaagtcatgtggggagtgcgcgctctggaaggaacaagacatcggggagagaagaggagttgggcctaggatgggccatggcctaggaccactggtcagtaaggggacagactaagagcactgagtttttaggggtgcgatgtcactgcagagggtggaggagcacccaaagaaagcatcatgtagtcaacaaagctttgccatgtgtgcatcttataccaaggctctgtgctaggtatgggaacacagagatgaggaggacctggtgccagcccgaggagcttacatccagcagggaaagtagatgcagagggtactgggatgrcacagcctgatgccccaggtttgggagacacagagggcagccgccacccactggtgagggattcttgtttatacacttgcctcagatttatgagttgagaggggctccccttactaggctgctctgtggtatcacattttcagatgccggatagagtgtggagggggcatgttatggtaccatgctgctgccaggtgctccccctcgaaaaaggagtttaactaactcttstaagcatstgtctgaagacaattagtgtgaaaaggccctaactttatagtctggcttcattttttttattagttctgggccctggaccattcaatttctctgaggcttagtttccttatctgttcaatgtggagaatgattttccaattttccccactaggtagttggaagaggtaaatggaataaatactgtatgtggtgcatagtagatggtccagggctatcagccctgttcmctccatgccccacccccagtgcaactgactaatgacctgggctggtctggatacccacctaatawgggacccgctgacagggagggaggtggacggattcatctctttcttaaagtttcttgctctgtgtgaaagggaaactatttaaatgtgtcatttaagagagggtatgcatcaagctatttagattcttctgaatttggattcagttcactacacagcttttttggtttgctctctagataatttaactttcataatttggatcatagcacaacttggaacttcttattcacaatatagtatccttattctcagcagtagcatgatttcacgttcagattggcaaatgtaaaaggacagttcactgagcaaatatattaatatggagcttcatgtttatgtaatgacgttgggctttgtgtgctctacagaatgtacaggggtaattagatatttcagatacgtgtctagacagggcagagcttcaggagcacttgctcaaccctgggaaatgctacaagtcacccatttgtgaccagaaaaagctctctgtgattaacaagttaaatgtggagttaactgtatggcactagatttatacccaagaggaaaatcagatctgatgaaatttgtcaggactgaccatttgtmgaaccagactaggcctaactttgcccagtgtggcctgatttgagggtgctcaaagtgatatctttcaaatatctttctatcatccagctatggggcttggattctattcttagaatcacctctkcaggttaagtcattctgattcaaygaggctcctataaaatgtgagtttgttccttgagagagttgtacattgacctagattgcttagactcagggacagtagtgaggaagcacacctcaggatttgatgtgagggcaacaggaaatgagtaaacatttgaaatagagtttgcttcctgaggagggtgtgcgcaggcagagagsgctgaggggcagcctgaggagtaagagaaaaactgactaatggggcacgtgcccctgtgcgtggaacatgggatgaacctggcttagcttcagccctgcgcttgaagagactcacctggtgccctgactgggattattttaaccaaatgtaaaagtatctagaagccagcccctttctggttactttgtggttactrcatacagtactttctgatgctgaagacttaatartgtcagccttgaagtgtaaaccttccgagggcgatgatagatgatagagaatcacatgccartctttacctcttgggtgccctctcccagcatctcatggcctctgtagcaccccctccccagcgccaggaatctacaagagtacacatgacagcttactcattgtgaattgctagttgtgagatcgtccataaagctccattcctggtatccaagagagatcttcaaaagtaggggccagttgaacttggaaagtacaggcttcagtgtacagcttccaagagaggccatctggctgctgctgctgctgccagcttccagacggaagctgagatttrctattgatgttccagcattgatygagctcctgcctcgtctgcatcaggcatggtcctygcagcttcacgcaggtatttcatgctattgcaaattgttgcttgttagtattcctcccaactagttgtttggagtcagctagttgttagtatttttactctactgactagaaatctgagactttgaaaggttaagtgatttgcccaataccaaacagctggggaatgagagagccggaatctaaagttagaaatgtcagcctccccctgctaasttctgctgttggtaagggtatttcctctccctctggggctttctattgctttcagagagagagtttgcaagctgaaggaacacttaacttgagaggctttcccaaatggagtataaaatgccacgaggaaataacttaaagatagggtgctggagatgcgtctaagatgtgaaggaatgtcacacatgtgcatggctcacctcgcacctcattttgattcctcagtggcttttagggtcttctcctgcctcactccttttagccccctggcctggtcttacactctgcccatccagaatgaaagcaggcctcctacgtcttcgcagtggacatgcattggcactgaacaacatgccgtgacctcttttatacctcatgcttgtcattctttctgtttatctcgacactccaacctaagctgtgaccttggctttctctccctggctccaattcatattctccctctagtggtgctgcctctggctgccctaggtaaatcctaggcctccaaaggattttctcctttgactcttgccttcttggacagtactctgctgctctcgtcccagatatgccagtagaaaccacctattaatccatgagccccaaggatcctgaagcatcactttgcctcctatctcctatggcgttgacagtgytggccataaccctgcagtacctgcacccagccagtgccagcatgtgagccttgttgacagtctgcagaggctggttggagctgctaaccctgtgcttccaggcccacgctgtttggttyggttcgagttgcccttcagagccctgcccagccctgacttggaagctgttgcttattgtgtcttagtgtggagcagtggggcctgaggcaaaagtatattgctgctgcttcattagtgaaagcatcaccagagaaacagaagtggggaacaagagaagtgaagcaaagaaagagagtaaatataagagctgtatcattgacctgactactgcttgctagcaagtacagctgattgatcttgtgggacatatgcagagagrtgccatgtgggtgacttgtgggacacatgcagagagatgccatgtgggtgacttgtgggacatatgcagagagataccatgtgggtgacttgtgggacatatkcagagagmtgccatgtgggtgactgcacttcagggagtctttctgggggaaagtaactccttcactgccttccctctccccttggtcaaagtctgccccaaggggcatgaattctcttgcacttctggtttgtacaagcctagaagtggccagctgatcatcccacaccttattagcaactcacacctcatcagcaatagacaagaaatcctgggaaggagccaagaggggcttgctgtacccatgggtgacttgaggggccatggcagtggcatcagaagtgacatccaggtctacacctgtgagagcagcacaggccatgttagatctgctcagcctggcagcaggcaagtgctcagcccggcagcaggcaagtgcacaggtctggatgatgggtaatctgaatccagtcacgttgagcagtgtaatgtcagtgcagcctggccgtttgacttgtgtatgctgctgggaaacttcttgggcatgtaaggaaatactcagttttcttttccagttcccagggttgagcatctttttgaggggtctctcttatatgggtggggcctagctgagtgttctctgtgattggggtgaggggggaagggtccagatagtgctacactagtgagatgcttctcacaataagaggcagaggagctgctggtgatcgtggcactgatcaagtattaagggctcatgtctctggaaagcagaagtcctggtacctgaagccttgtctaactgtattcatccattttcacactgctgtaaaaatactacgtaatttataaagaaaagaggtttaattgactcccagttccgaatggctggggaggccttaggaaacttaggatcatggcggaaggcagaggcacatcttacatggcagcaggcaagagagagagcacacgggggraactgtcacttttaaaaccatcagatcttgtgagaactttctcactatcacaagaacagcatgggggaaaccacccctgtgttccaatcacctcccactagatccctccctcagcacatgaggattrcaatttgagataagatttgggtggggacacagagccaaaccatatcgctgacctaygggcagactgtgcaaggccaggtactaccttccaggccatgccacatctccaccttctttcagcaccagtacaaggtggagggttttggatacactcccctgacctggccttaaatgaaccsctgtttgggaagatcctttacagacacagcacctccatcttcaggccagctcaacacagaagacacatgttgaagatcccagagacagagttctgaggataccttctcttcaattgtgaagtttagatgatatcaagcaaagtatttraagttctagagacycctgtgggcatacataagttctttaggtttcatttataccagatttctccaatgtgactcatctatcagctgatttcctgcaagagggtgaggtttaatctggatccattggaggttaaggtatttaaatagctaatggcctccttgactactgaccccatcacaaccttccttgacccaacttatctctacacagtaaaaataggcatcatcaaactgagagtacagaaggccttcacccatgcaaatgatactcataactaataatagccaataaacagtcttgccaagcagtgggagctagctgctctaaagtaacaaactggatctacttcccggagtagggggtggagtaggttccagttccctcggagcatgagaactactcaatcaggggcccctttttaggctctttatgcaaatctgtgcacctcatctcctggccaggcttttttagctgggagtttggggcagaggtgccaggccccctccagctgtagagctgggccccagacttgtttcgggaaaggaagtgatagacatgtgataacagggccattccggcgacttgctcagaacaaagggcatctgatccaagtggacttgctstctctactgctagaaaacagctactgttggcaatcctcaaatggtaattgtcccacaaaatgaaaacataagagtccattttcaccagtcaccctgttagaaagcaaagtcaccctgttagaaagcacagtctggctctcctgccgagcacctccacacttttctgcttatgtccccggcaagccatgtttctagccctttttcaaatagtaggacttgagaatcctacctcctgcttctagctccctcgatccatgctcatccctaacttacacactggggtcccgctggcagcccacctctctcattctggtacatagaaacagaaagcttggatccttgaagccatggagccagcccgggcacctgggccacgggagacgagccatcacagaatgcccagggccacagcagcctctcaccaggcaaacscataaggcaagccctgcctcacccggctgtttggggaagatgggtagcctaggcatgggtggggtctgattctgcacggtgactttgccatgccaggccccacataaaaagggcttcccacaccaccacaacgttcatgacctcgcttcagagctgtttgccgtgacctacttcacactcagtattattctgtccactgagcctcctggctgctgacctgggagctgactcactttcctgtttacagccttgcctcaaccctcactcttgatggtggtttacatagtttctctggcaatgatatttgcttcctttttgactagagttcagattctcttctggccagacagcctctgactattctggtgaaaaatatgccagattgtccctggcccccaggaccctttgtccttggtttggcttcttaagagcagtctacctgccggacttgcctttatatgattggggtagcctcagtgtaagagaggaaggtgggagaatggaaaagggagggaaggagctaggagaggaaggaagaacaagcccttttctcctatgaatccttagcgccattgatacagacattaaaatgaayaccaattatttttcccccttgatttttagatgtgtttaatccaaaagagctatagcaagtgatgtgagcctattgtgagcattcagactcratagtgctgttctgtagcctaactggagtgcctttatttttctatgcacaggtaggtattttctgacaactagttctacatttatatctcaaataactcttcagtgagtacccagatttaatgagatcagtgaagtttggaaacacttcsatcattaatcttgtagttgactatagaactaaattaagtggcaggttccttctgatggttacgtacttcatagtaattatagttcaaaaatatgatatttttgaatccctgttctgttgataccttcttgtttgggaaatcaccttacccacagccctgccaaaaccttgggcttggatggttgtgtttctaccatgtgaccctcagttcagatgtttggaccagtggtggacacttgaacctgacacaggcagtccatcaacctggccagtgaccaaccaggttatcttgcttgaaaatttaagcaaaagaatatagagagctaaaggacatagtcagttgttggtgggtgtgatactcttacagagtcagttcatgctacataggcaagctgaggttgtgagaaagcagaaaccatcaataagcagagaaagctggtttgcagagaagaggatgcatcaggcaggcagtgagtgaagagatgacatggacccagaaagacagatggggcacatgactggtgcctggtggtttctcagctctagactctgaaaggccagtctatactcttatttcctgcttgtcgttgtccatgaaatgacttctttgatcttacagcaaacctcaaccctaccacctctttttttgacataagggtttctgttccttatagccaaaaaaccttgactaaaatagactactacggaggtgttgccagtagtggttgcaatagagagctataaacttatatcttcgtcattaagcaaacggtggaatgttttttagttgcttatttggaagtagaactaggtgtcattaaaatctgtgtacatccatattctccttgttaatcatttagaacattctagctttccacccttttctcacttgtgataatggtattggtttcatagggtgggtctttaggagtgctgtttgggggaaataaaaaacacccgaagtaagcttacatcaaaggacaagattgcttctgctggtttataatgggtagactttctgattatctgcaccagggacataatcttgattgccttgtcaagaaatccattgcccaattaactggagatttttatggctggagaaactccggatatatagcataggaggtggggcagggatgagagtgaggtaatccacagtctgtgttccatctccagcaattacaagttgcattcctcatcaaatttagcttctacatcaaactggcatttatctgggtggagatgtgtaaacagtgggtatcctgggaatggagctgtggctgggtttttttttttaatgagctaaaagagagggcactatatatgtttgcataaaacatacactgtgtacatttgcataaaacgtacacacaaaagccaatctgggcaataaagtcccaagttaagtaaactgttctgcggggagagtttctgtatctgatagaatggacagaaaaatgagcagcagttgggaaaaggacacttggagggtggtagagggagaactcatttacagcgagtggcagtgtagccatgtggctagacacttaggttctggacccagactacctggattcaaatttcaagtccacggtttagaagctatatgaccttggagaggttacttcatttcttagtgcttcagtttcttcatctgcaaagtggaaataacaatagtttctacctaataggtttattgcaaaattaaaggaatcaatacatgtattatgcctagagcagagtctagtctgcttagtgaatgctacctatttattattattctgtaagacataacctagtgtgccaaccasatgcaagatgcagcagaactaaaactgcatgtgtattctattcttttcctgatgaaaaatccaatagatttactcttttactatgaaatgtgtgtgtattggctgaaacgagaaagaagattcataaaagagctactaaaatgaaggtgggaagagagrggctttcatatacagagtgaaaagagattgggttctggcctggaaaaatgaggactgagatgcactatgttgagttttatgaaggataggaatagtatgaataataacttgtttatggaatactgggaaattagagctggcacgaaagatgaatactttgaggtgaatacttgaacagatggttdcttgacagtgcctgcacagtgagtggttcagttatggtgcttattagctcagaatttttgagagcaatctggaaaaaggctgtgggttagatgattccttaactattgagggcagttagggatgtttgtgatggagccctagtttagttcagttcagtatttgtaaataaattatatcaatatagtrccttaaaaaatggtttaagcactctaatcattcaattctcatgatagtcattgactgagctttgactgtgggcaagactctgctgggaatcaaaagatgagaaagatgggtcgtgttgaagtttccaatctgtattgcacccagaagcaaattaaattaatttgagggcttaatgtatttcatttgctcttacttatattttgaggccagagaatttttagttattttataagagttcgggattgatattgtgaaggagctaaataaataaaagttctctttttgctattattttgttttcataactctacccaggctacactctaaagtgagtagaaaagtttattttaaaatttatttttatttttagtgtagttgttcataaaaagcaattttagagttagaatttaatgtagagattatcttctaaagttcctcattttacagataaaggagatgagcccctgagaactcaggtgacatgctcaaggcagcaaagcttggatrgaagcccaggttctagtcttctgtgttttctttcctatccagctgcttcccccaggaggatcagggtaattgtagtccagcttatttctgtgtacacacaagctgaaatgtgtaatgttttatctcatagtgcccagaagcaatttaccatgaagccagtgaagattcagctcagggcctctcacttataggagctttggggtgggaagaggaagccaggttgcaatcagcaaacatttctgtaagcacgtctggtcaatgacctaaagagatactgtaagaaatggactcaaccctccccaagaccccagtaatttgttgtgatctttttcacattctaaaataaaagaaactcgcttttgtacctaattttgaatttgtaattttgtattttttttttttttttttaagaaatgcccttctcttgcttcaagattatataaatttytggctctgtgaaacatgggtcagcttctgatgtccaaacatacaatcacctgggaatttcatttaaatattttaaattttatttctaagtgcatttttattaaaaaatttgggctgggcatggtggctcacgcctgtaatcttaacaatttgggaggccgaggtgggtggatcacttgaggtcagaagttcaagaccagcctgaccaacatggtaaaaccctgtctccactaaaaatataaawatatatatatatatatatattagccaggtgtggtggtgggtgcctataattccagctaccggggaggctgagacacgagactcgcttgaacccaggaagcagaggttgcagtgagccacgattgcgccactgcactccagcctgcgcgacagagcaagactccatgtcaaaaaaaaaagaatacatttaaattacttttatttttatatttaattttaacttttgttatagtaataaagaaaaaattgtgttaaaatgttttaaataaaaatggcagccccttgcctcagccttccctaccccttgatattttctccagttaactgcttttaaatcttttgtgtttttcctaattttacctctatattatttattaataacttactttcttaattgattagttttagacattatatattgggttgctgtaatggtaggcaataatttaactaataaagtgcaaacaccccttgtttctcgtcacatttccccaaaatagttaagtcacaatttttgcttaccttagtcatcagtatttatattatcattgactgtgtaaatattattcacagcagaagcaattattagcctatggcatcctttctcatgtaactttttgtttgtcctagacttcataattatcttagtttcttttgcctaattttctgtgtatatgtcactgcttttccttttttttgtaaaactttttgttttccccagagttcataattgctttgattttccttctgcttcattttctgtgtatttagccaaatacatcatcagaactgccaaacatctatcatatcaatattacttttggaaatggtcaagcatattggataatctaccaatcctccctcctacccttttttccctagagacctcctcctgctctaatatggactgattttttttctagtgtctaaaaatttcatcataataaggctttgatgaggatgtttggtaaggatgacactcagcgggctctttctaaatcgtagggaattgtctacacattatatgtaattttacataagcaaagtttgaaartgtgttttaggtatctaatgtcatagaaggacttccttcattttctacttgactaggtttccatagtagggtggagataatgctcctgattctggatacagatggataaaatactatatctggattcctgaaatgcctagtgactaaaagtagaatttgctaatacataattctaatcctatttcttgccatatatattaaccttagggtcagtcacctgaattttgaattccaaatctcaaatcctatttcttgacatgtatattaaccttagggtcagtcacctgaattttgaattccaaataattactaagaatatatttccagacaatttcttattatcctcatactcatagtgacacttgccactgtaaaaactagttttaatataggtaagttaaacataattttaaacaatattttttaaacatggcacaaaattgttttacatattagtatttattagttgcattagaagctttacctaatagtggagaattaactatactagtatcagtaatagctttttatttcagtactttacatatgcagaatatttagttattttttactrtgtaccttcagagtaggccaataacattattttactttgctgaagtagaaattaaagtcattgaaattcatgattaagttttcttatggggacttcttgttctcagataattcatccccctgtaaaggaggattagtcttttcctagrtaatccacatgtaaaccatggaagacactgattttttggggaagtagacatttttttttcagtgtgtttcactatattttaatctcattcctttttgagattgttgcaactcaaatgttatggtattcagctgaagtcttgtgggacatggctctctactttcatttgatttttaaaaatttatttcctgagaatattgctgaaagaaaaaaaatgtttttaaatatttaaggtcttggttgaaacacttagccctggtaacctttacaagcagagattaagtatgcatgatcaaatcattctccccaaatrcaccgcctctggaatgcccctggcctctgcctagacctgtagctttgcagcaacgacacatygcaggatgcaccacccttcacccttccttttctgtcttcagcagtattgtccactgatagttgtggacagacatgggagtgctgaatccccagaggtaggggtagtctgccttgtatgccaatttttttcccagtaaggaattggatggtggtgggattcatgctgagggatgggtggggtcagagaaacaccaaccaaagattttgccaggattatgacatttcccctacagttttggatactttacaatgaattatttttctatttttatgtgttgtgtaaggggttacttgcatttatatttgtattactggatgcctaccaaaaataaatgtgtttactcagtcaactgactatgtaatcttttggtttgtttcatcagttagagtccacatcaygtctctctgaagaacagttaaagtgtyttctggatgaatgcatacttaaacaaaaatccatcattaaactttcttcagaaagaaaaaaggaagacattgaggacgtaacacctgtgttcccccagctttccaggtccatcatctctaaattgctaaatgaatcagaaacaaaggtccagaaaactgaggtagaagatgcagatatgcttgagagtgaagaatgtgaagcttctaaaggctactatctcactaaagccttgactggacataacatgtcagaagctcttgtcactgaagcagagaatatgaaatgccttcaattttccaaggacgttattattagtgacacaaaagactattttatgtcgaagactcttgscattgggagactgaaaaggccctccttcttagatgatccactgtatggtatcagtgtgagcctttcatcagaagaccaacatctgaaactcagttctccagagaatacaatagcaggtgaggcttggcgaacatgtgttttggtaaataattcttaaaagcacctcaatataaaggtattatggtttaaattagagtcgggtaagaaggtatgtttgtaagtcacaggtagcgtcaataagagtatgcaaacataaaacctatttcccaatgctcttatgaaatcaaagttgaggttagtactctatgaaatacgttattcttgatggtaattaattgtgtcatccagaaaataatgttggtttcacaggaaaagagaaattagtttgaatggagagaaatactttgaatagatttgcttagtatttcaacttcaaactttagtattttcaaactttagtgatgaaaatttgttctaaggaatgaatttaaaatgtaaaacttgtaactcattgtggttatattagtttctgtatgcaaacctcctctcctgagccactcctatgttctcaggtgtttcgtcacgatctagtgtttcatcttgcaatggtcatggtacaggatacaacaataactagttttcgacacaaacaaatattcaattatttatgttagaaatctgtgtaacaattggtgaatctatttaaatagattcaatttttacctctattgtagattactctaaaatatattggctattacatttctatctattaatctattccttattaaatctataatccattaactctgaactgagtcagatttcggttttgacttccatttccttagtcacccaggagcaaaatctgagtcatcactgaattacttctctttcttgcttcccacttccagtgttcaggtgttgtttgttctattcctgcggtgtctctcatgcccatcccttcctttctcttcctacaacttcaactggaccaatgccataacccttctcccagacctccctgcctcaagtctctcttctcttcctaccattgttgacaaccactaaacgaatttccttaaagcacagctttgataaccacacttccttctatggctctccaatgcctgttgatcaaaatcagaattccttaacttgttcagtgtctccatgatctgacctgaagttcttttcctaatcaatctctaagtagtcacctaaatgttattcagtgtgtagctaatctggtctaatgatttcggtgatttcctagcttctgctgttgttcaggccctcttcttcccagaaatgttcaggtaccccttcaatggtatttgaattccaaccttatcctctctgattgtagccttccctggtcccctctgttaagttttctgtcttctgtgaatgtccaagcactttggtttcctataggatcacatacacactcaccttctcttccttaaaactgcataacatttttaaaaacagagactctatcttgcaattcattgttacattttccatggtgtctaaagtgctgccttaagccaagtgcctgtttaataaataaaagaatttaaatgtataaccagttttagaataaaacactgaaaatatggttcacatttmttctttacattaccaatgaaagtaggtaatgttgcttaagaattatgtaagtcacacattctatataaatatttggattttttgtttcttacatgaaatttcgcaagctgtaatttttaaattaatattttttagattggcataattatatacatttgtggggtaaagtatgatgatttgatgtatgtatacaatgtgagatgagtaaattaagctaatttacattatctatcacctcacttaccatttttttgtggtaagacacttgaaatttactcttagttattttgaaacatacaatatgtgattaatgactgtagttaccctgctgtgcaattcatctcaaaatttattcttcctaagtgaaaactggtaccctttagccaacaactctccattccctttttccccctcttcatcccccagccactggtaactgccattctactctccacttccatgagtttgacttttttttttttttttgtatttttagtagagatggagtttcactgtgttagccaggatggtcttgatctcacctcktgatctgcccacctcggcctcccaaagtactgggattacaggcgtgagccaccacacccagtctctttcatcttttgataatagttgttataacaggtgtgaygtascatctcgttttgattttaatttacattttcttaatgattaatgatgctaagtattttttcatgaacctgttggccatttttatgtcttcttttgggaaatgtctgttcaggtcttttgcctattttttaatttttttttttttttttgctattgagttgtttgagttccttatatattttggatattaaccccttatcagatgtgtagtttgaaaatattttctcctacttcacagattgtctctttactttgttcattgttttctttgctgtgcagacactttttggtttgatataatcacatttgtctatttttgcctgtgccttcaaggtcgtattaaaaaaaagtcactgctcagaccaatgtcatggagcatttcccctgttttattctagtagttttacagttttgggtcttatatttgtgtctttaatccattttgagttgatttttatacatggagtgagataaggatcaaattttattattctgcatatggatattcagttttcccaacaccattccccattgtgcattcttgacatctttgtcaaaaatcaattgaccataaatgcatgagtttattactgggctttctgtcctgttctgttgattgacttatctgtttttatgccagtagcatgttgttgcaattataattgtgttatactttgaaatcaaggagtgtgatacctccagcttcttttttggtcaagatttctttggctattcagggtctattgtggttccatacagatttaaggattgtttcttttatatttctgtgaaaatgacattggatttttgataggaattgcattaaatctatagatgactttggatagtgtgaacattttaaccattaattctttcagtccatgaatatggtacatcttctttttttttttttttttttgagatggagtcttgccctgtcacccaggctggagtgcaatggcatgatcttggctcactgcaacctccgcctcctgggttcaggcgattctcctgcctcagcctcccgagtagccaaaattacaggtgcgtgccaccacgcccggctaattttttctatctttagtagagacgagatttcaccatgtgggccaggctgggaacatgggacatcttttaattgatttgctttttcttcactttctttcatcagtgttctrtagttgtcaatatatagttctttcacctccttggttaattttttttattagagacaattgttaatgggattgttttcttaatttcctatttagatagtttgttcttaatgtatagaaatgctcctgatttttgtatgttgattttatatcctgtaactttactgatttttttttgtcacttctgacagttttttggtggagtctttagcrttttctatatacaagatcatgtcatcagcaaagagagatagtttcatttcttcatttcctattaggatgccttttatttgtttttcttgcgtaactctggccaggacattaagtactatgttgaaaaaaagtggtgagagtgggcatccttgtggaaaagctttctacttttcaccgttgagtatgatgttagttacagatttatcttatatggcctttattatgtactttacctctatacctaatctgttgagaatttttatcatgaaatggtgttgaattttgtcaaatgctttttcttcatctattgagattatcatatggtttttatccttcattttattaatgtggtatatcccwcttattaatttgcatatgctgaaccatccttgcataccagggataaagcccatttgatcatgtgaatgattcttttaattgcttttgaattcggtttgctagtactttgttgaggattttcacatctgtgtttatcagggatattggcctgcaatttttttttcttgtggtattcttctctggctttggtatctgggtaatgctggtcttgtaaaatgagttcagaaggctttcttccacttcagttttttggaagagtttgagaagcactggtattagttcttctttaaatgtttggtagaattcagtagtaaagccatctggccctgggcctttttttgataggaggctttttattactgagtcaacctccttgctcattagtggtctgttcagatttttgtttctttatgattcagccttggcaggatgtatgtgtccaggaatctgttcacatctaggttatccaataaaatatctaggttattatatgttggcatataattttacataattaccctttgtatttctttggtatcagttgtaatgtctcctctttcatttcattttcgttttgttttaaataagcagaagttttgagcttaaagactttaaaaagtatttgttattgctttctaatcgcacaacaaatgtaaatttgttgaaggctatttgaaacatacagaaaagtgtagaagataaaatcattgtccagacctattcattgttaatattaacattcatcttttttctagttgtgtattttaaattgtcttcatattcttcttataatatattctgatatttttttcttttatattttgagcattctgtgttattaaatattcttctaaatcattcattatgatggctgcaatgtatcttatgatgtatcataatttaagcatttctttatttttggtcrtttatattaagactttttgtataagctaaaactatcatgagacaaaaatatggtcataatcattatcttcccattacatgatggtgtgatgagttcagaggatttgatttatttgagtttkctttctttcttttcctagttagtctagctaagggtttgtcaattttgtttatcttttcaaaaagccaattcttagttttgttgattttttctattgttgctagtctccattttgtttattttggctctaatatttgttattttctttcttctgctaactttggacttagttggttctttttctagttttttgaggtttaacattagattgtttatttgagattttttctttgataataagcatttattgttttatatttcccacttagaactgcttttgtcagcatcccattagttttgatatgttgtgtttccatttttgtttgtctcaaaatatagtttgatttccttttttcccccctctgacctattgtttgtttaggagcatgttgtttaatttccacatatttgtgaattcaccaagatttcttgttatagatttctagtttcatgccactgtgatcagaaaagatacttgatatgattaaaatcctcttgagttcattaagacttgttttgtggcctatcctggagaatgtcccatgtgtgcttgagaagaatgtgtattttcttgctgtagggtgtgatgttttgtatatgaatgtgaggtccatttgatttaaagtgtaattcaagtccaatgttttcttattgattttctgtctagatgatctcttcatcattgaaagtggggtattgaggtcccctactcttatactattgcagtctatctctcagatcatgtaataattgctttatgtatttaggtgttccagtgttgggtgtgtatatgtttacaattatgtcctcttaatgaaatgatccctttatcattatataatgaccttctttgtctctttgtgtagcttttgacttaaagtctattttgtctgatataagtatagctaacccctgctctcttttggttttcatttgcatggagtaacttttccatcccttcactttgtccatgtattttcttactagtaaagtgagtctctcacaggtagcatatagttggccttttattactattttttcaacccattcagccactctatgtgttttgactagcgactttaatccatttacattcaaggtaattgctgataggtaaggacatgctactgccattttgtaatttgcttctggttgttttgtagagctgttgtttctttcttcctctcttgctactttcctttgtggtttgataattttctgtgatggtatgctttgaatcttttccttttatattttgtgcaactattacaggtttttrtttgtgtttaccatcaggtttatataaaacatcttgtacaggctgggcatggttgtgcatacctgtagtcccatctacttggaaggatgaagtgggaagatcacttcagccaaggagtttgagccctgcctgggcaatatagcaagactccatctccttaaaaaataaaaaaaaacaacaacaaaatatcttattataacaggctattttaagctgataacttttatcacatataaaatctcaatactttaacgccctccccccgacaacttttatgatttagatgtaaattttacatctttttgtaatttggattcctttaacaatttattatagctgcatttgtttttaatagttttgttttttaactctcataatacagagaaaattcctttacacatcatccttacagtattattctgaatatgactatgtcttacttacaccatttagtgctttttgcttttataagttttatgtatcaattaggagccttttatttcagcttagctccctttagcatttcctgttaggcaggcctagtggtgataaacttacttagtttttgtttgtttgggaaagtttttatttatcccttatttctgaggaatagctttgctgagttaagtattcttggttgccagttttgtttttcttctacactttgattatattatcccacccttttatggcttgcagggattctgctgagaaatctgctggttgctgttttgggactcccttgaatattatacattcctgatctcttactgctttcaggattctttgtctttgttttattttaattttaatttaattttattttaaggcagagtcttgctctgtcrcccagactagactgcagtggcatgatcctggctcactgcagcctctgcctcctgggttcaagcgattctcctgcctcagcctcctgagtagctgagactgcaggcacgcaccaccatgcccagcaaatttttgtatttttagcagagatggggtttcaccatattggccaggctgacatcgtgatctgcccgcctcgacctcccaaagtgctgggattacaggcatgagccactgcgcctgaccgtctttgttttttaatagtttgattatgatttgtcttggtgcactcatctttggcttgaatttaattggagatctctgagctttctatacctggatgttgtcatatttccrcaaattttggaaactttcagccatattttcttaaatatattttctgggcctttttctttatcatatctttcttagaattttattataagaaagttagttttcttgatggtgtcccatagatttatgtaggctttcttcattcttttttcatagctctacatttttttcagggtccattattggggctttattagtttctttttgttgtgtcacatttccctgattctttctaaaccttgttgtctacacatttgaggaaatggccacctcttttggccttgaaggttttctttcacagtggtagaccttcactagttagtttagcatttgattatggataggccagctggtaacaaccccagacaggtacaccttgctgttggtgttgctgttgggccagcctgctggctgttctttgaggtcaagtggaacttctggctgtgctctgtggtctgatgagacagatcactagctggactccacagttaaggtggagctactggctgggctctgtaatagcctctgattgcacagggttgcatgttgttttccctggctgggaagtactgctgtttttaatctgtagctgggcaggtctgtgtgctgggctcagcgactgggtgaggtttctgctgttgtgctcagccattcaggatgggccaggctatcgtctagagaaacacatggatgcaggcttccctcagggaagccttaagcaaagcactgaggctttgtggggtcaccatgcagctgctggggttgggtggggccaggtacttttgtccatagatattcattcattgacctgcacttgcctcctagcctggcaagccttaagcagaacatgaaggcttggtagggttaggctagttggctgctggggttgggtggggcccgttgctaccctccttaggtaatcactgacctgcccttgctgcctggcctggggaaggcttaaggagagcaccagagctaggtggggaagctggctagggaatgaagcctggcagatcagttgactatacttcctgcaggacagtgctaatgctgttggccagtttctctggtggagtgcctccattggctagaatgcagagccactgcaagatccatgtgctcgtttctgtgagtctcacttttgttctttgtttctggctgatcctaggtggtctagccctgcctgtactcccagtgtttcccgggagataataatgagtgggcttcctgctcagggtcccagaatgttggggaagctgaatgtttgcctctctcttttcccactgtagaaactctgggcccaggggaatcttctgtgtgtggtgctgtgctggcttgaggtgtggcagggtttgggggagtggtgatgtggtcaaagtgaaaccattcctctattccacttaccccttgaatgaggcttttttcagttatgtggtccaagggggtgtctcagcttttcacgttcagggagttcaggagtattaatgaagatattcttgtctgtaaatagttggttggatttttgttgggggtatgggagctgagcaacacccattctgccatcttcctgastagaacttccagctgtaatgtttttatttagcagcagagttcacttacaaatgcaattcagttagatgggtgtggtttgctttcttcacaccaaagatcttcakttaataaatgaactgtgaaaactttgttctactctgaaattgmagtatattgtccttctttttggataaagtgtttttattagaaagtatctgaatctcctctgacttctgaaatcaaacttacaaaattggatgcaatcatttcttgtgtatgggatctcattcccatggagtccatatataggggggtttagaaaagtaatttgctaagatatgactttatttttatgtgaacatgagtcacactgatgcatatctgtcactgggtagagcatgacaagatggaatgaattggaacttaatgtgacttaatggaaagaagctatggagacatagaacatggctctgattataccagataatgttaatatgcaattataacaattaaccctgtgactatgattaaggtgtcttaggtgtgaatatgtgaaccatattttactttctgtttattacataataagctctaaggaataggtcttacattattactttgagcatgttagaatatctgaagttggagttttactaacctcattatttataattattaaaatagcttgctgatcaattttattctaaaatactaaattgtccattatgyrctttctacaaaagtgtgcatcaaaactgaatgctgtgtcagttttcttgacaaaaagccctttgaagacataactaatgaggagttgctgcgtgtttggctgttacatttctgttctacctccttctcaggaaatagatacacaagagtgtgattcggattagatttctggaagcagacaggaagaaaataagaaaagccatttattgttttctctttcaatagcaagtattactgatacgtagttgtcttttccttgatgtgctgaggtctgttccaactatttcaattgtgcttctaaaaggcagagtcagataaggcttcaaaactaaaaccaaactcagtgaccttgaagaccaatttaaatggtggtattgaaaaataaggatttgcctatcagttgtattaaaaattttcaatgtgaaacacattatcaatgtttgtgctttaagcttcatggtaaccagtattatttgaatttttgaatacaaggttcagtaaattcagcattgtactcactagttactggggttttacgggacaaataactagcactcttctcttccccacccaggtcagaaccgactgagagagagatagattctgacaaatggagatcaaggaggttcgctttattgctaatgaaatgtagaggattgtcatgatccgggtgggcagccagacaggcttccaatgctatgcctttaaaataaacgtactcacccagtcactggcagagatggaaaatctcaggcatcatctgtggagacctgtccatgtaaaaccaatagggtggaggagcgaagcatggagccttggggagcagggtcaggtgggagctgggtgctgactcctgaggaggcaggggctgagctgagcatgccatttcatctcccaaacttagcttcccacggacagtgtggagggtgtgaagtgaggccaggatgcttccactgcaagttcctccttgtgggagcatgaggagagtggggattaagtgttgtcaggtcacacttaacctcagagacaatcctgaatgtactggcacttccgaagcaaaaaggatcaggtctgtgagttagtctagtatttaatcaaattatctaatactgagttgctttctaggtaatcaaagcaaaagccacctatgcttgtatagtattctcccttcctactaagcatttgagctaattattaacagaaattcataaaataaagatgaacatggtattagcaaataacaaacatagtaaaatagggcaaaaacggacacaaaatcagttgtgcagtaaaaaatggggacagaactgcactaattctttaagaaaaacaaagtggaatttctcgttggacctgttgagtgaacagtattcttgaaaaattgtataagttagcagggaggaagggatagggagttattggttaaaggatacaaaattatagctttataggaggaataagttctaatagtctatagcactgtagggtgactatagtcaacaataatatatattttcagatagctagaagagaaggttttgaatgttcttaacacagagaattgataaatgaggtgatgggtatgcaatttacctgatttgaccactagacattgtatgtattaaaatatcactgtgtatcccatagatatgtacaattgtgtgtcagtttaaaagcctatagtaaatgcaacaagagtcatgtaagttttgttttctttttaaaataatacccctaaatgaaaactatagtggccaactgtcttggattgctcagaagtgtcctggttttaccattgaatgttccatgttccaggaaatcctcagtctctagcaaactggaatggttggtcactctaaattgaaactgtgaacataaaaccaaagagcagattagttactcaaaggaccaaattaagggagtccaagtaagtascagaatcccaagctagaacctagattagcagagggagggtggcctaccacccaccagtgggaagtggcctagtggttaggaacatgggttctgggtagggaagacctgggtttgaatccttgctctgctgctagatggagatcttaggtaagttagttaatttctctctctctcctctacaccttggtttccttgtctatcatataagatggcttaataccctgtagggttgtaatgaggatcaaatgagaacattcaaataaaatgattagctctgggactggacttggttggcttacatggcgtttaacattgaacattgtcaggagatttttccataaaaggctagatttctgacatttctgacaaatcagcaagttctaccaccacccacgggagctgagtagcagatgctccccttagaaggcatgtgtattctccaagaggacacagcccccacctagccctctctacttcatgggcttggtcctttggagacattgaatttccattccatgttgtaagtctcctctgcttgtagtgcartccaaccactgggagcttgttagagatgcagggcccctaagggcccacccacaacctaaggcatgagaattttcattttaataagatccctggtgatacttcccggcaataaagtttgagaagccctgttacaaactgcagagcattattcctaaccacagtgagtatcaagatcatctggggagttttttgcttgtttgttttctagctgtgtccaaggacctatccagacttgctgaaatcagagttcctgggatggaatgtccaggctgctaaattaatgctagggacaggatttcactgtgaacacttgagaactatagatttcagtttagatgaaagaaagctaagtatgttatcttattgggatcctcagataaaaaaaaagttctactaataatgacgactatataatctgaatatacttgaggctgaaattttgcccattgattgtaacttgctggatgaggcctggttgccggcagattgacttttggtaagggtgttgcagtggtttgaagtgggtgtgtgttggtatatgtccttagtcataccacctgaacagtttcaagggaactagattgtttgagaaaattttctttgttatagtatagtcttactggtttgcaggagagcggtgagattctagaaacagtgaccctattagctgatcttttccattaaaaatattttggattgctcttagggaagtccttaactcatcattgccttaatagttttctgtttgtctcaaacagggtgtgccttcagacctcatagttactatttgttaaattacttttccaaggctacacgttgcttcttcaatgcccttagtgacttaacctccctttgtctagtcaaaccaatgctcttccagagtttatttggtcaaaatatcagagatgccatattagaaatttctaatgtgaattcattttttaatataaaaccttagtgtatagtaagtttatatttggttaatttacatcttcaatttactttcaactaattttctttaattcttcttgaggtagacttttcatataaatatttgctgttgatcattttctctatcattttagcagtataaaatgaacaaaggcatgcttgagagttttgatatttaattgtaatgtccttatcactttatcagttattggaaacttctggttctgttgcttcattcaaattgggtaaagtaaaaagttactgaagatccgctattgtgactgtaaactaggtctatggactagtggtgtcagcatcaactggaagcttgttagaaatgtagagtctcagccgggcactgtggctcacgcctgtaatcccagcactttgggaggcccaggcgggcagatcaccagaggttgggagtttgagacaagcctaaccaacacggagaaaccccatctgtactaaaaatacaaaattagccgggtatggtggtgcatgcctataatcccagctacttgggaggctgaggcaggagaatcgcttgaactcgggaggtggaggttgcggtgaactgagatcatgacattgcactccagcctgggcaacaacaacaacaaaaagaaatgtagagtgccaggcccactgcagacctactgaatcagagcctgaattttaagataccccgcaggtgatttgtgtgcatgttamagagtgagaagctccggactaaatggtttactacttacttctactttaggattatcaaaaataaatggtggtagtgaaaataatgtacagaaagtaccttttttcccatctgctgaatgtctgcttttttcttcttaaatttctttttaacgaagatactgctgcatccacattgtcttgtgatctctccagccatccatcttgtcattcttttgggcaaccttcctcttagagcaagcatgccctgggaccctcccttgagttctctactctttcttcgttaatattttgtttggagacacatataaccagtatggaactatctatgctttgcatacttttgattgcccagtctctctacttccgtctgccttgagccggcctggcatttaagctatactgagtctgttccttagccagtgctgcctcttacctctggctgcatgttagaatcacctggtgagatttaaaacagattagcagcttggttccatcccagatgaattaagtcaatttctaggggtgggttctggcagcagtcatttaagtcagtttctgagawcagggtctgggtgattctgctgtgcagccatgctttaaaaccccaaggctccatgctattcattcatcatccatctgccatccattcattcatcgatttaccccacaaacatttcatgagattctcctgtgtattagatgcttttctaagttccaagagtttttcacctcagcactgttagcattttgagttggacatttgaagggctgtcttgtgcattgtcgggtgtttaatggaatccctggcttttactgacttgatgtcagtagtgtcctctgcagttatgacagacaaacatgtctccagacattgcaaaaaatgttctttgggggcaaaatttcccccagttgaggaccgttgttctaggtatattgatgaaaaattttttgttactcaatctagttctattgatgaaaatttttaagtgcctaaagacagacacttaattacagtagggtgggacaaacatagtaagagcttcaggacaaagtacatagacaacactatagagggatgggaggtggcatttaagttgtgcctccaaggatgaatggttatttgctgggtgggcaaaaagaacactccatagtgagagaatagcacttacgaaggcgtggaattatgtcccatcatctcccacctcatgcatgggggtattgtgatccacttttcattcatcccacctgcctctacatcctgtttaatatttcttctccatgtgttgacagtaccactacatttatcactttgctctgaaactgcaagtcatctgcccttcattacaaggttgagtctttttttaataagaactttattgagatataattcatatatttgtattagtttcctatggttgtcacaacaacttaccatgacagaaatttattctctcacagttttggaggccagaagtttgaaatcaaggtgtcaccaaggccacacgccacctggaggccctaggagagaacgctagaacgcttccatgcttcttccagcttctcctggctatrggcattcctggctttgtggccacgtcactccagtctctgcctccgtcttcacattgcctccctccatctgtgtgtgttaatctccctctgtcttttttgtataacaacacttcttattgaatatagggcccacccagagaatccaggatgatcttcttatctcgagaagcttaatttaattgcatctagaaagacccctttcacaggttgcagggatgaggatgtgagttttggggagccactgttcaccagcttcctacaattcatcccattaaaagtgtgcaattcaattgtttgtagtatatttacagagttgtacctccatcaccactatcaattttttattttttccacccccgacaacgcaacattttgggtattagtaatcacttcccattttccccaaccccagccctaggcaatcaccagtctttctgtctctgtgaatttgcctagtctgaacatttcatataaatggaatcatacggcatatggccttttgtgactggcttcttacattatgtcttcaagattyatccatgttgtagcatgtatccatactccactcttttctattgttgaataagtctcaattatatggatatatcacattttgcttatccattcatcatttgatggacatttgggttgtttccactttttggctattacatataatgttgatatgaacgcttgtgtacaagtttttgtatggatgtatgctttcatttctcttgggcttatacctagaagtggaattgccaggtctatggtaaccttctcaggaactgcyagactgtttctaaagctactgcaccattttccattcctgccagtcgtgcatgaaggttccagtttctcctgtttctctttgtctttttaaaatttagttctattgtcaattctgcattttctgataaccttctcaccaagggtagaaaaatatttccattccttttctgttaatgtcacaattttttttctcacttcaagaaatgaaaggcgatcagctcttatctattctacatataacatttacttttggtctcactgtacttcccagaaacttagtagaaagcaaaatattaacttctgtgtgtgtctccacatccataatcattttagctccaaaacctgtagtgttctccctgagctgtaagctcaatgagagtaggcgccctgatctttctatttttctcgtaaactttgtctgcagctcgtggtgactgttcagtaagtattaaatgagagtgtgattattgcctcatgtgtaaagggatttaatattttataggctgagttgtttttcttaattatgcatacatttctgaatctctaataactgtggttattgtttttatgtgcagatgagcaggagactaaagatgcagcagaagaatgtaaagaaccctaatcaaggacttgctgggtgtgcttttcagaaagttggtaatgaagttaaattaaatttcttattgaattatttgaattcaatgaatgcactgcagagactattctttattgattttgacatttggagtcgctctttgtggattatatttccttgatatttttgagacttggggtgtaattgttcagtggtttttgctcattaaaatttctgggaccattgtttataaatttattgctaatcttacagtattaggattcattataaaaaccaacattttaatgtatacgtgttagggtaaaactcgttgaagtgctgtgattgtcctgtattcaattttgtatgtttcacctctactgtgattcagacagatcatggtggtcactgggaatttttgctgtggccctgcttttccttcttcccacttgtctcatgtctgtgaaactggtacaacctgccataagatgaaatgaattgtctcaacaaagcaatattagaagagcctttactatcttattggtgatgacacgtttcttaagtaggagtttgagtgaattatttgatatattactttgttaataatagttaacaatagtttcttattttctttcagagtttgggccttttagattgcatcaaataaagatgagctactttaaaagacagtctgcggtactatttkaagagagatggtttagttacaagtcagtaacttagattcatgagaaaattttgtgttgacattccataagatgagttggcattagaattggaagtccagtttatttctgaatcaaaaaatgagcgggctattgtgctgcctttaataaaatttgagtgatgtatacataacattgtttttgctggcacatgttcatccactgatactgaataacattaatgattgtttatatggaatttccttgactttttaaaatgaggaattctatagctactattttcagaggtattgataggcagtttctttttccagacactatttcagtttactatttgttcatttaaaatagcaattgttcatgctgatgtcaatgtgctacgtataatttatcttgatgccaagagttttgctgtgggatggaagtataagttaaaagttgtgattttagattctcataggaatgccatgaggcacactctgtgttttagggtttgggtgggaagaatcagagggcaaaggtgatatgggtgagaatttgttgtggggcagagaggggccagtgttgtccgtcagcgtttcagaggagttcagctttctaaatctatgcttttctggtatttgatgtttgtatgtatgagagagagagagagagagagaaagaargaggagggaggggaggggagggtaggaaggaaaaaggggagggaagagggagacagaaagaaacacagagtaaaattatttctagacttgcactgcaaagggcttatgactttatagtttgcttctgccaatgatatttgggacatagtgagcctttctgttatttaggtaagggggaagaaaatagagttattttaagtaatgaattctgccataaaagaggtgggaccattcacagcatgtcaactgaaggtaactctaacaaggactggtaactaagtctgtaacgtaattcaacamaaagcttccggattttttttaaaaagtcaccctgatttakatagaaagtgttattaaaaatagatgtttttattttggatttccctttagggcttagtgtttgtccggaacaaggtgaaaccccgtctttactaaaaatacagaattagccaggcttggtggcgggcgcttgtagtcccagctacttgggaggctgaggcaggagggagaattgcttgaaccggggaggcagaggttrcagtgagccgagattgtgtcactgcactccagcctgggcgacagagcaagacttcatctcaaaaataaaaagaaaaagaaattatagaagagagagagagccaatttatttaaggaatgaattcaggagcttaatactggaggcttttctacatgtgactctttagaaaaaaaaaaactgctggcaccacctttattgtatgtacattcttataagacctggagtttattgctcttcactcgagctctcccacaacacatgacaawaaactgttggaggaggaaaaaagctatcatctcgatgacataattttaatttttaacaagtcctttatttcagtacaacctgattatttgaaggtcagtcttagggtgaaactggaacatgcctggaagaaaagctcctctttccagtcactttttctgtcttatcttggtattttcaatcagttttgcttcactatccaagaatgaattagaattatctcccagcacttcaaacgttgaactcttctgataatgaatgatggtatttaattctttgccatttcaaagaattatttccttcacatcagttttcctaactccacagctattatcaacactttctagttcctgcttcttcaccttggtactataaaatgatttggcaatttacatttgtatgtgatcatggctactcagaaagatgagtatttatagaatgagagtgaaaatcaacaaggaagattttatctcacccagccagtcctttctagtgtttaatagacctcaaagccagacctttaacctactcataaaatttcttctttgatctgttttcattaaaactggaaattaactggtcagtattccacattcataattagcccatccaaaaatcaaggtctgcttattggtacacttgggccttttcttcacatgataatttgtatttagacacacacgcatttatggattccttccaaattttacattttttagtcttcttttttgattaaacttattattccttcttcaagaggaggtatctgtaatgcttggctcaacattgcaaggacagctcctccctcatccacatttacttccgaagtgtctccacaacatgcaatcgtgttgcccacccaaggcatcattcgtgggtcagaaaatgtcgctgtgagagttgcgtgtgcttcagtgtttttccctttgttttcatactgcactttgaaaaggattcaatgacatctaatgaccttaataagaaattttattcttatgggggcccttgacttagggataatttctcttttatatgtttttgatatggcaggctaatgtatcattttgttcttttattccacaaacgcagcaaattytaagcctaggcctgagcaactcagtctttctcaatcacatacaaactgtgaatgttgctatgacttactgtaatttatttttgtatatgctatattgatttatgaatggtatttacgcatatacttcatgacataaagccagtagagaacaaataagcatggatacagtaagtataaatataaatttccatatgatttattgttgttccttgtacataagaaacagtaatatacaacttacactgctttagaatgtaaaatggataaaaatgtgtacaaaaaaaagcacaytcctagaaaaaggtattggcaaatagtaaaaatgggaggtcaaaagcaaaaaaaaaaaaaaaaaaaamcaaamcaaaaaaaagaaaaaaccaacaattcttcaattcagtgtgcaaacattatataaaaatagaaatactaactctacaggcagtatttcctgataaattatttaaatagcatatctacacaatctgagatatctattccaatggcaatgagaaaataatttataaaaataaagcaatggtataccagatgatagaaaaaaaacataactttcagaaattgtatttaacatttcaatgctatttccttattgggaatacttctctgcagagtttttatgctatgtacaacactgactttttaggtactacagtagctttaagtttgttagacacttaaactctttccgcttgatccaaaaattctttactcagtcacacaacaaatgaggtaatatttgtatgtaagtttcaccttttgtcatttttttctcttttggaaaaatgaaagaaaaaagtgtatatgctttccttctccctggaaatatgcacaagggatggggtaaaacagtattgaagacctcatggctttctttgcaatttaaaacatttgcaaatggataaccaactaattccacttgaaaagataaaacagagaaaaaaagaatcccataacatccactctgagcacaaggggcagagcagcttattagactgattttccttgtgctgttcttgcaagagatttgctgataaatgtcaactacttgctctcaaacactttccgtatgaagcctaaatttccaggcagaacagagttaataaataatctgtatttacaatcttacagtcacgaagactctcaacaaagatgacatggatagtctttacgcttcttcctgttccatgaataatccttcagccagatcttccagaataagtaaaaaataaatattttacatcgtaaagcatttaaaaaaaatctacattccaaaagagagaattagaaaactccatgataattcaggaaaaaagagaaaaggaatgttttagttaggttgataataattttgtgccattgtaaccataaaaatataagcacggctgcccctcctttgggaggcagctggtgctcactgagatggtaggttttcctattttcctgctacatctgcacaagctacatctagaatgaagccaccaatttcaatgtgaccaggcaatggcagccagcactgccttacactggtttgattctgattccctaattctggccactgcaggtgatgagtaagggtggggatcagggaggaagtccagaagccagtctttgtctccctttcctgcttctatttaagtgcctatttacatgggttaatcagctaaygccagtcagcatcatgaaatccagcaatagtctttcaatcccctgaaaatgacttagtaccgaacatgtaacagttcctccatattwtcttcatacaatcgtctcgggtatgcgccctccccttagtgctttggcctctgctccccgtgttcctgaaggaggatgtcagggtggttttgtttgctaattctagtgagtcctcccttctctgacatgcctgaaaatgcttttgagtccactgctcagagatggcctcacaatagcaccctgctctgtgacaaaggcagagtggaatgggcaccttccyaactgaagcaagtagatgctttttcaaaaggaaaccaaagcaattgtttatatgcttggaagatgtcttattcattggaggctgaatgctgagtctgtttttgaaaactgcattttcttgaggcaggtcgcacgttctaggagtccacactgatgcaagcacagaaaagaaggaagccaaggagaagtgrtcctggggrttttctcaagcccatagttccagaaggtgcaataccagcattggtttatgatcagtctttcaatcaacaatttgatgattagggatctgttaaataaacaaatataaataaatatacaaatgaaaactaattcataaaagcatagacatcttagttaataagttaaccacataggaatagctctacttttctaatgacaaaagcctaattttaaggttgttcaagcacattagcatttaattttattagctgacattgatgctaggagaccgacacagcgtgaaccttccagaacatatattatgctttccaaaggctttcaatgttaacagtttagggagtcttattttaaaaatttggactcaaaaattacattaataatttagatttttttgagtaaaatcaaccatctttctctactgtcattgatcttttaggtatctggccttggcccagtaaatatatattaagcacttattttgtggtagagccagtgttggactcagcgagcttaagtaatgactaagtaaaaaagaatgaggaaaaaaaatgctaagtttaatagtgaacattaatttaacatgccaatatgaaagcaacattcctctcccttctttgtatacagggaaaagttgggaatgctaactcgtgctgtgatggcatgcataaaacaataagcagtaagatatataaatatataattgtaaagaacagtrttattaatgaagtccaaattatataggagcttttctgcagcttacctttgcactgtgtatgaggagcacagagattgctaagcaaactaatattatagctaaggactcaggaactcataagccacagtgcctaggcattattccatttttgtccttgtgtcctcaaaagcaaaatagaaataaccctgtctccaaaacagtctttacactggactcccccataaccgtcatccttgatattagtctgaaatagagatgtccagtgtacattcatggtgatgttgctcttacctctacattcgtatttcaggtcagagaagaacaccatttcttgagagaagacaaacaaccctagtctaccaccagcataggttttatcatagatgggtccygagtcagccatgattttcttcccttcatacatcaccactctgcagggaaaaaaaatcttgtttagtgacaatgctatttaatactttttgtctttttgtccctcagtgtgactgtaagtgaaagtgaatcagtatgatcgtacctaatgaaacccgtctttggcctgtggctgagacgccatctgtaggcggtgaaatctttccagcctatgtgacgagggtcatgccacagggtgcgcacctgaaggaaaaggaaaaggaaaggttgaaacacagctccttcaggtaaagatttctatttcattc

SEQ ID NO: 13496 - DNA, 26737 bp, Homo sapiens
tgaggctgggggcctgggggcctgccctggctcccagaggcctcctgtgaccagggttttctctgtgggaagctcattgatcctgatgcagccacatgtgagacctcaacctgtgccccacccctgggctgaccagtggtgttgcctgccctccggaggagaaagtggccagamtctgtgatgactccagcctatgaatgtgaatgaggcagtgttgagtcctgcccgcctctacgaaaacagctctgtgacatctgactttttatgacctggccccaagcctcttgcccccccaaaaatgggtggtgagaggtctgcccaggagggtgttgaccctggaggacactgaagagcactgagctgatctcgctctctcttctctggatctcctcccttctctccatttctccctcaaaggaagccctgccctttcacatccttctcctcgaaagtcaccctggactttggttggattgcagcatcctgcatcctcagaggctcaccaaggcattctgtattcaacagagtatcagtcagcctgctctaacaagagaccaaatacagtgacttcaacatgatagaattttatttttctctcccacgctagtctggctgttacgatggtttatgatgttggggctcaggatccttctatcttccttttctctatccctaaaatgatgcctttgattgtgaggctcaccatggccccgctttgtccacatgccctccagccagaagaaggaagagtggaggtagaagcacacccatgcccatggtggacgcaactcagaagctgcacaggacttttccactcacttcccattggctggagtattgtcacatggctactgcaagctacaagggagactgggaaatgtagtttttattttgagtccagaggacatttggaattggacttccaaaggactcccaactgtgagctcatccctgagacttttgacattgttgggaatgccaccagcaggccatgttttgtctcagtgcccatctactgagggccagggtgtgcccctggccattctggttgtgggcttcctggaagaggtgatcactctcacactaagactgaggaaataaaaaaggtttggtgttttcctagggagagagcatgccaggcagtggagttgcctaagcagacatccttgtgccagatttggcccctgaaagaagagatgccctcattcccaccaccaccccccctacccccagggactgggtactaccttactggcmcttacaagagtggagggcagacacagatgttgtcagcatccttattcctgctccagatgcatctctgttcatgactgtgtgagctcctgtccttttcctggagaccctgtgtcgggctgttaaagagaatgagttaccaagaaggaatgacgtgcccctgcgaatcagggaccaacaggagagagctcttgagtgggctagtgactccccctgcagcctggtggagatggtgtgaggagcgaagagccctctgctcyaggatttgggttgaaaaacagagagagaagtgggragttgccacaggagctaacacgctgggaggcagttgggggccgggtgaactttgtgtagccgaggccgcaccctccctcattccaggctcattcattttcatgctccattgccagactcttgctgggagcccgtccagaatgtcctcccaataaaactccatcctatgacgcaactggagtgagtctctttcttgcaacccaaacagctgggctagaacagaggagtcacatgttagtggggtttattcttagacaccatctgtaggagggggccaggggctgcaagttacatgacatttatcacaaattaccttacgctgaagtgatttgtgtccctttctgctccttgaggcttcgtgtgttgctcacatttgccacccacaatgaccagccccgtgcatggcacgcagtaggtgggcacgtgaactaagcgtttgtcttgtctacattgctgacagtggggagggtggagaacatggactaaatccagaggtgggacagggagagagcaagtcaaatgcagccagatgtttgggggctgtctggggaagagagggtgtagggaggaccataagcagctgctgaagctgcrgctactggggggatttgggaatatccggcttaggagtcttcacctgcttctgcatacttccaaggggacatatgtccatcttggattggaggctctcagaggggttagttgtgtccrcttccagtggtctgaggcctcctgagactttttgtacattcaattaaagtgtaacatacagaaaagttcacacattataaatgcaactcaaggacttttccaaaagcgaacacacccagatcaagaaayagaccatcctayagtccccscttacactctgtaccagttgcagcccccacaagggtaactactgtcttgacttcraacaccatagatttgatttgcctgtttttaaactttacwtaagtagaatcacagagtgtgtacaatgactttggaaaactgtttgacaatatctattaaagctaaaatacccttgccctatgaacctgaaattccacccaccttgccaagggacaaaaagttcccctctaaatgcaccaggctgtcagggawgaagcgttggctttggggcccccattcacacacatgacyttttcyggggcayccaagcatcagcctgtcgtcaccaggtgccaccctggcgatctctgaargctggagtcggagtgcctccctcagacatcctgttctgcgtcactccttgggagaagtcgtgtttacagatggtgggtgtcacccatgccaagcactyctaagggttaatgctcactggtttgcctggttcccaggacatttcctgatgcccctctggagggtgacgccaacaagccagtggagaagccatctttcccaggtgctgtcaggcgcccccggagctgctmggtgcatcctaggatccctcttcctcagctttggtttgatggcctcatctcctcccctgcaacctcaaaatgtaaataaaccctttctcagagacttcggyagaaaattcctctgacctgcacttggacacagctcatctgggtttgggaggtgtcaactgtgtaargatgactctgatccccatgtggcttttcgactgtgtcccctctacagtcagttattagcactgactgtgctaggaagtgagcaacacacatattcccagaccacatggagctcargagcttggggagagagacagggaagtggacgactacagggccttctgaaacgtgttgcagggagaagtgtcagtcaggggatgctaacctggctttgggtaagggacagcctctgaatgacaggacattaaagccatggcctgcagtttaagtaggagttggccagttcgaggtaagaataccagtaagcaagaacgccagagtagctcctcgagctgccttctgtacctgacatccacactgaagccagcccctctgtgttcagccttgctttactgaagaggtgtcgctgaggggctgctctggggygctgctctgctttcctgtccccaacttgttctgagctcgagccacctccatactggtgctcctggttctcaggcctttgaactcaaaytgaatcacaccactggctttcctcgttctccagcttgcagatggcagattcgggaactttttggcctccataatcacgtgagccaattgctataataaatatctctctccctctttcttcctctctctctctctgtgcaaatatagttccaattataagagcccctaactggaaaataaccctatggtgcactggtgagtagagaaactgtggttccctcaaaccaccgaacactattcagcaatacgaaggaacaaactattgatatgcaaaatagtgtaaatgaatctcaaaaacatcggaaagagggaaggaagccagacacagaagagtgcatgccgcatgattccatttatatgaaattctagaacaggcaaaacttatctatagacagagaacaacagatcagtggctgtctggggttgggagtgggsaagtttggctggaarggcacagggctctttctgtgagtgagggaatgtgtctgcattatagtgatgcttatgtagttatatacacttatcgaaactcatcttactggccacttaaaataagtgcattttattgtgtgtaaattataccttaatgaagttgatttgaaaatccaaagtagtaataataagtaataatctcgtagctggacagctgtggtgactcactcctgtaattccagcgatttgagaagctgaggcaggaggatcacttaagatcaggagttctttttatttttatttttattttttgagacggagtttcgctcttgttgcccaggctggagtgcaatggcatgatctcggctcrctgcaacctccaccttctgagttcaagcgattttcctgcctcagcctcccaagtagctggaactacaggcrctcaccaccatgcccggctaatttttgtatttttagtagagatggggtttcaccatgttggccagactggtcttgaactcctgacctccagtgatctgcccgcctcggcctcccaaagtgctgggattacaggcatgagacactgcgcctggccaagaccaggagtttgagaccagcctgggaaacaaagtgagaccccctgtctacagaaaaattaaaaattttagctgggcctggtgccgtgtgcctgtagttccagctactcaggaggctgaggtgggaggataccttgagcccaggatttcaaggctgcaatgaggcatgatcaggccactgtcctctagcgtgggtgacagagtgagaccctgtctctaaataataatcataagaacaacaaggaccctctaaacgcactgatatctaaggtgtattaagcgaccaaaaaaaaaaagaaaatcaaagtgcagaaaaacgttaataagagaaaaaaatatgtctgtattgtcttgagtgtgaaaaaataatctaaaagcctatgaaagaaactaatcatattggtttcctgttggtgaggagggctaagagcacggagacttttccctatgctttctgtactttttgattttgagatatgtgaatgtaggtttctctcactgctcgaactttcactaaccaaattactacattccaaattctcaaaaacaaatagatttacttaaaagtaggctgggtgcggtgtctcacgcctgtaattccagcgctttgggaggccgaggcgggcagatcacctgaggtcgggagttcgagaccagcctgaccaacatggagaaaccccatctctactaaaaatacaaaattagccaggcgtggtggcgaatgcctgtaatsccagctactcgggaggctgaggcagaagaatcacttgaatctgggaggcagaggttgcagtgagcccagatcatgccattgcactccagtctgggtaacaagagagaaactctgtctcaaaaaaaaaaaaaaaaaaaaaagatttgcttaaaagttaacatctccggccgggcgcggtggctcatgcctgtaatcccagcgctttgagaggccgaggcgggtggatcacgagatcaggagattgagaccatcctggccaaaatggtgaaacctcgtctctgctaaaaatacaaaagttagctgggggtggtagcgcgcgcctgtagtcccagctactcgggaggctgaggcaggagaatmgcttgaaccagggagtcggaggttgcagtgagccaagatcgcgccgctgcactccagcctggcgacagagggagactccatctcaaaaaaaaaaaaaaaaaaaaaagttaacatctcatccaaatttgcaccgagtaggaaaacaaaagtttaaaacatgaaacagatgttactgaggccgaaagggtctcccaggcctgggagtctgcagcttttatgcaattctgccctctggccaccgccagggaagaaaggttgtctccgtctgctgcatcgcctttgcccagcaatgaagcccccaagacagcggcagccggttgcctgaaccttcctatccttgggggcacccagtgcaggtggatgacccgactcaacctccgccagggcaccctcggggcaggacgggtagcaaggaggggacagagatcggccccaggagaccacggaagatcgcgctcctggggccaacttcagcagcgagaggcggcctttgcccaccgcctcatcccaccacgccgcggtcctccaagaaccttcccagcggttctctcctcctctcaggagtagaggccctctgagaccgacggggwgggacggctcgggccggtcatccgaggggccgcacggattccctcctccgcccagctccaccccctcgaggggcggcggtccgggagtggcgacccggctcccccatggcgcgcgccgtcggggcccctggccaggctccgagcggggttggcggggaggggaggcgggagcgagggcgggcggtgggaggtgggggcgggaaggtccgaaggcggcggcctgaggcygcaccgggcacgggtcggccgcaatccagcctgggcggagccggagttgcgagccgctgcctagaggccgaggagctcacagctatgggctggaggccccggagagctcgggggaccccgttgctgctgctgctactactgctgctgctctggccagtgccaggcgccggggtgcttcaaggtgaggacgcgggcggggtgcgccctgaggggcaggctaggcgcggtggtggtggcggggatgggttctgctcagagctcgggtcagcgcgcggagggtctcacggccccggcaccatacggccagtaggtcagggcgtggggactctttgggggggtctccgtgggacctgcccagggacgctcaagtgtgcttgggctggccccgggcccggacttgcccacactgcccggctgccactccgctggcaaagcagagggcatggctccctccccctcggggrcarcccagcccccagcccccagcccatagccgtagccccctctkcctggattctcgctctcacaaccagcttccatccgcaggccaccgtgtgacccgctcctgctcctccaccccttaggactcagcggggctccrtcctctaggaagcccccatgcccaagagtcccccagagtccctgctttgctctcaggctgcagaactagctgtggcctccaccctgctcacccctcgtccctcctcccagggcagcagggcagtgtgtatgttgtttatattgttgccttgtttggtgagatagagaagggcctctccagatagaaggtgtctgtttagcagtgctctggraagactgcagctgtctcctcggggtaacccctccaaacaaagatgttaagatggggctggaacaacctctgcaagcgggtgggaggattasccagtcctgcacagcaagtgcctggccgggaacagggagggcaaccagggagggggcatgcggggctgggctgtgctatgcagactgggcggtggcttccacagcactgtgtggggaccaaacaggtacaggggcctggtctgttctggccccaggggagggccccaggcggtccactgctccctcccctctgagccctatcctggggtcaggggaggtgatgggacccctgggagaggggcgtctatgtgcccaataccagcctggctccctcgggttccacccccatycacccggtcaccggagctccagctccagctccagctctgcccctctctccctcattggggtcagggtgcccgtggccagcacgtgcgcgcaaggccatgtggacagcacccacacaccacactgcacccacaccacacctgtgcccgggcccaccctacctcttccccaaacccttagaggcctaggagcagcaaagcttggttctctactctcagttaagtgctctctgggctgagagacctcccctccttcccctcccccacatccactcagagccctccctgcactggcccctctagcctcctttccaaggtggcagactcctctcggccctcatctgcctgatggcaattcactcatccaatcaaggagggcttcttggaggaagggtctttgatgtttgtagtctgggagagaaggtggaggagaaaaaaggagttggggtggcytagcaggagctgagtcacttccacaggcagccatcagcccagcaggactgaggccagggctgcgtggaggsgggaggctgtctgttctgggagctgggactgggtaccgggggaaggagggctgctgcaggctctgggtgcctggggcctggstcctgcagggcgggcctgtgrgagtggttggggccagtggaggggctgggagcattccaggggaacattccaggcgccctctgagtaatgcttggctctgggattcctcctagagcccccttaggcacacccggccagggagcaccaaggctccgtccrgaagcgtcccctccccttgaagagatgaggaggggccttctgggccagggtaccaaaaccctgccaccaggacagagtccccgagggagctctgggcaaggtggacctcgcaaggcaacatctggctgttgtttttctcagatgatggggggggcacaagtgtcctctcttcgtacatctctcaccctaaargcatctgctgcccatctaaaaatccctaaggctgccgcgctctttccttcccctctgcactggcggccttggcctcttccttgtgatcgccgagcccaagcctgccccccgacaaaggtcaggggactcccgtgtccccagctgagctgtcccyttccagccttctcttttcctcctccttgatagctcctcagatccaaggatgcccacgggcgtccctccttctccaggctgagcccacgcgtgttgaargtgaagtctgccccaaaaggcctccagtgcctccctggggatgtcctctacccccctccctctgctttgtcccatgcccctgtgttcctcargtccccctcaccctgtgctctgtctttactccaggacatatccctgggcagccagtcaccccgcactgggtcctggatggacaaccctggcgcaccgtcagcctggaggagccggtcagtgccatgtctccccgccctccacaggggccctgaacctcccagcccttttgtctctccctacattacagcttctagttttgctggggtccccagaaccaccaagtcactactcctatargcccctgcctcccctgcccctcaagtgggcagaagaaggcactggggtttggacatctggatctcgtgagcccgcacacatggaagtcatttcagctttctccaccccacctccctctttccctccctccctggatgatctgggccacccccacccccaccaggcagaaatgggtccagagtttgtgggtcctgaagcttttcargagcctctaaaaaaaaaaaaaaaaaagcaccaaaaagaaaaccttttgcaaagttgaccagaacatgtgaccctgtggacacactgctgtccctctcagggccctgccacgaaggcctgaaccttcagcctcactggctcctgtggaatccacttctggtatsgggggggcagtggtcactctcctgatgtcccccagatgtaagaccaccccatgtgcttcttctgcaggacgctctgccccagcctcttcccaatcccgctcttcacacgcttccagaataaccatgccccatctgtttgtgccataatatctgtgctgcaaactaagagggcagtagccttgatatgctcattttacagaggggcaaacgsaagcccagagagcttggggaaattgtccatggtcacacagctctttaggctgggagcctgagacccactaaggtctgaacgattttaaaccattggctacacccctgcccctcctagagagccctctttgtttggaattttcagccctactgtccaaatccagcaaragggaaggcaggggagcattgccatgaaggctgagaggcccccagagacccagcagctcccaacccagggccctcactgggatcccctaggcccataaggcccccattccactggtcaagcacggcactggcctgagctttgagattgccctccccatccccaggaggggaaggctggacacacactggggtcactctgcctctgggcctccctgtctgtctggcctgggctgtgaccaagaggagagccccaaaggggctctgcttcccccaccggtgggcccctgcccccaggaagcctgccaagatggtacagaagaaagagtagaggctaggtrtcccctccaaaaggcaggaaacactcacatttcaagatgaggggtatatatcaaggggcagggtaccaggagggcaagagtaaagatagcaggggctgcagaggaacagggacctcgagtatggcctttttcccggtgcagacctttccccaataaagcaagtggcattccagcctcatgagctcatgctggaggccttgtggggcctgtggccagggaggcarggaccatctgctccccacttgcgaaggaagaactccctccaaagactctgagacccttggacagggccccaggccagtgcatttttggagaaaaggagtcgggggttaaacattccgaaggcgcagcagcctcccaggaagctcctgggccggctccaactctgggcccccagccaggctgagtggacaagggggaagtggggtgttcccacagggtgggagacgccaagagggtgggggaaggagagagggctggccgtccaagccagcctcctgacacctagctgagagccagtgtgctctcttggctggaatggcgtccatgtttacttcgtgggtccagtgaagcaggtgtcggagccggagggacgggggctgctggaggcccaggaaaactttggaagagggagcagtttgccaaaattggaagtggaggagtcaaatttgaattctataggraatgagcagcagctcatttggaamcaagcctcaggtrgcagaggctctgaggaggccctgaccatggctacccgatgcccccataatgtcctcagcacccctctgtcttcccctgcttttgatgccccttctgggcatgaaagaagagggcgggccaggggaggggcacctttctgggacctctggtctctagggaggatgctggtgtgcctggcargctgtgccaacgcccttccaagtggctgttgtcaggactgcaaacatcctgagtttgggaacatctttgtatgttctcacctcctccacgccctccatagtatgtggggggtcctgctgactccccagcccacgttctccccaagaacttcctccccagccggctccacaggccacctactccctggcaggcaggaggcctggaggccaccatctcagctccacacwytttcttgcccaggtctcgaagccagacatggggctggtggccctggaggctgaaggccaggagctcctgcttgagctggagaagaaccagtgagtgccaggctggggtagggctgggaggaggggatcagtgttggggggcagggactgacacagatctgtgcgggtggctggatgggcagaggaccccagagagggtgcagatgacagggagagtcacgcaggcctgtggttggctccctggaggctgaagaggaccgctgaggctgtcagccccgctgtggggcacctccgccctcccaaccccaggagcggcttgttagctccctgctggcgatgagtgagcaccacctagtggacatttgcaagatatgctgagtctaaagaaatcctagagggaaaagatgagccggcaccccaggctaagggaatggcagggaccaagatgcggtggctttgggaggccgaggcgggcggctcacctgaggtcaggagtttgagaccagccttgccaacatggtgaaaccccgtctctactaaaaatacaaaaaattagccaggcgtggtggcggcgcctgtaatcccagctacttagggggctgagacgggagaatcgcttgaaccccggaggtagaggttgtggtgagccaagatcacaccactgcaccactccggcctgggcaaagagtgagactccgtctcaaaaaaagagaaaaaaaagaaaaagaaaaaaaaaaagaaagaaaagaaaaaagaaaaagatgcagtggctacacttgggggcagcagtttgtctgacctgcctggaaggtctccatctacagggaggggagcaggggggaatgaatttggagagtcccaggagggccagatcacagaaggccattttggtgctcagtgtcctggaccatccagagccaaagattttgagctggggaagggacaggcagacctgtgctcaggaaggtgmcttgggctgggtggggtgggtgtccgggctggagcgcaggctcttaaaaccacccagattatgttatcagtatatatcacctactgagtgcttgaccgcaggcgctgttctgagcacttgacacgtattttattctccctcgtggagtcggatggacagggaacaaactctagttccactgtgcccaaccatattttcccgacgtccctaccctttcaatggggtggtcacatcacctacctcctarggtggcgggtgtgtgtggggcargggtagggggcagagctggggcaggtggtggaatgcctgggaggggggaagcagccatcattagcgggtggtctggaggtaatgaggccaaggtgaggttgggttaaggattttctttaaagaagacagattgacttatgattgatccatccgtgtgggaaagatcctgttgagatggagcctgaagatggaatcattaccggagtgggtgtggagaaggcagggagggtggaagcagcgtgggcaggtggcgattctgttttctctggaggcagggggtgagcatcaatcactgaaggacaggtgggaggtatgtggggtctagaagtctgaggaaaatatttcaaggatctagggcaggtgggggcaagagggtcgaccagatgcccaacaaaggagggcagcaggcaggggaactgggggaggtcaccgcatttccccaactccaagtcccattcttcggcagtgtctcctgactcctcccctcccgatcctgtggatcctgctgcctgctgcaggtcccctgggaaccacaaactcttcccctattcccactcctccccggcgtcctccctggtgcttcccatattcacayctyccacaactaagccatcaccaagsctccttcctctagccccaagagtttctgatctgagcaagtcaccattgctcctgtcccttccctaagacacactgtgagtgtctcactcataaagctgctccattagcatttagggaggaaggctgggagacatcctggaggaggcaggaggaagctgaattcagtgttccctgtaacaccccctctcagcaggctgctggccccaggatacatagaaacccacyacggcccagatgggcagccagtggtgctggcccccaaccacacggtgagatgcttccatgggctctgggatgcaccgccagaggtacccccccaccattcctacccctactcctccttgcattcctaaggggcggttggagccagcccctaccacaccctccctcttgcccctcttgctccagccctggctgagatttggggctggccccttcctccctaggatcattgccactaccaagggcgagtaargggcttccccgactcctgggtagtcctctgcacctgctctgggatgaggtgagctctgggagaggaggctgggcctgggatggggaaagagctccctcacacccgctcctacccctctgcaccctagtggcctgatcaccctcagcaggaatgccagctattatctgcgtccctggccaccccggggctccaaggacttctcaacccacgagatctttcggatggagcagctgctcacctggaaaggarcctgtggccacagggatcctgggaacaaagcgggcatgaccagccttcctggtggtccccagagcagggtcaggggcatcgatcggatgggagtgggaatgctgtatctatagccctccaaatcagaagagacrggaattcacaggcctcgagtcccagtatttttattgaagtctgaagaaacaagttccagaaaacatgttaaacttccttctgggagctgggrttggkggtcagggctcaagcccagcagcttccactcagggtccccatttgcacctccgcagggcaggcgagaagcgcgcaggacccggaagtacctggaactgtacattgtggcagaccacaccctggtgaggagagaccccaggggttggcggggtcagggatggggccagctcagcccctcaagccaccgggatttctgccttcccagttcttgactcggcaccgaaacttgaaccacaccaaacagcgtctcctggaagtcgccaactacgtggaccaggttgggggcggcggggagagagcggtgatgggggtggcggcggcaggacaggcargtgctggtggggtttggggaagaggaagggcgccccacgaaggaccaccggcgcgatggggcgccctgtcccggcttcagccccgcctcgccctcagcttctcaggactctggacattcaggtggcgctgaccggcctggaggtgtggaccgagcgggaccgcagccgcgtcacgcaggacgccaacgccacgctctgggccttcctgcagtggcgccggggrctgtgggcgcagcggccccacgactccgcgcagctgctcacgtgggtgcctctgacccggacgcgggtcccgggtggggcggcctcacctcccggccccgcctggtcacgccgsgctccgcccccaggggccgcgccttccagggcgccacagtgggcctggcgcccgtcgagggcatgtgccgcgccgagagctcgggaggcgtgagcacggtgagccccgcgggcgggggcgagggagagacaggaggctctacggccgcagtgaccgccctcccacggcyccccaggaccactcggagctccccatcggcgccgcagccaccatggcccatgagatcggccacagcctcggcctcagccacgaccccgacggctgctgcgtggaggctgcggccgagtccggaggctgcgtcatggctgcggccaccgggtacgcgggtggggggtcggggctgmggcggggcggctagtcctggggacttcctccgctgcgtttctttggtcgtccctcagtttcctcttctgtaaaatggggataatgatcmtagtgtccgcttcagggtggtttatgaggcttaaagggaagaagctcaggcaaagtggatyctcaacggtatgaagattattttccgagtaacctggcgaggttactcctacacygggaggagcaccgtcgggtcgcgattccaccttgggtcccgggctgctcactattggggcckcatcgtcccctgtcccrcttgttgtgtgactttgcgcgggttacttcccctctctgggctctgcgcrtctggcggctgtagccaagcccaggggtggggatcagagaagcgcgggggttggrggactgtccctccatgcccaatgccctccccgtgccggtaggcacccgtttccgcgcgtgttcagcgcctgcagccgccgccagctgcgcgycttcttccgcaaggggggcggcgcttgcctctccaatgccccggaccccggactcccggtgccgccggcgctctgcgggaacggcttcgtggaagcgggcgaggagtgtgactgcggccctggccaggttaagtcggctcgcccggcccccacttgccctctccgctcaggtctggggcgctgcgccctcacctgggcccttcttgcctttctggtcccaggagtgccgcgacctctgctgctttgctcacaactgctcgctgcgcccgggrgcccagtgcgcccacggggactgctgcgtgcgctgcctggtgagggcatggaaggttcagggtgagggtttcgkggagcttgggagccggcctgttggccttagttaattggtgccctcaggttcccccgttgggtgctgggcttgggtaggcctggctcccccagctccgagccgcgctctcggcatggacctctcactgcacgtggcctctctctgccttccccaccacccstcacctgcgcagctgaagccggctggagcgctgtgccgccaggccatgggtgactgtgacctccctgagttttgcacgggcacctcctcccactgtcccccagacgtttacctactggacggctcaccctgtgccaggggcagtggctactgcygggatggcgcatgtcccacgctggagcagcagtgccagcagctctgggggcctggtgagaggacacgagcacccttgcaccctgccccccatcctctggtggggccagttttctactgtggggaagatgggcaggggaaactgaggcccgctgagygcagcccctctccgagctgcccccagcctggcccatgcttcctcaggctcccacccagctcccgaggcctgtttccaggtggtgaactctgcgggagatgctcatggaaactgcggccaggacagcgagggccacttcctgccctgtgcagggaggtagggagtggagctgagtggagggagcagaagctatggagtgggtttggggaaggggggtactgcagctgttgacccccctctacttcctccccagggatgccctgtgtgggaagctgcagtgccagggtggaaagcccagcctgctcgcaccgcacatggtgccagtggactctaccgttcacctagatggccaggaagtgacttgtcggggagccttggcactccccagtgcccagctggacctgcttggcctgggcctggtagagccaggcacccagtgtggacctagaatggtgagctctgcccacccgacycctccttgccgtttgaatccygcaggccagtgtccccctcactgcctggtgcactgcccgtaggtgtgccagagcaggcgctgcaggaagaatgccttccaggagcttcagcgctgcctgactgcctgccacagccacggggtgagagcccgaggagtgggggtgaccttggggttcctaatcctacgtgaccctcctcttctcttctctgcaggtttgcaatagcaaccataactgccactgtgctccaggctgggctccacccttctgtgacaagccaggctttggtggcagcatggacagtggccctgtgcaggctgaaagtatgccagtggggggcatgtgggcaggagctggggtggtgcacctgctcaggactcagcgccccttcccccaatccccgcagaccatgacaccttcctgctggccatgctcctcagcrtcctgctgcctctgctcccaggsgccggcctggcctggtgttgctaccgactcccaggagcccatctgcagcgatgcagctggggctgcagaagggaccctgcgtgcagtgggtaggctccgagcgcctgcttcctgagcctactcctgcggttcccctcctcagagctctgctggggctgtgggagctggggcaggccctcagccttgcccccaggtgcagagagcagccccagaggccatggaaagaagtagctttgaacaggagkttccagtggcctcccagtcaagcgwgggggtggatccctgccccacsaccagcaccgcaaggcatggccctctacctcccagtacagctcctcttgtccactctcctgcttctcccaccagctggctgcctcacccttgacttcgccctgtttttccctggctcagattgcagtccctgtaccatgctgcccccggaggcctgtccagcctctgtctcaccagttttyggccctttgccacttcctctgcacaaatcacctctgtcacccmcttgaagttcccaaatgctgggcccagcacatcttttcactccataccactggtcagctgyggtgctggctgcccctgtgcyagggccctgcyttaacccagttctctgtgacctgggtggtggcggagtggggagtcacataatactaagcatggctgtcctaggactcaccctgcaccagggccctaggcagggcaggcactctgtggccatgtctgacatagcctggtcttgggagtgctccgggcaagccaagggagatggcatgatttgggccagagatgggggcagagggcataacagacaggggcagggcaccacctgggccccgggtggcagctaagaggaccctgacaaagcgagttgtgattgagggtctgtgggcagaggagcaaggtggccagagcctggcgtgtcagcacggagggggcgctgcagagggtggcggctgcttctcatccccaggcgggagtctcagggcaggggagaatgttttgaaggaacatcacaggaaatgacaaggccttgggrgatgggatggggacagtcaaagatggcttggaatcatcaagggcagcagggcacccaggggcaaggagagcagacatagctgccgaaggggcggacatccaaggttctttggaagctgagcgatgccagcatctggagagtgccaggctgctsggtggtgtcagagcctggaggaaatgttaggactagagagaggaggtgccagccgagggcatgaggctcacttggagcctggatcccaaggctcccctgaagagggagcaggaagggagctgagagggtgacttggagcagatgggtgccccaagaaactcagtaaacgcagaactccctgggctggacaccatgctgcggggaggcaataacccactcaggatcactgtgccaacctcctggactcttatcacgttgctcagccccaaagatggcccacacagggaccaccccctgggcggcgttcaccccayggagttgggccccacagccactggacagycctggcccctgggtgagtgaggcaccagggggaggtggagagggaagggagaagggaagggctcaygcctcctgcctycttccagatgggcagcacccagtcaccttgagtcccctatgcccctccccagccccagggkctcctgctgaccatattcacaacatttaccctccaccatttctcccagaccctgagaactctcatgagcccagcagccaccctgagaagcctctgccagcagtctcgcytgacccccaaggtaggcagggacctggattcaaagcctccccctctcatcgcccaccctcccacctctcccacccctcagtttgctgccccctaatcargtttctgggctcargttattatggaaatgagtttatgacctcttggttatcatgsagaccaggatgctggaagcccctgggctggggagggagaagctgtggcttttcctggatcactggtcctcactgagtgaggrtgggctcyctgccacacagcttgcagcctggggccccagtcmttaggggacaacatatcctcctcattctcagcagatcawgtccagatgccaagatcctgcctctggtgagaggtagctcctaaaatgaacagatttaaagacaggtggccactgacagccactccaggaacttgaactgcaggggcagagccagtgaatcaccggacctccagcacctgcaggcagcttggaagtttcttccccgagtggagcttygacccacccactccaggaacccagagccacaytagaagttcctgagggctggagaacactgctgggcacactctccagctcaataaaccatcagtcccagaarcaaaggtcacacagcccctgacctccctcaccagtggaggctgggtagtgctggccatcccaaaagggctctgtcctgggagtctggtgtgtctcctacatgcaatttccacggacccagctctgtggagggcatgactgctggccagaagctagtggtcctggggccctatggttcgactgartccacactcccctgsagcctggctggcctctgcaarcaaacataattttggggaccttccttcctgtttcttcccaccctgtcttctcccctaggtggttcctgagcccccacccccaatcccagtgctacacctgaggttctggagctcagaatctgacagcctctcccccattctgtgtgtgtcggggggacagagggaaccatttaagaaaagataccaaagtagaagtcaaaagaaagacatgttggctataggcgtggtggctcatgcctataatcccagcactttgggaagcyggggtaggaggatcaccagaggccagsaggtccacaccagcctgggcaacacagcaagacaccgcatctacagaaaaattttaaaattagctgggcgtggtggtgtgtacctgtaggcctagctgctcaggaggctgaagcaggaggatcacttgagcytgagttcaacactgcagtgagctatggtggcaccactgcactccagcctgggtgacagagcaagaccctgtctctaaaataaattttaaaaagacatattacacttggaccttggttagtcttttctgtatgtaaattcaacccatggggtgccctgaggaccacacggggtggtggttggcggggtggtggttggtggggtggtggctgayggggtggtggctggcaggccgagcctagrtggcagccagagccccaggcatgtgtctgggcacaggacggtgttgcctagtttgaacaccctctttgctctgtcactcctgcytcccttgggcgttcacattctcccattgcttcatgcaagagctgmtgagtggcctrtatcagccagctgttgccgcataacaaaaccatcccaaaactgagtgcagggaggcaacttcacctcgggctccactccacaagcccaaggggccaggtgagagtgctctctaaagccccctcctgcytcagttgtagttgcaaaattttaatttatgaaggtgactgatgacacagaggccaatgctgttgaaataagttattactcacagtttcccaccatgcagggccacagtggggaggcactaggtttggtccagggacagaatcaggagcgagtggaaggcacaggccacagcccacagtgccgtttccactggggaggcaaggcaggccaggggaagagggtaggattggcattttgaatcattctggtggggtttggggcgtggggttgggctctaattgtctgggtaggtgcctggccctgagctggtttagggcaggggaaatactggtttcgtatgtgagagttccttgaagggggtggttggtgtatggactcaagactggtcggtttgcatatgaaaggcatgagttgtttctgatctccaggaatcaagcagtttctctccagccaacaagcccccaccccgagatgttaaaccatcataaaatagagaatctaaggccaggcatggtggctcacgcctgtaatcccagcactttgggaggccaaggcgggaggatcatttgaggtcagaagttcgagaccagcctggccaatgtggtgaaaccccatctctactaaaaatacaaaaattagcccggtgtggtggcacgtgcctataatcccagctactcgggaggctgcggcaggagaattgtttgaacatgggaggtggaggttgcagtgagctgagatcgtgccactgcactccagcctgggcaacaagagcaagactccgtctcaaaaaaaaaaaaaaaaaaaaagagagactctaaaaatacacgttaatatacctcccccgctcttacccttcaggagggggtgtctagaccccgcgggactccagctacaagggaccctggggaggccaactctgccctcttggctawtccccaagactgcccagcaccccytccaccccttctccattcagtggcgaaccctggggaggccacgtgggaaggaaagagggctctaagaggggaggccccagactgggggagaggcctgtctggagcccaggatcacctggctgtgctgcagaactggagaagagaagctcagcagaaaggagctggcatggggccaacagcagaaaagcaggaggcacgcagaagtgactgggaagcaggagggtaggcatggaccctgaggctgagcaggaggtactgaggggcagagtggacgctgagctgggggtagcgagcgagcccagctcagctgtgacgccctctgtttggccacccaactaccagctacttgggctgccccgggaggaactgggcttcctctgacattctgtggcctgcggccatctgtcacaccttcttctctctctgcccctcccttgacttgtggcacccacagacaggtgggagagtgtacctgccctgtgtggtcagagcttggttttgagtttccttccctcacccctctttcctcccacacgccaaaacacaagaggatgtgtcagaggcctgtgaaccagagcaactccatcctgaataggggctgagcaaaataaggctgagacctactgggctgcgtttccagacagttacagcattctgcgtcacaggatgagataggagatacaggtcataaagaccttgctgataaaatagtttgcagtaggccaggcgmrgtasstcacgcctgtaatcccagcactttgggaggctgaggtgggcggatcacctgaggtcagaagttcgagaccagcctggccaacaaggtgaaacctcatctctactaaaaatacaaaaactagccaggcatggtggtgtgtgcctgtaatcccagctacttgggaggytgaggcaggagaatcgcttgaacccaggaggtggaggttgcagtgagctgagatcrtgtcactgcactccagcctggagcgagactccgtctcaaaaaacaaaacaaacaaaaaaatcagcttgcaatatagaagctggctaaaacccacccaaaccaagatggtgatgagagtgacctctggtcgtccccactgctacactcccaccagcrycatgacaggttacagatgccatggcagtatcaggaagttaccatatatggtctaaaaaggggagacatgaacaatccacccctgtttagcagatcatccagaaacaaccataaaaatgggcaaccagcagccctcagggctgcgctctctatggagtagccattcttttattcttttactttcytaataaatgtgctttcactttatrgactcgtctcaaattctttcttgcacgagatccaagaaccctctcctggggtctgaatctggacccctttccggtaacagatgtcgtagagtgaagcacaaccactgcaggggcatcttggtttacattttgcttcagcggccatggttagcacagcggaaagcacatcacagtcttctgattcattaaaaaaattaggaaatggaccaccacaaaccacagacagatgtactgagacaggataggtagtcaagaaagtgaccatgttctaggcgcgcagcagcaactgtggtgaccgtacagtcaacaagcctcagcactggcattgcaattgagctcattcaagcaaagctatcttcagcagggacttctccctctaggcagcaagcgcatttttattttacctgtcctcaaactgatcctktgctccttataayagtaaggaacacacccctgtgtggagatttaagatgctaatgaggccaagcgcagttgctcacgtctgtaattccagcactttgggwggcagaggtgggcgggtcacttgaggttagaagttcgagaccagcctggccaacatggtgaaaccttgtctctactaaaaatacaaaaattagccgggcatggtggcgggcgtctgtaatcccagctacctgggaggctgaggcagaagaatcgcttgaacctgggaggcggaggttgcagtgagccaagatcgtgccactgcactccagcctgagggagagagagagcaagacatcgtttttgtttgtttgtttgtttgtttgtttgttttttaaaaaaaagtcaagacaaatcatagtgggggcttttctggtcactttttaaatcttagtgttgagactttatttgagacagggccttactctgttgcccaggttggatgagatttttaacctcaatatttacttatagaataactttttggttagtcaaaacaatgctgtgtctcattctgatcagaataaaacatcagacaactcaagagaaacattctgcaaaataactggccaggattcttcaaaagtgtcaagggtaaagataaggaaagatgaaggaactcccagattgaggagaataaggagacaactgtgatgtgggatcctagaatggatcttggaacagaaaaaggacattagtggaaaaatgagaaatgcaaaacagtctacagtttcgttaacaggattgtaccaaggttagtttcctagctgtaatgattggactatgattaagtaagatggaccatcaggggaagctgggtgaagggtgtaaggaaaatgcttacattttccamcttttctgcaagtctaaaattagtcaacaataagaagtttaaaataggccaggcatggtggctcacacctgtcatcctagcactttgagaggccgaggtgggaggatggtttgagcccaggarttcaagaccagcctgcgcaatagagcgagaccccaactctattcaaaaaaatttttttaagtttaaaatagaattatataaaaaaggaaaagaaaaatgctgtttcatagcgttcctagtttagcatgggagagaccaggtctccctgggtggttgtctgtgtgttgctgggtgtgcgtggcarggctagtgtgttggggtccgtctaggcacattcaggcgccgaatcccgtggctcccaggtttacctgacggtgcagcctggggtggagacttaatgagggcggggagttgctgcagcaaaggctcctcccaggggtatcagcgcagacagctgggttttcactgtgctcctgctccagagvcactaggaagggggcgcctatcagactaggrctctgccagccatccttctctgttgaaggtccagcatggtccgctgcctggggcctgcgctgctgctgctgctgttactgggtgagcgcccctctcttcccctggaccccgaaccctggcctctctgtccctgctcctcagtgacaaggtgggagggcaagatattccaggaaaagctgaaccacaggaagggttgccagtgagargcctgtgcgcacggcttggggacccctggcaattgaccccactatgtgctgagcacctcacctcccagccccgtcaagccaccaccgccatccccctcccgagtccagccttggcacccgtgccccaggaacttttgcctattgtctgccatctcccaactctctcaccctcccctcagccccagccctcctacccatcacacagattccttggtgaatcttyggtgttgttcatctgttgttccaccttcttggactgctccgtccctgcatggatgtcrcggagggaggggtcactttaccgagtgtagtgtggaaagtggaatctggtaaaggtttaaggtggaggagatcttgcagctgagatgagctgctgtgagggtggagactgggtaagggtgttctgggcaagggtgacaggtaagcaacaggcagaggtgggttcaaacccttaggcaacatcaggtgctggtgtgtgcagctgagacctgaggatgtgcctggcaaggctgtgagaggaaagcaaaktgtgccctttggggaggggaggaagggaggactcaycccgctgccatctatcccctccactcagggaccattctaagccctcgagctatgttcatccttcctgcagaggcaggtgctgaagtcacagcaggaatcactctcaccacgcggtccaatccacagcytgaaagacacagccattgccagagaggcaccctgctcccagccctggggggggataccaccccgtagcccctgtgcacaaacacacagggagatggatgaggggccaggctgtgcacgtccactcaggctgggcaccagaaaggcttctagtctgaatgagatgctccagactggagaacttgtggaggctgggggggattcgattagcctggkttttgtgactcaaatcctgggaaggggctgccaagtcccaacttccagttatcctggctctatttagmcacagcctgtgggcatgtgggcagagctcaccctctgtctacccaacccctggtgtgtgactggggtgccagrcacyttctctgtctccagcagggtgtcacctatcatggggcctggtcactaaaaccactgatgaacccttgggtcctgtggctcaggacaaagcccggcggtgtgtcgtcagggacttctctgaatccacaccctggcagccaggactcagtgggttcttcagtggccagagctcttgcataaatccgctctcccctggctgatgaagggtggaggggctggaggaagc

SEQ ID NO: 13497 - DNA, 21623 bp, Homo sapiens
ttaccaaaaagtacattttaacattaccttgcttctgggctatagcttatgactactataaatgagaggtatagtggcatgctctctacaccaggcattgcatcttagaaggtaagaatgataatgaggcccctcctatacatgagaacacggaggatgggagatgttaaataacttggttaagatctacagctcataaatagaagttgaccctagggctattagatgccaaagtccacactgataaaccgggcagaaagaaagaggcttttagacaaagaaaaaataaaataacatgtaatagttgattagtgctctaagttgtattacacaaaatgtgctgatagtccaaaaatataactaagaagagttggataaactgaaagtgtccatgaacttctaaggcttggaaatgggatggccaaaacccaagcacagaattgtctgccttctatgtcagagatttttacagtacctactctgtcatttaaaattatattgtttcccagacttcacactgacaggattttataacattatgcacatttaaaatattacttataatagaattgttacattcatttattttgagatgattttacctttgtaattctattttccaagtacacatttaagtcaacaatttggttcctataaattatatccactctgtctacaattccccatccaacttgggtggttggtaattacaactcagtcactataagaacaacttcctcttaccaaaatttttacaaatttgtggagtgtgtccagccagaaatcaacaaaaaaatatatattattacaaccactgaccattttcgcttcaaaattttaatgttatttttgtataatttacgtcaaagaaaatgtactccttttaagaatacaagttgataactaatgatacatggctattctagtataataacatcctagtgaataggcaaaccgattttgtcaccccagaaagttttgtcacgcccattgttatcaatctccttccacttcctcctcagataagtagtcatcgaatttctatcactgtacgttagtttttcctaatctagaactttatataattggaatcacagggtatgtgttccttcctatatggcttctttcactcataattgaaacatatttttttcatccatgttattgcatatattagtaatttttccctttcatgactgaatagcatttcagtgtacatgtatagcacaaattgttattttatgctctggaattggatatttatttgtttccagtttttgacatcttcatttttgaggaaacagtgggcccttgcaatctagtggctcagtgtttagctttccatgacatgagactcaaggcttatggttctacattcccagatatatggtctagtcatggcttctgtttctgggatgtcactctgacatgcttcaactcagtggttcatggctctggctgtgggcgaaaccctcatgtgaaatactttagttaatagaaaaaaaattgaatcatttaaaagtacatgatgggaagataagtaatacacaggcaatttctgctttcttccatgctacaaatcctcccagtggcaaggagcacaagtttgtgctgccatcggattaagtcattggcaaagtaaagataaaacaccatgagaggttgggcatggtggctcacatctataatcccagcactttgggaggccaaggtggccagattacgaggtcaggagtttgagaccagtctggtgaacatagtgaaaccccatctctagtaaaaatacaaaaaattagccaggtgtggtggtgcctgtaattccagctacttgggaggctgaggcaggagaatcacatgaacccgggaggcggagatggcaccattgcactccagtggggtgacagtgcgagactctgtcaaaaaataaaaaataaaaaaaaaaaacgatgtcctcctacacagtgagttctagtcaaacccaaacacatttaacccttcacctagagcacagaaaataaaactggtagcccacatgtcaaaaggtggatgtttttctaactctgggtctttaatctccaaaaatattaaggtaacaaatcaggagaatttttggtaaagaatttgataaacgtaacataccgtgtgcattttgcaattagcccacctttcatcaaatagatttataaaataaattagccacattgagtttgtttctgggataagcaattgaacatgtgattgcaaaggcagagaccttttctggccttccctggctcctctgtctaaagttcatgagtcctgcaatattttgtctcctactttgccaattttttttttatcattctcatcacttgctacatttgaacagtctgaatattccagttacatattacataccaggtgtattagtctgttctcatgctgctaataaagacatacccaagactgggtatttataaagaaaaaaagaggtttaatgggctcatagttccacatggctggggaagcctcacaatcatggtggaaggcaaaagaggagcaaggacacatcttccatggaagcagacaaaaaggcatgtgcaggggaactcccctttatgaagccatcagatctcatgagactttttcactatcatgagaacaacatgggaaaaacccacctccatgattcaattacctcccaccaggtgcctcccatgacaccaggggattattacaatttaaggtgaggttttggtggggacacagagccaaactctgtcattctgcccctggcctctcctaaatgtcatgtgctcacatttcaaaaccaatcctgccttccaactgttcctcaaagtcttcactcattccagcattaacccaaaagtccaagtccaaagtcttctctaagacaaggcaagtcccttccacctatgagcctgtaaaatcaaaagcaagttagttacttcctagatacaacggggatacaggcattgggtaaatacacccattccaaatgggagaaattggccaaaggaaggggctacattccccatgcgagtccaatatccagtagggcagccaaatcttaaagcttcaaaatgatctttgactccatgtctcatatctcggtcatgctgatgcaagagtcggggtcccatggccttgggcagctccaccctcgtggctttgcagtgtacagcatccctcctagctgctttcatgggttggcattgagtgcctgagtattccaggtgcatggtgcaagccgtttgtggatctaccattttaggatctggaggatggtggcccttttctcatggctccactaggcagtgccccagtgaggactctgtgtgggagctcacaccccacatttcccttctgcattgccctagtagaagttcttcatgagggtcccacccctgcagcaaacttctgcctggacatacaagcatttccatacatcctctgaaatctagacagaggttcccaaacctcaattcttgacttctgtgcccctacaggctccacaccacatggaagctgccaaggcttggggcttgcaccctttgaagtcacagcccaagctatttcttggccccttttagccatggcttcagtggcccgggaagaagggcactaagcctttaggctgcatacagcagaagggccctcggcttacctcatgaaaacatttttttccctcttaggtctccagtcctgtgataggaggggctgcctggaaggtctctgacatactctggagacatattccccattgtcttggagattaatgtcttagagattaacatttggctcctcgttacttctgcaaatttctacagttggcttgaatttctccttagaaagtgggttttgctttcccagcacatcatctggctgcgaatgtttcaaacttttatgctctgcttcccttttaaacataagttccaattccaaaccatatctttgcaaatacataaaaatgaatgcttttaacagcacccaaatcacttctggaatgctttgctgcttagaaatttcttctgccagatgccctaaatcatctctctcaagttcaaagttccacagatctctagggcaggggcaagatgccaccactctcttcactaaaacgcagcaacagtcacttttattccacttcccaacaagttcctatcttcattcgagatgagcagcatttagtcaaagccattcaacaagtctctagaaagttccagattctattttcctatctttctctaagccctaagaactgttccaacctctgcattttacccagttccaacatcgcttccacatttttggagatctttacagcagcactccattactcagtataaatttactgcattagtcatttctcacactgctaataaagacatactcaaggctgggtaattatatagaacaaaaaagatatttaatagactcacagttccacatggctggggaggcctcagaatcatagcaaaaggcaaaagaggagcaaggacacgtcttacatgggtgcaggcaagagggtatgagcagaggaattcccttttataaaaccatcggatctcatgagacattcattatcaagagaacagcatggaaaaaaaacagcacccatgattcaattacatcccaccagatacctcccataacacatgaggattattacaattcaaggtgagatttgagtagggaaacagagacagaccatatcaccagccttcatgtttgtctttccctcttgaatgtgagaccaaaggggaaaggaccatgatatgttttgactgaacctctggcacctagagcaatgtcgtccgtatatgtttgctaaatgaatgactagatgcactgcttgaggattctaacaaaagataaacttagctaaataatctgcaaataatcatccttgattatttttctaaccttaaacatttgtattaattataataatatcactcattatttgcttaccatttgccaggctatgttccatgcattttccacattttctctcacttaatgctcaaaactgtgtaggtacatactattaataaaattatttcacatacagaggaaccaatgcatagggaagttcattatcttgccaaggaagggaagtttaaaatgctaagttcgacattctcattccagagcctatgctctgggcctctacaatgcaatttccctcaaaaataaaccctccaggatgggtgggtggctcatgcctgtaatcctagcaatttgggagaccaaggtgggcacattgcttgagcctgggagctgaagacaagcctaggaaacacaaggagaccctgtctttacaagagatacaaatattagctggccatggtggcatgtgccagtaattgcagctactcgggaggctgagttggaagaatcatctgagcctgggaagtggaggctgcagtgagccaaggtcaaataactgcattccggcctgcacgacagaatgataccctgtatcagaaaaaaaaaaaaaaaaaaaaacagaaagaaaaaagcaatgtgaaaagaaggacattaaataagaaaagctttaattctggtgaaaaatgtttctatttcttaaagcaaaaatgtttcacagggacatacattacccacaactttcccaagagctatgaggtggggtcaggggaacagtggttcacatactccaaaggttgtgttacttttctccgtcaagctttctaatgattgagaaactcttcactgtgtgaatttaattgtacacatactttttcaatcctgtcttactctccaagccccattcccctcctaccctgatctatccaagggctggtgaagaaaatttcccatggatacactacctgatgcaggctacagttctgattctttaatgggaagaaaaataaagacatgcatatgcatgcacagtgagtatttcccaatacatgtacaggccctgccaaaaaggaaggcgaagcatactttcagtttcagtcacacaagaagggaggagagaaaagccatggccggtgagtcttttactgttccaagaacaggtccctgggaagaaagagttttggaaggggctggctcttctggaagccataattagcatctgtggaagtttacttgagtagaagcaaggaaaaggggrgagagggaggagagaaggaactagaagattcttgcagactttagaaaggaaaggcaagcccagaaaggaactgaggctttaggggaagcctgatgtcattttgcaatcttaattaaactcttacttacatgttgaaagtctgacagagggtacagaattggcacaggaggagtactagcagcagtggttcctaaatgaaatgggctatttctgcttcattactttattaaccagagttaaataaacatgcgacataagaggatgatctctgctttccagggactgatgtggaaatggtaaactcagtcttcaggtcactccatgcacatgtatggagactattgagggaaacaagtaggacagcaatacagtaagaagagggattacccaacygtgaggagggggacatttcactgatgaaatctaaatgaggtcactttctgttgattacatgagaggaatatgaggctgttttcatgatgtgagaaatccttgtgctcyaaacagacaaggtcctgaaggagaagagaaagcwgtttatccrttccatgggygaaggtacaataaatggcttactggatgaattattacagacaagggtgctgaacmaggaagagatggagaaagtaaaaygtgaaaatgctacagttatggataagacycgagctttgattgactccgttattccgaaaggggcacaggcatgccaaatttgcatcacatacatttgtgaagaagacagktacctggcagggacgctgggactytcagcaggtaagggtcagtgactyacacycaagttcacctagggcctgtcttcgtgcctaacatttgatttctttactagtcatgttaattggaagaaaactttcttatttctggcttcagggccatatttctgtagcagggtccctattgcatgtcccttgactctcctttgattcttttccttaatcctcagtggcactcttctgattaaagctcatttcctgttctgagtatgtggtagctcctttactgaagctcttgagaaccatctgaaaagcttcatgctgtgttttccagtgttcctggcaaggcaaaatatttacctgtggatttatttttgctgagtgcaaggggtctgtaggcacttatgkagttgtaaagtcacatgaagctttaaggtttataatcaaayactttttataacttttctccaaaattttaccctcccaaaagaataaaatatatttcaatgatggcgatacactcagagaacacattgaacgtatagaaaagtgaagatttctaatgggctcattcctccagttgcctccttgtattttctttsagtaagatcacctggttgcctgttaccaggctgtgggtcatgctgtgaggcctggaaatcctccacttgcaaccctcytcaggcccaatacagggctcaggaactgagctggccaaatctcatgaccacttggacctaccacgtggtgaggatgagagttctggtggattcccagtcattgatgtctgtggcacttcctaaagccacttcagagggagatgttctttgaaagcaaaagccttctgttctaagggttagggaaagcttatgcctgtctaagcagacattgcagatgtttctgttttcatctatgtgtaataaacacgtatttttctaccaatgcctctttcattttctacctcccaccactctctaaattaaagaacatcttkaacattatttaatgtcagtcagtcagtcagtgttatgggagaaatttttagtggggagtgttttacagattggggtaaagttttccagagatgataagtgactacttcaataccctttatcttttcatagatcaaacatctggaaattaccttaatatgcaagactctcaaggagtactttcttcctttccaggtaatgctgtttttaaaggaagagcattctttgacccacatcttccttgacattaattttgtaggatcaaaygtgggtaaatgggctatggagaattctcatagattggtcatataattttctttttgtaatctattctgcttttgtagaaactgtttccacagcttcattatccacatttatattaaaaattctgaatctgtgtctcaaatcctgattacccaaataagtaccaaacttcattatttaagcctactgaaatattcactcccatctcccagagacaccttattctaaactttcccagagctgaaaatgctatacttccacaccctgcttctcttccggttttgtgtaacttggttattggtgccaccgtcaccagttgttcaaaccaggaacttgaaactcatatgggacccttccttctcatgcacctctaacattcaacccatggccaagttttatgcaggcttttctcaaatttggaaccatctctctatttctacttctattattttattaaagaacccctattcccatagtgcactcttaaacttatatctgaaagcaawgtagaggctaggaatgcaaattatttatcaagttcagatattactctactgaatttattaaggttgggtatcatgaatattttcttaaatgtttcacagcatgggatattcaatatataaagaaatactgtattctctactatgaaaaaatagctcaaaaataacctaactacttctagtttttttctattgttttcacacttctttatgaagaaatccaacattttatccaacaaatgattattctataattttttccaatatatctattctaattmgttcttctccacatcagcacatttcatgctgcctttgtttatctaactgattgtataacmatttttcaaatttgtttttaaaattaaatattattttttgccttaatagcttctaaaagatcctccacacatctagaaaacttatttctattttaaaacaaaggttacrttaatttctttaacaaggacatcacattgttggattgtgttgaacctgtgatgaaataaaaggctcaaggattttctcacataaactctgtgaaaacatttcctcaagtgtctgtgcaatgaatgtttagtgctataaatccatctagtgtgtaccttgattttagcatttatcattatatcttcattctacttcatatattcaatattcatgtcctttcatatgtatacatagaaggaagagatcctgaaggacaggacaaagattcattaaaaaatattcctagtgcttactaccatgtatattaagtaaataaataaaaagataaacatgtattttaaaaaatattttagtagattaaattaagacctgatcccattaaattttatcctagggtttgaatattttgaaaaaagtttatattcttaactattttatctcacacattttttgttttctgagtgttttatcaggcatagactttaaattttccctttctatgttagtatctaaaatgcttgtagaaaggctgatcctgaaatatgaaagaagatacttgtaatgcatacctggaaatctcttgcttgaaatgtgctccattaggagcaaactcactcagctgtgttaatgatgtagatcaggattgtcctcctcagagtgcatttcctcttctgtggcttcatccataggtgaggctgtaacaaacacaaagtggaacaaacagggatgccactgttcatgatgttctttgtctcttgcagctcctcaggcagtgcaggacaacccagctatgcccacatcctcaggctcagaagggaatgtcaagctttgctccctagaagaagctcaaaggatatggaaacaaaagtcggcagaggtgccatgctcagaacccaaggatagagtggggtgaaagaaacacttcargcagttctgaaatgcagtggcttattcttagagccaaccycattgagcagttctggagaatcatacttctgctccccttacataaaggatttctatatcctagaatcccaggtttatagaaagaggtccaaattggatccacttccggggtaaataacatcagtgatgacagctattgaatgcttattaagaatgggcattgttctaagcattttgcacatgataatatataatttttaaccttaaacacaacccattttagagatcaagaagctgagacgggattgttaaatatttttcccaaagaaaaacaatcagaaattggaacaatcagttttagaattcagtcatttttgcttcaaagcttgtgcatctttcaaaatcctacctatcaagaacaacgaagtcagaagctcagctgccatctgggcatttgcaatgtccatgcatactcttgaagcagcattcaattctgttcccccttttcaatgtatggttcatggggtttggtrtcttgataggactaaggaaggggaagctgtcataaaccaggaagggaaatatttaattggaaagaacaaggctgttcattcaaattgcatttcctacagatttatccaataatggacaagtcaagccgcacacgtcttgctctcattatctgcaatgaagaatttgacagtattcctagaagaactggagctgaggttgacatcacaggcatgacaatgctgctacaaaatctggggtacagcgtagatgtgaaaaaaaatctcactgcttyggtaagttctattatacaacagaaacaatggttatgcccttcgtataactraataatattagaaagcttggttgtaagaccaagaaatgtaatctcttgataatctaaartacaaacttgccatgagagagtgctggatactacatggtcctttgtaacataagagtcatgcagcacaagcctggtataactgaattgggaaatgttttattgactcagtaatgccactgtctctctacaagataactctggatgacttcctataacactttccttcacctttcttgaaactaagactaaatttttttttggcaccctgttgtttgtcacggaattccttaagaaactccttaagtatttatttattgactttccaaggtaccatgatagttaattacatagtcgaaaatcagtgatatggtgtctttcaggacatgactacagagctggaggcatttgcacaccgcccagagcacaagacctctgacagcacgttcctggtgttcatgtctcatggtattcgggaaggcatttgtgggaagaaacactctgagcaagtcccagatataytacaactcaatgcaatctttaacatgttgaataccaagaactgcccaagtttgaaggacaaaccgaaggtgatcatcatccaggcctgccgtggtggtgagtrctgatgcctttgagaacaccagacaatcaaatactatcctactctgtatgcatccaagaatttttggtttcttttggtttgtcttttaatgtcaaagaacacatactgtcagtattcaagaatgcagcttctgtgaattgaatggctggttggtagatatttattccatatttaagcttgagattttgatgtttggaaatttttacaatttgtttgatggttagaaaagataaacattgttgaaaagattgtaactgaaatgcatgtgtstatttgcatgtgaattaatgatagagcaaacacattaataaatatcattgaacagaggctaggaggaaaacatcttctcagccattggtagtagtaacaaatcaaactgtgtctttccagacagccctggtgtggtgtggtttaaagattcagtaggagtttctggaaacctatctttaccaactacagaagagtttgaggatgatgctattargaaagcccacatagagaaggattttatcgctttctgctcttccacaccaggtaacaggtttctacacaggacatctttgttggkgctatcaatagaaaaagtgacaataacccactagaggtggtgattaacaactcaagaycaactcaagctttgttccaagttatacacagaattccctttatccaagagagcaattttgcatatctgttcaatgcattactaattaaagaattcatctatgtttcaaaatatttttggaactttgagcgatagcagagaattaaatggaagacggtatgtgctgtagtacattagaatctgactctgcatagaaaattctgccatgttgagatcattcattagtccaatttgcccagacatcaaatatttataggagaagagtaagagcaagattctgaaaagcagaacagcaagcgagrcactttggggccctaaattaaagtgggttttacctagaagcatgaagtgtgtgagacagaatatatttgaatttttctaaaygtaygctttggagtaagaatcttgctattattgactgacccagacatttagtattttgtaaaacagttccactagttcctcctcgggctttccttgaattgctgactaatatgtgaatataaatattatttttctaaggatttaataaattaatatatttgaaatattgggcacgacacaaaataaagcacacattaaaaaactgctattatttaaaatgtatatatttgataacttaattcagttacttttctaagcaaggtttaaataaaaattatttaaatcctttcattcaccacctttggcagtttcctgagaggacttgcattctyttggtcacctctggcccaaaggccctgyctctgctcaaatagttaagttttctaaaatrttttctaaaatgagatatcttctttcagaagaagcttggttctacattgggttgaacatgccctgatgtagaactcaataatttttttttcccaatgatcagaaacaatgacactacccaaaaacaccatatattttcagcctgagtacgtatagcagagtttaatattagacagaactgttcgttagtatcstttgatcccagccttccacatgacattcaccgctctctaagtagctctttgtaggcctctggcttctcattatcaatctggctgatttatgtgtctttcttttctttcactttccttactcctaccttctagatgactgtcagaaactccaattcagttatctataacttccatgttaaacctatctccacattctgctgtgccaatcccaaccacatcatagtgatctcctgaagaaaaataattatctacttccttaatttcacaaaacatttgcaragatatctgtctccacgatatctttcacttacttccttttactagaacaagtctcagttaaaggcttcatttagctgagatagctgggtttctaaatagaattttattatyaatatatactttatgaccwttakaactggctaaaatgtgtcattaaagaatgtgtctgtcattacatacagagctattgctgctgcttttctcttatgacttcctttgcataattttatgccttcattacttctgtgtctactatgtaataaattaatatttttctttaatatttctcttcttcataagaacttttttcctccaatatactgtgcttatttccttatctactcctcctagatttctacttttgttctgttttatgatttttatagttaactttttgtgtgtaaatatcttactgtcaatgttatttaatttcgattaatcttttatgaagtacataaattgagaatttgataatataattaccccatgtagactgagtattgcmtatcctgggttatctcaaacacttgcgtgacctcagatacctcttgtgtatggagttattaccatcccctgtatagctagctgagtctattaaatatcagaatgcataattaacttaaatcacagtcagtaataccactttgggaatgcacatttagatatttcrtttccaaatcccaatcactcccctctaccccattccgccttttccttatttgctactaaatttatgatttcaaacatccctcagctggagtataaatactagggtttcttctctttcttcaggcaagagccagtcttgagatttgaaatgtgctttatccatagataatgtttcttggagacatcccacaatgggctctgtttttattggaagactcattgaacatatgcaagaatatgcctgttcctgtgatgtggaggaaattttccgcaaggtaagatgctagtggatgctattttcactctacttccctgaatgcttggctattgcaattggaagcatagaaagcagatccagacaagtttatcttccaataatgctcttctttccaaaagagttttggagytctttggagagtggacaaacccaggagcctaatccaatctattaagacccacagccttgagaaaacaatcatttagtttcaccccgctcctgccctgcagagacaaatgaatggactctaatttacctgtgtctctcatggctattagatccagcagcagatttaaaatgccctgaggagggtcattcaatgcttacatacatatatggttatacttgttgcagatggaagtactttttgtttttgtcacttattttgctatatttgttgtagttttttggcataactcaagaaattcttgaaaaaaaaaactcagcaaaaaaaagggctacagactttccttactcttttaggttcgattttcatttgagcagccagatggtagagcgcagatgcccaccactgaaagagtgactttgacaagatgtttctacctcttcccaggacattaaaataaggaaactgtatgaatgtctgtgggcaggtacatgtgtatggtcgggagtgtgggaaggttgaggaaagggtactgaaagtccatttkagtcaagaactcyaggtttacaggctgagaatccttaatccaaaaattygaattttgaaatgctctaaaatccaacactgtgtgagcgcccacatgatattcaaaggaaatgtttattgaaacatttcaaattataggtttttggattagggatgctaaaccagtaagtatacagctgaattccaatatacaaaaatatctgaaatttgaaatacttctggtagcatgcattttggataagggataatcaagccatatacagaaaatactgaagtaatgyctttcttctggtcagtgcagagcacgttgctcttctcccaaagtttttcatttagaccccttttgagattcatctgatattggcctagaagtggcygtaagactacaaaccctcacttttggatgtttctctccttcacctcagcagggtatatttaaacatagcatgtggtctttccttttaaaattgtgtatgttcccattggtggtataactttataacttgcatgtctttaacaaaattctttcctatgtttttttttttaattatttctttttctcataggaagtgaagagatccttctgtaaaggtttttggaattatgtctgctgaataataaacttttttgaaataataaatctggtagaaaaatgaaaacttgtcctcatttttctcccacactgaagaaacagggactggaacttagagtgactaaggaatttagagtgtttgacttaatctgtcagacccaaactggctattggcacctttctttcccagaacttaaagtaaaataaaatataaaaatttaaaaaagaaaatcagacttacaaacatagcaatgttattaattactttcttgaacaaaaatttattttgtgccatttttaaaaaaagaaaaatcgtttgctgggctttctgctttggggatgtgatataagttacagcaggtatctgacttcaaataatttagagctcagcaggagagacgggggaagacagctagttatgacagcgacagtgtagtgtgataaagaacttttcccaaatcccacagtttgctactgacaaatccatgaacttgcatgtttctaccctttgcaaaagtatttaagacaaagtaagttttgaatcaaccctcagtagttcacagacttcttgaaaagataagacagccatccaaaatgaagcgcttggcagatggtgcctgacaccctgaagaaactctaggatgcatggtgtgcacagtgaagtcctggcatggtgcagagaaaacgagtttggggtgaaatcatgcactcagggatgttaagatttagggaggattcgaagaactaccccttacttgcaaatatgtttttttctaatatttaacagattaaatgagagttaatttctgacttcttaaacaccttcatagttgaacacattacagtctctctctctctctctttttttttttttttaccttttattaactgtttctctgggcatatctcttctgtgttatcatgcatactctactacaacctgagactacatctgtgatcagtctttgctcagagaatatcaaaaaggagaagtgaattgccaccctaagtaaaaattaactgttaaagcagttttagtcagttgaagaacagcattccaggaagtagataagaggattccttcagaactgtctccaatcaaagcgtaagatgacagggagatggggaggagaagactccatcatgattcctcagcacagtttaaacaagaaatacatttattgaataaacaatcctttccttgtttctttttgctgttgttgttgactttgttgagtatcagttggttataggtgtgtggctttattttggggttctctattctgttccattgggctatgtgtctgttttttttgtacgaataccttgctgttgtggttactgtagacttctagcatagcttgaagtccagtaatgtgatgcatccatctttttgaaaagcagtttggagatttaccaaataactaaaaaaagaactatcatttgtccaagcatcccattactgactgaatcctcaaaggaaaatgtactgttctatcaaaaagacatgtgctttcaaatgtttgtcgcagcactattcactgtagccaaaataatagaatcaacccaggtgtccatcaatggtggattggatttaaaaaaatgtggtacacacctactatggaatgttacacagccataaaaatgaaaccctgccctttgcagcaacatggatgcaactggaggccattattctaagcaaattaatgcagaaacagaaaaccaaatatcacataatctcacttgtaagttctagctaaatattgtgtacacatggacataaagacgggaataacagacacagggaaataccagagggaggaatgaaggaagaaggcaagagccgaaaaactatgtactgggtgctattctcactacctaggtaataggttaaattgtactacaaacctctgcatcacctaatatactcttgtaacaaacctgcatatgtacccctgaaactcaaataaaaattgaaatgaaaaataaagaaacccaagatatacaaaatatttggttaattcttatgggaagatgcaaggaaactagttagattttactcattcaggacatgtgtttttagacgagcagaggtagaaaaactgacagatcagaagagagggatgaataaaagaagatgtggggctatggagagagaaaaggaaaaagaaaaccaggctgaggtttcaacccacaaaacaatgttttgtcatttgcattttttttccccagggaagaatctagagttcaagaatagaaagccaatttgcttactacagggcacttcccaatgatgaaactataggttcccagaagcaacttcccataatctgtaatcacttgtccccactccctgcaataaggaagtacctagtgtattttatctctgagtctgaggcactttccagtgctgtacaaagagacagaggctgttagctatggctggtgagtctgggcccttttctgactagcagctgggtactcaggtcttagaaaaatcttgatttattgctatgtgacaggcagaaataccaaaagggaaatcaaccaatagtgtgcatgctgaatctttctcttattggtggtatgtagtttgaatcctgagactgtgtagagacactgaaggagagtatgttctctagatgttttcaagccagaaaaaggttaattcctttctttcagcttctggtaatcaaagagagagtaaggaaagacagagtaagttatttgtgtgagaaaactccggaaatttctaaatgcactctgaaatcttctctgcttcctcttgattccaaattaatcctccagactatgaaccttctccccacaatcagatctgagagcctctgtgttctcaacgtgttgtcatctcttatcttgaattatcttattggtctgtttaaagtgattgcatttttccacctttctatgtagtcctggtactaactcttataatgtaatatatcttaggttgctatcatagacttttaactgtcttcccactcccaaaaacttaacccttcagtccatactgcacactactttcaggccaactgtcttatacacagaagctaaaaaagcctatgagttggagtcctgggctacttaagcagctcgtattccagcaggtcatattgcgtctttggtttcattctcctcactggaaaaaggaagaaactggaatagatcagtgctttctaaaccttataacatatatgaataatctgcagtctttttttttctttaatttatttatttattattattatactttaagttttagggtacatgtgcacaatgtgcaggttagttacatatgtatacatgtgacatgctggtgggctgcacccactaactcgtcatctagcattaggtatatctcccaatgctatccctcccccctccccccaccccacaacaggctccagagtgtgatgttccccttcctgtgtccatgtgttctcattgttcagttcccacctatgagtgagaatatgcggtgtttggttttttgttcttgtgatagtttactgagaatgatgatttccaatttcatccatgtccctacaaaggacatgaactcatcattttttatggctgcataatattccatggtgtatatgtgccacattttcttaatccagtctatcattgttggacatttgggttggttccaagtctttgctattgtgaataatgccacaataaacatacgtgtgcatgtgtctttatagcagcatgatttatagtcctttgggtatatacccagtaaagggatggctgggtcaaatggtatttctagttctagatccctgaggaatcgccacactgacttccacaatggttgaactagtttacagtcccaccaacagtgtaaaagtgttcctatttttccacatcctctccagcacctgttgtttcctgactttttaatgattgccgttctaactggtgtgagatggtatctcattgtggttttgatttgcatttctctgatggccagtgatggtgagcactttttcatgtgttttttggctgcataaatgtcttcttttgagaagtgtctgttcatgtccttcgcccactttttgatggggttgtttgtttttttcttgtaaatttgtttgagttcattgtagaatctggatattagccctttgtcagacgagtaggttgcgaaaattttctcccattttgtaggttgcctgttcattctgatggtagtttcttttgctgtgcagaagctctttagtttaattagatcccatttgtcaattttggcttttgttgccattgcttttggtgttttggacatgaagtccttgcccatgcctatgtcctgaatggtaatgtctaggttttcttctagggtttttatggttttaggtctaacttttaagtctttaatccatcttgaattaatttttgtataaggtgtaagaaagggatccagtttcagctttctacatatggctagccagttttcccagcaccatttattaaatagggaatcctttccgcattgcttgtttgtctcaggtttgtcaaagatcagatagttgtagatatgcggcgttatttctgagggctctgttctgttccattgatctatatctctgtgttggtaccagtaccatgctgttttggttactgtagctttgtagtatagtttgaagtcaggtagtgtgatgcctccagctttgttcttttggctcaggattgacttggcgatgcgggctcttttttggttccatatgaactgtaaagtagttttttccaattctgtgaagaaagtcattggtagcttgatggcgatggcattgaatctgtaaattatcttgggcagtatggccatttttcacgatattgattcttcctacccatgagcatggaacattcttccatttgtttgtaccctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttccacttttcctaattgaataccctttattttcttctcctgcctgatcgccctggccagaacttccaacactatgttgaataggagtggtgagagagggcatccctgtcttgcgccagttttcaaagggaatgcttccagtttttgcccattcagtatgatattggctgtgggtttgtcatagatagctcttattattttgaaatacatcccatcaatacctaatttattgagagtttttagcatgaagggttgttgaattttgtcaaaggccttttctgcatctattgagataatcatgtggtttttgtctttggttctgtttatatgctggattacatttattgatttgcgtatattgaaccagccttgcatcccagggatgaagcccacttgatcatggtggataagctttttgatgtgctgctagattcggtttgccagtattttattgaggatttttgcatcaatgttcatcaaggatattggtctaaaattctcttttttggttgtgtctctgcccggctttggtatcaggatgatgctggcctcataaaatgagttagggaggattccctctttttctattgattggaatagtttcagaaggaatggtaccagttcctccttgtacctctggtagaattcagctgtgaatccatctggtcctggactctttttggttggtaagctattgattattgccacaatttcagatcctgttattggtctattcagagattcaacttcttcctggtttagtcttgggagagtgtatgtgtccagaaacttatccatttcttctagattttctggtttatttgtgtagaggtgtttgtagtattctctgat

SEQ ID NO: 13498 - DNA, 36360 bp, Homo sapiens
ttttcagtctgtgtgagtctttataggcgacgtgtgtttcttgtaggcagcagatggttgggtcttgttttttttttatccattcagccactccgtcttttgattggagagtttagtctatttacattcaaagtttcttggttgtttttgaccaaactcacatactatcattcatcgatttgactgtgctgtaatttttttttttggagacagggtctcactttgatgcccaggctggagtgcagtggtgcaatcttggctcactgcaacctccgcctcctgggttcaagtgattctcatgcctcagccacccgagtagctgggattataggtgcgtgccaccacgcccagctaatctttgtatttttagtagagatggggttttgccacattgaccaggctggtctcaaactcctgacctcaagtgatccgcccacctcagcctcccaaagtactgggattacaggcatgagctactgcacctgcctatttacattcaaagttattattgataaagatttactcctgccattttgttatttgttttctcattgttttgtggtcttccctcctctttatctagaagagtttgtgttgaattggtgttatttattccttaagtggtagaattcaccgctgaaactacccgagccttgaatggtctctgtgggaacattttccccctacaaattccattttattgataatgtcaactgaaattaaggctgttgagacaaataattcgataaaggtttattggaagccaaatgtgaggatcaacccagaggaacacaccaacaaagttgagagtgttctggaatctaagtcagaaggtttctataggagaggctaggaggagggaaaggactcctcatactcatgtctaagtcagaaggcttctataggagaggctaggaggagggaaaggactcctcatactcatgttgtccttttctagtcagaaggtttctataggagaggctaagaggagggaaaggactcatactcatatctaagtcagaaggcttctacaggagaggctaggaggagagaaaggactcctcatactcatgttgtccttttctttggagggtacaacacagaggttacaagcattggctacagatgacaacatacaggtcaacacatctctgtgcaagacagtcagtaaacctttatgattcaggaataaatcagcatcttttcagtccattaatcagcacatcagcaatctgaggaaatcatgataagattctttactcagggaccattaatcataagaccttcccaagcaggccagtttggaagtctgtttacttttaaactgtcaaatgtgacctgtaaggttatcagatataaggctattcagagtatctatttcttcttgagtgaactttggtagtttgtgtcttttaaggaattggtcaatttcatctaggttgtcaaatttattggcataaagtcattcctaatacttccttattatcctttttatgtctgtagaatctgtggtagtggcatctctaatttctgctagtggtaatttttgtcttctttcttttttcccctaagtctggctagaggtttatcaatgtatggcctttttcctttgaagaacaggtttttggctggatcttacagagcccaggttggactagaaatcatttctagaacctatactagaatcatttctcttctataggatgtttcttctacctcatttttgccttggtggggggatgggagaaagagcttgattctttttttttttttttttcttgagatggagtctcgctctgtcgcccaggctggagtgcagtggtgcgatctcggctcactgcaacatccacctcccgggttcaagccattctcctgcctcagcctcctcagtagctgggattacaggcacccgccaccatgcctggctaatttttgtatttttagtagagatggggtttcaccatgtttgccaagctggtctcgaactcctgaccttgtgatccacccacctcggcttcccaaagtgctgggattacaggcatgagccaccgcacctggccaagagcttgattcttgatgagagaaatacattgatacagaaggaggagattacacctgctcttccacacccctcattggccctaacacacttctgtgcagtgtgttgacatacctcttctgcagtcttgaaaagtgattgggaaagaaatacactgaaaactacaaacatcactgaaaggaatgaaagaagacataaatgaccaggcacrgtggctcacacctgtaatcccaacattttggaaggctgagatgggcagatctcttgagcccaggagttcaagaccagcctcagcaacagggcgaaaccccatctctaccaascccccaccacccamgttagctggtcgtggtggtgcatgcctgtagttccagctattcaggaggctgaggtgggaggatcactcragcccagaaggtagaggttgcagtgagctgagatcgtgccactgcactccagcttgggtgacagagcgagaccctttcttcaaaaaaacaaacaaacaaacaataaataaataaacagaaaaacaccttgtgttcacagattagaagactttatattgttcaaaaatcaataattttgatatggattacattggatctgcagattcatgcaatcccaatcagaatcctagtggcttctttacagaaattgacaagcagaaactgaaattcatatagaagtgtaaggaaccagaataagtaaaacgatcttgaaaaaggagaacattgagggactcatacttcccagtttcaaaattgactataaaacttacagttaacaagactgtggtactgccataacgatggacatacagatcaatgcaatggaatgggaaggtcagaaataaaactgtacatagatggttttcaacaagagtgccaagacaattcaggagggactgaatactgtctaacrcgtggtgctggaacaaagaggtatccacatgccaaggaatgaggctgggccttactccacaccacatacacaaattaactcaaaatggatcaaagacctaagaggtctcaaagagctgaggccagaaaacttgtagaaaagacataggggtaaatcttcgtgaccttggatttggcaatggattcttagagatcacatcaaaagcatgagcaaaagagagaaacagacaaattggacttcatcaaaagtaaaacaaaacaaaaaaacaaacytttgtgcttcaaaggacagtatcaaaaaaatgaaaagccaacccggagaatgggagaaaacatttgtaaattgtgcgtttgaaatgggactagtatgcagaatatttaagaactctgmcaattcaacagtaagaagacaaacaatccaatgaaaaatcactacaggacctgaatagatatttctccaaagaagatacagtatataaatggccaataagcacgtgaaaagatgctcgaatcactagtcgttagtgaaatgcaaatgagatactgtttcccgtcctccaggaaaaagatggacaaggtcatgtgctgttacggactcggatgccatcagaggctgtcctggggaggggggttcggaagcaggttttgtgggagcattgcagtctcctaagtaatgttgaggaagtaattaaagtagaatgtcctgggccaggtgcggtggctcacgcctgtaatcccagcactatgggaggctgaggtgggcggatcacctgaggtcagcagttcgagaccagcctggccaacagggtgaaaccccagctctactaaaaatacaaaaacttggctgggtgtggtggcacgcggctgtagtcccactactctggaggctgaggcaggagaatcgcttgagccggggaggcggaggttgcggtgagtggagatggcgccactgcactccagcctggatgacagagtgagactctgtctaagaaaaaaaaaaaagtcctgccaacccagcggtccttttctcagaggtaggaaagaatgaagcagttttattgaataaacattaaagcagcctttgatgcccagaggttgccaagacagaagaactctcccccttcctcccagccaagccgaccggccctgttccacgggcgtcctcactggaggggacccgtcccaactcagacctccagggccgggttcctctgtcctcgcaggggccgacgctggggcagactcccgcgtgacaggggaccagtccccacccccgagattaaaaggtttacctcatcgcaaagggacagaagggagccgaggacagggggaagggaaggctggcttgccctttggcactttaagaagctccttttctttcagattctatttgccagacagtggrgggtggcggcaggtgggaggaggggggtggaggagccgccccccacgtggccgagggcaccctcgagggcagtggatcctcgcgctcccctgaccttgtccccggccttccctcccccagagatccagagcttcgcgggcgccgagaaggacgcgcgcgtggtgggcgagatcgccttccagctggaccgccgcatcctggcctacgtgttcccgggcgtgacgcggctctacggcttcacggtggccaacatccccgagaagatcgagcaggtgcgccccgtggggagggcgcggccaggagggtgcggggcgctcggtccgtycctgtgcggcccccagatcttggctcctggccgggcactgtcygcaggaggggaccccggggacccaggcgggcggggcagggatcggccctgggcctggaagtccccgtccgagggccccragccccccacccccatccatgcgctgcgcccgcagacctccaccaagtctctggacggctccgtggacgagaggaagctgcgcgagctgacgcagcgctacctggccctgagcgcgcgcctggagaagctgggctacagccgcgacgtgcacccggcgttcagcgagttcctcatcaacacctacggaatcctgaagcagcggcccgacctgcgcgccaaccccctgcacarcagcccggccgcgctgcgcaagctggtcatcgacgtggtgccccccaagttcctgggcgactcgctgctgctgctcaactgcctgtgcgagctctccaaggaggacggcaagcccctcttcgcctggtgagccgccccgcgcccgccgccttgcctgcagtaaacgcgtttgttccaacccggggccgcggtgcctcctgcgcrtccccccggaggggaaagggccgcgtcccccgcgcgcgaggccagagaaggccccgctcccaccggtgctgggccccgaccgcagcccgccgctgcccgcacctgcggagtgcttctcacccctcattaaaatcatccgtttgcatgtctgcctttacctctggctctttgagggcgtggagggcgcctcggccgctgctccgcctgcaggaagcgccgctcggtgctcaaggagggaagccaggaaggagccgcagccggcaggggccccctctyccccctccccccttcccctcccccgggcctccacgcccacccgctttcccgcccgggacggcgagtcctgtcccagtttgggtttccccgaatgccgagctggggcaaggacttggttctggcggatggttgcgcacccctgccggcaaaatggaaacgcagccccttgttcaaaagcgaagaattcgaaagggcaacagccgcgttacagtgaacccggaccttagggctgagcagtggcaacgcaggcgggagagcrccggggagccccgagaccgtgggggtgctgggggtgggcgagcacaggggagccccggagaccatgggggtgccgggggtgggcgagcgccggggagccccagagaccgtgggagtgttgggggtgggcgaggacargggagccccgagaccgtgggggtgccgggggtgggcgagcgccggggagccccggagaccatgggggtgctgggggtggacgagcacaggggagccccggagaccatgtcaggtgcaccttgcaccatcccggagcggggagctggggagctgacccatcaattcccctccccctgggtcatctccctgccggaggccggaacagcgagaagacgggccctcagtgaattggcgggaccttggggctgaggagatacccagttccaaagtgccctggaacgaggggcatttaccgtgtctcaggggagtcttggctcatgctgcacaagccagcacgctcagcctggtcctcacactgtctcagcaatagtggcgaggatggcagggctgtcacacattaacagttcagagctcgatggagactgctggggaccccactctggctggtagctacaacattcagctcccaggtgcagatgggctggatcctggggtgcgggcccaacctcatgcccggcagacgaggggcccactggcctgagaagctctggctgggtgctgatttctggccttacctttgagggtggcctgtggccacaccggcagtgggctggctctgtggctgggtgctgatttctggccttacctttgagggtcgcctgtggccacgccggcactgggctggctctgtggctgggccaggagctttgggccccaggcctagggctgcagccacacagtctcggccaggtggtccatgcccccttcccctcggtgccagcgagtggatactttcagcaagcctgggataggaagggctgtgatgaaacgcaccaggatttatttcagttgggtgtggtgggatacagacacaggacycctgactttaaaggagagtgtgtcacaaagtactgcagacccagctacttaaaccacaggagggcacgtaccgtgccacacagggccgcccggggcggggcrccgtggcaacaggacgcagaaggcgagaggggagagcatggccagaggctctgtgggggtttccctgggaagagaggccagggagggtaggcacgaaggagcaagtttaggattggacaggttaatttccctgggctccgggctatggggtggtgtctagttgaccaccgtcctgccccagggtgattgagggcagaggaacatgggtttggtgagtgagtcagataaggggtggttgggtttacaggctccaggtgggttggcttgtgccttaaaggggagctctgtttgcaggcaccttttgctgtctctaggaattagccagtcctgggagggcagtctccacctagccagtaaggcccccgagaggtcaaagcattgtaaaccagaaaacaaaaaccatatgagttatacaggaacagtctggtgggcaggtggcattcagcccctgtgctctgggtctctagaagaatggggttctcagcctctggccatgggtcccccaaacagccttagtgtcttccaggctcttgggcttggcttggagtggcccctgggggctttggctggggcggtgcccatggctcaccctctgtccatatagtggggcccaagttgtccactgtgctgggctagcctgggggggccctgtggtcagaagctagacccccaccctggcagtgccaccccctaggcccctaagctgcaggtgcacgtggaactttctggagggctcccgtgcagagagggtgaagcccattcctgcactttttcttactgtactattaaaatgaggagaaatgggaacagggtgaggagggtggccctgaagtggctggcgtggccatgtctcctggggcagcacccgggccctgggcaccagctcttccatctgtagacgggagggcagtgagcttctaggggatgatttccacctcctgggacggaggtgggcaccggcccaagtgaactcggattctcctgcacacagcttccrtattcagtcatttacttatgggcccactatgtttgtctcatactctgggttagaaaagtgtatggcctgcctggccctggaatcagtagccctgggcctgtcactggggagagatggtggaaaccckggtgtgggcatagctgagattctttctcctgtaagtggggtcccttagggtccccgattcaggagctatttacagcacctgccagcatttctaatgtctcagtgctgcccctgagaaccagcgccggcgtcacaaccagccccattccccctcgtgttctcagctgtagccaagccctggtccagcagtakctgggtaggaaatgcatgcagctcctgcyggggcctcccgccccaaccctctctcctgacaggcgatttgctgggctggaggacagggccaggtcttggccttggcaccgtcctgggtcacgagtgtatggttctggtcactctgctgtggtgcgaggatgaaggtgccagcccagtgtgggcaaccctcacagccagaatgttccagtgccccgcacctygggaccctggatgtgtgyggctgccgtcacaaagtaccgcagacccagcagcttaaaccacagaaatttattctatcacagtcctgaaggcccagagtacaagatcaaagtgtctgcagattctgtttgtctgaggtctctctgcttggcttgcaggcrgccgcctccctgctttgtcctcctggccttktctctgagtgcatccctggtgtctctccctcttctcaccgccctgtccatctccacatccaatccagtcggcggtgctgggggtaatccagtctgccatgctggaggtcaggccttcagcagatggtttctcgagggaatgcagtgcggccctcaacagaccccatcctcccctcctggcctccagacatggatccctgactccatcctycccttgaggctccacagagctctgaccccatcctcccctcctggtctccctccagacacagatccctgaccccatcccccactcccagcctccagacgtggagccctggctggggaactctgtgtgctcccagcctctgaaggtttctgggcttacctggctcctgtctcatcccagtccccctgagtagccacggaggtggggtccctaaggcccacatggttggggttccattaagaacttcaagtgggtggctcacgcctgtaatcccagcactttgggagaccgaggtgggtggatcatgaggtcaagagatcgagaccatcctggccaacatggtgaaaccccatctctactaaaaatacaaaaaattagctgggtgtggtagcgggtgcctgtagtcccagctactctggaggctgaggcaggagaatggcgtgaacccgggaggcagagcttgcagtgagccaagatcgcaccactgcactccagcctgggcgacagagcgagacyctgtctcaaaaaaaaaaaaaaaaaaaaaaaaaaagaacttcaagtggggctgggctcagtggctcacacttgtaattccagcactttgggaggccgaggcaggaggatcgcttgagcccaggagtttgagaccagcctgggcaacgtggtgagacctcatgtgtatttgtctgataaagacatacgcaagactgggtaatttttaaagaaaaagcagtttaatggactcaacagttccacaatcatggkggaaggtgaaagaggagcaaagtcacgtcttacaagagggtgtgtgcaggggaactgccctttataaaaccatcggatctcgtgagaccattcastatcacaaaaacagcaccggaaaaagccgcccccgtgattcagtgacctcccaccgggtccctcccatgacgtgggaactatgggctctacaattcaagatgagatttaggtggggacacagccaaaccatatcaccatgtctaccaaaaatggaaaagttagccagtgtagtggtgtgtgcctgtggcccagatgctcaggaggctaaggtgaaaggacctcttgagcctggggaccaaggctgcaggaagccatgattgtgccgctgcactccagcctggctgacagagtgagactttgtctcaaaaaaaaaaaaaagagaaaatgataaaagcactgcaagtgggcagcggctgaacgtggagacaggagttctcccttctgagcacggccctggtgccgctgacttcgtggggagcctgtagtcaggggagcagcagctggggagagctggggtctcagctgccttcccccatatcgcacatgcccgtctcgtgtgtatctgcactctcacacgcgtgttcccctgccctgcgctcacatgtatctgcactcactctcacatgcttgcttcccctgccccatgctcacgtgtacctgcactctcacacgtgtgctcccctaccccacactcacatgtatcctcgctcactctcacacgtgttcccctgtcctgtgctcacatgtatccacrctctcacacatgtgctcccctgccttgtgctcacgtgtatctgcactctcacgtgttcccctgccctgccctcacgtgtatcctcactcactctcacacgcgtgctcccctgcactctcctgtctgagctgagctgacctcagttgggtgctgcgagccagggcctcatgctggcctctcgccctccacagccccaggkgtccaggctcctccaggaacaaacgcaggccccacgggctgcctggaaggcctcccagaaggcagcacagggtcacgagggtcacccgcagkggcacagggaggcctcgtcacgacaggattccagccaggctsgcctgatgctmctgggggtcctcggcacatgccccttcaccctggcatgtgcttcttttccgggaacccayactctggctgagtggagccatcccctctgggtcaacagcacccggggtggctctgcagcaccccactccgcggctgcacagggaccttggccccactgctccttgtgccttgctggttaatgagaagccggtggggaggtgctgccggtgagcgtataaaggccctggcggcggctgcggagcactggccctgtccttccatctgcycagagaggagcatctggatcaaggtgctggccatgtcccagctggtggaatgcgtccccaacttttcggaggggaagaaccaggaggtgaggcccgargagctggtcaagcatctagggctgatggggcagcttgagtggctaaggcccaggccatggaggaggtggtgggcttggtgtcccrggtcgtcttcccaggatgggcagagccgctgcccrtgggccccaaggacrtcccgtggctcagggccctggggagtgcctgacccaggggtgggtggaacacgactggtgcttgtgggggctgaggcttggctgtggcttcaggggcctttcgggtgctttcggtggggggttgggcagatctctgggcctcaaagggccttggtgctcccccctgaaaatggggctcctgccactgactgaaagggctgtgtgaggycacacgaggtggcccagcatggtccccactgccgcctctccatctccactggagttagcttgctgagcycccaccctgcagccaccatcctcactggacccaaaacgaagtaggcacagagggggcagcaggcccccaggtccggcctctcgccttccacagccctgaggtccaggctcctccgggaacaaacgcaggccctaagggccacctggaaggcctcccagagsgcagcaccaggccacaggggtcacccgcaggggtgcagggaggcctcgtcatgccgggattccagccagcaccaaggccctgggacagggcaagatttggggctgagcccctgctcccagcagtcctgccacccggaaggttctaggcccttcaggcccctcccccatgctggtgatctgtccctcccctgctcgggggtgggggtcccggcccctctgtgacctgcgcctgtggtcaccttcttggatccccggccacgtctctggcatctgtctgtcggagcagagcccgtgagtctctcctggaggcaccacctgcagccccttgtggggacygtgcttgggcctggagtgactgtggctgctgtgagggttcccgggcggccgctgtgtgcgggcactttcggtgggagctcagcttgtcggagagcccccaaaggcttggcccgcctcctcagcccccatttgtgtctcrgggtgcagccacctccaagctccttttccttctttcaaacggggagactgaggtgtgggggccgggcctgtgtcccaggtgatcgacgccatctctggagccatcacacagaccccgggctgcgtgctgctggatgtggacgcaggcccttccaccaaccgcacygtgtacaccttcgtggggccgccggagtgcgtggtggagggggccctcaacgctgcccgggtagcttccygacttatcgacatgagcaggcaccaaggtgaggtctctgggctctcctgtggctgccgtgtctcagaatgtcagggccgagccctgtcctggtgtcctgggagagggggtaggcccggggcccaggcttggaacgtggggtccagtggggctggctctggctctcctaggaggaccctggagtgtgggggtcatggcccccakcctgcctgcagggctgtgctctgggggacccccaggtcgccaygctcccacagcaccgggccaccttcacggctgggtggggggagggggccacgccggggaaggtttgtgggccccgtccacctgcccactcgtcaagggggctgagagccagtcttggagcaggcactggtgggggaagggctgcctgraagctgacctgtcaacagcccacaagccaaacacctcggtgggcaggcagggccaaaggtgtgtggacacacgggcgctggccaggggctgggctgtgggccgctcatgagaggccagggatccacagtgatcctgaggggtggayggatgagaagcttatctctaagtggccagccctgggcggtggcggcaaaggcgggggaggctggcgtcccctggggtgggygccgacccacggcttggtgtagccacagcgagggactcagctagtgagaagaatgctctggaaacgcagagtggattctcggcttcaggggagggggttggggtggccggaacccagcctcgagcgccccctcttggcctggccggggctgcctgagagctgagctttgcacccctttcaaagttatttttgtgagtgttaggagagggacaggtttatcccagagatgccagaccacccgctcaggtgctgctgctcctgggctgaaggacctcccccacactggctgggaggacggtgcgggaacttccgttgtcccgggagggctggtgctgccgctggggcagggctgggagcgcccagggccggcctcctcccygtgggtcagtgtgagcagcttgctgggtgtgtggactgggggctgcccaggccggagaggacagagggtccgagaaccccgtggagctcccacccgctcccacacctggcctcctgcccggcctcgcygtctctctgcaggagagcacccccgcatgggggccctagacgtctgccccttcatccccgtgaggggcgtcagcrtggatgagtgtgtgctctgcgcccaggcctttggccagaggctggcagaggagctggacgtgccaggtgagcgtgcccccccgcccccctcacyctgctcccgtctcattggtgtgggttattggctccttctgtatcccccagttccctgcccttgactgctcttgcaagggcagagtgttccaaaaagccaacatgcagaagcgcagctccctcaataccgaaataaacgcagcctcgcctgcggccgtgcaggcccggggcctcctcagactacaccgcagagcagctgcacaggcaaaccaagagccttaaagtccacgccttctagagcagaataatttcactttgggaaattaactaaatcaagaaaatgatatgaaacaaacagagacaaacgggacaaagtgcatacccacccctaggctgcaccaacccagcgctcctggaaagaaatcccgaggcagggacgtaggtcacagtcacgccagcgtgcagggcacacgtaacccccgtcacggtcacgccggcatgcagggcacacgtaacccccgtcacggtcatgccagtccccccgaaggaaatcccgacgcagggcccacgtcacagtcacactggtgtgcgggttcacgagtttttcctyttctctgccgttatatttatgtggttgcttgcggttctgtttatcatacaaagaaaacagaagcatgaacgtcctgccgttagcatgtcccacatgttccatcctaaccctgcaattcgccttttcagggccctctgaggagggggtgggcaggggtgctggcccacactgagggtccactgggaccacccgcatccatccaaggcggagaacgggcactccccaggagagggtgcagtagaggcccattcctgggttaggctggagggagcccctccacctgcgtcctccaggaactgagtcctggaccccctgccggtccaggcctgaccgccgggctctcctgcagtttacctgtacggcraggcagccaggatggacagtcgccggaccctgccrgccatccgggccggggagtacgaggccctccctaagaaggtgcccccaccccgggcggtcgggcctgggaaggaggtggacctgcccctttgtcctggctggggtggctgggccgggcccctccttcccgggaccccggggggctgttccctcccgtgggggatgtctcaccccagagcgaacttgctcacagctccagcaggccgactgggcgcccgactttggtcccagctcctttgtccccagttggggggccacggccacgggggcgaggaagttcctcattgcttttaacatcaacctgctcggcacaaaggagcaagcccaccgcatcgcgctcaacctgcgggagcagggccgcgggaaggaccaggtgaccccgttcactgaccccatggagccccacccagcccctcgggaaagggttagaggctgagagcctcaggcggggaggtcggtggggatggggcaccggccggacagggttcggcctcccacctgcagaccggcccagcctccgcgtccacaccgtgcggggaccgcgcaggtcggcaggtcaggggcggagtgaagctggggagctctggcctcctggggattttccagggaacgaggcaggacttccctttgttaacatgtggcagcatttccatactgctgggaaacagcgacttccggagtcccaggtgccctcaggggccccccatatccctccagatgccttgggagccccgacacccctacaaaccttcaggtgcccccaggcctttccctccacgtctgcacagcagtggtcacccggtctgagcgtcactccgggtatagatacccggagaaagcgggggggaccacctgcccatctgttccccactcagagaccccggtcccacaaacagccaaggtcctgggacccggcttcccgacctgcagactcagcacaaaagcacagggacctctaagtcctgctttaggccccggccaagggcagaggtcagagtccccccacgtggactcagtcaccccgacaagtgcggggctgaggggacttgtcgggagcggagcagatgggatgggagaacggcatgggggtgccyggggccccacccctcagcattcccccaacatctaggacacagcgtggctggaaggcagggcctaggctgggcgggggcctgccggggtgggcctccggygtctgacccttggggcctccgtttccctgtggcaagcgaagtttctctggccctccccggccagctcagtgagggacggaggagaaccacagcacccacscaggcacaggctcctccccgtccagctggggaatgcaagtgccaggagagactggcagggccaggcaggatgagcttcctagtccaggctggggaacgctcttcctttgcagccaggacgtctgaagaaagttcagggcattggctggtacctggatgagaagaacctggctcaggtgtccaccaatcttctggactttgaggtcacggcactgcacacggtctacgaggagacctgccgagaagcacaggtgagcccgggagcagccgctgctgctgtgaggggygagccgatctgtcccgtgggcagggcgggggccccacatcctccagccagggccattctccagccagcccccagggggtracgctgcctgtgccttggcaggagctgagcctcccagtggtgggctcacagctggtgggcctggtgcccctgaaggctctgctggatgcggccgccttctactgcgagaaggagaacctcttcatcctggaggaggagcagcsgatcaggctggtgggccgggctgccgaggaagggtcggacaggggcgtgcagggagggtggggaggcggtggcggagctcacagccctggggcgcagcttccctccccctcctcccccttcattttattgacttgtgttcagaagatgagatttcactttttattttggacaccttattgaggtttttttgtgacctatgatatgctcagctgtgcaaattccacggagaggacaccccaccctttctgcttggtcttgcctcctgggccggccatgctcccgtggaggggcctgtgcctcctctcaccacctccatcggggcgtcctgcacccctggaactggcagctcatggatgtgtgtgcctttagctatgggacttagatccccatccacggagcggctccttcagaaagtgattccttttgtcttgtggacacctgggcctcaaggcttctggagtctgggttccaccggggcctcaggtcctgctggggtgtggcagcgtctgcagagccgctgtccgccttggtctgtcctttcactcgaggtcactgcagagccgctgtccgccttggtctgtcctttcactcaaggtcactttgttttaggtgtgtttttcgcaataagcacaatccacttaactggattttttggggacgttttgtctgtttgtgtttttactgatttagctctcgtgacttgtggattccgtccttgtttagtctcgggcatattttcttctattagatcgctgacccagttatttagttctctagctgtaggaccccgtgatgctgcagcagctttgatgtcttctctgcctccgtctttactttctcttccactcctttcctctggattcacagtggttttccaaaacccagcctcaatcattggtgygtttgtggccttgtctgttgtattcttggctgttaacaaaattttttgtgactttacattttgtataatttcttacagagaagatacaggtggccctccactcctgcctyccacccatattttccaagtgcttgcattttgccccatttatttgtgtataatcatattatatttttttccggactatttaaaagttgggttgaagacattgtactcttttacccctaatttattaaggctgtgtttcttaagaacagggacattctcttacataaccacagtgtaattatcaaaatcaggaaattcaacactgatacaatcctagtatctaataatcctcaggccataatcaaattgcttcagtgtcccagtgattcccatcatagcgatttctcctccaatccgtgatccagttcacgtaacacagagcactgagccaaccttttctcctttcttccaactgttcctgtcttccttgtccttcattgaccttgacatagtttcaaaggacagacttttaaaagcgcctcagtggggactagtctgatgttgcttgtggccagatgtagttgtgcatttttattttaatttaatttgttacttcttttgagacagggtcttgctctgtcacccaggctggagtgcagtggcacaatcacagctcactgcagccccaaactccagggctcaggtgatcttcccacctcagcctctcaaagtgctgggattacaggcaaggaccactatgtagtcctggctaattttgtacagatggggttttgctctattgcccaggctggtctcaaactcctggactcaagcaatccactcacgtcagcctcctaaaagtgttgggacgacaggtgtgcaccaacacgcccagccagttacgcatttttggcaggaaaagcatagatggtattgtgtcctcctcagagacgccgactccccatgatgctcattttctcagggtgccgacgtggacccgtcacttgccaaggcgacccccttcctcctggacccttcactgcaatgttactatttttccttttgcaattaatacgttgtggggagtacttgaaggtgtttaaagtattgagtaggtaaatacctgtttattactgaaattccagagttttaggagccagtgacagcattccaacgtcatcctttctgtctaagcagcagctgtcgcttctccacatttccttgtcttcttatgtgtgaggccccgtctgctttccagtgtggcgttttgtcttcttcttttttttttttttttttgagatggagyctcactttgtcacccaggccggagtgcagtggtgtgatctcggctcactgcaacctccacctcccggattgaagcagttctctgcctcagcctctcgagtagctgggattacaggcgtgtgccaccgcacttggctaatttttgtattttttttttttagtagagacggggtttcaccatcttggccaggctggtcttgaactcctgacctcgtgatcygtccgcctcagcctcccaaagcactgggattacaggcgtgagccaccgtgactggctggggttttgtcttctttacctgaagggccccatgcctgcggcctgcacaggtctggctgtgcccgtggctgcgtgctgcctccttgtggtgaggctgctttgctttgtgttgtgtgatttttgattgccagtgcatgctctgtggaattttatctatggtaattcttggacacctgggttcaaagttttctcctccaaggagggtttgtgctggcgcttgtggacactgcctcacaggaccccctgaagctgagtttttggcttggagttctggaaccacacaagagtgaattcggtgtcgggtgaggcctgcagccctgtcagggtggcttgtgattaggaattcccaggagatttttttttttttcctgcttcacccaaagggaaggcagggactgggaagtacctcaactgtttcctctggcgggtggctgtttctaattcatccttgggggtgtcaccttccaggggtctccagtcggaccccactctgaaggccccagacctcccccactcatcaggggctgccagagaggggcagttgcccccagggcagacccagctccaggctggcaggcctttccggactcgtctttctggtcgtgtctggtttcgaatgatgtcctgtctgctagcttagccaggcctttaaaatgcccggcatcttcctggggttttctgcggaaggaggctttgccttgtggcttgctggttctatgccacggggaggcactctccacccygcccggctgctgtccgtctctgtggggtggggtgggggtcgcatagccaacgtgttctgaatgggtttcccagaatgaattctaatcttaaatgggactgtcacaactttattttgaatttaggtaaaactcacttttgtggcatacaagtttatgtgtgggtgacttggggctgttcctcagcttttgaggacttgttagatgtgaagacttggtgaattaaaatctttcccgcccgtcagcgatggggcagtggtgctggggggcggcgaagcatgagcagcagtttgctgaggggtccccagggggcaactcctttctctgggcctcaggttccccaagggcamctcagggtgayggctgtttccagaagcctgtacggggtgcctgctggggcggggcccacagggctcctggcggggcagmggtggggggtgccagccacgcccctgccctgctccccgcaaaagcacctgtgtgctyggggcagggggcggctgccgcaagggtgggacccgcgggttccgaggctttcctggtggtggagacgcgccgaggccgtttccactccaagccccttttccaggtggtgagccggctgggcctggactccctgtgccccttcagccctaaggagcggatcatcgagtgagcctctgccctcccgccctcttctcacccctcccgggctctgcctctcgggccttgcggggcgctggggtccctgcgtggagacccggctgagtcctcccagcgcctccctttgggcgcctactcggcctgcgccaagcmggggtctgggggctgaggggggcacagagaccccggccgggtccccgcaggttctcagccgagtggtcacctccccgtgggtgcagacgggcgtggggcctggggccgccccgggaggactgcgctccccccaccaaccccggccagacccgctgagccgcgcccaccctgcaggtacctggtccctgagcgcgggcctgagcgaggcctgggcagcaagtccctgcgcgccttcgtgggggaggtgggtgcccgctctgcggcccccgggggcggctcggtggcggcggccgctgcggccatggtgagcgcggggggaggggcaggggaggcgcagttgttggggggagggcggggagggggaagggcgctgttggggggagggcacggggtggggagggcgcggtggggccgccctgggtggagacgtgggggccacacgggtgggacccccgcagggatcacccgggcccctggctcttcctggggtcggtcccgggccgtctggggtccctgcgacccccacatccacccctctcgcagggtgcggcgctgggctccatggtgggcctcatgacctacgggcggcgccaattccagtccctggacacgacgatgcggcgcctgatcccgcccttccgcgaggcttcggccaagctaaccacgctggtggatgccgacgccgaggccttcaccgcctacctggtgagtggcggccacagcagggctccccgggccccaccaacagcgaacccccagctggggccccagtgagaagcgggtcagcctccggctggggaggggctggggaccaggaggggcctgagggcgtcaccactggccgctgtctggaccttgaccaccagcaccgccctcaccccggcaagtgcttgggcccagcagggtttgagggttcggccagggtgaccccacattcacaggccatggcagccggtacaagggaacaggcccctcccagcaggggagccaggagcccaggcttgggggaccccacagacctggagcaaggcagggcccttctttagaagcctgcaattccaggaaaggaggcctgcaagaatctcaggaacacagtgatgagtgctctcaggcaggccagagasgacccgtttcagccacagcataagacagaaacaccatcttcagataacacccactcaggcaggcagtgaccccacctccctccaaacgggacaggaacatgagcatcagctggcaggatgtgcccacagatgggtgctgggtgctcagagcctagggcaggggccagagagcctgggaaagggcagtgacaaggtcaggatgctcccaagcagttccagcccaggagaggacaggagggaagggcasaaaagagagagagagggaggggagagagaagagagggagagtggggagagaggcagatggcggagagagagagggagggagggatggggagggagggagggggaggagagggagagggggagagagggagggggagagacagagagagagggagagggagggagagagggagggagacagagggaggaggggggagagagggagggggaaaaggggagagagggagagggggagagagggagggagaggggaggagggaaaggggagggagagggggagaggggggagagaggggagagagggagagggggaaagaggggagggagggaggggggagagaggtaggtggagagagagggagggagagagagggagagaggggagagaggtgtaggggccagccctacagggtctgtgggtttttctccccgtgtgtagagatgagagattatagaaataaagacacaagacaaagagaagaaaagacagctgggcccgggggaccactaccactaagacacggagaccggtagtggccctgaatgcctggctgcgctgttatttattggatacaaagcaaaagaggcagggtaaagagtgtgagtcatctttaatgattgataaggtcacgtgagtcacatgtccaccgcacaggggccccttccctgttaggtagctgaggcagagagagagaggacagctcacatcattttttttaatcctctttttagaaagattaaagactaatacttttactaagtttgctactgttatctagagggcggagccaggtgtacagagtggaacataaaagtgaaacaggagcatgagctctaaagcacagcatcacagggagacgattaggcctcgggataactgcgggtgggccctttacaagaggtggtggaccagagtcttcttcaaactcccctggagaaagggagactgccttttccgatctgctaagtagcggatgcttttctttggcactgacactaccatagaccatgctccgcttggtaacgggcgccttcccagacgctggccttaccgctagaccaaggagccctctagtggccctgcccaggcctgacaaagagctcacactcgttttttggtcactttttagcgtgccccttcaactcctatctgtgtatggcctggtttttcctaggttatgattgcagagcaaagattattataatgttaaagagtaattgctacaaactaatgattaataattatatataatcatatctatgatctatatctagtacaactcttgttattttatatattttattgtactaaaacagctcgtgccctcggtctcttgcctgggcacctggctggcttgccgcccacaagagggagatggggagggggggtagggagagagggaggggagtggggagagagggagstggggagagagacagggagggacagagtgggagggagggagagagaaacatgtgccccagcctctggagcagggcggtgggggcgcctgtgtttctgggagggccacaagacccccagccctaagttgggaagtctaccttacaaggctgggtgagaaaggcaggccccaaatgcacgtggaatccacacacaggcacagagggagccaagatgagggcctcggataaacagtcccggatttgcagagggagtcgcctgagggtcccgttctggtcctgtggagaggtgaagctggctgggcttctgggtctggtggggacttggagaacttttctgtctagctaaaggtttgtaaacacaccagtcagcactgtgtctagctactggggtgggaacttggagaacttctctgtctagctaaagtattgtaaaaacgcaccagtcagtgstctgtgtctagctaaaggtttgtaaacgcaccaatcagcactctttaaaaacggaccaatcagcactctgtaaaatggaccaatcagcactctgtaaagtggaccaatcagcaggatgtgggcrgggccaaataagggcataaaagctggccaccgaarccagcaagcgccaaccgtggcgggttctgttccaagctgtgggggctwtgttcttttgctcttcgaactaaatcttgctgctgcttactctttgggccttcgctacctttacgacctgtaacactcactgccaaggtgtgtagcttcactcctcaagtcagcgagaccaccaacccaccgggaggagctaacagctgtgctacgcgccacctgtragagctgtaacactcgctgcgaaggtcggcggcctcacggggaggaagaaacagctcccgacgcgccacctgtaagagcttaacgctcactgtgaaggtcggcggcctcacggggaggaagaaacagctcccgacgcgccacctgtaagagcttatggctcactgtgaaggtckgcggcctcacsgggaggaagaaacagctcccgacgcgccacctgtaagagctcactgagaaggtctccggcttcactcctgaagtcaggcaagaccacgaacccgccagaaggaagaaactccggacgtatctgaacatcagaaggaaccaattccggacacactgtttgcagggaggtgtagacgctgatcaccgtttccagtcattttaaaaattcaggttttatttatttactttttacagtagataggcccttcgggggttcaccccgccttcgccacagcccgcccagtgctcgcctctcttgctgcctcagagctccgcctttccttcccctcgcacacagccccgcccgctcccagcctggccccttgggttttccactgggggaagcacccccctccccgggggggcccagggcacccaacacctgcttgcagarccctgctttctgggatgcgcttctcattaccgggcaggttaagcatgttccgtacatttagcagtggtttttacttcttttccaggaagttatctggtgaatattttttgactccttttatcttagtttctcttggggctttcgctgccttctagtattttttttttttaataggggaggcaggccttgttctgggctcagctttccccgtttgttgttcgtctttggactttgcgtgtggggcttctgacaatgactcttaatctttatgtcgtggaatgtgtcaatcctgactttatattttttgggtcttgtatcacagttcaaatggcctccccagaacaagatgatcttttctatactttaatgggttgatgaactttagacccggacaggcatttgaagacagtcatgaatttaagtataaatattagaaataggccaggcatgatagctcacacctgtaatcctagcattttggaraaccaaggtgggcaaatcccttgagctcaggtgtttgaaaccagcctagaccacacaccaagaccctgtatttacccacccaaaaagaaaaaaaaaaaataaagccaggcgtggtagcaggtacctgtggtcccagctactcaggaggcttaagtgggggtagcttgaggccaggagtttgaggctgcagtgagtcgtgattgcaccactgcactctagcctgggcaacagaacgacaccctgtctctaatgtaaacatatgtatataaaacatargaacaattttatgtttagaaatttaaaataaggtgmataattaaaaaacaagtaggaaaagtacatagatgaaaatgtaatcaagggacaggaargaaacaagacgtgtggtttagagaaccatgagcggggacagtgagactgtgctaggcatcagtggtcgaaatcagtggattggtttacgctccctgtgagccacgtgaaggtggacggggagtgctggattggtttacgctccctgtgagcaatgtgaaggcagacggggagtgctggattggtttacrctccctgtgagcaatgtgaaggctgacggggagtgctggattggtttacgctccctgtgagccacgtgaaggtggacggggagtgctgggttggtttacgctccctgtgagcaatgtgaaggcagacggggagtgctggattggtttacactccctgtgagccacgtgaaggtggacgaggagtgctgggttggtttacactccctgtgagccacgtgaaggtggacgggggagtgctggattggtttacactccctgtgagccacgtgaaggtggacggggagtgctgggttggtttacactccctctgagcaatgcgaaggtggacggggagggctgggttgatttacattccctgcgaacaatgtgaaggtggacgaggagtgctgggttggtttacactccctgtgagccacgcgaaggtggacggggagtgctggattggtttacactccctgtgagccacgtgaaggtggacggggagtgctggattggtttacactccctgtgagccacgtgaaggtggacgggggagtgctgggttggtttacactccctctgagcaatgcgaaggtggacggggagggctgggttgatttacattccctgtgaacaatgtgaaggtggayggggagtgctgcattggtttacgcaccctgtgaggcacgtgaaggtggacggggagtgctgggttggtgtacactccctgtgagcaatgtgaaggtggacggggagtgctggattggtttatgctccctctgagcaatgcaaaggtcgacttttgaaaaacataaggagatatctgtaccttgcaccaaatacataagtaatttccagatggaatagaaaactgtatttccccaycaccaacacaaccaagcctcacgataaatcacagaaaacaaaacggaccgggcgggcaggcctcggccggacgcagatgaggccacctaaagcacacccttggccaagatctgcccagggagaccatggacaccgcaaggcctgggtgtgagagagtgttcgtagcgcgagtcgcagcttgaggatggctgtcctkcctccgcctgcaactgctacagacccttgtgcagaggacagcctgggagaggggctgcagccaggaggcctggtctggatgatgccccagccagtcagggagacactgggcatttctgttcctcgatcactgctgtyggaatggtcaaaggatccagatctggctggcgcccagggagcatttgctctcatccatggtcgagggtaggggctgttgatgatgactttctggtggagagttggctgaatcttccaagatgaagtgagcatattccccactgagaaccccttggccagggctctggccacagtccgtgtgagtagggctcccagtgggtccttggaaggttggtgtgtggtcccagctrtgctcttccacacggggtgggtccgaggagccgagtgccttacggtgacgccgtgagctacacacatgagcacctaggaaaggccagtgcctgtgaccggggcagggacatgaggggctttgaggtttgctcttggtccttctgcacagtctgagcctcttatgcccaggcttgggggcggtgcagctgcttgtgttggagacacaggcccagagccactcctgcctacaggttctgagggctcaggggacctcctgggccctcaggctctttagctgagaataagggccctgagggaactacctgcttctcacatccccgggtctctgaccatctgctgtgtgccccgaccccccctaccctgctcctccaccaagcctgatgcyaagggctataaaccactggcccaacagaagcttggttcccagagaactggtccctgcctgggacatgctccttgctacagccccttgtgggagctcagagggcatggctgctccccctacggtccctcgcccagtggttctgtctctttatggcaggaagcaatgaggctccccaagaacacacctgaggaaaaggacaggtgagcctggagggccggccgcaccgtgggcctctgtgtctggggagttggtggccaggatcccgagtacctgggtgctgtgacggggcgtggttggcctgggcgtgctgggtgtttgggaatgacttcccatcgcccgcttctgcagcctgctcagccctgttggggtgcagtgtgtccactgcctgcctgtgtgtgccgcygygcycaggctctcctcttgctcctttcaggcgcacggyggccctacaggagggtctgaggcgggcagtctctgtgccgctgacgctggyggagacggtggcctcgctgtggccggcsctgcaggaactggcccrgtgtgggaacctggcctgccggtcagacctccaggtaggggggcccgggggaccccaggcctcctgccgcaaagcaggaagcagctgttggggctgagttgctggagagcacggtggttggctgggctgagccaggtagggagacctcacttcacgggcagttcccggggctttggcctcctccaacagggccggggtgtccgctgccttctaagatctcgctcayggcggcaccacagacggagacccaaatgtgtctgcagagcccaccctgaccactgtataagtgtatactcccccaagaccccttgtatcacccccactgtcttgttctagaaaacacctatgtcagcccaggcacaatggttctcgcctgtggtcccagcactttgggaggctgaggcgggaggatcacttgaatagaggaggtcgagaccagcctgggcaacatagtgggaccctggctgtacaatagatacatatgagccaggcacggtggtgcctgtggtcccagctacttgggaggctgaggcaggagaattgcttgagcacaggaggtcaaggctgcagtgagcygtgatcacaccactgcgctccagccttggtgacagagcaagaccctgggtcaaaaacaacaaaacacgagaaagcacacaaggcagctcttggaagtagatgcctcacactgacrggccacagctgggcagagggtcccagagaaggagcgtctctctcatgggctcagcactttctgcagctgccctaagacctcatggtcttcgggttctttataggaaagacgcctcttttcagcatctggtcccagagaagtgtcccctcagtccctgggaagtgtccctgggcagtgggcgggccgttagcctgaagctgcctccgggggccctccaggggatgactgtctctagaactgtggtcctggttcctagagtggcggagagcctccagtgtgactgctcccaggcytcctgtggggctgagccctgcttggataagagaaagttttgttttctaagctcartggtggggcttagccctctgtggggcgaaagcgggggctgcgctgggctccttgtgaggaggaggacgaagtccggcctgtcccagagcccgtcaggcagagaccctccttccggcagtttgctcagccttgatccatgtaggggctccctggggtccttgcaggtggcggccaaagccytggagatgggygtgtttggcgcatatttcaacgtgctcatcaacctgagggacatcacagacgaggcatttaaggaccaggtgagcaggaggcaggtgtggtgcccggaccccaygtgggggcctggattcacagcctcagggtgattgccgactggcygtgggcagtgggggtcggaggttgctgcccagcaagctgggctgaagactggaactaccagacccctctttccctgtgtccatcagatccaccatcgtgtttccagcctcctgcaggaagccaagacccaggctgcactggtgctggactgcttggagacccggcaggagtgacggtgcgggaggcctctcygggctctgtggcccctccctcgcccatccccagagggcagagctgtgacctcggtggggacacagyttgttcrtgtggggcccggaggrtaggtgggcaggcagcggggcatcgcctgggaatggaggcgctggcagggacagaaggcccctagtcccatgtgacctccagtaaagttttggcaccaaacctgtgttgtgtgttggcggttttgggggcagggctgagagctgagctgcgggtcttggggcaggagcaggacatatggtcagtggcccatgggagccagggttggagggaatggggttgcagcgtgaggagacagacctcagcgccagggtccccagacacccagtgcagcccacagtgggcagggtcacaggtattcagaggacctggggttcagtgcaggtccctgggctgtgaggccccttgtctgagggaaaggggccctggttctgtgcatgggacagaaaccccagggacagcaggaccttcgacgctggaaggatagcctcgcttcccaggtgcagctcccggcaggtctggacagttccacagagcacggtactggccctgtcctcagttcccgtccacccttcaaccagtggctcctgggagacttttcctccctgcctcagctccctgcccagccagcctcctgtctccagagaagttctccattaaaaaataatttagcaaatcactatactctcaaattacttctagatggactattacatgtgacagatgatgtatgaatgtatttgttagtcagcactgcaggatattaaaaagaagattactgtgtccttgagtgaagcagaaaactcaaatgccttattggagagatttcccattctgaaaatagaacatacttgttcatgaaaaaagatgtcatcatccaagacaaatgacaagaatcctacagggagaaaaaacacccaaggtgtgtgtgggtacagggccatcatcactcagcatgaaaggttcctacatatccggccggcagggggtgacagggagggggtgccggggaggggagactgggagggaatgctgggagggaatgctgggaggggaggctgggagggaacgctggggaggggaggctggggaggggaggctgggagggaacgctggggaggggaggctgggaggggaggctgggagggaacgctggggaggggaggctgggagggaaygctggggaggggaggctgggaggggagtctgggaggggagactggggaggggactcaggagggaaggctgggaggggacattggtgaggggacattggtgttggggatggtgaggggacatttgtgaggggacattggtgttgggacggtgagggggcattggtgttgggaccatgaggggacattgtgaggggacattggtgttaggaccgtgagggaacatttgtgtggggacattggtgttgggacaatgaaggggacatttgtgaggggacactggtgttgggaccatgaggggacattggtgttaggaccatgaggggacatttgtgaggggacattgatgttaggaccgtgagggaggagacatttgtgaggggacattggtgttgggaccatgaggggacatttgaggggacattggtgttgggaccatgaggggacatttgtgagggatgctggtgaggggatgctggtgtggtgtaattggtgaagggccaatggtgagcggcagttgctgggtggagctgtgggtagagcctgtaggtagctggaagtcccttccagtgggactgacgttcctgccctgcagggtccgaggctgcacacgtgggagctggcacragagaggggagcgccctctccctgcagaggccctgggcagctcctgtgtagctcctgtgggtggagcctgtgcacctgcaggggcctctgcctccctccacctgcgggacccgcggtgttcacctggagcacagagatctgagggctgacactcagggcgcaggggcttagcaaaacaggcgggcctcttctgcatctcctgctggcatttgcgtagtttttttgtgggatgggaaaaggaggaaaggaagagaaaataactgacgtactcccctggagctgcaggctgtgtggtcagatgacagagcrgtggagtatgaagaaaagagtgagtcttttcaaaggacaacaaagtttcagggtatccagagtgaactgcatttccccagtttcacatgttgactcctgaccctgaccctcaccctaaacctgaccctcaccctcaccctcaccctcaccctgaccctaaacctgaccctcaccctgaccctcaccctgaccctaaacctgaccctcaccctgaccctcaccctgaccctgaccctgaccctaaacctgaccctcaccctaaacctgaccctcaccctcaccctgaccctaaacctgaccctcaccctgaccctaaacctgaccctcaccctgaccctaaacctgaccctcaccctgaccctaaacctgaccctcaccctgaccctaaacctgaccctcaccctgaccctgaccctgaccctaaacctgaccctgaccctaaacctgaccctgaccctgaccctgaccctaaatctgaccctgactcctgacccctacccccaaccccaaccccaaccccaaccccaacccctaaccctaagccccagacctctggatgtgaccttgtttggaaatggggtccttgcagatgcagtgagctcaggtgagatcatcctggagcagggtgagcttggtccagtgtgacttgggtgaggttatcttggaataggctgagtcctggtccagtgtgactccagtgaggtcatcctagagcaggctgagccttggtccactgtgactctggtgagctcatcctagaataggctgagccctggtccagtgtgactcgggtgagctcatcccggaataggctgagccctggtccagtgtgactcgggtgagctcatcccggaataggctgakccctggtccagtgtgactcgggtgagctcatccyrgaataggctgagccctggtccagtgtgactcgggtgagctcatcccggaataggctgagccctggtccagtgtgactcgggtgagcttatcccaggataggctgatctctggtccagtgtctcgggtaagctcaccttagagcaggctgagcctggtccastgtgacttaggtgaggtattctagagcaggctgagccccagtccagtgtggtgacttgtatccttatccaggagatcaggaaccctgggatgctggggagaggccggggcaggcccttctctagtcctcctctagccctccagaggaagcatggcccggctgatgcctccaggcctgtggccgatactggtagttgttcaagctgtgtctgtggtgccctgtgatggccaccaagcccactcctgtcaggtcagcacctgcctgtggagcctctggttcactgtggggctcctgagctgagcctgaaggaccctggggtctgaacagcaaaaactcactgagatctccacacagaacacaacaggctcagcacctgctgtctccccgtctagtgttaatcatgcgtccacccacagaagaccctcagccatggtgacacttcttagagcactttgggcctggctggggctggagggagagtttgctgatcaaggctgtggggtctgcacaggcggggtcagccagcacctgcagttgatgtcctaggaggtcagggctgggcccgggggagccattgaccctggtgggcgagcgacagctgcagtgtttccctcctggccacaagacacctttgaggtctctcctgcgcacagaagctcgcaagcaggcacgcaatgggttcaaagcctttattgggtcagggcttgctccagagctcaggggccaggtaggtcaggagccttgggatggctgcagggggagggaggccgggcagcctgcggagggcctggggagacctggggctgggcgggggccggggctacggggaccccgtgggaggagctggaraggygcrggcccagggcgtcgtccgagtgagcagcggtgctggccgtgtgggacccsggccygcttmgcaccatggacrgggtgggctcacgaccctcgactgcggggcccgggcggcggcgctagcagatccagcggakgaagcggtcgaagaagcygggttgygccaggctgtcatagtccttctcgtggaacacggyggcrcggtcacccaggctgagcgtggtgagcacgtccatgtccacgtcgctgcccaaggccagcacggtgggtaccacgttctgcttgcgcatggagtgcgccgactcgtgcagactgtcgttgcccgtgacgccgtccgtgaggaacacgaaggacagctctgcgtgcctccgggcccygccacgcgggctgcgcacgatggcattgatggcgtgcaccacgcctgcgcccacgtgcgagaaggagttcaggtattgygtggtctccagcgcctcgtggatggcmgtgaggttgtggctcagcgggaaggccacctgctgctcgccggggccaccaaactgcagcagcgccacgcgtgcgttgagagggtcgtcgtccctcygggccagygtcagccgccgcgccacctgctccacgaagcgccgggccttgtggaagttctgctcacccagccgctcggagccgtccagcaggaagacgatgtccacgggccgctgcgtgcactgtgccacggacagctctgtggggagacgcaggtgcgggctgggcggaggrgaggtgggcaggaccgggcaggtgccagccccgcacctgtgcccttccattcgcaccctgcctgcaacctcacagaccactgggctctgcgggggcgtttctgcagggcagccctgggtgtgggtccttagcccaaracactttcaggcggcactgctgggagccgccrtctcctctgctggtgctcccaggcctgagaccctgacacaggccccaggccctgtccacctgctgagcaccatccctgcacaggctgccctcctgggagggaaggggcccaaagcatcctttcatggctcaagaatttgctgcccacaaaagggccactgtctgtgtagtgtgggaggtacttaaggaggaccctggctctgacacccccagcctgacccctcaatcgctgggtcccagagctgctcagaacacctagagctggctgggccacgtccctcccggaaagaccaggagcccctgactcttctgattggccatggtggggagcagtgggcacaggggcagccagaccttctgtggcagcccaggtgggttctgccctatgactctgttaccaagtggggcccccacctgcctgggtggtcaccagccctgggcatcggggacagcttgggggcctggccatagccacaacccaggccaggctgcctaccacaygtgtgggtgtcacgtggggccagagaccacaggacaggacacggacagtccttgcgtggacctggccctgtggcctcaccaagacctcagctcctgggatgggggaggggagggacagagccagtttccccaagggtgtctgcttctcagcccaacccctggacgtcgtcacagctggtacatggacccccaggaatgcacacagaggaccctgacccgaaactcggtttctsggggccctggaggtgcaayggtccagccccgcaggcagtgagcaaagctctgaacacagcagggtgacctcacgctgcaccrcagccttcacagaacgcttgagacatggacgycgtctgagcacrcacgagctggcagatggggttccctcagtgagcttatgagtgacgcagctyattcagtgaaaggaagggcagcctccctgttaaggccacacctaggaaccggcttaaatgtccagaaactcctcaggtaccgctgggcttcccaaaccccctcaaaactaataacattttcactgctgtcaccmaacatatggagacagacatgcaaggggcagctggttttgggggtctctgtccattcatcagtgtctgtggggcctggaggagacggggaagctgtgggggccggccaggcacagggaggctgaggctgttgggatgtctgtggactctgctctcctcctcctgtggaggatccttcatccccacagtgggaagaccagcctggcctgccctgtgcagtgggtgtggggacgagaacctggccctgagaaatggtcacagccgtgcccggcaggagcccagcctggatgagggctcctgcagtcagaacgtcggggtcagctcgccgtgggggccgctccctttggatggtgatccctgccgctccccaacattgtggaccctgggattctctgctcagtcctctgaggaccgcagaggttgtgcctggtggatgctcccccgactgtgcttttggagacccagaggttgggctggaagggtgcagacaccccgggatcagggctgctggcaggcagctgtggccattcgccctactgtgcatgacaccagcccagatacgtcatggtgccaggactgccagcttcccccaggactatctgctgcccaaccggaagccttcacctgccaccaggtgggccgtgagcgcccacgagtcaccatgcacgggattagtgcccacacccagcgag

SEQ ID NO: 13499 - DNA, 27240 bp, Homo sapiens
agaatggctaacctcagagctaagccccagccacctttcttgggagagggccccctcaccggaagccggggtcgctcttccaggtaggctgagctgaccaaggggaggatgacagggtggatgtagaagaggaggtggtgactggggctggggcttcttgggcctgaaggttggggctcaggcacctgccaggccctgtactctgkgtgccaagccttgggagggccatgtcaggggctgggggaacacagggagagcgattcggggagtggcttggggaacggctgggtgatcggggtggcttgggcagaggtgggggcacagtctggcctgagggggccccaggccggaaggtgggggacagaagtccaggggagtgagtgccaggctctgaaggaccctggcccacatccaagggcaaggtytggggtggccgtggcaaaacaggatcctcagggctgctgtggagggcctcaggccgggctcggaaggagggggagagccgagggtctggggaggtttggatgcarggtggggagcctgtaggaccagatgtctgagctggaggctggagatgcccctcagaagcagggagaggtctaggggctggggcatccctctttctagctgatgtctgtcccacagaggctgygcctgatgccgtggatgctggagccagggcctgttcctgagttggagacagaactggactgggcaccggggaaggggtggaggggagttctgggggctgctcctcagaagccagggccaggctcaggccagaggctgccagtgttggcttgggtcccacggaggcaggtggctcctgcttctggtctctggaggttggggccagattgggccccagggtgactgggggagatcttggccctgctgaggcaggcatcaccagccccagggacgtcggagccagaactgagcctgtggtcgctgggggaggctttggtccagctgaggcagacatcaccagctggcccacagatgttggggccaggctggagctgcggtgggcagtagctgttttctgcccttcaggggtacacagtggagccaggattggtcggggagatgccagagccagcctcggtccttccgaggaagctgacatagctgcccgtggccctacaggtgccagagccaaccttggttccgagggtcctagggctgcgttcttctttgctgggagctgaaaacttgagtccaccttgtggaggacaagtcaaagattcagagtgaccctaaccagggcattgggccccaacttccatatagaccctggcagagttcatctagctaagaaaggcacatctttccaaggaagttcttcctactatctcacttcaatctattctgctgcaggtcaacttctgtcttggaggagataggacacaaaaccctaacccctcctttaagtctgaaacctctttcacagatggggaaactcagaccctgactcaaatgaggcagagtgtgaacctaaacctgaggacttgccttgccttcctggctggcacccacaccctgcccattcggggcagcttccctgggcaaccctcccactgyagtccctgaagctcccccagccacggctactgacctgacatcccaggtctgggcacactggggacagcctgtttcttttctttttctattgtcaagatacagacctacaggtgcagcttgttaaatacctctcycttccttcataatgcccagaaaccctcagttccccaccgccccctaaacatccaaatcccttggttacagccctctctgttctcttacccattcccagagctccactcaggagcaagagctgggagctgagactggctgtgtagattcaaagcccagctctgtgtgaccttaggcaagtacctctctgcccagcgcctcagtttctctgtctgtaaaatgaagggatggggtctagggttcctggccacattatattctggggaatcttcatctcccattgtctgcatttatgagcccaacatttgctagaattccatctagccccgttgaatagtccatcctcaccaagtgtgaatctagcattcagagcaagtccaggattctaagttgatcctggtgtcacatctctctgtgcccaggttgtgccctcttacatcctccactttctcccctacctgaaaggacaggcaagcaggtatcccatttatgwccggcaggtgggaggggtggggagtcacggagtcctgtagagacctatcctccttccccatctattctctctgatgtcccctgtctccagaagacaggataaagtgtccttcaccaaggagggcagaagaatgtctatacttgccccaggatggccctaggtagggtaacagggcgcagggaggccctgcctctggagacgcacttctgtttctgtcccgtatccttctcagttcagagtacctaaaactccatctccacctcccttctcaaactcagttctttgaggtggcattttaggcaccctccttggctccaagtgtcacactgtgtgccggcttccccccaactatcacaccgcctccagtactaacaacttagccatcccagatgtcacagttttagtcttcagcgacaagccccctcattttgcattggctcagagaggaaaagcaacttggccaaggtcacacagcaaaggtggagcacagctgggtcctctgatacccagtccaggactctcccaagggctcctggagatggctaacttcatctgtctccgggcatcctgtcactgcccctcagcccccagggtgctctcttcacctagcccctgctcgctgagcagaggaaagtaccagcccctcagtcaggagcaccagggagcctgcagtrtatgtggggggggtgtgtggaaccagggatcaggaaagcggggggcactgggtctcaggggtcttaccttggagggtgccccagtttgggcaacaccctggggcatgggcagggaacccaggccagcccgggtccctggcctcctgctgcccctgctgctctggccctccatgtctgcagcccccggcagcctggactcccttggctccggctccagctctaycgctcccgggaaccagtgatgtcatcagccatttcaacctgctgagaatttaaaggcacaggctcccacttcccagcctggaagaggccgaagcaaggtggctaccccctgggaatccttcaaacwggctgctgaggctggaacagccatggagtggggaggggagagtgtacccatctgcctggcccaggtcccaactggcagcaggaaggaggctgtctgtctaccttcacctttctgccgtaggcctggtcagccctttgctccagggaggggcattaacacacctgccttaaggtaggacaggtggttcagaggtctgcaccctctccagggcctcagagacaactgagttcttgccctgatcctgtgaccttcctggctccctgccagctcagagcttgccccggcccccacccttgccccattttcaggtcttggtgccaccctctccactcctactgccagtcccaggctctattcttcccaacccagaaccagacactcaggctccagccactgcagtcttttcccatctcaggcctcagcaccagcccctcctcttctgcagacacctagctgccctcagatgtccccacagccaggcctaacccagcccggcttctgtcagctttcttctctccagtattcactgggtgtggtttgggaggggaacttgctcaaggtcacctggtgaactgagaaggtctcctgtgtttcartgagaaaacttagtgacctaggatgagcacaagcccttcgagctatctgggggaagggaacttgggtggagaagggcccagcagtggggtaacagactgacaagagagttacaaacaggcctgagaattgctacagccaggacccagcccaggacatggtccccaacaggcctacgggagtgtttgttgaatgaataaatgaattagaagagtgaatgggtgatgagggtcagattgggctgggatggctgtgggatctgtttctcatggcttagagaggagtgatcccacccactttaggcagaaagtgttcagagttgtgtgtgcagagctccctgttaaccaacatggagcatctgcatgggcctgtgcagtctcctacatgaaggcagatgcctcactttcctctcctgaaggcacttcctacctctgcttgactgtcagtaggtctagtctgtattctcaggccagcatctctgctggaatttgcaggggcagagactcaggccatattagagtgttggggtagaaaggtctttggacagcgatagtggagatggtgacagtggtgacggggaaggcgactgtggtgatggatgtgatgatgtatgtaactgtgatgatggaagtagggggctagcagtggttgtggtgaaggtggtggaggtgatggtgatggcaaaggtagaggtgatgatgataccaatactgatgatggtgttgtgtcaatgaaagaggtagtgttggagttggaggtgacagtcagggaggatgtgagagtagacctggtggtratgctcaggttaccagaaaaaggaagattcgaactcatcctgtcttatcctctgtctcctgttttacaaataagaaaatgggagcccccgggctgggggagtactggcaaagtgcgggtaatcccagcactttgggaggctgaggtgggcagatcacctgaggtcaggagttcgagaccagcctggtcaacatggcgaaaccccatctccactaaaaatataaaaatgagccgggtgtggtggtacatgcctgtagtctcagcgacttgggaggctgagacaggagaattgtttgaacctgggaggtggaggtggaggttgcaatgagccaagatcgtaccactgcactccagcctgggtgacagagagaggccctgtctcaaaaaaaaaaaaaaaaaraaagaaagaaaagaaaaaagaaaaagaaaatgggagcccccaagactacccagcttttcatgcaatcctagagggaatgatgggcagatccaggcctctgggaccagtcctaaggctcagccatctagggctgggacaggggcatcagtgccctttggaagccagrcaaatgtcatgcaaatgtgtctgcagagggctcctctgcctcaggagggcaacccaggatttcccaccacccgctccctgagctcagaccctgcaggggactttgtttctggccctgccactgacttacttgaggaggtcactctgattcccaatttgtgtaagggagattaaaacagcagacacctcctaagtttgctggtgaagattcaacaggataatatatatgaaatgtttagcatagagcctggcacagcaagctctccataaaggtggctgctctgtatttatcatcatcatcatcaccaccattgacttcagcctgcccatgtggtggatgctgaaacaggctragggtggttactctcctgggaggacaaggaaggggctctgagacccaagcctggtcttgtcaggagaagggggtagggggcggaccccagctgaaaagggagtgagttggagctatatttgagctcctggtrtgatgaytaaggaggttgataacaggctctggggctcagggcggcaggctgggggcagctgtcagggagaaccgcccccctggagacggctgtctctggaggccctttctggctccctccttgccctcactcttggtgggggaggggggtgggcgtactgaggcagggtccagggctcatccagcccactcctggaaactcagtgctgtccttcaggctgtgtgggtcagggataggaaggcaggatgccagtgatagatggagtatcccagttactctccatagtaaccctgtgaggttggtaatgaggcccccattggacagaggaagaaaccgaggcccagggattacacagccagtagagagaggacagagcatggagctcctggagaggcagtggataattcttcccgacagaggagctgactgttgaaccccttctttgaaggagagtccgtgctgccaaatcgaagaagagaaacgccctggctggaaagcagagagaacagcaggtacaaagcatggatggggaaggaaggttctggctgtgaaaggatgagaaatttggacatgtaccctcctgccctttggttcggagtaaacatgagcagggaagggagagaagtctttcctgtctttttcctcctcctcttcctcggttcactttccaggggcacctgaggatggcaacggtaccgagggtctgtcctccttcctttctctccctggtcaccctgacccaggcccgccatgagggaggtcatgctatggctaccatctgcaaaggtgtagagggtgatacaggatattgtgggaatgtgaaagaaggggttatctgggagggcttccctgaggaggaagtatacagggcacaaaagagcatttcttctcccaaggcttcactccagggtttcttgttggtaacaagcttcacakgttatgtccccagcacttcattctcaccctctgaggcagatgtcatcctcactccccattctgccactcaggaaatgggctggaggaggaggagtgactttcccaaggtcacacagytggggctgagctcaggcctctctcctccttctcttcggctccccctcctcctaggcagcccagcacccgctgtcagctgckctgaagtgagtggctatttttattctggtgcgaggggatctcaagcagcagagccatgtaggttagaggctctaggacacccggcctcagcagtccaggggaaacttcctgcagccaccagaccctgctaagcttgcctgggggctctcatttcttgcagactgacttgctctgggctcctatgcctccagaagcttctttattggagctcagaacagagcatagagccagattaagccctggtcatggtcctgatcctccaacttgaacccgactcttggtattgactaagcctctactccagctcttgactgagctctgacatcaccttagaatgaaccctgactctagtcacatactgatctaagcctgaattaggctgatcccaacttgagaccttagttctgggcccagatcaagcccttatccttytctaagactgagccttagtcacagactgaattctagccccagcccagactaaccttttagactgactctggcagaagagtcagactaaccttttaaccctgactctggcagaagactgagccctaatcttggtcaaagactgagtcctgagcctaatcattgactgaactctgaccacagactgaattctgaccctggatcatgcaattctggtcacacactgagccctaaacggaagactgtgccctgaatctggtcacagactgagccctgaacttagtcattgacagagacatgaccctggtcacagactgagcctggctcctggtcacagactraagactaagcccaatcatggactgagccctgtatctagccctaggctacagactactcaactaagggstgacctagaccctgtctgagcctgaccccatcacagactaatccccaaccttggccccacytgaggaagactgctggcctaaattacatgctgccacataagaggcatggattatgggcagagatctgtcttgggagatcttgggcttctcatgctgctgatgccacagtgttccttcctggtactgttatggtcacagtctccaccactggttccactggctggttggtcaaccctcagcagcccaagctgtggcctttaggggccacagcatccaggctaatgcaatgagagtggtttggtggcatctgtccagcaaacaaccagggcccatggggtactggggtttggctctgtcagcagcaagaacgactccgtggggcctctggcttcagttactctgaggcccttgctggggtaggggttggagtagaaggaaatagtggggtatgtcccattattttcgtaaataaagtttactgtttgtgtttaggtaatccatgcccattacacaaaacacagaaggaaaacatttacctataatttcatccaccaagaaataatcgttctgacttattggtttgtttccttatagatattttttggtgggggcgggggtctaggcatatatatttatatatacatgttgtatataatatgcatatatatttatatacatgttgtatataatatgcatatatatttatatacatgtatatttacatatacgtgttatatattttatatagctatatctattttttgagatggagtctcactctgtcktccaggctggagtgcagtggcatgatctcagctcactgaaacctccacctctggtccaagcaattctcctgcctcagcctcccgagtagctgggattayagacatgcaccaccatgcccagctaattttgtatttttagtagagacagggttttgccttgttgaccaggctggtcttgaactcctggactcaagtgatccacatgccttggcctcccaagtgctgggattacaggcgtgagccaccaagactgggcctatacatgttttatagaattggttggttactgtgttgctgccacaatgtccagcaacacagyagggttagggttagggttaggatcctgttaaggttgcagcccatctccttcttaacaggaactggaatatggtggaccccaccctcagcttcaggaatgggtcccagttggttaagccagtaagcaattcccatttccccaggcacatgattagatcacgaatgaactagcaagatacaaggaaatttttgctcagggcttttgggaaaggaagcttattttctctcctgaggaggctgccaaaaaagatgatcttccttccattagatgtaaatgaagaggccaatggctctagttactgctggcagccatctttacaccatgtagaaaattggcctactgataaactgacattatggaaagcagaatggagagacaccaggctttggtgacttcattaactggatcaaacttcacctgaagccccacctgccattggactttttttttcttctttttgaaatggagtctcaatctgtcgcccaggctggagtacagtggcaygatcttggctcactgcaacctccgccacccaggttcaagcgattctcctgcctcagcctcccgagtagctggagttacaggtgcccaccgctgcgtttggctaatttttgtatttttagtagagacggggtttcgccatgttggccaggctggtttcaaactcctgaccttaggtgatctgcccgcctcagcctcccaaattgctgggattacaggcgtcagccactgtgcctgtcctggacttttaaaattatttgagccaacagagtccctttatttatttatttatttagagactgagtgtcgctctggcacccaggctggagtgcagtggcgcaatcttggctcactgaaacttccacctcccgggctcaagcaattctcttcctcagcctcctaagtagttgggattacaggtgtgcaccatcatgcccagctagtttttgtgtttttagtagagagggggtttcaccatgatggccaggctggtctccatctcctgacctcaagtgatctgcctatctcggcctcccaaagtgctgggattacaggcatgagccactgggcccagcccctttatttttattattttttgacacagggtcttactcacattgcccaggctagagtgcagtggtacgatcttggctyactgtattattttttattttttataggagatggggtctcactctgtctcccaggttagagtgcagtggcatgatcatagctcactgtagtcttgaactcctgggctcaagcagtcctcccacctcagcctctggggtagctgggactacaggcactgccatgcctggctagattttaaatatctttttttagagatgggttctcactatgttgtccaggatagtttggaactcttggcctcaagttatcctcctgcctcagcctcctgagtagctgggtttatagacacaagccaccacaaccagctccctttattgtttaagccagtttaaattggggtttctatgacttgcagcccacagcatcacaactcccaattgatattaccagattactgtttttgttgcttttttcttgctatttaataccataaccacgaacattctccatgtcattccatctatgctgcatctttttttttttttttgagatagagtctcactcgcccaggctggagtgcagtggtgcgatctcagctcactgcaacctctgcctcctgggttcaggcaattctcttgccttagcctcccaagtagctgagattacaggcagccatcaccatgcccagctaatttttatatttttagtagagatggggcttcaccatattggccaggctgctctcaaactcctgacctcaggtgatccgcccacctcggcctcccaaagtgccgggattacaggcgtgagccacccaygcccagcctgctgcatcatttttaacaattgcatggttttccatcctatggaggtacactcattaatttaactcatcccctgctgtgacatgcttaggttatatccccagttcttcaccacgataaatggtattctaataaacaagcttgacctaacaatcctctctctgatgattactttggggctaattctgaaaaatggaattactgggtcaaaaaaagtttttagagttttgattttgcccttcagaaagccagggtgaattcatacttccccagcagtgaacagagtgttagagatagcttactgtgtgaatagtctggacaagactaatcatattgactacatactcatattatatatawatatttttttttttttttttttttgagacggagtcttgctctatcacccaggctggagtgcagtggcacaatcttggctcactgcagcctctgcctcccgggttcaagtgattctcctgcttcagcctcccaagtagctgggattataggcatgcaccaccatgcctggctaatttttgtatttttagtagagacgaggtttcaccatgttggccaggtggcctcgaacttctgactcaagtgatctccctgcctcagcctcccaaagtgctgggattattggtatgagccaccatgcccggccaagcctattatttttatatctttacaatcaagttagtaaaggggaagttagcagggtgcaaacaaaagactcagtgcagacttaacttctctagaaggcacagtaggctcagtgtttagggcccactatacttttagggggtccatgaaagtgtttttttttttttttgagacggagtctcgctctgtcacccatgctggatggagtgcagtggcgtgatctcggctcactgcaagctccgcctcccgggttcacsccattctcctgcctcagcctcccgagtagctgggactacaggtgcccgccaccacgcctggctaatttttcgtatttttagtagagacgggggggtttcactgtgttagccaggatggtctcaatctcctgaccttgtcatccgcccgcctcggtctcccaaagtgctgggattacaggcgtgagccaccgcgcctggtcgaaaatgtttttaatattctttaaaattagaaggatacactgggaagttaaggttaaaaaaaaaaggaaacatatactaataataatgaatccagcctagattatagttatctttttaccaaagcaattgaaaatcaaatatatataatatttatgtatattatgtatatttaatggaggcatgtgtccatatcccagctactcaggaggctaaggcaggagcattgtttgaggccaggagttgaacactagctgggacaacacagaaagaccctgtctctaaaaaaaaaaagaaaaaagaggccaggcacagtggctcatgcctgtaaccccagcattttgggaggcggaggcgggcggatcacttgaggttgagaccarcctaacatggtgaaatcctgtctctactaaaaataaaaaaaattatccgggcatgatggcacgctcctgtaatcccagctacacaggaggctgagacacgagaatcgattgaacctaggaggtggagattgcagtgagccaagattgtgccactgcactccagcctgggcgacagagcaagactccgtctcaaaataaaaataaaaattaaaaaaaraaaaaagaaagaaaaccctaggatccatgaaagtcataatgcagccttggctcggtattgagaaggagtccctagattcaatgggaaaagaggacagtgacgaacttgctgtgtctgtggaagaaagcatgaagaagagaactggcatcctaatctggtgatctggtgatccgttctccttttttttttttttttaattgtaggcattttatctgcaaatgcatattacctccttagaaaaagaattccaggattttacctcctgtgtgttttcgtcttgcttctttgtgatccatgatgccagctgaggttgtgagtacaatgaaacccaactggcaggatgggagcagattattctgccatttttctagatttttgagttgcacatcaaatcaggggctgattactccacacttgtttaacctgcctgtgaggttcacagcagttttcctagctctgtgatcatcaatgacttcaacttcaccagtgtaactatgcttcatcaccacagttagaaaccagacgacgacattataagaacctggtgtttgcctctcttttggcattgttgatgctctygagagcatcagccgggacattcatgcacaccattatggcagcacatggcagaaagagctatctgcttatgyatgagattgagaggtgaagccarctggacttcctgggtggagtggggacttggagaaattttctgtcyagccagaggattataaatgcaccaatcagcgctctgtgtctagctgaagaattgtaaatgcaccaatcagcactctgtaaaaatgcaccaatcagtgctctgtgtctagmtagaggattgtaaatgcaccaatcagcactctgtaaaatggaccaatcagcactctgtaaaatggaccaatcagcaggatgtgggcggggacaaataagggactraaagctggccgccactgccacccttcatccccagccagcagcyggcaacctgcttgggtgcccttcggtgctgtggaagctttgtcctttcgctcttcccaataaatcttgctgctgctcactctttgggtcctcaccacctttaagagctgcaacagcctgtaatcccagcaccttgggaggccaaggtgggcggattacgaggtcaggagatcaagaccaccctggctaacacggtgaaaccccatctctactaaaaatacaaaaaattagttgggcatggtggtgggcatctgtagtcccagttactcgggaggctgaggcaagagaatggcgtgaacccaggaggcagagcttgcagtgacctgagattgtgccactgcacttcaacctgggggcgacagagcgagactccgtctcaaaaaaaaaaaaaagaaagaaagaaagaaaagaaaaatagaaaaaagagagttgtatcactcacygtgaaagtccgtggcttcattcttgaagtcagtgagaccactaacccactggaaggaagaaactccagacacatttgaaggaacaaactctggacacaccatccttaagagctgtaacactcacagtgaaggtccgcggcttcattcttgaagtcagtgagaccaccaacccactggaaggaagaaactccggactctcaagatgagtgcagagacatgttgggttcaagtcccaaatccacagttcactcatttcacctttctgagcctgtttcctaacctgcaaaatggagttcacggggtctttatgaggtaaggaaggaactgataatgaaagctaacactgtcctagtaggtacttttttttttttttttttttgagtcagagtctcattctgtcgcctggctggagtgcagtggcgcgatctcggstcactgcaacctccgcctcccaggttcaagtgattctcctgcgtcagcctcccgagtagctaggattacaggcatgcaccaccacacctgggtaatttttttgtatttttagtagagacggggtttcaccatgttggccaggatggtcttgatctcttgacttcgtgatctgcccgcctcagtcttttttttttttttttttttttgagacagtctcactgtgtcgcccaggccggagtgcagtggtgcgatctcggctcactgcaacctccacctcccgggttgaagcgattctcctgcctcarcctctggagtaactgggactacaggtgcccgccactatgtgcccagctaaatttttttttttttttttgagacagaattttgctcttgttccccaggctggagtgcagtggcgccatctyggttcactgcaacctccgcctccgggttcaagcaattttcctgcttcagcctcccgagtagctgggattacagacatgagaatcatgcctggctaagttttgtatttttagtagaggtggggggtttcaccatgttggtcaggctggtctcgaactcctgacctcaggtgatccacccaccttggcctcccaaagtgctgggattacaggcatgagccaccatgcccgtcctgtattaggtactgttctaatgagctttatatgtgttaacccctttatcctgccaaycccaacagggtacacaatattgcatcaccacaatgtgtgctctgggaagtaaaaaccttgattggaatttttgtccaaagaaataaaaaggccaggtggagtggctcacacctgtaattctagcactttgggaggctgaggcaggaggatcacttgagaccaggagtttgagaccagcctggtcagcagcaagaccccgtaatctactgaataaacaaacagcgcaaacagggattccctagggttcggttttcctatctctttttttctacaaccaaattggtttaytacaggaatgcaaggtttaacatatgaaaatcagttcacatattttaccacatttaataaaataaaggagaaaaaccacatgatcatctcaatagatgcaggaaaacatttgacraagttcaacatccattcatgataaaagctctaagaaaaatagaaatagaaaactttcttttacaaaaggcaccagtaacaaacctacagcaaacatgatcgtttaaagatgatatctggaaaaagacaattatcagttccagtcaacattgtaccagaggccccagaccgtaaaattaagacagtgcaacgaaacaaaaccaaggtataaggaccagaaaggaagaaaaccacttttatttccagatgatataatatgcatatgtagaaaataaaaaaaaatatccagttaaactattagagtaagaaaattcagtaaggtcactggctgcaaggttaatatacaaaaatcaattgtcttcctatatgctactaccaagcaacttgaaaatgaatatgtaaaaacaatagagtttgtaatgctataaaaaattaaatacctaggagtaaatctaatgaaagatatgcaagatatttattctaaaaaccacaaaatattattgaaggaaattaaagaagacctatagaaatggagggacttactatgttcgtggaagaaaagtcacaataatgtaaagctgtagagtctccccacattgatttccccagtgggaayctgaaatcctgatagaaatttggaaggtttttctgtggaggttgacgagctggccctaaattgtacctggaagtgtgaaaggccaagtatagtcaagacaaccttcaagaagaacaaagctagactgcgatggcttactgaggctgtgggatcacacatggccctcaccacaggaaaatgtaggccacaggccaggcatggtcgctcatgcctgtaatcccagtactttgggaggccaaggcaggaggatcacttgagcccaggagtttgcgaccagcttggtcaacatggtgaaacctcgtctctactaaaaagacaaaaaattagccgggtgtggtggccgacgcctgtaatcccagctacttaggaggctgaggcaagagaatcgcttgaacctgggaggcagaggttgcagtgagtccggatcatgccactggacatgagagtgtccagcctggacaatgagagtgaaactccgtctcaaaaaaaaaaaaaaaaaatcagctgggcrtgrtggtgcatgcctgtagtcccagctactcaggaggctgaggtgggaggattgcttgagcctgggaggttcaggctgtgattgagccactgcactccagcctgggcaacagagcaagactctgtctcaaaaaaaaaaaaaaaaaaatagccagcccagcagctcacacctgtaatcccaggactttgggaggccaaggcgggtggatgacttgaggttaggagttcgagaccagcctggccaagatgatgaaacccccatatttactaaaaatacaaaattagctgggcgtggtggtgggcacctgtaatcccagctacttgggaggctgaggcagaagaatcgcttgaacctgggaggtggaggttgcagtgagctgagatcgtgccactgcactccagcctggctgacagagcaagactctgtctcaaaaaaacaaacaaacaaaaaaacaaaaaaaaatgggccaggcgcagtggctcacacctgttatcccagcactttgggaggctgagacgggcggatcatgagatcaggagatcaagaacatcctggctaacacagtgaaaccccatctctactaaaaatacaaaaaaattagctgggcgtggtggcgcgtgcctgtagtcccagctactcgggaggctgaggcaggagaattgcttgaacccgggaggcggaggttgcagtgagccgagatcaggccactgaactccagcctgggcaacagagcgagactccgtctcaaaaaaaaaaagaaagaaagaaagaacaaagctagaggaccaacacacaaccagatgtcaagtctgactataaagctatagttaataagacagcgtagttagacaaacccactgaaggactagaatagggtatgatattcagaagtagactcccatatatttatatggttacctatttatttatttatttatttttgagacagtctctgtcgcccaggctggagtgcagtggtaggatgtcggctcattgcaaactctgcctcccaggttgaagtgattctcctgcctcagcctcccaagtagctaggattacaggcgcccacaccacgcccagctaatttttgtatttttagtagcgatggggtttcaccatgttggccaggctggcctcgaacttctgacctcaagtgatctacccacctcggcctcccaaagtgctgggattacaggtgtgagccaccacgcccggccgtggttgcctatttatatataacagaggtaacgcggcagagtagcaatgaaaaagacaagatttttaattgaattggatagccacattaaaaaaaaaagtaaatcctgactccataaatttaacccagctgatttaagaccctgttgtggcctatcagctgtaaccctccttgcatyttcccacctttgaatagcaaattccttkcctcaccccaggtcagaaagtctgctcagcagtagctgtggatggtaagaagacacgctggtaggtctcagtggctcccagaagccgcaccccctccaccgaacctcactcctcatctcccacgctccaaagcgaggagtcctcagaaagccagtttcccttatttattcttctttctttctttcctttttttttcttggatgtcctaccagtttccctatcttaaagtcgcaggttcggctcagaaactccagtgtccctcagcgtctcgccggcaccctctgccggcgtgaggtggcgctgcctggccgcatcctgggggagcgtccacatcctcggtcgacaaaaggagcgtcgacactctcggacctgggaaagtgacggcccaaacgccagggaggagccaggacctcgccctgagctagcgggaggtaacggcggggagtcctggggcggagaccgagcgctgggggcgtggtctccagcgggactgggcctctagcgggagtgggggcsgggscgggggcggggccagcctggrggcccagacgtggcgcagcgactcggaggttcgcctccagcttgcgcatcatctgcggccgggtcccgatgagcctcctgttgcctccgctggcgctgctgctgcttctcgcggcgcttgtggccccagccacagccgccactgcctaccggccggactggaaccgtctgagcggcctaacccgcgcccgggtagaggtgagtacgccggcctccagccccggcactatcgttccccaaccctgcggccccatgggagcaccgtccgtcccggccccaagaccacctcgaaccgcgagtctccctgctttccccctggcgccgggaccatccctcctgttccctagccccagatggccccagcatccaccgtggaagcctgagacaccgactttggggcctggaactccgaacccttccccagctccccctacccggtccgacagcggacacccagacacactgacgcagtctcctaactcttctcgtggcctatgactcccaatcctgtcccaacttcccatcccccatcacttcatgttttcctggaattcccccccgacccggttccagggctggaggctccagaaagtctcttttccttctcctggggggaaagaagactttctgggtgcctcctcccatatgcaggatccggggaagggggccaactcggaggggcaaccgagttgggaacttggttgccaacatttactctgcagcagcctcccatcctcccccaaccaggaaattcccgttcggagtccctgtcttgctatgtgactttgaccatcacagcccgcctctgagctttttgtcagctctgtcygacaaaagggtgtagaatggttgggtgccggtggtgcacgcctgtaatcccagcactttgggaggccaaggcaggaggattgcttgagcccaggagttcaagaccagcttgggggacatagtgagaccctgtctctaagaaaagggctgagggtaggatggaggagggctggagtgggtggtcctggggtctagactcctgctggatggtggcatctcctcagggaaggcagggaggagccctcccatcctcccatgtcagggaagcaaccacatggtctgtggggctgggccgcaggtggcaggcagggtgaggtctgcctgtgtagagtagggaccagatggtaggtgtctccaatgggggcccccagggccattctgaggtgtttccttctgctctgcctccactgtgagatttcagggatcaaaggccaagcccaggtctctactgcttaagaggagcagggtgatcatttcccctgggcattgggagtcagtccacagccagtaggatgtacaggccccaaggctggcaggcacactgtkggtctctggccttgctcttttcccctggtgtctctaggcctgagtctccccacctgtatacacagttcccccttctgcccacragggtccagcatttccttcagaccttgggaactgctgatccrgggataactcacagcccgacccaactcagggataaggaagtatggctttggggatgtgactggaataaacgtgaaggactyctgacctatcccattttatccccctccagacctgcgggggatgacagctgaaccgcctaaaggaggtgagtttgaaggaagaggtccctagctctgttccccctgagcctcttggggagtgggcaacatggtcccaatgactggggcrgggaggggggaaggatccctaggctgagagtctagcctaggctgrgagtctagcctgcacctgacttgytttatgacctcactgggcttcagtgtctcgtctgtacctcgagtagactgaggtcatggtctctgatgctctggttcctccccaggtgaaggctttcgtcacgcaggacattccattctagtatccttctgttctgggggaggggaaatgggatgggcacctgggagaatctccacgtaacttcagaaaggggtggcagatggttttcaactgacaagttgaattgattggtagtggctcccagaggattctgaggtggtctccatgttgggtgggcaagagagattgactagtgatgactgccacagaatggagaggagggccctttacttctttgaaccctaattttctcacgtataagcggagaccctggcccctcccgggcacagagtaagctctgagcaaaggaggcaatgctgttcccatcagtaaggctgcggaaaccaccacctccctctgcccaccaccccgctccttaacaccacctccagtcacaacctggtgatgaaacacctccctggggccgaccctgagctcgtgctgctgggccgccgctasgaggaactagaggtgaggccgtgggaggtgggctgggggcgaggccagaggcgaggcccagcctgctgaccccgcccctcctccgcctcagcgcatcccactcagtgaaatgacccgcgaagagatcaatgmgctagtgcaggagctcggcttctaccgcaaggcggcgcccgacgcgcaggtgccccccgagtacgtgtgggcgcccgcgaagcccccagaggaaacttcggaccacgctgacctgtaggtccgggggcgcggcggagctgggacctacctgcctgagtcctggagacagaatgaagcgctcagcatcccgggaatacttctcttgctgagagccgatgcccgtccccgggccagcagggatggggttggggaggttctcccaaccccactttcttccttccccagctccactaaattccctcctgccttaactgaggctcgactccttcgttgctgcgggcgggtggggtgggaggtcggaagaagaacctctgaggatccctgctggagttggagaccttgcggagctgccttcggttcaaaccccctccccacccccaggagacgcagagaggagtcaggatcgttgaaaaccaataatttatcaaaacgctgcgtgtgtatgtgggggggagggtgtcgcaacagacagggcagyggtgggcggacgcacaggcaggaracggtgcccggagagtgggggcggcascttgccactggctggccatgcgggcgggcaggctagacattcttgccgcgcaggcgcagttcgtggcgtcgcaggtggttgtagagcgactgcacataggtgaagacacacttggggtcaggcttcttgcccatgatcatcatgtcgtccacctccaccaggggcacacagtccaccagcatcctgcagggagggggcacggggttggatgtcagcgccagaccygcctctcgtggcgcccctctaccccaaggtcttttttattgccgcattgcctgctggtctttcataaactccagacagggaaaagccttccaggaaggcaggaagcccctggcttcatctacccaagcctggaggcatctctcggggcgggggagcagagctaggcaggtggaggcggagatggcagaagagagccccatcccagtcaggcaggkcctgggtctgcttcctccaaccctggggaggtgctggctccaaaccctgcccatgttctccctggagaccaccttctgctcaccctcactggcacactccagttggtagaagcctctcagctcggcctttgcacccagatgggcttcatcactggccaatctttatctatggataggtctcactctagtggccctgtggtccaccgatgattgtctgctagctgcctgatctggtacttcctgttgagaggcccagggacccctattctttgacagggggtggggataaccctgctgctggagatggaggccagggaacgtgtgggcagcagaggggttctctaacccttatcacctgccwtgggtagagcagaggaggcagatgaggatcccagccaataccaatggaccatctatgccatgctcggggggaccacccttctggccatccttcagaatgctagctgcccttcacagataaggaaactgagtcacagagcagaggagccatttgtttcaagccccayggcttagtaagtgcaggctaggccgcatgggacccaggcccccagttctgggtgttggcaaagccttttccccactctggagtgagtgggttgtgcctattaagcaactgacagctcccagagctctgaagctggagtctgctctctggctccttttcccctgtccctcaacccccagagcaagacctcttctgccttgatccctcctatctgccatacctgggacatagcaagcattcaatgttgctgaatgagtttcctatggcagggaaggcataatggcaacaattgctccttattctcaagacacctgagaacccaagaccacctcccatctcgtgcccttatggacaaactcagaactgtggtagggctgggcctacccccagctcacctggactccttcagagaagaaacctgggaggcagaacaccgaacacctctgttttagtccagactgtatccctaaccagttgtgggtgctagataaggcccttttctatgactgtttccccctctttagaacaggacagttattctctatctcatttgagaccttacaagaatttaggatgagtgagagggttctgggtctgctgcygatgtgccacgtgcccctagggtcatccctatcccagactgggcttgtttcccgagctgtaccatgatgcaaaggcagcctctctctgaagcttcttccagctgtggctatcgtcctggggatcccgaccgccctctccaacctggtgctccctcccgccccactcccttccctggagaccttataaagccattgtttacactggggctcagggctcagggctcaggctgccccagtgacaggccaaacaccaggcaacttgagcaacagcacggctgagtcacactttccaactggatcagggctgggctgggcccctctccctccaagctggcttgctgggcagcagctcctaagtccatatatgatctggagatagcaccaagcccatccgccactcatctgtgctccttctctgagtgtgtgtgtgcacatgtggactgccccccacaatggctccaggccctgaggggcatctgagtgtgcccctacctgtcactgactcacattccttcagccaatccccttgctccttctgggcctctattttcaatcctctctacaaaatgggcgggaacacagtgatggggcaaggaaaacagccactaagtggggagtttggagtctcagtttctggccccagctctgacctaaccatcttccctctccctcccacccccaggacagtcttagcccacgtctctctctgagctccttgtctgtaatggggtagttagtttaggatctgaattctttactttggtactgaggtgaggtgaccagagaggaaatgccacagctggcttaggatccagagtccccagccagaaacatcttcctgttgaactggtcctgctcctgagctccccactttggagtatggcaccaccaactccccagtgcccacacaggagcctggcagacttcttgaccttccctctccctctccaaaccagatctattgggaagcctgtctctctagctcttaagctattccagtcatctagtccatcccatctctcatccaagcctcatccraggaaggtcctagaatgctatatccatcccttctctgtttggaaaccctttataactcctgttgtcctcaggaggaaggtcaaacttttttttttttttttttttttttgagatggagtctcgctctgtcacccaggctggagtgcagtggcatgatttcagctcattgcaaccttcgcctcctgggttcaagtgattctcctacctcagcctccygagtcgctaggattacaggtgtgcgccacacgcctggctaatttttgtatttttagtagagatggggtttcaccatgttggtcaggctggtctcgaactcatgacctcgtgatctgcccaccttggcctcccaaagtgctgggattacaggcatgagccaccgtgctcggccagaaggtcaaacttctaactgtggccccctcctccctcatatccagactcaagtttcttcccttcctgatgtgctgtgctctccagctctcttgccctgctaagcctaggctgattcctctgcctggaactccctctccctcctttagcctgaacttgttcagatcccagcttagtttgcacttttttcagatggggggcccagacctgcagcctgggtcaggcatctcccctgggcttcccccatcacagtgctgcccacctgggtcatcactgcccatttagaatggtctcacctgctgggccctgaactgccagaagacagggctatgtctggctcctctggcttgactaaatgccccccttacttcccccacccgcmtccctggaccctctctggccttgctgagcagattctggtgaaacggggcaggtggkagaggcggcgtttctcaccgtggggccccgagcaggggttaggactttttggtttttaccagcccyttctggaccagacagcggtagaattcctggatgtacgtgtacacgcacttccagtcaggctctcgaagccgcaccatgtcctctgtatccaggagctgcgggcagtccgcatgggtcctggggagggtagggggccgggaaggggtggggkacgggggcaggaggccagggccccgggtggggaagagagggaagaggcagagaagagagaggggaggaaacagagacacacacacatacacacacacacacagagacatgagttcaattacgattccagtgctgcagtctgccagccccccgcatgcctcctccccactgtggacgtgccgctcactacccatcactaatggtgtgcaatgcagacaagggtgggggccaaaccagtcacaggtgcagagaactctaggggcaagcgggaacgcggggtgggggcgatggcgttggcaccaaggttggagaggagggctgtgccccggggagagggggtgagggaggcgtgagaggaggtggggggaggaggaagaggagaaggaggaggaggaagaaatttgagggaaaccagaaagagaaggggaaagaagggaagacagatggagaagggtgctgagggtgaggtgagcagacggggcaacgattccaaagtggagggcttgctgaggtcctatataagcctctggcagcactatataggctgggcgggcacggtgcccgggccaggagcctccttttggaatctccagccgggatcccgtgggagcaggaagctctggtgatagtgggaggagagcaggacagagaaagggagagagagggagaagggggcagagggaggatggaggggatatggacagggccacctggtgggctttggcccgggctggtaggccggcctgcggctccttcgttccggcgggcacctggcacgctcagcagcgggggggtggggatggagaaggacggggactctctggggaagggggtctcagccgctgactgacaatgtggctggcccgctccaggggttctcagggcaactgggcctggtcccgatgtccagccccagatgtgcagcaacattagcagggccagggcccacacttactccgcagatgagaaggccacctcgaagttctggcgtcggttctgagggctaagctgcccatagtcgaaggcctcagggaagaagttgtgcaccagggcacagaaggccatcccatcactccagctggaggagaagttctggatgtcgacgtgctataagccgtaggaggactggtcaggaacctgggggcaactcccccctgctgtctacccctcagcattctgttattccagacctagggcactgggcacaaagaggccccgtagcttgcacaatgagtgaatagttggaacatgagcctcctccaagtcagcctgtcaactcccatatttgcaatttcaagggacagagctactgagaggcccagcgccacccagctaaggctatggtcatgcctcatcactccttccctcatttagagaaattgactcagggcytcmtacagagcaacaaggaggggactccaagagtgggatccggccttgaaccctgcccaccacccaagaggccctgttacttcatcactgattctggaatctagggcttgccttgtgtcctctttgagcctcagtttcctcaccccaagagcctttccatgttccctgtgaggccacacagtggcaggaagtgtactgggtaataggagctctgctaagaaggaggtgttgagctggggtctggggaggcctccaggccccctggcctcccggggctcacctcgtagccgcgagtcttggctcgacaccagtccagcagcatctgcttgatgctgttggcgttggggaccccgaagctggtggatcgctgcacggctgcgcggggtccgccagggctgctgtaggggcggtgtcaggaccaggtcacacgactataaggggcatgcctcggwgggcccacccagtggatcccaggccccgccttccatgaccttcgggcctttgcaccacagatctagccgcgcgrtcttcccgcctctgccgggccaactatcaagccccgccccccactgcctatcamgccccgccccccactgcccagcccacttctgcagctcacccggccgcgccctccttctccagcttctcaatcatggccttgcgcgcctgggaggctgaggtcttgg

SEQ ID NO: 13500 - DNA, 13964 bp, Homo sapiens
tgccctaccaccaccacgcgctcagcctgatgtgtttacatggtactgtatgtatgggagagcagactgcaccctccagcaacaacagatgaaagccagtgagcctactaaccgtgccatcttgcaaactacactttaaaaaaaactcattgctttgtattgtagtaaccaatatgtgcagtatacgttgaatgtatatgaacatactttcctatttctgttctttgaaaatgtcagaaatatttttttctttctcattttatgttgaactaaaaaggattaaaaaaaaaatctccagactcaagttgctamgaccttttgtcctgccttttgtccttccttttgtgaggcacttacttacaacttggttacttagttggacagcaggaagttgtgtagataggagcctgattgtgttcttaggctgatagattatttgcctgtggtttggagtctagttggaagaagcctcaggtaggtgggagctggagcagtggaggctggagaggtctcccaggctaagggtggggctttgagtgacttaagaaactcgcattctctagaagcctgaactctgcttcacactgtgtccctgggcacccagctcggactctgccctgtcagaagggagcatttgaatttgctgggccaggtggaaaacagcttccttgaaagggcacttttgaagagtacagggaaggatccttaaagagtggacacaggctggacccttcatgacgtgacccccattggccgagtgaaaggatagccaaataagtatttggaaagaaagggagggscctggcatggctcacgcctgtaaatccagcacttctggaggccgatgggggtggatcatctgargtcaggagtttgagaccagcctggccaatgtggcaaarccccgtgtctactaaaaatacaaaaattagccaggtgtggtggcaggtgcctgtagtccctgctactcaggaggctgagacaggagaatggcttgaacccaggaggcagaggttactgcagcaagccaagatygcaccactgcactctagcctgggtgacagcgggatactacatctcaaaaaaaaaaaaaaaagcggagcgggggtggaattttcctatagttttctcctttatcccacacctgaactccaaagggcagggtagagtttccagcaagtttccaggcatggctaagagacaggtggttgaaggtcttctatgaagaaagcttactgaagctggaaagaccatctgagttcacagaaggaagaatgagaggagggaatttagaaagccttccaagctgggcatggtggcgtgcgcctgtaatcccagctgctcaggaggctgaggcaggagaattaggtaaacccaggagttggagtccaacctgggcaacatagcaagacccccacctctacaaaaaataaccaggcttggtggcacatgcctgtagtcccagctgctcaggaggctgaggctgaaggatcatgtgagcctaggagtttgaggctgcagtgagctgtgatcgcaccactgcactcctgcaaagagaaaagaaagatttcaagtccatgagggcggctagaaagttgctgtagggccatttagattagagaagaaaagagccttctcaagaagggccttctggccgggcgcggtggctcacgcctgtaatcccagcactttgggaggccgaggcgggtggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaagaagggccttctaaaactcctctgagtctgtatacgctgtcatgcaagactaggtgagtctctagaatcaaacagtgataatacccagatgccttccagcaaattgtagcacctgttgcaataggtgccactccctcctaaaatcagccagggtgcctttggaccagaggtagggtgagcttttgtaggaagcagggcactggctcctggatacagactggagagcttagctccagaaaacaggagccatgttgacagaaaaccgtgctctacacagttttctttctgactttgtgccagcccccaccccaccccaactgcaaagatcaagaactcagagggctactgtgcttccctcctgctgatcaaagatgagctctgtcctggccttagtcttttccaagcaggagggcaggagagaatcttgcatagctggctacggtgccccacccaagggtctaacttggggctctatcacaaaagctgcagcaaaattgccaaaartaggaactactgggggtgggggtcctgtctcccctgctcagtcaccacctcccctccctaactctcattctggctcataccacgtgctcccagaagaaacgttctgagcaggggctggtatgagactgcctcccctcccaggacccactcctccctatgaccaggctggtgaccctccctctagggtgccagtgccattcactgagcagatgtttggcaggtgtctgttatgtgccagacctagcaggggacagagtcctcccgatacagatggaccagtatgtttggacataaattgtgaaaggagttgctaatctttctgtgcaaaatccactcttgcggtcaccgccaacactcctacacatgtcagggcatccagggccaggacttggtaaccctgttcaggagcagtcgctctggagactcccaagacgagggaaagaaatgggtggaaacaggggcctacactgtgggccccgcagccaccaaacagtccaacccgtggccactgagtgccttgaacaatgcctggctggaccctgagtctgagtgtgtcatcaacccagtttgttattgtcgttgttgttgttatgtatttttccatcagctctgtccagaaagacytccttcctttccaaaatattagtaaagggggcttagactagtttaagccaaataccttgcaataaaatggagtagccaccctggtgaataagtatatttagaaaaggaaactgcctgcttggtaagatgctgttcaacagcaccccctatcctgatgcctcgcagtcccygagccaggaaactgagaagtccctgatcagactgcaaargctgcaggctccgcaagggtgcaaggccaccctcaaagaactagaagccaggcctcccgattcccacccctgccagcgctaaatagtaaccgctgaaggatgcagggcagctgtgagctgcagttttcccacaggcaaaaatcacaagggtaaaatctggcctccagccttayagggatattctaagttgtgaaagtgctttggccacaaagaactgcgcaaatgttaaatactaggtttagccataacaatcattttagtaacaaaccaaagagaagggtgaaacactggcaagtatcttggagtccaaccagtaagcttctgagattcccccatgtgctgactgggacaaactctaccccccaaaagaaaagacgctctcttggcccgagacacctgtgagctgtcccagcaggggaccagccaccttcccactttctaaagctacagacagctgggatggtcaagtaggcagcccaggctgatggctcaccaaggccacctccctgtctacacagtcccatagacatctggggccacttcagtcctagaaaagatgttccatatctcagcaactgcaagtcaaggacaagcagagagatgtgggactgctgccttcatgcctgctgcagaagctgaggtctcagatctgataaagcaagtgtagtgggaataagggaatacattaccagaaactgggattctagaaaacagaatagttactgtttactaagtgctaggtacctttctaacagttttgcatatatgttcaaagttcatgcttaaaacgatacaaatttattatcttacagttatggaggacagaagtccaaaatgggtcatactgggctaaaatcatggtggcagcagagctgtgctcctggaggctgcagggaaaaatmctttgccttctccagcttctagggaagggttgctcatgtccctcagctcatggcccccttccagcagtcacatgagtctgatctccactgccatcctcacatctctttctctgactctgaggccactgcctccctcttgtataattaaggacccctgtgatgacaatgggcccacctggagaatccaggccaaccaccccatctccaggtccttaatcacactagcaaaatctttttttgccatggaaggtagcaaagccacaggttccagggatgaggctgtggacatctttggggagcgttattctgcttgccacacagtaacccctgccataactcagggcgatggcatattctatcattatcttcaatcagaaactgatgtgtggggaggtgatgtatcataactcatccagggtcaggcagctggatttgaacctgcctgacccttagatttgaggttttctggctccagaatcttctctgaagtgaaaggcatgaggccgaccactccctgatctggtaaacagagatgtcagcctggtttctagtgttagggagtttcctggagtgatggtacagggtacatttctgccctgcatcccaagtccagagactgggttctargtccagcctttcttctaactccctgagagatgacagcctctgggcaaagtccctctgtgctcttcagtctcttcatctgtgagatggtggcatggggagaggctggagtgatgtcacagttcctctcagcctgcatcacaggctctaggactcaggtcctatcagtaacctgctgrgggaggtctgggccttccaggagaaacctgacaagatggtgctgcaaacaccaacggacacacagcactttacattcacaggctgtctcaggggcctccaacaaccctgaccattcttgccccattttgcagatagaaaaccgaggctcagagagattatataacttgcccacgatcttcctccagcaagatggaggccaagtgaaatgagaaagcaggtctcctgccacttcctttgcccagaggtcttctccccacaccagggcttcccaagggctgagatccagtcacacctgtgcgtgatcaaatataagtgtgaacaatgcaaagggagacgtcttcaatctaaggggcttcaattctgtaatgtaattctgagattatgcccttttttgttaaagcctttcctttttgaagtgatggtcactgtagatggtgagggttttttggaggcggacaatatctttacatgacaaaattaaaagttggcagctccgaattgatctctggagtgttttgaaatgcaagaggtctccgaaacctcagtctgggagccacggagggctctcccctctccccaggtttaccagtttgggaggcttggagagaggcctggaggacctgctggggactaaagaagagcactggtgggaggacaggdcgggggaagggggaggggagtgaagtagtctccctggaatgctggtggtgggggaggcagtctccttggtggagkagtcccagcgtccctcccctcccctcctctgccaacacmatggacaatggcaactgcccacacactcccatggaggggaaggggatgagtgcagggaaccccgaccccacccgggagacctgcaagcctgcagacactcccctcccgcccccactgaacccttgacccctgccctgcassccccgcagcttgctgtttgcccactctatttgcccagycccagggacagagctgatccttgaactcttaagttccacattgccaggaccagtgagcagcaacagggccrgggctgggcttatcagcctcccagcccagaccctggctgcagacataaataggccctgcaagagctggctgcttagagactgcgagaaggaggtgcgtcctgctgcctgccccggtcactctggctccccagctcaaggttcaggccttgccccaggcyrggcctctgggtacctgaggtcttctcccgctctgtgcycttctcctcacctggctgcaatgagtgggggagcacggggcttctgcatgctgaaggcaccccactcagccaggcccttcttctcctccaggtcccccacggcccttcaggatgaaagctgcggtgctgaccttggccgtgctcttcctgacgggtaggtgtcccctaacctagggagccaaccatcggggggcyttctccctaaatccccgtggcccaccctcctgggcagaggcagcaggtttctcactggccccctctcccccacctccaagcttggcctttcggctcagatctcagcccacagctggcctgatctgggtctcccctcccaccctcagggagccaggctcggcatttctggcagcaagatgaacccccccagagcccctrggatckagtgaaggacctggccactgtgtacgtggatgtgctcaaagacagcsgcagagactatgtgtcccagtttgaaggctccrcyttgggaaaacagctaaagtaaggacccagcctggggttgagggcaggggyagggggcagaggcctgtgggatgatgttgaagccagactggccgagtcctcacctaatatctgatgagctgggccccacagatggtctggatggagaaacyggaatgggatctccaggcagggtcacagcccatgtcccctgmaaaggacagaccagggctgcccgatgcrtgatcacagagccacattgtgcctgcaagtgtagcaagcccctttcccttcttcaccacctyctctgctcctgcccagcaagactgtgggctgtcttcggagaggagaatgygctggaggcatagaagcgaggtccttcaagggcccactttggagaccaacgtaactgggcacymgtcccagctctgtctcctttttagctcctctctgtgcctcggtccagctgcacaacggggcatggcctggcggggcaggggtgttggttgagagtgtactggaaatgctaggccactgcacctccgcggacaggtgtcacccaggsytcacccctgataggctggggcgctgggaggccagccctcaacccttctgtctcaccctccagcctaaagctccttgacaacygggacagcgtgacctccaccttcagcaagckgcgcgaacagctcggccctgtgacccaggagttctgggataaccyggaaaaggagacagagggcctgaggyargagatgagcaaggatcyggaggaggtgaaggccaaggtgcagccctacctgsacgacttccagaagawgtggcaggaggagatggagctctaccgccagaaggtggakccgctgcgcgcagagctccaaragggcgcgcgccagaagctgcacgagctgcaagagaagckgagcccackgggcgaggagatgcgcgaccgcgcgcgcgcccatgtggacgcgcygcscacgcatytggcsccctacagcgacgagctgcgccagcsctygsccgcgcgccttgaggctctcaargagaacggcggcgccagactggccgagtaccacsscaaggccaccgagcatytgagcacgctcagcgagaaggccaagcccgcgctcgaggacctccgccaaggcctgctgccsgtgctggagagcttcaaggtcagcttcctgagcgctctcgaggagtacactaagaagctcaacacccagtgaggcgcccgccgccgccccccttcccggtgctcagaataaacgtttccaaagtggraagcagcttctttcttttgggagaatagaggggggtgcggggacatccgggggagcccgggwggggcctttggccctggagcagggacttcctgccggatctcaacaactccgtgcccagacwggacgtcttagggccaagatcgacgttggaggacctgctggacgcctggctgcttacgagtgagggagtagagtctgccttagcaaggctcaagtagaaaggaagtcacagcggaccaggcaaagccacagacaatccaaggccaggtgccctgaaaggggctcaaacaaggcctgcagccctgtctgaggcgggccaggaaacagggttgctttagctgggagcagtgggttccccgtccccagaggtgtgtccgtatagagccttctccagcccagccgctgtcagcggggcgggacggagcggggcggcctcagggagccagccactgggattggggtttggtcccgggtgcaagtgaagcgcttggagtttgcgcctgtcctcctttactaattcaaaaacctctcaaacagacacttcccttttcttctcacaaggccagtatccccctcccactactcccatcccgcccagaaacagccgcggcttcctcaggcacagcagtggaagccagtcctccaccccctgcggctccatgccatgccaccccctctttctgccagccctggcagaagctggcctgagtaagaaaattcaccaccacctcttgcaggtacatttttatttccaagatgctctcatatctgtgctctcactgcatcctcccttccccacatcctggctagattgccatcagacgcagagcatggatgaggacactgaagcctggacctgtgacgtcgcttgcccagtgaacagcaggatgggctaggcmgcgctttttagaccctgcacccctggccatccatgattattgaaaagagtgygcgggtcgggtgcggtggctcaagcctgtaatcccagcactttgggaggctgaggtgggcgtatcacttcaggccaggagtttgagaccagcctggccaatatggtgaaaccctgtctctactaaaaatacaaaaaaaatcagctgggcatggtggcttgcacccgtaatcccagctactaggaaggctgaggcaggagaatcgcttgaacctgggaggcagaggtcacagtgagccgaaatcatgccactgcactccagcctgggcgacggagcaagactccagctaaaaaaaaaaaaaaaaaaaaaargagtgtgtggcctggcactcaagttcacatgggtgtgcaggcatgcctgtgtattctcacatgacctccctgctcacggtccctccttgcactcatgtctgaatgtmcccgcgtgcacgcacatggcttcacagatctgggcagtgccttccctaccctctctctgcagggccttttgccccctcwtgcaggcccctggataatcggccccatccccatgtccccatctccagtgtatcttagctaccctaggtaaaggagtgggctttttagttcctaaccttccagagctacaacagcagtcatccagccaggtctgggtgggaacattttctagatacgggtgctgagatctctcagcccagagagaagccctggggaattttcagagagaaagcagtctccaggtggggctggatgtactgatgccactgagatctgtaaaggagtccctaacacctgacataggagtgacaaaactgttttctgcaccaactgagcagaatacacgcagctgacctgggctcaaggtctggccctgccacgtgctggctctgtgatgctggccaagtgccttcgcctctccgggccacagttttttgayctgaagagtggagccctactcaagccatctgcagctctcgggctctctgacctgacatctttcgggtggtggggacacaaaggaagcagcctctattrggagaccttgtgcttctttttggtcccaggacactgccccccaccactccagtccrggtcccaagggcccagtcagctcaactgtaatcatgacaacattgatcaagcatctttacgtgcaggtgctgtgccaaacggttcgaacgctctctcatttcaatctcacggcaaacctacggtggagggggtacggttgtatccactttacatgtaagaaactgaggctgatatcaagtggtggagccaagaatagtgcctcgttgcatcttactccaacctctagcccatccggcctcctcccttcacgtgcgcctaagagggctaggkggccyggataggggaggtcagctccacagttttgagtaaacacacacagtctcaactctgatgacaacttaagtgccaggcatagtggctggcatggggcacacactcaagtcatgttgtgcagcacctaacagtttatcaaagtatcagcaaacttattgtcctgtttgaccttccgcacaaagctgtcaaggaaggcagggtacggagggtgattcctaccttagagatgaagaaactgaggcccagagactgcccagctaccagaaggtggatagagcrctggcctccatgcctgcctgacctggagtctgtccagtgcccacccacagaacagcctcggccctttcccatgcccagacacagatggcacacttgcgacggcccactcatagcagcttcttgtccagctttattgggaggccagcatgcctggaggggggccaggcatgaggtggggtaggagagcactgagaatactgtcccttttaagcaacctacaggggmagccctggagattgcaggacccaaggagctsgcaggatggataggcaggtggacttggggtattgaggtctcaggcagccacggctgaagytggtctgacctcagggtccaaatcccagaactcagagaacttgtcctyaacggtgctccagtagtctttcagggaactgaagccatcggtcacccagcccctaaatcagtcagggraagcaacagagcagggcatgagaactcctctgtaggcaaccatgggacccacacccatgtmcccaytggacgacaccagtcaggaccacaccaccctctcaacttcactggacgacagccctgagacctcaggcaggaatcccccacagctgccaccctgggagaagagatatccttgcaggaaccccagcacaagtcaaaccctgccatctccaggtcacctcagatgtttatgcccctgggcctgaggcacaaagtgacagggtggggagatgtgaaaggtcaaggctgtcattgttttctgtgcaaacagcaccrcctggagttgcacaacctggtggctctgagcagggtaggacagagggaggcagcctctcatttggaaagtcattggaggattgattagttgtgtgatctggggcaggtcacctaatcgctctgagcctcaattttctcatctgcaaagtgagaaaataacacctaccccaaagccggttctggggactaagaawgtttatgaacacctctgctatgccagctaatgccagtcagggtgaggtggagaagggagtaggggagaggagagtactgatgggcaggggcaggatgggagaggaaggacacacttctgctcacactggccccaggtcttagaacaaagcagaagcactcacgggcttgaattrggtcaggtggggcctcccaaggcaaacccctagcccaggggtccccaacccccaagtcatagataggtactggtccatggactgttaggagccgggctgcacagcacgaagtgagtggtgggtgagtgagcaatmccgcctgagctccgcctcctgtcagatcaagtggccttacattctcataggagtgtgaaccctrttgtgaactgcacatgccagggatctaggtggagggctccttatgagaatctaatgcctgatgatctgaggtggaacagcttcatcccaaaaccatccccgctggcccatggaaaaawtgtccaccacaaaactggtccctggtgccaaaaaggctgaggaccactgctctagccagaccttcagaaaaggaaaatggggccrggcgcrgtggctcrtgcctgtartcccagcrctttgggaggccgaggcaggaggatcccctgaggtcaggaattcaagaccaacctggccaacatggtgaaaccccatctctgctaaaaatacaaaaattagctgggtgtggtggcrcgtgcctgtaatcccagctacttgggaggctgaggcaggagaatgggttgaacccgggagayggaggttgcagtgagccgagatggcaccactgcactccagcctrggtgacagagggagactccattaaaaaaaaaagaagaaraargaaagaragaaagraagagarrgaaagaaagaaaaaggaaagaaagaaagaaagagaaagaaaggaaagaaagaaagaagaaaagaaagaaagaaaggaaagaaagaaaggaaagaaagaaagaaagaaagaaagaaagaaagaaagaaagaaagaaagaaatagaaagrgaaagaaagggaaaggaaaggaaaatggaaatgagggctaaaacggcrcgccctaggactgctcyggggagaaaggagggacctgggaggaatgcagtctcaactctgtcatctctcccgcagcagcctgacaaaggccctgtgaggaaagaggaggctgaagaggcacaggcccaggggaggctggagcacctccattccattgttgggatctcaccagggcwggggygggtgggaatggaggcagctggcaggggggatggggagggaggccagcgggtgtacctggcctgctgggccacctgggactcctgcacgctgctcagtgcatccttggcggtcttggtggcgtgcttcatgtarccctgcatgaagctgagaagggaggcatcctcggcctctgaagctcctgaggaaagagcagggctgagtggggtggatcggcctmtggacgagccctgggctcctgcttgaccacccaytgggactgggatccccaagttgcctccaccctgcccccagcccagtcccaccaagtgcttacgggcagaggccaggagcgccaggagggcaacaacaaggagtacccggggctgcatggcacctctgttcctgcaaggaagtgtcctgtgaggggcaccccaggtccccatgcctstggacccctccctggrgaggtggygtggcccctaaggtagaaccttagctgggtctgccagaaggagtaggggccggctccctgctmatacgggctctcagaagggggactggtgagsggcgagggatcgaggcccaaagggaggtgggtgggatggagcagaaaacccaccaractgaacatcaaggcacctgcggtctggactgatctccgtccagtccagccaacatgctgtgtgtctttgggtgatttctggccctctccaggcctcagtttccctgtctggggtaggactgggctgtctaaggcttcctccagccctaagcctgaaraatgaggggggaacctgcacttggagccacttccagccccaccccctrtgtagctttgggcaagtgacacccctcccgggcctccatgttcttcaggttatgatgaggggtggggggcacccrtccagctscraggcttccttagctctagcaagtgcttctccaggcttgctggctgggctgggcagggagctcctcttgcccctcttcatcctcctcccctcctctttcccctccccagagggcattacctggagcagctgcctctagggatgaactgagcagacaggcmggagggttctgacctgttttatatcatctccagggcagcaggcactgaggacccagggcgctgggcaaaggtcacctgctgaccagtggagatgagggcctgaggcagggtgtccagatgcagcaagcgggcgggagagttgggaaatccctaggagact

SEQ ID NO: 13501 - DNA, 66131 bp, Homo sapiens
  misc_feature (1)...(66131): n = A,T,C or G, or insertion/deletion polymorphism (see Tables 1-2)
ctctcaggtgctgaggaggatcatagcccttctgaggagctggacaggcacaggcctcaacttcccaagggcaagcccaccagttccctgcagagaaaaatgctggttgcaaggagcctgagccagcctcagcatgggctatggaggttcatccaggtgagatacagctagccccagagatgggcctttcatccactygcagagcagcagcaggactgaggactgcctctagcctgtagacgccactgcccacagaatcatggcctagcccctttccttggcattcagggtcctcaggagccaaactccaagccttccagctgcccctcctacagccatgggggctttgggtgagcaaaactcttcccgactccccttgcattctcccacctggcactactcaggcagttccctctgcctctgcacmcttctccactgctcacaacttagcttgtctttttagttccagctcaaatgctgctccttcccgagacttctgggttctgccctccaaatttcctatggtcctggcctctatttgaggtcaggcctgatgtgagatttatgggtctcccccagcccagcagctgatgtttgatgactgcatgatagaggagaatgccacatggcagaagatggagtaggctgtccccaaacactggctcttctgtcactgtcagcactcaaactcctctgagtcccagggagtttagcatatagcaggtgctcagccaggctttcagatgggaccttgacagcagcacgcagcagggtctcctcctacactcctacagaaaccccttgattccaaacctctccaacctgggctgcctggtccactgacctgcctggccttcagtcaggcggacagcagcatttcctattctcagatgtccgcagagccagcctcaacccgcaggttgactctgatggaaagaagcacatatgattttcaagctgatatcrccgcggcccagaatttcagacttctgtggacccacaggaccttgtcaggaaagaaaggatagagggcagcccagggcactgggatggtattggggaagggatgttttccccctgattaaactgttgcaggagtcctatgaatatggcacagttggacagtgttagtaccatcacactgatagtggagaaactgaggcagaaaagttagggcatttatgcagaggggtgggggtgggggcaagggtctttgggaaagtcacttctacttcccgagtcttggctaggaggcagcactttttttaatagcatggaccctggagtcaaacagcaggtgtgacttcatcatcctccactgactgctgtgtggctttagagaaactgcttgacctctctggacctcattcttctcacctacccaaggagaacttgcgtcagagaattcaacaagatggtgtaaacggagcatgcagcactgggccagctcggagccctgaggtggaagaaagcctgggacattcaaggcttcgatagatctacacaggtacagagattggggtgtcgcctcccatccaagcacacagtacycaaacaccttagatgggttctcatcaagcttctccgaggtttgctctggcacctcagactcccctctgagcctcctgggccagcatctcctccacggcccacacatatactgagtgtggctgtctgccagccagtgccaggcaaaccgggccaggaaactatccagaatgagcagccacgcttgtcttttccgcccgagagcctcaagcgctgcgcagcagcgccctctcctggcgcatcttgatgagacctccgcagctgatatccccgtggccaagaatttcagacttctgcagacaccacctaagaggagatcgtccttaccttccaaaaaatagaggaagaattaaggcctggactttcccaagatgcccagagaggcagcagcagcactaggaccagagcccaggcakcccagctttcccgccagctgcttcaccccctcacttcacagccacttacctctgcttcttgactgccagcctcaagctgaacaggtgatgggccagattcagtctgcacatgctctgcacatactttcccaaagtgccatcaacaaaggaagaaatcctgctcccaatgagaagctcgaaaatcgtgtgctccttttccttcccatcagagtcaaggagggagctcagagctcccgttgtctgaggccagtgcaggaatgatgcagctggggcaaacactcaaagaagaaagacagcacaagcccgtggtccggtttcattaatcctttgaactcggtcctgagtaattgctgtctgcctgctctgtggcagagcccgaaaatgtcacggtggcagataggtcagacgggtcctatctatcttcctggagcaaccaagcattgcacaaggactgagcggcatggtgagagttggaaaaagaagcaggggtgccttgagagagggcaaccaggtcgtgacctcctgtgaggggcctggggaggcctcctcatgcagaagatgctttggtatagatctgaaggaggtaggagtcggctatgaggagggcagggagagggagctgcaggtggagggagtgatcagtgcaaaagctctgtgggggaaatgtggctggtacctttgagggcctgaaagaagccgggcttctgtgatgctccaggaaaggccagggggagtcctcacacctgggartgatgtgaccacctcttcagctctgtcttgtatccagacaccctccttgtctgccagccaccagcaggaccttcagacttttccccatgtctcctcatttaaggcccagckgactaagcagtgactgactgcccatcaggcctgygccaggctctgcaggtccagtgcagaatgaggcagtaccctcttctcagtgggctcacagtctggatgggaagacaatcaaccactgagtctgacagcagagatacagatatgctcagaatattcaggaaacacagatgagatctagaagatmccatgtggcatagggtgatgaggaaggccttcaagaaaggcctgtcaggaggtgacagctgaactgagtcttaaagaagaagggggcagggattagccaggggakgagggagagggtgttccccacaagggaatagcatgtgcgcagtcacacayatgcacagaatgtgagacattgaggtgcaaagtggaaaagcagccagacccagtcctactgagctacacacaacacactggggaattggaatttatgctcaagatcacagaaagtcatcraagttcactaaactgagcagattcaaagtttcagaagctcactggggcagtaggacaggggcagagggacccaggaacccgtgtccactgtgatccaggcagggcagtggcacagggctgggctgagccacattcggagacagcaatgagggctgggtgtcattgaggggatggacactcaggactttgcggctggtgggataagaccttgggagagagaaatggaggatggcatccaaggttctgttttgggtggccactgggtggaggtgtgtttctctaagttgaagaggcactggcggaggaagagagagttcatcgagggatgcgctaagatgacccgagccacccaggtggaggtgttgagtagagggatgtctggactctgaagcaaggtgtgggggttatacgctgagagatgggaggtacgggtgggtgagggtccagatggggccctgaggaattcacacctaagcatgagaaggggccatggcaccagggaagaagatgagaasagctggagaagcaggaggaaagctgggtgagggcaggaatctggaagcagaggggagcaggcggcatgggcagcgccttcactgcagcaggtcaggcatggacagctgacccaggcctttgctgcccgagtgtggcaggtggacatggggaggggattgttggcttgcctgagagagtggttggggaggtgggagctgtggggctgtgtagactaaaggtgcagccaggagactccaagtttggagagccttccctgattgcttcctgtagaacgatggactccctctccagtgctcttacagccacctctgtgtagcatctcagatggattgtctcctctcaaacagagactttccccaaagcaaggcactagcacagactgatgctcaggaaattgctgtggcctgaaagggtaaataagaaatggggagtgggccactagttaacaaatgctatcagcatagcccatctgcatgtcctgctactgaggaaagtgctctgagaggtcatcattggggaaggaactgagggagaaagaaaatgggrttgctttctggccctagtcatgcagggagtggatctctgtggagtttctttctctctgtaatggccagtagctgccctgcnctctcccgagtgtagaatgcaaatgtgaatggcagcacactgcaaatggtgctctgaagtgcgaaggccaggaagaagggatggcctggatcctggccacagagccagcattctgcctgggctcatagccctgtggtctgggattctccaggcctggccatggttgctggtaaayctagggtcctcccctcacttccctgggtgatgygccccatgggcaggtttgtggcatgcatatgggaatggagcacagtaattcattttggaaagcaacccactcctgctctgctccagctcgttagtagttcaagcagcagctttctgggcctgggaggccatcctgggctgccagggacactgcctgccaacgtaagacctcctcaattggtgctgacacaggactgaggggatgacaaactgcctggcaccccttaggtggtcttccagaggagtgggttttgagaattgtcaggctttccacttgtggatgcattccaatggtgaactcagtaaaaggccactcttcagagacctgcatttctcatagcagccctaggcatatatcccgggcatgacagggcacagcttggggttgatgctgatggcaactctgaagcctcaagactgagtgggtcaccataagcagcaggaagttgaggtgccgggatggggtgtgatgcttccactcctccctggaactttgcaatacttccctagccaggccggcgactccatcccgggctgtcctctcccgatacaggtccactctctgtgtgccggggcaggggagggagtgatgctgcaggaaggtcccttcacctccaagtccccactcctcagtggacagrcctttgtaggatcaagcttcggtggtcaggctctgtcttgctttggaagaaggaggtctggctggctgtcgcttcatattaacstggatgacgtgacatgaatatgcccagtgggacaagagcaggcccagcagaggccccttcctcctgmccatacccttcaccattcttgtcaaccttggggtgtcttggctgagacccacagctgagtccctgctggaaactagcagaacgctggggggcttcgagtcttcttaggaagggaggaaagacactctcattgtaatcaaaagcctctccgcacagcaggccacttctccagtgagcacggacccctggcctggggcctggctgaatgtagggtctgcctacagagagggagtttgaggtacagagcaccacctctgccttctgttggcccagggcggacagtgtagggtgagccagggccaggcagggagctgggcccctagagagctgtagctgaaagttagacatgaccctgaaccaccaggtgcctgctctaggcacggggtactgagtgggacatggctgagatgaacaaaaaggcatcactgcccagagttgggatgggagagagtccacagctgattggaatcagcattgtcagcacagcacagyacagggagataygcgcattgcmgtctctggatgggcggctggcactttcagttcaaaggcgctgaggctctgaagttggcaaggaagaggataacccggagaagggaggactaagagaatttcacttgatgacccttgcctctttgtgtctgggatgagccgcgcggagcgcacccttatccacccagagtgctgtgcctttaaggtccactgggggcgtgatgtcagccgccctccggcacttggagaggtgagcgcggcagcccgcgcagccggtgactgggggactgggtttggagtaggacctgcggcgtgctcgagactccgacttcggtcttgcggcgcgctcgcgcccgcgggccatgccccactgactctaagtgggcactgccccggctccgggagggcgagaccgagcgccggccatgggaagcttccagctggaagactttgcggcgggctggatcggaggtgagtgtgcttaccggggacccccggtcagagagagcgagcctggcggagtttgcctctatgctctgaggaaacyttgcctctgtgcsctgccatcccgctccccgttgtgcgcgcagcctgctttggggagtgcccggccccgagatccccctggtggtcttgcagttgccagggctaaattctgagagcttcacagcgtttcgggctgagcttctgatttgctcattaagttaggatccgtgggacttgatgaggtaatgattaaacagctcgtcaaagcccacagccaatggaggctcctggcggcgcacacacccttcagtgacctggtgcacacctgaattgcggacgtggctcgcgggaacttatgtatgagggtagcgcttggctgctgatcccggggcgcagggtggtgggagccaggcttcgagattaggccggcccaacggggcgtcccgactggagggagcagagctctcacagcagggagcggagcgccggctgcaggtgcccattgccaggctgcgaggagcacttattgccttcagccgccgccaaccgtcagccatcgcctacctccaaggccccttctccgggcactgttgggtctgctgatcccttcgccacagctcccgaagccactcttttactgggcctgggatgggttgcctgggcgagagttgcattcatttccttgcttctccatttttctttccaattggtctatccctcttttctcagctattaggaaagggggaagtttgagggactttgctaattgtaaaaaaaaaaaaaaaaaaaaaaaaaagtctttctttggacccatctaaaagggttatcctaaaagggatgttggcaaatgtagcccctcaccaaaggggtgaaaaaataagatgaaaagaacaacaaaccagattggatcccaactcctcccctcctacctagcaggagaccacctctctcccgagaccggtggctgcagggccctgcttcacaccttcctgagcagaggtggctcctttcaccttgagtaagtctgttggcacagatgcccttgggtggggctgagacccgcctctcctaactttcccagttagggggctgcagcctgaggcccgctgggcatatccaggtcctttttgactggacaattattccaccattcagcggggcaggcagagagaggagacacttccgtgggctgccccttaaataagcagaccaccttcggtagggatgcaaatggcttggtttgaaaaatgccctggaaggtagggctgagtcagagtagttccaagactctgatacccctccccatccccaaacgtgataacatgtgaaccctccccgactcacagcaagtaggggatttttgtgctttattctggtccttactttggtgatgttattgaaagtaatggcaaaaatcgcaattacttttgcaccaaactaataacatggctttttttttttttggcttccatgaaatgatgktaagtgtttactacacttgaatacttactaggtgccaggtatagtttaagtgctatatgtattcttttaaaacaattttatcaaggtttattttatgtattataaaattcacccatttcaaatgtacaattcaatgtcttttagtaattttacaaagaggtgcaaccatcaccataaatttgttttagaacattttcatcccccagtaagatccctcatttgaagttgaatgctgttccctctccttaatctcctttctgtaaatttgcctttcctgtatatgttatgtcaattgaatcttgcaatatgtgatctcttgtgtcagtttatgtatagttctttaattattataacaaccccaaagaggtaggtaccrttgcatccttattttacagatgaggaaactgagatacagagaaattcactgacttgcctaagaccatgcatctagcattggcaccaggattccaacccaggctgcctggcaccagaatctgccatcttaatttcatcttaactctttctgaacaaccttgcataacaaaattttgccctttttttgatattatccccccccccaccccccccmmccmcacacacacacattttgtttgagattttactggtttgtgaagtgccaaggtctggaaatcactgaccttataatcccatttttttaaatctcaaatcccctgctttcagatgggtgggctaataagtggcagggagatgttggcccaaggctggatctaagcctgccctgagctgaaggatgtgtgcactcactatgggggaagccatggagcctgaggaccagcgcacctccccccactactgggaagggttaattactgccatcacctctctgcctctgcccagtttagtaggtaggaggggataagaggggacaggtggttctggacccagggaatcattgttctgggattagctggtttctttgtccctataaatatctaatattccaggagcccttagctacctggttaaatcacctctactaacacagatatttccttcctcctcagtgttctcgggaatttgtctttgaagaacagtttccctttcaatttcagtcactaactgctgcmacaaggctgatacggtttggctgtttccccacccaaatctcatcytgaattgtagctcccataattccacatgtcatgggagggacccctgtgggaggtaattgaatcatgggtacaggctttcccatgctgttctcatggtagtgaataagtctcatgagatccaatggctttataaaggggagttccctacacaagctctctttttccctggcaccatgtaagatgtgactttgctcctctttaacattctaccattattgtgtggcctccccagccatgtagaacagtgagtcaattaaatctctttcatttgtaaattacccagtctcagtaatgtctttattagcagaataagaatggactaatacagtaagttggtaccagtagagtgggatgttacagtaaagatacctgaaaatgtggaagcaactttggaactgggtaacaggcagatgttggaacagtttgaagggctcagaagaagacagaaaaatgtggaaaagtttggagcttcctagagacttgttgaatggttttgaccaaaatgctggtagtgatatggacaatgaagtcctggttgtgatggtctcagatggagatgaggaacttgttgggaactggaataaaggtgactcttgctatgttttagcaaagagactggtgacattttgcccctgccttagagatctgtggaactttgaacttgagagagatgttttagggtatctggtggaagaaattactaagcagcaaagcattcaagatgtgattttggtgctgctaaaagcattcagttttatgtattcacaaagatatggtttggaattggaacttatgtttaaaagcgaagcagatcataaaagcttggaaaatttgcagcctaacaatgcaatagaaaataaaaacccattatctggggagaaattcaagcctgctgcagaaatttgcataagtaacaaggagataaatgtttatcaccaagacagtggggtaaatatctgcagggcatgtcagagaccttggtgacagcccctcccatcacagacycagaggcctaggaggaaaaaatggtttcctgggctgggcccagggacctctgctctgtgcagcctagggacttggtgctctgtgtcctagccacttcagccatggctgaaaggggccaaggtacagcttgggctgtggcttcagagggtgcaagccccaagccttggcagcttasacatggtgttgagcctgtgggtggatagaagtcaagaattgagctttgggaactgccatctagatttcagaggatgtatgaaaatgcctggatgtccaggcagaagtttgctgcagttggctgcaggggtggggccctcatggagaacctctgctagggcagtgtggatgggaaatgtagggtgggagtcccacacagagtccccactggggcaatgcctagtagagctgtgagaagagagccaccatcctccagaccacagaatggtagatccacttacagcttgcaccatgcacctggaaaagccacagacactcattgccagcctyatgggyattataattttttataaaattattttttaaaaaagaaaccccatttcctttctccctcagtttcttcccygatggtgacctctcagagcactttcctttgcagtggggcatgcagatgagctatgttgatagcatttgctaactcctgggagacactcatgccagcagctgggaggaaggctgtactctgcaaaatcacaggatggagctgcccaagaccatgagaacccacctcttgcattagtgtgacctggatatgaaacatggaacaaaggagatcatttcagagctttaagatttggttgccccactggatttcagacttgcatggagcctgtagcccctttgttttggccaatttttcccttttggaacaggtgtatttacccaatgctcgtacccccattgtttctaggaagtaactaacttgcttttgattttacaggcttataagtggaagggacttgccttgtctcagatgagactttggactgtggacttttgagttaatgctgaaatgagttaagactttggggcgccgttgggaaggcatgatttgttttgaaatgtgaggacatgagatttgggaggggccaggagtggaatgatatagtttggctgtgtcctcacccaaatctcgtcttgaattatagctcccataatatgtcatgggagagacccatgtgtcatgggaaagacccagtgggaggtaattgaatcatgggggcgagttttcctgtgctgttcttgtggtagtgaatgagtcttatgagacttgatggctttataaaatggtgttccccaagctctctttttgccttctgccatgtaagacatgacttgctccttcttcaccttccaccatgattgtgtggcctccccagctatgtggractgtaagttgattaaacttctttcctttataaattacccaggcttgggcatgtctttgatagcagcatgagaacaaactaatacaaagggcttcttaatctaagtggccttagggcagccttggttctcttcaaattgtacaggtcttttgagtgtgtgtgtgtaggtatttttttctgtgaaaaggtacagtgtattcatcacttttccaaagaggtcttcttttaaaaaaattctatggtgacatcactcacatttgagcatcctataggtgtcaggctctctgctaggtattttatatgcattactggatttcattcttaccatggaagcaggaggtaggtgctgttattattcccactctatgcatgctaaaagtgagacatagagaagttaagtaacctgcaggtaactgaaaagttttcaggttttttctttacacataccctaccccgctttttgagctgaaattaatataatagaaaaccatttgaaagtgtataattcagtggcatgtattacattcacaacactgtgcaaccatcacttctatctagttccaaaacatttttctcatgaccaaagaagatgctgtacgcttcaagagtcactcccatttccacctcttcccagtcctggcaaccactaacttagtttctgtctttatggatttgcctattctgggtaattcatataggtagagtcacacaataccttgccttttgtgtctggcctttttaatttagcataatgttttggaggtgcatctatgctgtagcatgcatcaatagttcatttatttttattgccaaacagtattcctctgtataaatatcccacattttgtttattcatacaccagttgatgggcattcatacaccagttgatgggcatttttggctattgtgaacaatgttgccgtgatgtgtggtacttgtacttgttttagtatctgttttctgttattgggtatatatgtaggaattgaattgttgggttaggttgtaactctatgtttagcttttttgaggaattgccaaactgtttccaccatggctgtatgattttacatttctaccagcaatgtacaagagttccaatttctctacatccttgccaacagttcttttccactttttttcaattgtagctatcctagtgcgtgtgaagacgtawctcattgtggtttcaatttgcatttcccaaatgactacagatgttgagcatctattcatgtgtctgttggtcatctgtatatcatctttggagaaacgtgtgtgcaagtcctttgcccattaaaattattttagtcagttgtaagagttcttcctatatatgaatactaaatccttatcaaatacgtgatttccacacattttcttccattctgtaggatgtcttcacttttgtgtgcaaaagttttcaatttttatgaatgttattatttcttgtgttgtgtaggggagttagagataaactccraccccctgtttagctcctactgggctcttcagctgaatataaaaaccaaattgacaccagactgattaacaagagaaaaataatacagattttattagtttttcatgacatagggatcttcayaagagagtgaagttgggagaagtggccaaagcaagatcttttcatactttttagacaaagagtgatcaatttgagaagaaatgacaggacaaagaaaatctggctagggtggtggaattttgctagaggagtcactaggagatgtgtgggkggggggtataaaacaggtggaagataaggattacttcattaagtatgaattcagggccactgcagcctycagttctgaatcccagctaataagggctattttcttaccctggtatggagagggtaaccctcccagaggaatctttattgcttgctgcatgcaggaagaggcaggtcagttcagcctttcagaagttatgatttctcaatcttttcaacttgaaataatcaatgcacccatctgctatattttggtatggcatgtccttcactccttcggttggttgtacacttggtatcatatctgagagtccattgcaaatcacaggtcaagatttttttctatgttttagtttaagaatcttatagttttgctctcccatttaggtctttgatctattttgatttaattttgtatatggtatgaggtagggggtctatctccactctttcacccttttgcctgtgaatatccacttgtcccagtccctttgccttccttttatggagtgattgcttgttttactctattttctctgccttccttggtgcatgggccagtgcctagcacattggagcccacccactccccctaccccagcaattgaccgttgactaaacaagtgcctgttttgtcccaagagctggctggtgtaagccaggagtccaagggctgagttacyaggcattcttttttgatccacaggtgcagccagtgtcatcgtyggccaccctctggacacrgtcaaggtacagtagccatgtttcccattacctcttaaaaagaggcatggagctgacctgcctctgggactattcctgctgtttctaayctctcagagagtcttctgcccagggcagactctctgttgccagtccagggggtgttgggtgccaggaggtctggtttaggttcagaaccctcagaggtccaggtagaactttagaagtagattggagatgggaacctatcattacctgatgatgcacatgggtgtgaggactctggsgctgttgggaccttcctggcattgggattatccaagccccttgttctgggatgttccctagaaaggggaaggggctcatctcagatcatacaacaagttaaaaactgaggtgcgagatgctgcaaaggagcagtctttcaccccatccccacccctgcacccgtccccagtggtgagcagaatttagagctatgctctgggaacggagccataaattgtgcctcctcactgctgactgccttccagatccatttctaaagctctgcctggattgtgcacagagaggagcctcacagaccgttttcaaatggctgctgcaatgtcctttctccccatcttgctccctgtatgaaaatggaccctctcctaggtcagggcccatgctcaccctcttgatgggaagatcagcctacctgttttaaatatttgaagaaacactttaagtagtaaaggggggcgtttaggctccccaggggacatcccaatgcagggggatggcaggcaggacccagtgctgggagatgggcacacaaagtggtgagtgaagcaggcttagtctaccctcctgaaatggtataatcttcccattttatatagsaggggggtaaggtgcagagtttaggaacctgccccagacctcagagccgggcattgtagtgctggattcaaagctccaaagtaaattttacttctgggctgacctaggctttgaggactcaggagtgagggaggcaggcaaggagacagatatttttaggacactgatggacaataattagggaacacaacagatgcacaaatcagttatggacagtggtaggtgctgggggacaataacacaaggtgatggcaaasacagtgatgagagccttctgtattttgaagagtcagggatggcctctctgccagggaggcagctaagttgagactcagatgacacaaagagccagatacgcagaactgaggtcagagtgctattcacagagggacaagctagtgcaaagccccaagggtgggaacaggctgcgatgtacattctccaggaaaacaaagaaggccagtgtgtgtgtggtgcacacagtgagctgagcaagtggtgtggtgcaggtgcttggagaggccaagggagaatgggattgcagagtgtgctaggggccttgctgcgtgcctcctgccagccctgcacacccaggccctgggtcccagagcccaccaaggagggctgtgcagcaagttcatgtctgaagtggacttactagcatatcacggctgagccattgcwgcccagagttagggcccatgtctggcactccccagggctgtccagagctaagccaggtccttagaaaccttttccacctctgtggtagctgcccactgagccctctccaccctccatgagagctggctagttaccgtgcccaggcctggcttccctagcctgtggcctctgactctctcctgttcagagtgcacctcagcacggggctgggcacagcctccctgggtgagtacctgctgaatgagtggccatctgggacctcagccaagttcaaggtgcctgctgcatacctctccagggctgggccttggggagacttggaagactcasatgcactccctaatgtctccatgagagtgctggttgttcctggcaattctcaccctcccaaactcacctaagtcattcccagtctgtcttctccagggttcattcaacaaaccagttcacaagaatggatcagtggggaggcagcatggccaagccagaaagcatgggctttggaaccacgcaggctctaggtgtgaatcctgtttttgccatttcctgattgcatagccttctgttaaacacgatacaaatccttggcttacagggtcagtgtaagattataagcattgtttctggtacctagcagggattcaaaatcggtagctgctatttttatcaacatcattcgatatatattaagttttgctcagttaccacatcatgtgacaatgtccagcaagattttaaccaaaattggagaatgtgtttcaattctctgatttaaatggtatttataaatttctctttgggggtcagtgggacacctcaaaagatgaacaagcattctccaagtggcatgctcagtccctgaccatggaactgcctaccagaggcctagcatctcggcaaggaaaagggctgttgtttctgtaaaacccaggctgacttaatataagtgagttggtaacaagtcactgttgggtgtgagggatttaatggtaaaaatttgagggtatgaattagtttccttgggctgctgtaacaaataaccacaaactgggtggcttaaaacagtagaaatttatttcctcgcaagtcaggaagcaggaagtccaaaaccaaggtgttgatgccttctggaggctccgagggagaayctgccacatggtcctctaccagcttccagtgcctgctgcagtgctcggcattccttgggcagtggctctgtaactccaggccctgcctgtcttcatatggcctcccctctgagtctctgtgtgtcagatctgcccatccttcctaaggacactagccattggatttagcacaatttacaggagtggagctccctggccacagttgcctgaaaaggctgggctttctcccttctctgcactctgccctgaagctctggagggaagccctcctgaaacatgacatccagtctttgttcagcctgagtgcccctgttgcactccagcacaccttctttccttccttctggctgatgttttctcaacagaccctgtccaccaagaaagggccaggcaagtctgaataactggaaatccagtcctggccttatcacctactctccagtgacctgggcacagcacttaaccttcctgagccttgaattccttgtctgtaaagtgggcaagtagcacctccctggtggggctgtcatgaagcttgttcatggaggtactgaggatacagcaatgagcgagatgatgctactatcaagaatagacaggctggrgtgcagggaggcagacagtcacttgtctagggtccggggactcacctgtggaagaacccggctacaagggcctgtgctgctgacccaggtgaaaggcttattcctgtgcccttggctgcgtggtcttaggttgaggaggcctggctggtgcctatgtctgatgcagcgtggctaggttttctagtcagggcttggctgcctctagaccaggggtccccaactcctataccgtaccagtaccagcctgtggcctgttaggaacggggctgcacagcaggaggtgagcagtgggtaagtgagcattactgcctgagctctgcttcctctcagatcagtggcagcattagattctcgtaagagcacaaaccctattatgaactgcgcatgcgagggatctaggttgcccgctctttatgagaatctgatgcctgattatctgatggtttcacctcaaaaccatcaccccaccctggtctttggaaaaattgtcttccacaaaactggttcctggcgccaaaaatgttggggatyactcttgtagaccactgggactggactgcaatggacaggctttgggaggggstgtctrcctccttctcatgaacatcccagtgggggttcttgttttgcttcaacatgctccccacaattctaggctgccccctcactacccagtccartctggggcatgcatcttggcccaggacagccagggcatggcttgctctgccaggtcaggggcaggccaggcagtggctcagctctgagctctgaggcttcagccacctcacctctgacactgagcactcatcctcttctccttgggttttcagctctgggatgctgagaggttccaatgggagagaaaccatgaactggagtagcatgagattcacagcacccctgacatgaagctcatagttttgggctaaatattgcatgaagggccatgatcttcaagatgtatccactgcattcacacaatccagggctcccattctctataaggaccaaagaaagtgtcagagacctgagaaaatagtatagtatataagaagaaaagtacagaatcaaaattaatgctgcactaaatatttacaaaatataacctcatgttaaatagtcaaatgcaactcagctttcatggaggtctatgtggatgatattaatatgggatgtacattaaatatatacaattatrcttaattttatcttacttgatacaatatgagcaggtttgcaaaagcgaaagagtccaaaatctaagcaagtyttaaaatggccttgattctacataaccaggagagacgagaaagataatggcaagaccatcaattctgtaggcccaaaatgagtgctctggacacctcagatttggagatattttccataataactaaaagcactgaagctgggctagggaaccaagctctcttctctcttgcctttcataggtgttcactgagtatctattatatacctaacactatgtataggtcagaacccaacactgagggcagccacacctggtcaagagcttggactagacttgttttggtctcagtaggctagagattggtgggagtagcagcctctggggtcctgtggagtgaaaggccttggggatgaacaaaacgagggggccaggttcctggggaaaccatgtgaggcagtgtggttgactgaataatggtccccagatgtgcctgtgtcctcatctgtggaacctgtgaatgtcatcttatatggcaaaagaaaactttgcaggtatgattatgttaaggatcttgagatgggaggatgatcctggattatcagggaggttcttaaatgtaattacaagtgtccttataagagggaggtggagagagatttagatttcttcccacagaagaggaagaaaacaatgtgacaacagaagcagggagagaagaggagccatgatgctggggctccgggaaagagggtgaaccccaaaagctgggggagacaagaaaacacattctcctcaagagcctcccgagggagtgctgccttgccagcattctgatcttaccccactgagactcatttcagatttctggtcttagaactgtgagataatgcattcatgctgttttaagccatgaagtttggggtaatttgttacagcagcaataggaaactaatataagtagtcagttgtgttcatctgtaagatgggaccagtatccgtgccttagagcatctgtgggatttagtgaggtcaattttatatgatggtcagtatgcagttrgtgcataataaatgccttctcctgctatcactgggggccctagagacttgggctttgctgctggcctcagtgccagcctacccgagtgctcagcatgcctgacagacctttgctccatggctttgaaattattctgtgatccaggtttggctctcaggttgagtcacttcatgtattattggcttgagtgactcaaccactcaattttcttagcaggaattgattacttgttgcagggggtgggtggcagtcagccatttgtggattcactttccagggacagccctgggagagtgttggacctcatgacagccttacatggggcacagagagagacctgcacccctccaccacctggcccaagtcattgtcctggttgtggacatcccactccgaggtaggcctctgtggttctgcttaacaagaagaccttgaaggcccagttctcatcttgctgcattttccagggagtctcccccactgaatttaaaattaccttttccttcttatcacccagctcttcttatccttggtttattttcctctgtagtacttgtcttcatctaaaatatatatttacttgggaattattttttattgaccatctttcctgactccactaggttgtaagttccatgaaggcagactctggtttctttactgctgaattccctgagactggaatagtgcctccaataaaataggccccgaacaaatattggttgagtgagtcaataaacacacttctctgattatgaaagtaataattatgaacagggtgatactatttcctatatttttcctatggctacatatgtttataaaactattcaaatggatgcttctcaaactcttggccacgttattagccatggtcataaactcaggagaggagtagggtgagagcgaaggtgggtccaatgaagctttagccttacatgtgacattaatttgttgttgttgtttttgagagaatttatttccatacgagttgtgtacttaacattagttttaaactacataaaytaaaaataatgaaagtaacatctgcttatcrtaggaaagttggaaaatacagaaaagtcycatgcaggaaaacatcgcctgtgatcttcacctctgagatcaccattttaactatatgtactcttccagggcctcctccacttgtctacagagctgatctcaggcagttcatgtgaagagctagcctgcttttctgggtctcagcccctcactgcacactgggttccatggggatgggccagtatctcctctttggtggtctcatggctccttcatgcccaggcatgacatgctgtgtgtgctgacaaagtgttttgatggagaattataggctgcacgtcttaaaagaagtggaaccctctaagactagggcaggggtactcttcggtgggcttactcagaccctctatgcctgtcagctcctgcccctggtcaccaaagccagcttccatcagaggccaccacacattagccatacagtccttgttcagtcagtgcaaaggggccactatgccagggttgtgcccagctctggggatggaaggaaagtaacacaggtggtcctaccctagttgggtggtcctacataaactctatataatcaaatacatagggccactgcgacatttcgactcagacctaaaagatgagcaggagctggaggaagagccttccagaagtggggaacagcaggggcagctggctggaggcaggaaagaattgctgctctagggtctgggaacatgcaactcatgcagggctcagggagaggagatggcatgtggggtgagagacaggtgcctcccaggctcagggagartgcrgaatttatcctacatttgatgggaggccactggaggcttcattgacctttgaaaatgatcagtctgcctgttgtgtaaagagaaatggaggaagtgagggagaagcaggagaccagggagggcttcaggccatgtttctggtgaggatgaggggtgaggcctagggtggtggttctaggracaagaagagcaggtgtcccccaaakatattttggagggtggagcgacagacagcagatagggtagagtcccagtttaggtttttgtactcaagaggtggggatcrtacaatcattcrgcacaactarctggcctttgccattctctcagcaaagcaggcttctctgcattgagtgagtctgaatgggacattagagggaggcagtgcaagctggagacagggcaccagcctggccaggactgaaacccagaccctttgctggcgggggtcactatgagcagggcctttccctctgggcatctccggagcagtggggctatgaatracctctgcgctgacccatgtccttgcctctctccatagactcgcctgcaggctggcgttggctacrgaaacaccctcagctgcatccgcgtggtgtacaggagggagagtgtaagtgccccttgggcgggtggagtgatgcctgcctgggcccccacaggctggggaccagggccacagccccacaccagcatgcaggtgggggcctctcatcctgctcttcacactcagcttgattttccctacttcatctcacaccacacctcaaatattatgtgttacctaaactcacccctgccactaccayagcataactgaggaaaaactccagttktgtgtaacctctgtggagaaatcctgaagaatctggagctgcagtgtggaaaattcctgcaaaaacaaggtgatggctcagtttttcacaaaggaatgagtgactggcaaaccgtgtgctgatagacctccctttatctggcccggccggagccagatgtgtctgagcctagacaccagagtttacctgcgcccaggtcactttagaccatgcgacctgaggtattccttttccgaagggaaaactgaatgatgctttgtagaagatgcatcaggctcccttcttgagaatcagcatgtgcttcaggaaaactttctgaggcccctctttgtggaatttagaataaattttaaaattttgaatgaaatgacctgatttaaagaaaccatcaggtggaaccctgtcgcagccctctgacttttccctgagtcactggaaatgtggtcccactgwagccattgtctccaccggactccatcctaacaagtgtcctggggctcggaagcctcctgcaggcacctagagttttcccacggatgaagtgtgtcttgcgtcagggtggtggtgtaactcccttgatcggctgctttaaaattggggcgagcgctgcaagcccagcacttggtgttcccgggtgatgctgtgggagtccacagtcccctgaaagcggctgttgattctccttttggcacatgttcccgacagtgtctgccagtctgtgtccaagctctggggttttggtggggactgcgggcggtttctctgagacatagcagcccatggctaagccacatcccaagttatctgaaggatcttgtgatggaagaagagcatgaagcagggtgtgttcacgtgtgtgtgtgtgcatacgtgtgtatatatgcgtgtgtgtgcgtgtgcaggtgtgtgtgaggcatcctgcctctggcagccagggtacagtgtgcgcagtgaggactagtgggtttgtgcacagcctggagtctgcacaatagcttcccagtactttctcacatttgatttggcacgcgtgtgctgccctgactcctccaagggcctgtggaattttccggttttcctcagcacatctgtggtgttcatcaagaatgccstgtggaagggaccgaacccggcctgcagcaccccctcctcagcctcctgcagcctgtgtgtgcgcatcctgtgtccttatgtggccccttcagccacttctgtcagaagacacccatgctcatgggcactcatctagaggctggcccaggcacccctcgggggtctagggaacccctgtcttacaccacaggcttagtagactgcctttgttgtaactgcctgtcaatttgtctgttccacacctcactttccccagattatgagctcagtgagggcggaggctgtttcttccttatggttgctccccagggcctggcccctggccagtgcctggagaatgtttctgttgtggtatatgaggtgggggcgtgtggtgcttggccagcccactgctcctaaggtctcctcaggatcccccttggccacagcctgacttctttccagcccaagatcactgcccctcccggcgcatgcatggcatgtgtgggttccaggccaggacacaacccacaggaaacaaagyggcctgcagaagccgggctgtcctcggagcaagaatgcctgcccctgagtggttccccaccccctacctcctgtcgcatcagcaccctcttcccctctcttcatggacacatgggcagatgtgtccggtggtgtaccccgtcagcctgcaggctctgcgacggcagcccsgggtcctcacgcctcttccttctggttttcactgcagatgttcggcttcttcaagggcatgtccttccccctcgccagcattgccgyctacaactccgtggtgtttggggtcttcagtaacacrcagcggttcctcagccagcaccgctgcggggagccagaggccagtcctccccgcacgctgtcagacctgctcctggccagcatggtggccggcgtggtctctgtcgggctgggagggcccgtggacctcatcaagatccggttgcagatgcagacacaaccgtttcgggacggtaagaggccaggggagcggaggctggtgtctgggacttgtggccctttcctggtttgtgggatctgggacatggttgttaaaatccttttattgagcaaggcatctaccttgtcacctagtagtccgtaattacaggcatacctcggagacatgggtttggttccagaccactgcaataatgcaaatatcacaataaaagtcacatgaactttttggtttcccagtgcatttaaagttatgtttagactatactgtagtctaagtgtgcaatggcattatgttttaaataagtatatataccttaattwaaaaatactttagtactaaaaattattgacaattatctgagtattcagcgagtcgtaatctttctgccagaggagggtcttgcctcgatgttgatggctgctgactgatcagggttgttgttgctgaaggttgggtgggctgtggcaatttcttaaaataagacaacaatgaagtttgccatatccattgacttcctttcaccaaagttttctctatagcatgagacgctgtttgatggcattttacccacagtagaacttctttcaaaattggagtcagtcctctcaaaccctgacgctgctttatcagctaagtttatggatattctaaatcctttgctgtcattttaacaacattcacagaatcttcaccactagtagatttcatctgaagaaaaactgtctttctyatccataagaagtaactcttcatcmgttaaatattatcatgagattgcaccattcagccccatcttcagcctctacttctcattctagttstcttgctttctccatcacatctacagttccttcctccatggaagccttgaagctcttgaaattatctgtgagggttggggttaactacttccaaactcttgttaacattgctattttgacctcctcccatgaaccccaaatgctcttaagagcatctagaatggtgaattttttccagaaggtttttcaatttgcttggttcaaatacatcagaaaaatgactatctatggcaactatagccttaagaaatatacttcttaagtaacaagacttggaagtcaaaatcactccttgattcacgggctgccgaatggatgctgtgttagcaggcctggaaacaacattcatctccttgtgtatctccaccagaactcttgggtgaccaggtgcattgtcaatgagcagtaatattttgaaaggaatattcttttctgagcagtaggtctcaacagyggacctaaaatactcaggaaaccatgctgtaaacagatgtgctgtcatccaggccttgttgttccttttctagaacacacagagcagattgattgtcattcttaaaggccctaggattttcagaatggtaagtgagcactgggttcaacttaaagtcaccagctgcattagtccctaacaagagagtcagcctgtcttttgaaacttcaaagccaggcattgacgtctcctctctagctatgaagtcctgaagtcatctttttccaatagaaggctgttttgtctacattgaaaacctgttgttgagtatagtcatgttcatcaattctcttagctagatcttctggataacttgctgcaggctctacatcagcacttgctgcttcaccttgcacttttatgttgkggagatggcttctctccttaaacctcatgaaccaaccmctgccagcttcaaamttttcttctgcagcttcctcacctctytccaccttcagagaattgaggagagttatgtccttkctctgagttaggctttggcttaagggaaagttgtggctcatttgatgttctatccagactactcaaactttcttcataccagcaataaggatatttcactatcttattatttgtgtgttcattggagtagtgcttttaattttcttcaagcatttttcctttgcattcacaacctggctaactcttgggcaaaagaggcttagcttttgacctgtctccgctttcaacatgacttcctcactaagtttaatcatctctagcttttgatttaaagtgagacatctatgagtcttcctttgacttgaacacttagaggtcattgtagaattacaaactggcctaatttcaagttgttgtgtctcaggaaacagggcagcctgaggagagggagagagatagggaatggctggcttgtcagtggagcagtcagagcaaccatgattaagctgactstcttatatggacacagcttgttgtacccccaaacaatgacattagtagcatcaaagatcacagatcatcataacagatataatgattatgacaaggttgaaaatattgtgagaattatgaaaatgtgacatagagataggaagtgagcacatactgttagacaaatggtgccgatagccttgctggactcaagctgaccacaaaccttcaatttgtaaaaaatgaaatatctgggaagtgaaatgaagtgaagtacaatcaaacaaggtgtggttttattactatttaacctgatgcagtaactgtcattgattaagtatttggtatgtggcaggtactctctaggacctttgcatatgttctcataattcatcttgtaacaattctgtgaggcagatgctgctatctccattttacagatgagaaaacaggctcccagaggttaaggtagttactcaagaacacacgattagccactggtgagtgagagccaccagtgagagtgaggcatgggaggtttctgcaggcaaatattgcagtacccagtgcaaaatgctaaggccccttgttcaaaaattatgccatattttacaatggcaacagcaaagcactaagccaagcatggtgcttgtgtgaacacactggtctcatctgcacgaagctagccccagctgagctgggactcatacgcatgtatgtctcatccaaaarcccagagtcccgatctcacctggcccacatgccaggaagtgcagcaggcgaggccttgctcctgaccacctgtctcctgcccttacccacccttgcctgtccttcagcccttgcctttcctgttagagcttcacttcttgttgtgcgatgtagcaatttctgcaccacaaaccctcatctctcgttcctccttgctgggaaagagttttttgcatctttcctggcagtggctttcccaaaggagggtagaaaaaacaggaaggcacttgctgtgcagagcagagagagtgccggctttggaggaaggataggcttgcagtggtaggagacgtatttcagtaccttgaggtactttgattctcagctctaccactcagttccctgtctcctcaggttagatactgcccttcctgaggctcatgctccttttctgtgtaatggaaaggctggacccatagtcctttcctgtgtaatggaagaaatggacccagagtcctttcctgtcacctcagacatctgatggggctgacagtctccagcttgatcttggcccttgtggagaagactcctctccctggcagccttctgagtagcccctgtgtgacccctctgcccagggaggctgggtttcagcatgtatcatggtcagagccccagcagctcactcaggagcatcccagcctagcatctcctgccccagccccggagctgcccaggacagggtctgcacatgctctaagcatggtgctgctgctccttgctggggtgcatggagggcctgaggcctggctgccccaaggctgtgtgtcacatgccccaaggctcatggccactgcagcacgtggggagacgcaggaaaacaaatggggccatcagggagacacagggccggcagttcttcaccttcatcttcagcatattgggtcatgtcttggcacaattcaatttgattcaagggtggcacctctgaggaatgtttgaactttgctgatctgtcccatcccagaggcataagcaaagatgtagaggaatgaaggctgtcatgagcaggctgagaacccaggcatccaggcccctgtgctggctctttgctctatcccgactgcttcagaaaagcttgccttaggggaaaggaaatctccatacgtcttaaaactgtttggggttcggttgttggaaaaggctcagcaatgaggctttttggctgctggaagcagccccgcctcctttaccacctggcaccttgtccctggaaggggaggaaatgggggtagctttgcgaatatctgtttgcaagtatctgttgggggccctcacccagctgggacgccaagggaggtgtttcccaataaatactttccttaagaaggtctgggacatttgaaggtttcttgacaactttttgttctatcctctgtcctgcccacctccactccagctttccctgtacagtatgctagaatggtgtcataccaggccctgagtgataggggattctgaagctaggctagaagcatttggagactagaggaagaatgggaggcagccaagggagtggctgaatccaagcatggcctccaagcagggtgcacagctcctggccagtgttagggagctgagcagccaccattagcagctgccaatgtgacatgctcactctataccagacaccacataaggtactgtccacccatcaccttctttaatatccaccattacagcatgaggcagatatgattgccatctctgttcacgtatctccaagatgatagttatgcacctactgggtgccaggcacagggctatgtgctgagaatgcagtggtgaacaaaagactgcatcctgtctctgttacagtgtggcatccagctgagagccagagaggaactgggtgcctacaaaccatggtggtagggaaatacaatgggctgtcaggctggagtcaaggagggtttgggagcagggtgggagaagggctgggaggaaagcctggaggtcagggctgtgcacctgcccaggtagtgctgarggccactcargtctgccttgcctaggtatgggagcctgagatatggcctacctggggaccttcagatctctcatcagggaagtccttaaagggatccttaaagggccttaaagggccctttaccacctggcacctgtccttaaagggccctgtcttttgggtaagcctctgagcagtgagaacacagggaccctgtccttccaccatggggaggtgctgacatgtctcaggataggtaagattccccgagcctcctgtatggcaatctgcccatggcctgtgccttcaggtkatttgtctgtggtgccagaaggaaaccagttctcttaaataaacccccgaggcagcaacagaaaatgaacatgtgtttgttctgttcttccctgtgtgccaggagaccagccttttgggagcttggagaaggctcttagtaagaggcatggaggtttctgcaggcaaatatttctcaaccctgcaaagctttgagccattagaacctgggctcatcggcttagcacaaagagcaaagccaaagccaaagatggttcaccaagtgcatrgagggagagtaaaagccaagattggaggacccacctctgccgtgcccccacaagtttctgtgatctggactgaataagaatggtcttggcagtagtggctgagtggccagtgtttactgaaccctaattgtgtgccaaacacaatgctaggagcttggcatatgtttartcttcacaacaacccaattcctggggatttactatggggagactgaggaacaragaggtttcatacccccaggtccctcccttagtgggaggtggaggaggtctgattcagaggcactgatgctttctctgcttttgccccaggatttgyagaagctgaggttatgacaacgttgataacattgggccacctgggcctttgcgcaaaattgtcatgcacacaaatagcttcaaactttagggagaagtgagctgggagcatgtccccaaaatgacgttgtccaagtaatgggcacagcttgtgggttccaagggttgggtgtgaattctgtgggatcgggctgccccctctgatctcccttgccctcagttgcttgggggaaggaatttggtggcagcaggtgctagacaggatcaactactggagaagggaggggaggctgacaaaaagtcaccaggcagtgttttctgccaggaatccctccagaaaatgagaaggaatgtggttttctttcaattgctcctcaggaaccctctaggctagagatagaaaactcagagactcatcacgacagggagctaacatacatgtaacctcctatattagtccaatctcttgccactaataaagacatgcctgagactgggtaattcataaagaaaagaggtttaattgactcacagttccacatggctggggaggcctcacaagcatggcagaaggtgaaggaggagcaaagtcacgtcttacatggcagcaggcaagagagtgtgtgccagagaactctcatttataaaaccatcagatctcatgagacttactcactatcatgagaacagcatgggaaagaccccacccccatgattcaattacctcctaccagatccctcccatgacacatggggattatgggagctacaattcaagatgagatttgggtagagacacagccaaatcatatcgcctcccctggcattgcagtaaatacagagtttatttgacacaaggccagccacaccacgtgggagacagagttattcctcaaatcaatctcataggaggcttataagttagggctttttcaaaggcagtttgtgggaagggatggagatggctaggcaatgggtgcttgctgctsattggttggcatgcaatcatagaggtgtggaaaattgtcctcctatgcacattgttgcttctgggtgaggccacaggagcagggtttgtgggtccaggagcagggctggtgagttggtgccactggtgtcagacatgcaaaaagcctgaaaagatacctcaaagggcaaatcttaggtttcacaatactgattactcctgcagtgatgttatcggcaggagtaattggggaagtttgcatatcttgtgacctcctaaataatggctggcaatcctttatgtctataccttagcagaattcaggctcctctcctccatacyttagcagaattcaggctcctctcctccctctagcctgttgacctctcattacttttagggaagggcgattatcatttaaagtrtaaactaaatgtctggcaaagttagctcagcctaagccaagaaataatcaaggcagcttgaaggataaagtcaaaagggggattggctagattaggttgcccccactgccataattttctcactgatctaatttttgcaaaggtagtttcataagtgagaagaggtgtctggggaagtgaatcctctcccatttttcttgagaccacagctctcctaatctatgtttcatttttcctctttcgattgaaacctggacacagaacatattttatcttctgcctcattctgctattagaaaagcagtagttcaagcctgatgtgtaagcttcagtgtctgagaggcagctgggagtggtggggactgtggcaagctgggcccacatcctgtccaagggagtggtcacaaccccactttatcggactgttgccctgtggcctgatgtgcttggatcctccgatttttaagagaaggcaaaaaggtagatttttttcatgagatattttggttggaatgatcatgtaattcagtgaaaaccaaacagaacaccatagagcccaaggctgtgtgaattgcatagaatggggctggggctggctgcagtcctgtggtctgcgccctgggtcagtcccaatccatgtgttgactgtgctcatgtgggcatttctaggcagccttgggcagggcttttgagactgattgggttttgtggttctgcctcaggattgccagtccacttccagggcgatcctatgtgatatgagagacagcactcacatacggaagccaggtgccaagaggcctctggcttcttcgctctggtacatatgacaggtggactgggggccacattgaggtgagagcccagctcaggtggttgggggactggcaaatatatagccagtgtatattcagccagcccctcctgattgtctcttagtggtgatccatggttaaaaatctacaagctacagaacattgaaagtagaggtagaaagtgcccattcatgcaattacaaccactggtaacacattaatgtgtttatttttccattctgtatacatagattaaagattttaagaagctgtgatcatgctatatggacaatttcatgtcctgtttttaactcagcattataatagaaacactaaccatgttattaaaatagcatataaaatttttttaagtagatgggcaatatttaaaatggatgtgcactagtccatcaaatacacacgcacacacacacacacacacacacacacactgaaagagtctatgtagtatggtaaaaattaagcttccagaattagactacctgcttataattctacttccactgaacccaaaaaaggttagacarctcacctaatgtcaccaagcctcagttaactcatctgcaaagcaggcataactatagtagctactttatagctgggatgcaatgaaawgtattatacatgaagacctcagcacaatgtctggcatatagaaaatgtgaaataaatgttaattatcagtaaatgtattatttaacaatcttcctaatggtgaatatttaggttgtttacagtttttcctcttttaaaaatagtggtatgatcagcgaatatattcataaagagttctctttatttagggttatttccctaaatgtgtgggctctttgattcatgagtgggataaggggtgtggccatttttaacattcttggtacatattgtgaaattgttatccagaagagttttaccaaatcatataagcagttgcttacatttaaagggaatttccatttgacactgactaccattgcacaataaccagtagttatgcccccatgtaaatgcttccaaattaacagaggtattctcctggggcctctgccacttggcaagcaaggagacattggcctgtgttcagttgtatgtgcctgtgacagtaaggcacctgtgaaaaaacccttccttttaaaatcactgccctttgcatgggcatgagcctaactaggtggcctgttgggcatgagcctaactaggtggcctgttgggcataagcctaactaggtggcctgttgagcctgagctagaagtcagggctgtgaccctgcagaccagtagtccctttgctgcctgagccatgtccttcctagaagttcatggctaatgacactcactcctcccccatctgggagtgtttagatctgtttttccattgaaagactaattaatgtgcakatcacaaagccctccacataacaggaggttggagttgggaggatcagggaaggactgaacattaactctgtgctgactatcctaatcattgcaccaggcccaactggaggcaaggagatgagtgtttacacctgtttgaattcactgtgaactgttcattcacaagcatttcctgagcccctgctttgaggcagacacagtgggtaaagaagcgctggaagccacagccttcagggtgtccacagtctagtggggagccagatgtgtgcttcaatgagaaaggcctcaggaaagtctttggaacccctgactctggcttggtggatcaggaagcctccagaaaggaagaggctgttgatcgggttttttagttctacgtagcatttagagatggggacatgggatggcgaagtgttttaatactgtgggaacaacataggggaagatttagtggcaggaaaatgtaggcacatggtgggacaagggagcctttggttagcacagacaagcaatgcagggatggtgggggttttggaagatgtggagtaagttgggaagcgcttggatttcttcgctgaggataggcttagattatattcagcaggcagtgaagcactttggacaccagaatgatgcaatcagagtggtgttggagaagagaaaactggcctctggaaggggcagaagagtggtgggaattgtagaagtgggtagattgatttgaaggctatagccacagacctggggccctgggcttgggaacagagacaggtggcagatgcagaggccctgatgatatagaagcagcaggccaagcattaggcataagcaggagagaggaaagtgtcaaaaatgaccaaagaccccaaagttggatgacaatgagacaagtggaaccccccacacagggaattaagtagcaaatgaaacatctaagacggttcttggcatggagcaggtaatcaatcaatgcttactgtggctgctgctggaggggcagacttgagtgagaagaggatgagttttgcctggtctatgtagtgtgaggtgcctgtgagattgcacctggaagcatcagggctgcaggtagaggcacaagtgcaataggcatagaagtgacagttgaggtcataacattagatgcaaacaccaagcgagctgcaaataaggcagaggatggcagcaaagagaagacttagtgaaggaatttgggaagaagcagagagttacagtaacactaataactgcagttaaaattatcgagctcataccatgtattgagctataccacgttaatgcccattccattatcatcacagcaaccctatgaaataggcccacttatcatctttattttacaggtgagaaaaccgaggctgaattacataatttgtccatgctcacataactatcccttggggaggtggggaattaccccaggctgtgcaactctatgacccctagaaactgagtcctgagaaactggtgttactgaagtaggaggaaggagcatgtggaggggaaaaatgctaaagttggggtgatgatggggacagagacagagggcaatggagaaggaaaaggcgttcatttccaagttgggagagaagaagaaagaaagtaaaaatgcagagagattcttgagggcaagtgggaggaagttgagggaattgatgtcagaagccctggctccatcatactgaagaccatmtggatagaaaggaatcagagtggggccaggatttgaggtgaagaaggttctaatttctggacatgacaagagcagacaagctgggctggatggtaacagcagagagggtcagccaagaggggtctcagccacaaagccatctgagcccaagaatctgcatggtgacaaaataaggcaaaaacatttctctagtttccctgaatcctcagagttgcctggctgggaggtcatcagctgtacctctgaggccctgagtgcatccatttgtctctttagcaatattttattgctactttgaagatgtgtggcaaccaaggaaaatattcttctccaggcaggttgaccttgggaaggaacagcagattttccaagactttcccagtacagggtaggggttattgatgttaagatccctgaagggacacacaacccttaaagatgaaaccttatgtagaaaggcaggaacccttggagcatgaaaaggracccaaaatcctgaagacaacccaggcctgtatagcctgggccttctcaagtaggctgtgggttgccaacagcaagtgagagctggagcaatggcagcccaggagtgaagggaggaggtttgtggagaggccaagcatatggccatgcagttccaaagaagtccttgttctgaacggtttgactagtttgaaccctttgaacagtttgtccttttcaaacagttgtcccacatagttaccagacattaatgatagtgcatattacaccattgtacaaattacgtacattggtgacacatggtttatttaaagcaattgacaacagcaagtattgtcctgatttctggacttaacaccagtattggtcattcttggccccatgtgggcaacagtgatctcccacagtagacttggctgcaggtcacagctgcctgcagttggcaggtctggcacttccagaatccagagtcatataaggacatggtgataaaaataggaataagaactatttgccttgagtaagggacatttgcatggcatgtatttcagtaaagcacatttgtcaatattcccttttcatgttcataaaagccaaatgaggtggacaggccacttattctctgcctttcacagatcatgaggaaactaagacccagtgagattgaatctcttgcatggggttgtacattaagtagcaactgaataggaatgcaaatccagggctctttctatgaaagcatctgcctatcttgggcctctcacgtcatgaggaaactgctggactcttagaaacaggaactaggtaggagcttcccagctggtaatatcctgggaagtgatctgaggggtccaccagcctgctcaagctcaaacccaaactgaggatgttacagccagcctgtctgctggaggatgtacagccatgttactgatgcttccatcaaatctaagcagtgctgtaggtgggacyctgattttggaatttcctttaatatctaaagcctctgacccaaggatcagtcagggccagacttttgatgaatgccaagggtgtgagtcttgggagtgctgagacctgcctaagtyaggcgctccattgtccatggagtagatgctgagatatatatgggactcrggccatagtgtatgattcctgtcatcaggaaactcaccgccacactaagggcaaaacaacacactcagaaaacagtagcaacagaggcaagccatactagggggcacagcctcaggcatgggctgtggggacctttttctaagagcgccttgttaatatggaaaatgtggtccaacccatcgaacagcagctgyacttttaagagttcgtggactaagaaaacaaatatgtaaggaagctactatggattactaatatgtttaagtaaaatcttattgtgttacctgtgatagtacccacacatatgagaaaaatgggcacatatgtatgtgtgagacattgtaggaattctgtcaatgcataatgctcatggattgtggggtgccttgaaatgactcccactggctgagccttactggaatagaaccctcgtgaaaacccrcacatccctgactagtgacccatagggcctcatttgtggatggctgatttgtgaaggattttctgtagaaagtggcctcttgagaaattatgctgtgttccctgtcccaccacccacataccgacatacccacacagcagaggaggctgggagcactttcccttccagagagtggccaggcctttgtgctcctgagggccagccctgctcccctcagtggccagccattgtgtttctgctggccttactgtttccaaggtcatggcccattgaagacattgaatagcattgactgagaaaggaaaataaatggaacatctttgtgtttgtgtctgaggaaggcacagtgactttctgtggctgggtccctgggttctggaaaaggggcaatagtggtagagctggtgtctcctgtctgtgtccagccsagctcagcccttctgaagttggatgtcccctaagagatggctgtattggtacctgttaggattggccaaacctggacctacaaccaccacaccccaaaataaaactccctgaagaggcatctacctctaagggacctcccaggccaaacaggaggccagcagtaaggcactggcacttcacagagagctgcagagccagatagccatggcctgtggctttaggtgtgctggccgggactgagctggacaaggcaggaggcctgggccctcctccacttcctacggcagtgggttgctattttcattgactttgaacatcttgctagtcttggttacataggtgcagggggcctgagatagccctaactgaagttggggaaatgaaggaaaccacatgcctcctgagtttttgaggtacataatctctatctatcctaataaaaggtagtatgcccttgatctagagaggcagcagtttttgaggtacgtaatccatatctatcctaataaaaggtagtatgcccttgatctagagaggcagcaaaagttggtctcaaatgcaaagcattcatgattttaaaaagatcaaaatttgattaatgttttaatcctcattacagaataaaaaattctaattagagaaattaggtacacttcgcttgagaaggatatatatctaatgccaatcctttcgcatatgcatgtacaccctgaaggttcagaaacaatgggctgggagttggcagtttcctgtgagctgtgtcctgatccggcacctcgtagtcttcctcaggttccttggacaaaggacttgcaagtccagagatctcagttgtgcatatttccaagactgacttaccagtaacttttcaaatcagcttttaagagtcatcaaaattgggttttcacaaactaaaattggtcccatggtatcagagtaccaagaactccgatccagtgttttcctgaggctatctgctgaggctcctggcaaccccccggctctgccacccccacaagccagagagcacttagcaccacatgggccactggcggagatttctgctgttttccagaagaaggctcttctgtttattcatcagcagggctatcttatactggtcatagttttctatggctcctactcttgctgttgaattgaaaatcagtattactataagtgcatcatcatgttaggtttgttggactttgggcctcaccaatggtggtggtgtggtgcatttttatctcaggtatatttatgcttggaattataataactacctttgatgacattctgctctgtggacccartatgaatcatccataccactattggtagtgctagtgctgatggacttgtaagttacaaccactgccccagagaaaggttgcttctcratgagtgacacctcatgatatcacagagttgttttaccttgaaaatcaggagaggatagttaggctgtggaatcactgctctccctaactgggctgtaaacaaaacagtttatttcaaatatgagaagtcacttccattgtagagtgtgatgacataggtgaatgcaattgtaaaaactcatcaatcgtgcacttgaaagctttaccttttattgaatacaaagtatagttcaattaaaagacaaactgacaaaaaacaaaaataagaggccagaggaggagaacaggggcttttgagaatgagacttaagaatggggaggaggtccagccaagaatgcatgaccacaatgtaataaggaaatgtcagacaaaccccgaatcaggaaagctctattaacaagcagaggggttgtgtactcttaaaaaatgtcagtgtcacaagaaacaaagaaaggctatggaaatgttccagattgaagcactggatcctgtcctggaggggaaaatgctataaagggcatgcatgaagatcaaatgacaatttgatcatagatggtagattaaagtattgtcaaagtagctatatgaaactggtaattgtgctatagttatataagacaatatctccattcttaggaaatatttttcaacatatttaggggtaaagactcttcaagtatgtaactcacccagaaatagtttagaaaatgaagttatgtatgaatgtgtaaaaatacatctatgtgtatacacacacacacacatacacacacacacacacacacacacacattccctattgcttaccttgggaagaaaagaagaaaaaggataagtttgggtcttgttgccaaagtcagttcaaggtttgacaggtgtttttgcaacatctgcacctccaagcagacacaatgttaccagaatcccctctttcaatcaataactcctgaaagccacatcatacccatagctgattcatgaaaaccttgactcctggtcaggtcactcttacctggaaatgaatggggcttaggcaaagtttagacactgggacaattatatcgattcagttgaattgaacacacaygagtgagaagggagggaagtgaagagagtgggagagagaacccacaaacaataagcaaatgagcttatttgcttattgttagcaatagataaatctgggtaaattgtatgtatgggcattctttatactattttgctttttatacttcttttgcaaatttagaattatttccaaataaaaagttttttcaaaaaaaaatattgtgaatgaaggagctagaaagaattccaagagcttcacagtataaacttgggtcagtttggagctgtgtcagtatcctggtgatgggagtcaccatgataattatactgcactaacagccataaatgggtaattccaaagcaataaaagctagattggttatgtggcaaacctgggagaatgagagagaatttccttattgcttactccgcagggaaaaggaaaacagtacaggatttttgttgacaaggccagttggaggtttggtgggtgttttcccatctgtactttcaaacaagcagaatgttatcaagatcctctccctcagtcagtaactcctgaaagccactatttacccatagttgcttcatgaaaaccttgactcctgggtcaagtcagttttgcctggagatgaaagcagttcaggcaaaatttatacattgggacaatgacatctattctgtctaacggcagaatttctccagatgaaccaggcagtagcaccatgggtctggaagaggaaggggtgcctagtgatctctcagtgggctttcaaaggccatcatgtctgatcttgctcagaggggtcttgtgcccccaaaggtggctactaccccggctcacctcctatgggatccactgtggaagaagttggctccatctcctgyccacactgaagttggcctaatggatatggcaggggtttactcccttccccackggaagatggaaaatacagcatgggtttgttcaagcatacttcccaggcaygcagaaaccaccccctcaacctcacctgcttctgggatgagttaaagtacagattacactttattctccaatctctagactgtggagtcatgaagccgaatgcttctaacctttcctctgataaagatggactgtttgggggacttggacattgacctatatgatgaaagctgtctgcctgtttaccagcatgtgtaaaatcagattggaacactgtacagagaattaaactcaggtggcaaaataggcttgtggtcgcagacacactttattctatttctttcctggtcatgtcacattatgttatttcctggagaagggaaagtcaagaacaagagcctactttatctgcactgggtctggaagktctgtctggtcatgagtcaaagcctcatagtagagaaggatccatagcagagaagggtccgtagcagagaagacaagcatcagagtgggagatgggtagcaaatgagagagaggcagagtctcagctggctatgtgcacccctagaagaagctggagacaaacaacccctgagctgccagcatagactactgaggttagacaagaagatagcagccctgggtcccaggactttgaggggccaagagccccagtgctgccctacaactgtttagggcacagcctggccagggctggagtgagtcactgagaatatacccagctctccaacctgtgggtcctgccaccaattcatgtcagcaaccttggtctcagttgataacgttttaagcccctacaatgttcaaatcaccatgctgaacactgtacatgtattaccttatttgcactcatgacaagctccccctcttttaacataaggaaatgggctgaaaatgctgccttgccaaggtaaatttcgaattatttccaaataattttaataaaattatttattttatttttataaaattataaatattaaattatagattttaaattttatgtataatttataaattattttcaataagcggtagagctaggatttgcagccaggacagtctggctccaaatctcatatacattttgctccgccacactgtgcataaataaatgtgtacacagacacacacacacacacacacacacacacacacacacacacacacacagcatgttggattttctagcttcaaagaagagcttagtgtggcttstcataattgattctagacattctgaagtcacatttgcttcgaaagaagtagtggtattgacctaaagtaactggtgttctatcacgtggctgagatcgtccccagtctggctgtgtatattggcaggggctcttgttgggacctcagtatcctggtttgagctgccaagaaggtcagatttggtaaaagctgatgggctacatgagagggaactgtcaaagggctgggctggctccagtgtcacggaatgtccagtctcttacaccctgggtcacttgccaccttctctcccctgtctttgcagccaacctcggtttgaagtccakggcagtggctcctgcrgagcagccagcataccaggggccagtgcactgcattacaaccattgtgaggaatgagggcctggcggggctataccggggggccagtgccatgctgctgagggatgtcccaggctattgcctctacttcatcccctacgtgttcctgagtgagtggatcacacctgaggcctgcacaggccccagcccctgtgcygtgtggctggcgggcggcatggcaggtaagggcagcagcagctggagccgcacccctgtgcaggccacagcagtgggacagctggggaactgccatgcccttctcagcccagggggagggcaggacacatttaggtactcacccaacaattctttgttaggtacctactctgtccccggccctctcccacctcagtctcatcccttccctatgcagctatgagaatggcagttcccatttgactttcaggcaacagatatattttgaacacatactctgtgtcaggcattactaagctttggaaaggaaatccattatcatggttcagtttattaaatgcaatctttgtaatgtaaggatgccattagttctacaaggtaggaatcggtttccccatttcacagatgagaaaactcaggtccagaaatgttaagtagccaatcccaggtcatacagctggagctgacagtatagcagggactctgcagycagaaagatttaagttcaaatccacacttcatcattttgtgaccatggacttgttgcttaacctccctgctcagaatcctgcaccacatccttctttcatttaaggtaaaagttgatatctttgcaatggttttccaggccctcagtgatctagctccctgttccccacccacctcacttctactcctctccccttcctcactttctccagtcacactggtctctgctgcaacttgaccatgcctggcccttccctgaccacagggcctttgtacctgctactcaccacctcctgaatttaacaacgtggagaccactggggattttggcaagggccatttgatggagagaagggtgtaaaaacctgatgaagtgggataaagaaagaatgggatgaaggatattggtgcacccaagtatacacaactcttctgagggttctgctatgctgtaatgaggaacagagaaacagagccatagccagaagggcctttggaagccaagagaggatactttttaagaaggctgacatcatgacatgtttgatgtgatgggaaagatctaacagaaagaagaaaatcatgaatcatcctcctcctcctgctcctcctccctctctttctcctcctcatcatcacagtttgccatgctgtcagctcatagcagacatataacgaagctcatgtcttagccacctaactacagtttcacgttctggcccccaggtgcctgtgctcatgcccagctcctagtaagagctcagtcagtaccgactggcagagaggacggcaaggccccatttgctctcacttttgcagagagcaggtgtgaatggcctggcaggcaaatcccgttttgtgatgccctcacccatgggctgaggggcaagggagtgcaccagggcagcacctggggaagtggccccattgtcctggcagaaggcacaggtttagagaggctcctggaggaccaagggcaggaggctgaggggaccagaggccaggataggctgagggccaagggcagtctaaggtctcytttgagagctactgcgcagcaattacaaaaccatgcaaaccagttgccctggactttaacatcaatttgtttttctctccccatctaggaatgtaccaatttctgtgtttctataataacctggcattgttttcctagagttccttacctgagcatatcccatgaggatgacctagtggcaygtgatcccaaggcttctattccacatacttgaaaaagaaaagagatttttcaaaaagctgtccctgctctctttttgcaacccccaggctggcccttcctttgtgagcagcctgtctgcctgtgtttgtttagcttctctgtgtttagagtaaatcctgccctcagtgagctgcaaaccttcagcctcatgcctcaccctgggctctcttctggtgccctgggaaggtgctsccaagtacctgtggagcctgttactctttctccaataaaaactgctaataaatactgccacgtctcgagcactggctgtggactggcacttgctcaatgcttcacgttcatcaattcatttggtcctcaaaacagccccataaagataggtactgccatcccattttacagatgagaagcccaaggcttagagaagggaggaaacttctgccaagtctcacagcaagtggcgagggagaatcagaaacaaactttgcaggttctaagcctgagctctgtcccttctcccagcttaatgaatctctaaatggtagaaatctgcaaggaaccaggcccctccagatcctaaggagctagcccctgacacctgtttctttctctttgcaggagcaatttcttgggggacagcgactcctatggatgtcgtgaaaagtcgactccaagctgatggggtttatttaaacaaatataaaggtgtcctggactgtatctcccagagttaccagaaggaaggtcttaaagtaagcccacagcaggcctgcggggtcagtgtcagtccctggaaggtggttcacacatttagggggatgtgggactatagagaagggaatcaggagaccaggrggctgctggtgattatgtatcwggtgccacaagtgggtgctttgtcaagcacttcacctgggtggtcttttcacatggccagtggaggagataggtatgtgacctgacagaggttcagagagggctggtaacctgccgcagccacacagctggtccatggtggcgcctgggcctggtccatttctgtctgtctccgcattttgccttctcatcaagataggttgggcagcccttcctcactcatggctcagtgccttccccactcctcctcccagtgggaagtgccagagctgccttgcctccttcctgtcctcagtcagctcatctcaccagctccaggccctgtgaactgccttctgctctcccacctgagccctgaccccagacctctggtcgtggctgaggaggcagcctccaacacgtttccctgggctgtgtctcctctgttcttcctacagctcaagagcttaacttaacacacaccccttcccaccacctgaaaaggtgctgccccaggatagaccagacttccatgtctggtgtccaaggtaatacacagattcatcaccctccgcaggaactatcctgctggctcttgcttgcacgggctycttgctttcttggtgtggctcttagagtcagcagacatgggttcaaagtcagatgtagctactgtgagctggcaggatccaagcaagcagcttcatgtctcagggcctcagtttctcccagaatgatcatcccttccatgaagggcggggcatttgtgggttaatacaaaaagcactccattcaatatgtaacccatagggaagagttaaccatttctcatttgcattagtattatcwgtgttgatttttttagcaccggtattaccctggagctctgagtcttttctcacatggctgccccaccccaggccctgccagatgaatctgccccatccttccaggcccagtgcagtccgctgccattcccaggatccatgtccttggcttgcttctcctgtacctctctcaaggggcttctcacacaccaccacgggcaacagctatttctatactgccccttctctgcctcttacagcaagttttctgacgtcctgttttactctctcccccaacttgggaaagatccagagttggatgacccagtgttgaggtaaataactaacatgccacatgagagggacaagatccaaaagctagatcaaagggccacactaaaagacagaactaccagaagtcactgtaaagtccagcccttagtattcaatcatggatcaatcatctctgtagaggatggggcaatccgatttgatgaaggcttctagggaaaaatgcctaagggctttagttttcaaatgcttatttttagagcacctagtatgtggtaggcacagttctaggagctggggacagagcagtaagcaaaagagaaaaagcccattctctgatcagctaatgttggcagtgagcgaacagtgagacctgtcctaaggttgcattaatagaagtayagtgggtagaataagggaggtggaggcctctgccctgaccagattgcagctggaatgttgcatccacctttggtcactacccattaagcaagaccctagtggtgccctgggaatgaagagcaggatatcatagcrtgtgaggagaagctggaccctggttagtataagaagatgtgatacggaggaaacttgagttctgtctttatgttttaaggatggakaaactcaaagctttcctattctcattattttaaattccttttttaaatttttaacaagagctgctctgacagaagggtgaagcccagccctggtgcggcctcaattgtcttttgkatcttttttttcttcttcttttttttttttttttttttttttttttttagcagaaatacagtttgtgattcagccaatgagtatagagggatataaaagtgtttcaagtggatgattcatttttatttgagatgtttttgtctacttccccaaatattaatgtgtcataattcgtaaaaagtctgtagaggcaaaatatattgctgatattatttcctctgaaaattactgkgctcttttaaaaaratgaagtcctggaagtcagctgaggtcagacgattggtttcttaatctcgatagcgtttggtcctcactgttggttcagagacaggttttaagtcaagataataatactcagcttgagtaaccactgcatgatcagacrgttcaaggttaattgtttaaaatttgtattaatcagtcaaaaattggtaatgtatgaacataggaagcttccaaaactacatgaggatatactrtctcgatgccctgcctgtggtccctgtcctcgctcaaaggcaattaccgtaaagtttcttgtgatacatttcaaaaacatttacagtgtataaaagaatatatgtgtatgtacatrtctatgtatgcttgtatatgtgactgtttacttatgaacataaatagtaacataaacaaaaataatcacaccatctaaaacaatcaggttgtctcaaaggcagttttctggcagccgcagcaggagaaggtagagaggattcctccagtgccccaggggtggctccagttcccagttggcttgggctctggctgaatggagcacccctccccaagcattcttgactgtggctcgcagagatagagtgcaaggcccaaagcccatcatcattccaatctgttctcaccttgctatggaggaagaagtttgtgacaggaaagagttagaaaggcattaataatgacgatggtgaycaatttgagtagctctttgtaaccaacttaggaatgatcagtggtgcagcctttgtggtggggaaaatcaaaagtccatggactygtcgaggcatccccaagtagaaacagaaggaaagtctggtagttttggagccattctctgcccactgttagggtcgtcttgggctacatggaccatagctctgacttggagagttgccatctgaaataaccaggctggtgagcaccttggtaatcttggctccaaggaagcagctgctgtggaggggctgtggcagtgagatgaggctgaatggcagacagakggggcatttgtaggtagacagcttctggaggcaccagggccagctgccctgggttgctgtccctggggaatctggagccttcctgtcactccwggaaacctgaactgcaggcaccaggactctttcagttcagacgctcttcctttktcacgtccaaaattcatttattcattcattcatttactcatccatccatccattcactgattcaattaatgtgtttatggaaggtctactctgggcgaagcgctcgcaggtgctggggtctcagaggcaaaccatccacacagccctgcattcactgccctgattgtgattgctaatcccacccccacctctgttatctgtccttcctgacagataagtcagtgacacttggagaacagtgtgaggagtgctgtgatggggagataccaagtgcacagaaggtgaggggccatcatccacctgggggtggccatggggacactgccaggctgcaagccaggcctgggaagcactccaggcagaggggaccagaagaggcccagtggaggaaaaaggctggccccttaagggaatgacaggctgttaaccttcccagagtgtcagctgtgagaggccgtccagagaaagtgcaagggagagcatgtgggtcgttgcaagccaggaaagagtgaccctaggccatagggagacattgaggctttgtagggtgggagtgaggggggactcggtctggaggtcatatgctctgaaagctctgggtaaaagctggcaggtctgcattttgtttgccttctgtgggctctgcagcagagcaggccacagctgctggagggtgagctgtctgctggtctgaagtggcccacagctcctgcagggcccggggctgtgggacagaaggctcacactccaagctgggccctggctgcctccgccttgcagagcagagccaagcccrgacccacaggggaacctctgtgggcaccggcatggaattttcctctcagagtttgacccagttcctggctgttattcagtcactctggatgagcctgtggaattccagaaaggttagacattagagaagagtgttaatattaccaggatctcacttacaccctgactgaacagctcgagggcttggctgagccacttgttcatctctagggatccttgtccatcagcccctttcccagggacatgttgcaycctggaggctgctgygaggtgctggcacctctcctgaaggaaggccacctgatatcctagccagtgacagaggcctgcaccaactctgataccacagtgcccagagactgaggaaactggggaaatgaaaagggttggtttctacctttacaaaatgaccacttctgtttcttwaacttagaaaattatacaggaatcagagtaggtttctatctgtgcctgacagttctcaagtcatttacgtttgtgtgggaacttgcttttaggtggtcgtttcttaccagaggatgcattaaaggccagctcctccccacaatccccctctccaaagcttttatctgctctcatcattttctgggtcatgttgtcattgttcctgaaggggccttgtctctgctaatgggttataactgcttgagagttgraatcccatcacatttatgagccgacacacaacaccaagcaagaagattgagggaggaaaggaagatcataggcagtgtttgggaagcatcacataatactccctagggatggaagacaaatacaggtgtcatggagtagcaaaggcggagttcatcagctcatcagcacaggccattcttcctgagcatgcatcctagtgatggaggttgagtcctactccctattaggtgatagactattgataagaacaaggagggtgatgatgataatcagcagttaatacatgcttgtactgtatgccaggcaccgtgcaagtgcctgaaaagcctcatctcatttagtccctccaacattcttatcaggtcaattctattattacccgccccttacagtcgggaaaattgagttctagagagtttgccattggcccaagtgactcaatggcaaagccgtgcctcaaccccatgtctgcagagtcttaagcacagctcgagttctgttctcygccacttttgggatgtcctgtgaagcccctgctacagggattgggcatggctgggtgctctgtctactcagggcttctagattcccgaggasagagagagagagagagagagagagwgwgtgtgtgtgtgtgtgtgtgtgtgtgtgtgtacatgtgagagaagaagaaagagagggagagagagggcaatttaaaaagcatatgtaggtgtttgcctggcccaacagcttacctatagtatttagtgcatgtgtatcarggtctgggargaaaagcaccaccaggcatgacgcgggtcagggcagggcatgactgggacttccctgtgtggtctctgcctgcacaggtcctttgggctctggtgggggacygggcctgggtaggcagcaccwctagctattctctgcccctccttggtggccctgcagagagtgtgggtcagtcccctgcaataacctggcccctgtgcaaaggtgtttttcagaggcatcactgtgaacgcggtgcggggcttccccatgagtgcggccatgttccttgggtacgagctgtcgctgcaggctatccgcggggaccacgcagtgacgagcccataagcgccaggtcagtgtgcttccatcctggccaattgtgcctcccaggaacttgaaacttttttttttttttatcatgagaatgttgtggccttctgaaatgtcctgttgtttgtcacatatctaatctgtggtaggctggggctgccacccttttygtcaccaaacagcagttcagaaatgcccaccagtgactggtggtgtgctgggtccccagggaccaagtctggcacagaatatacctgtttccagacagctcgcctctccgtttccccttccagcagcttcaacagccctttcagagaagtacttttaccttcactgtgcagatgcaartgacccaggctcacaagtgaggactgcaaccagggtacctgcagggggcaccgtctccccacctccctactgaactgcacagcctgactctgagagccacccacaggctgccagagccctagaggacaggtctctgccaccattctttgcctcccataccctctttttctttctcattgcagaaagatcactgtagcctgaggactcttctaaagacagcagtctgactcctgtgctcacatgccctccttggctccccattgccctctagataaagccttcaccctgcttccgccagcctcactcctcaccactgttctgaatgtcccgccgtctctctcacccctaggtctttgctcaggctgtcccctctgcctgacatcctcttctysctcctttcctacttgtccttggcttcaccagytctttgccatccaggctgtagaagtctcctcctccaggatgccggcttgctttctcagctagggtgagtcgcgccttctgcagaccatcccccacccccacccacactgcatcctaaatgccagaggacaccctcactccccaggtggggctgctgcgctgtccctacctttgcactaatggtgcctggcacagagcccagcacacaaagggccactcagcagtgtcatcggatgggtggatgaccaacccccatatsccctcaggcctcctcttcctccctgtgttttttcttcctcattgtctggccccataccggctaccyrcaaagctcagaagacaaagtaagtgtggactgaactttctagtcaaccaagaagccatttgacatcagtcttggttagcacaaattctcctgggaaggatgatctttgtctataaaacctcactgctgcctcccccgtgagctggcaggggcattctcgggacggcagagccctgccagggtgcacgggtggtgccagaacctggacaaagggagggggcctgaccaatcaggcagactgtagtcagcccaggacaagccccaraagckggcttcaaataaaatgctctccactttttgctaaagtggcaacattcacagcttctctggctatttgccctttcttataaaaggaaaagggtagcaacacagtttacataattaaacatcttgagtgaagaattactgcatttgggtggcatccaggatagggaaggaattcatcttattcttaaagctgtgctsagatattggccatttcccccttttaacagagaaaagtaatttcttaaaaatcctataayaaaagccaggcatttttattgtagacaaaaatagaaaatttaaataaacagaaagaacaaaataataagacctgtcatcacaagaccttgttgttattcttccaagtatgtcttatgtgtattttcaaattgggatcctattctacacagtgttttacagccctcttttcccatttagtagtttgggaccattttcccatgtcatgaaatcttcagctacaagatggttttaatgccaagacctcccagatcccagagtggctggatgcctgcccaacctgtcgtacctgccactgtgaccaccctggtgattaactgcttcaggacaaaggaggaaatttctagctacccaatcacgattgtcctgcatttagcctttcacaagcagtgaccaacccaattggaagcttttctttctggaagcgytctttcttgcaaggggcatagatgtctgtctcccttaggagggaggactgctaaggcagggaggaggctattgcctcctggtgggagagggaggttcccagccactggtctgcagattcatcttaaacaagtcttgcccatggcattcaacttcctgctctaacccccaaataccaaggccttttaacaagactggattttaatttaccaagtagctctgagatttggggaagcccatgctcaggcagcagtcacacctactctttgaatgcctccctcattgtctagacccaggacagagtgagatgatgtatattagagatctagggtgccaagctgtccctaagaagtggcgggatggggaccatctcgagagttcctgagtacagatgacagggatgacttgagaattgtttctaagagcctgcaggggatagatcacccagctcccagcagttgccaggtgccttccaacaaccaggcatggagatatcccccagcttttccaagttccatgcgggaagatcagtgacctttggtggtagaagtggcatcccgaccacttaccagtggctggctctcagacttgtctgtggctcatgaatccaactctgccatccctacctgtccaagaccagcccccagagctccctggaatagtgctggtctgccctcggtcctgacatgcatgctgcaggtctcactagcctactttcggtttcaggaaaactgattttcaaggaaagaagacatagtgctcttatgatacctttgytgaacattttcaaatagccccggcaaycctgagagcctctgccagtctgtactttgcctcttactgcttcacaaacccagtctccaaatgggttgtttgaccccaagatccaagatttcaagactcccgttagaagatgttcttgtctttcctcctttttcccagggtctcatcccattaacaggtcaatgctaaaagtgtctgcagaacccatgatgtgaatttactgaagagaaagactctccaccaggtgggctttcagccaggcaggctgtcctcagaacctcttccttccttcacaattacaagcattctcatccccaccccggctggggcagcggagcttctgccttggagggattcaactgaccattggtcaactgatcaccaactattccagctttggacctgcacctggtaacaaacaaacraacagaacaaaacaaaactggagtaaaatagaccctccccccatggccattgtaaactcactgtgaattcatggaagagctggagttggctctaagtttcaaaataaaagcattaaaaacctcttcacattgtttctctgtcagatgcctctgyctagcttccaagrggcacctggccactgtcattcctctctctctgttcaggcctctgtgggtgttgcaggcccagagggaaaacccctccacacaggtgaggagagaaactgagccggggcagcctggcttcttttttcccagatgcctaaggtcggcagcagagggcgtagtggttgaacagggtgatgagggacagaaaccttctaggggttctcccaccctgagcagtggcacacgttggtgacttgcttcagagagtttgrccctgggcttggttggggtgggcactctctgggccttatttttacatggagaacaaaacaaaacaaaacacttgatccacagtctggcttccagagtgacttcattgttctaaattttattccttactagagccgcgtggggaggccattgctattttgctgttatgtggcttgtgtccctgcagcctcttccaattctgtgcccacaacaagcattcctagtcaatcatagagccctttcttgatgagctgagtggcgcctcagagtctttctcagcacagtgccgtggcagccaccaccagccgtgcagaactgtcatacaaaatgaatctatttgccatccctggcttaaatcccagtgaaggaaatgtcctcaaatttgttcttttttctttctcttgaaaaggtcttccttggtttctccactacgctgttccccaaccaccccctgcctttgagtgatttgggccatgtctctgaaaaatctctgtcttaatagaccgaagaccaaagcaattctatggtgcaaaagagttgaaagtgttccgtctcttcggtgtgaaacctgttactggagcggagggttccatgcttgaaataaaaccctcagcatgccctcctcaatatttctccttcacagcccctgggactgcagggtcccctgggtatctctgcaagttactgttcaagctgcccaccctccagcagtgggacattcattcatttgttcagtcatcaaacatttgctgagcagatgctgacctaggtggtggggacagccatgagggactccagtggcatgtcattctggtgcattggagaggctctattgatgggagagaccagcctgcctgtctgccccagtatcactgggtctgggtgggcayggaggatgcgagtgaagagatgcttctggcacctggttcatccctgggtagacctgaagtctctgctctaacacatcctagaatgtgtttcttaagtctgcctcaactggaccatttcccggtgcraggcatgcttgcacagtttgtttagaagtggtgctgtgtccacaaggccaactggggtcttctactgggtgctcctgatgaggctgagatgcaacaaccaccttcttcaggtgtctgagcttttcctagtttctattaatcatcatggcmcctyttgatggtagaaggaggcatgcagagagaagcattgctgatccagttcacagatgaaggaactgaggctccaacatacctragccccagctcaggactttaccaccaatcccatttgataatcttcctgaggctacacttccctgctgtccagcccagggtacatcgccagcagccatgatgatggctattttacggtgtaaaaaagacaaagttgttgggacacrtaagtatggcgtctgaaactgctattgaaggcctcccatcaaccacatcagaactgcccttctggacccacctcccattgctctggtccaggttccctgtgctctcatcatttcccccatcccatccagtgccaggcatacaatgggcatttaaatgttgctgaaagggttcccaagtgatcccacaagcctgctgggccagctgctgtgtgcccaacaccctccaggcttccctgcctctatgcttttctttaacctacaggacactcttacccccagcatcaccaggaacaggaatgctccctgttttcgacccagctcagatgctttaagcccttagatgttagggcttccttgcttctctctctctctcccctccagcagcatccatggtccttccaccaacgtgacccctctggcactgtgtccctccctgtgctacagtcatgtctgtgcaccctctctttctcactggcctgtgccccccttcagagccagggctgagtcttcccaatccttagattcagcatagcagcaagaatgaacagggtttagaataaaggaagcataaattaatgggcaaaaatgcaagcatgaccatgttaattgagaattgtttgtaataatgaaaattcagaaagtttctaaatgcctatcaatagaagagggggttgaacaaacagccactaaaaagaatgagatagatctcacatatattgtcatggaaatatgtcagcaacattgtaagtgcagaaatggaggggcagaataacatatatgatgttattcattttcattttaaaatatatatcgtatatgggtaattatatgggcattgaaaaacccttgaaggatacacaccaaatttaatagtggctatttctgggatgtgggattgggagaaggctttcagttccgamtttgatgttggtgatttctttgtacatcactataatgatggtgatttgatgatggtgattattgtaatgttttaatttttttacagcacacatatattgtttttataatttcttaaaataaaagcacaccttattgcagagctagggctccctgctggatacttgttttccaggctgcgggctggctcttcctcgctgcccagcctcagcccagctctgagtaacagcccctgccacaccccctccccccgccctcctccatgctgggcagacaatgcctcagcacatcttctgcaccttcactcccacycaggagcacctgggctgcaatgaatgaaactcggctttattgaagaaactcagctccagcccaaacaaatctcatgaggtagccagatctgggaggggtcagccagcaatggatctgcttcctcttagatttttctggagagggcaatcttgtggaatagttgggccaacagcttgtgagtcttcctccatcaacacattatggttctatttaaccaaatatatatatatatatatatatatatatatatatatatatatatawataaaatatatatatgtgtgtgtgtgtgtgtgtgtgtgwgagagagagagagagagagagagagagtgtgtgtgtgtgtgtgtagtctgactgtggccagtgctgttacaggcattgggtgacaatggcagggaccctgccctcagggagcttagtatcaggcattaatttctgttgtcatggtcaggaaagtctttaaacaaatggaatcctatttttaagaaggatgaaaacaaaacagaattccaagccaagcaccagttttggtgtctgtgccttggagttggggggcttcagggttggccaatttgccttaccaggaaagatgaaaagaagaacaaaaatcattaccatacagcagcagtcctcaacagcagcccctttcactcctgaaaattattaaggacctcgaagaacaactgcttatatatttaccaacaattactggaaattcaaacagaatttcaaaaatatttatccatttaggtataataataaacccatgacattttaamataaataacattctatgaaaataacgattctttctaaaccaatataattaacgagaagacttgcgttttccgtttttgcggcgaagtctggcttaaacagagggcaattgtgttcctctgtctgcttttgcttttagtctatgggttatcacttgcattatagcctttgggaaactccaccgtatgcttgtgagaacataagattgaaaagagcagataacatcttagtgttctatgaaagtggttttgacctcgtgggtcctctttgagaactgctgccctacaggggaaaaaatacatatgtgtgtgtgtgtgtgtgtacatatacacacacacacatatatatgtgtgtatatacatatccctcgcccaaaggctgataccctgcagaaccaccacttggtggcagtagaggtcaactaaaccctccgcaggaatccgcgtctgggagtgcacgatcttggccctgtggtgagaacacctgggccccgtgacacttcttttcctgtttcctgggtctcaccatctcccttggcgttgcccttttccttctctgtggtggcaagaacttcacattagggaggccttccccttgggttccagtttcacgcaggccatcagccacctgtgctcttgcaggcagcagtgccccctgtgctcttgcaggcagcagtgccccctgagccatctgtaaaatggccacactggtctcccttacctactttgcacagcttccacaagaatcaagtgcaaaagtgtttttgtaaactgtaaagtgcaaaacataggggttagaggaaggggtggcctggtgtgatttttctggtttctgttctttgcctgccttcttctctgagtctgggttgtttgctktttccaggaggtgaacacaggatgactacagtgttccctgggcctcatctctgcatgtgaagccctgagagctgcagatgtttggcctttggacctccaagtggacatcaattagcaagcgtgggctaggatggtgcagacactgacgtggcccttctgatgcctgggatgcctcatgagtcactgattcaagccctccaaggttctgatccccaatgcccactctgctaggctggcatcaaagagctttccaagaaatgtttggtccagctgagaagtcctgaccatgagcaccagggagccagaaaccacccagagaaacgttgcttcactcctctgtctgaggatggggaggggccagtgagctctgggctcagccactccctccagtctcaagtaacacgtccccgtgcctccagtctcctctcagcaccgaccaggtttttccccgctcctgcacccgtggatcctgaggacagcggtagcgccttcctcaccgcacgctgagtccagtgcgtgctcctcactgtgcacttattagtgtctgttgagtgattaaatcacatcctcaggtctgcagcaaataaatgaaagtttctttattttttattaactaaattgagatttttttcaagctgatgacagaaaaaaataattttgccatttcagggtaaaacttcgaaattccaagttaaatgcccagttcaagattttttccttctccaccttcccctggggttgactttagatctgggaggtttgggatttagggagaggcttcagggtcctgggaggtgctctgtcctaccctggtgttcttcctggctagtcctgggcatggctttccctccagggtggcttctgtataagcatcttcagtcccatttggtccctgtcccgtggtccgagcctgacatatgtgcccatcccaaggcctctccagccttaccatcctccaagacacatcagtgcccctctctgccctgtgtgaaaatctttggtttctccgttgaaactattcagggggctgcatcaagcccagcttcctagggccagtgggtggtcctccctataccacaccttaggtgtggtggcaagaggcattctcttttcgtgtcatctcccaggccattcaggggatacagctcatgtgcccttcactcttggttttctaccctccccaggagttctgccctctaccccgaggctctgctgggggccaggcagagagctcttctccagggaactcaatagtgtctgccatcatcctctcctctcggacttctcttccatagtccaaggagttactttctatcccagggctaggaaggttaccactggaaactctaaagccaagaattaacttctgtatcaataacctctataccaataagtgcagaaaatacatcagacacagtccaatctcattcatgataaaagtgctcaacagactgagaataaaagggaattttctcagcctgatactgagcatttatgaaaagtccacagctcacatcatattaatatttaatcgtgaatgactggatcctttcccactaaaatcaggaacaaaacaagaatgtgtactctcaccacttctattcaacattgtattggaagttctagccagaaattagccaaggaagtgaaagaaaaggcatccaagttggaaaaaaagaagtcagttacctctatttacagataatatgacacagtttaaaaagtgagggttgtgcaacctgccaatgtactaaaatatattgaattatacgcttcaaatggatgaattgtattgcatgtggtatatgaagcgtatctcaatgaagccatctgtttgctgttgttgttgttgctgctgttgttgttgtttgtttttttttaagacaggatcttgctctgttgcccaggctggagtgtagcggtgcaatcatggcttactgcaccctcgacctcctaggctcaagtgatcctcccatctcagactccgagtagctgggactacagttgcatgtcaccatacccagctaagttttgtatttttcatagagactgggtttcaccatattgaccaggctgatctcaaattcctgggctcaagtgatcagcctgcgtcagcctcccaaagtgctgggattttaggcatgagccactgtgcctagctaaagccatgtttttaaagtgataaaaataaagaatgaagacctttaggtcctctttgagtttctgctgaggccttcctttgcagagaaagggaggtcttggtctggggtcaatgaagcagagtgacaatgtgacaatgggaggagaggaattgtgaggtttgaacatcacagcatcttcctgcttcaaactgggtggatgtaaagagggagggatggatggatagatgggcaagctagctttatggctggccacatcttggcytgcagtgtgtgctttgatctggaatctgctggaaacaactctgcctggggcctggcaacctggagagggtagcaacttcactgcttgtgagcaacgtgcttctggccaagttatgcaacctcgttgggcctacttatctcatttgtgcagtgggaaaaattacatacaacaattatataaatatctcayggggttgttgtgaggatccaaccagatattctacaaaataggcttagaggactgcctggtacagagtaaacaataaatattagttctcctttctccagggtggcttcttgatgaatctcaactctcctggcacagagaagatggtaattatagcacactttactgtaagtgaaccctccttggagcttgcctgcaggaatgaacactgcaggttatgtgacttttgcagaaaagcctagggaaagcaccaagctatgctggtgattaatctgcatcagtgagtggaagctygtctctgcccrtctcctctggcaagacattgcatttccgagttatattctgaaaccatcaccaaccatcagtatctgtccctgctgggatcctgcttgggctggtgtctccccatgccacaggtggtaaaccacatagtgtcacatgattcaactatgtctggcgccagtcattcagaaaacccacatggaggagaggagaagagaaggcccttcagctgtgatctggaactccatgtggctggctgtccaggaagctacagaaacctttatccctcctggagacacccagcccagccccacataaaatgtcttcgtaagagtgccccccacccccacctcccttgttaaatagggcatgagctagagaaaggctgttttgttaatgcagcttactaatttcttatcattattctgaaatccaaacagctgcgaaaactcaagatttgttaggactcatttggctgcaaaacctgaccatttcagtgactgttgcagaattgatatgtttaattatggaaacttgccccaggccctgctgtgggtgttatgtaatatatggcacgtggattgttttaactttctaaaaggctaaaaagcttgaattctgaaacctgactccctaggtttctggatatgagagtgtggactggaattatgatgggtctattttaccctcaggctgtggttggaagaagcacaatgcacacccttggtataaagagaataagaaaggggcagaatgcaaacagcaaagggtttggaagcagagagcacgaggggtgaatccttcttctaaatctcaccacctgtgggatcttgggaatgccatgcagactttctaagctttggtttcagtatatataaaacagaaatgcataataataatatctacttcctaccataactagtgggttaagcacttaattattaagcatttattctgcatgcccacattcttgagcagtctcccacttccaagctgctgccttctcctctttcaggcacaaggccagtttctcaggaccctagccctcttagcagtgtcagacatgccttcagcctcccctagtggcaaccctcagatggtcctcatagacattctttgtaactgctccctgcagccctcctgcagctccagccacagcctatgagcctgagggtctgtattcagyatcaggagtcttatcacagagactcctacaggagtctctgatctattcttccccttaacaacacttgtagctttctttgttctgagcagcaagaaatgaataattgccaagagaccagctcatgttgttttttccacatatgtatttatttcaaaataaagacatacaatgttaaacaaataatcacaactgatactgatttagagtagcttacttgatttttaaattgtagcaacttaaagagaaagctttttaaatttaataaataggataaataatatttcatcttcatatcttgcctctcatccctctcatcttttctttctggaaaatttccagaagactcttcagaaatgtcagcgcgttgcctgccrtggtttggttgcatggctgttcacaggaaaaatactgtggggatgaaagttgataaggacagagtgactcaaatgatgtagagccaagcagccccagaagcctacctgccaagagccagagtcggtggtgaggattgtggggatgggaagggaagtggcttgagacacagagcaaataggtgggcaggtccaggctagctcatgtggtgtaaagacagcatakgtggttgacctcaaattggatttcaggggtctttacacacacacacacacacacacacacacacacacacacacacamacacccctattaagtggccctaaatctctgcattagagaaagccttttctggggactctttgaggcctaaaattgtatcattatccttttaggttgtctttccaaggtcatttgacagtacaatggctaagagtggggctctgaggtcatataggcctsagttcaaatctcagctctgccacttatcaaatatgcagccttaggcaaattagttaacctcactgagagtaataaattgaataattgtccctaaggtatgtatttattcagtgagacagcatrtattaagcacttagaactagatgccattgatggtagaaacgcatgcagctaaacagctgagctcagggctttcagccttctaggatcttgtgtggagatgctaatacccaaaaaacagagggaggtcacctctacccaacttgccatcccagtctgctgtcaggractagggtatatgctgaagaaaagaatgtgtggatgggcattcaggatgagtagcaagcttccaccttgacctgggtgcattgccctttaaatacctccttaatgcaggccaggcatggtggctcacacctgtcatcccagcactttgggaggtcaaggcgggcaaatcacttgagttcaggagttggagagcaacctggccaacatggtgaaaccccatctctattaaaaatacaaaaattagccaggcatggtggcacgcacctgtaatgccagctactcggraggctgaggcaggataatcacttgaacccgggaggcagaggctgcagtgagctcagatggcaccactgcactccagcctgggcaacagagcaagactctgtctccaaaacaaaacaaaacctccttaaccaacaggaaaaaaaaatccctgttaacaacatccattcagttagtacattgaatctctaggataatttagtattatgtgagctacatccctgattctctagattgtagcttctaattacactcagaaaggattctttcattattccatagtagagagaagtaaatggcctcgtcaggaacaatgatctatctcactttaattctattgtttcagtggatctcactttaattatattacttctgattaaaattcttagatgtcttttatcaaccttgaactaccaattccaactttatcatccttttgygttcaaacagggttggcatcaccattcacatagaaatcaccaacaggaacatatcacatatgaaaacaaacttactggacacttgttgttctttagtacttcaactgattttttcacccgactgaaaatcagtgggtatcttgtttgcatggtggtattggtcatctgagacagtctctcactgaagcatggtctggtgcagttgtcctggtaaatagtaaggatttattcaaagaaatattctgaggacagctttggaaatatatcacaaagagcaatataatagagatgatttttatttaatcamcattactcaaacttgcattatttttagacaggtcccttgycaatgtaggaagtgatctcccgtatttaaaggggatgccatttttccacagtgacatcccctggaggagacttcctgtatgttacatccaggaaacatgagggctstgggccctgaaatagtcggctctgaatgttcttttcaaygggtgcttcccggcttcaaggcttgtaagtctgaaagtgcagagtgaggaaaagccttttcacaccagctaatgggatgtgacaattgaatgcagctggtatttcagcagcagctaaaaacatggacggtactccaagggacaggggctgtgctgtctgcctggttcctgcccagaaggcactctatcctcttctcatctaa

SEQ ID NO: 13502 - DNA, 14611 bp, Homo sapiens
gtttccttccctttttccccttgtctccctccactggatccttccagaggatgctgcatcccactggcgccagtgctaaacactgctgatgttggcaaagcagtatttttcccagtgaccttggttttattatttttaattccctaggtccrtgtcaatgttgtaatacagtcaattttacagtccacagaaatgatagcgctgccttgagaggcatatggcaaaggggtcacagtgcagagccccagctctatggcagagagcctcacccacctccctgcctccacatcctcaccatggaaataggagcactgttggtacctacctcgtgagggcggttctggaattactcaaacacatcatctaagatgctttgtacagggcctggcacattgtaagcacttgtcagttcctgttgcacagcatcctccaggccctgtttgcagagttaattgcttctggtactttttttttccttttttttttttttttttggcagggggggtaggggggttgggacaagagtcgtgctcttttgcccaggctgcagtgtagtgacgtgatctcagctcactgcaacctctgcctcccgggttcaagcgattctccsacctcagcctcccgagtagctgggattacaggttcgcaccaccatgcctggctaattttttgtattttcagtatagatggggttttgccatgttggccaggctggtctcaaactcctggcctcaagtgatcctcccacctcggcctcccaaagtgctgggattacaggcgtgagccactgtgcccgaccgctttctggtacatttcttaatgtcctgtgaaacttcacctggaatgggatttgctgggaattcattttgtagacaagggaaggatgcagtcttgtcagatatggtgacttaaggatcatcttaaaggatttaggtttcctaatatcgccaacagccacatgggtttaaatcctcaatactggtaggggctgggcatggtagctcacacctgtaatcccaccacactcagctgagttttgaagttctgttttttgtagagatggggtctcactgtcttgtccaggctgctgaggcaggaggatcacttgagcccaggagttcaagactaacctggacaagacagaccccatctctacaaaaaacaaaaccccaaaactcagctgagtgtgtggtgcacgcttgtagtcctagctccttgggagtctgatgtgagaggtttgcttgagcctaggagttcgaggccgcagtgagctatgactgagccaccgcattccagcctgagcaacagagcaagaccctgtgtcaaaataaaaaagacctatagaagcattagtgcttggggtaactattagcatgtgctggcagagaaggtctagtgcctttaccttggtgctaagagtccctccagattagtggctttcccgtgccctttctcttctctgggctgctaawgccttccttccccttattagtaatattactgataaacaaattgtacattctctgatctcacttcagaggctgtttctgtgcactgaagatgtacacacagtcttaattcaaaagagatagcatttatgtgctgccacattaaacagattgcaacagtattactattgagtttgtgttggctctgtgcaaccctcatggtgcccaggaacagatgaaaccaccagagacttggagcctcaggttcattcaatggtgtcccagggaacggggttggagggcttattcccagaaggcctctgaaatgtaagagctattaacaaggagttataagtcatttttggtagctataggcccaggcaatgggtagagaycaagatgggataaatggtaagatcagtagagtattgctcagataaatatgtaagctattttactggcacactgtatctagtgatattaacatgataagctataggtaggataatttctcatcagattgcagaaatacatttatagcctatttcctgttatataatgaaaagctactaatggggtagtagacaatgatatgggtaatagcttaaacagccttcgttgtcacttacctgaattcaggaatgacaggtttctttcatgcatgaggtactggatacattaaacacacacacacacacacacacacacacacacatatggcattgagttctagtcatatcctaaagaaaaactatggtgcgctatgttatttatagtactatactctgtgtgagtgactctgtgtgtatgtgtgttggtggaggtcagggatgacttgtttgtaatataccttaaggaagtctgtccgaatttgcccttcaaatactaaataaattcatctctcacctcaaactgcctttcagttcccttttactaattttgtttaaaagaaaggcaagtgaaggccaggcatgggggctcacacctgtaatcctagcactgtaggaggtcaaggcaggaggatcacttgagctcaggagttcaagaccagcctgggcaacatagggagacgccatctctacaaaaaaaaaaaaaagaagaagaacctgggcatgtggtcgcatacctgtggtcccagctgcatgggaggctgaggtgggaggattgcttgagccagggattgtaccactgcactccagcctgagcaagaccctgtctcaaataaaaataaaaataagacagctattttaccctgtcttcacctaaataagctcatcttattttttgcctgaaactcttgcaaactcccaggtctgctagttttgagaaaccttggatctcaataaggaatagttctcaattgcttatragcataatggatttcttttggcttaaagttcaaaactggcaacaagcagcgctagcaacccatagagagatacgcagaccatttcgatagacgtgtttgctgagtgaacaaggctgactgaatttttttttttttttgaggcagggtctcactttgttgcccaggctggcgtgcagtggtgcagtagtggctcacagcagccttgaccttctgggcccaagtgatcctcccttctcagcctcctgagctcctgagtaactgggaccatacgtgcaccaccatgcccagctaattttttagatttttttgtctccctatgttgcccaggctggtctcaaactcttggactcaagccatcctcctgccttggcctcccaaagtgctgggattacaggtgtgagctactgcgcccatccctgaattcttaattacaactaaactagatgcttatggattttcctgttttacaactcttgcctcttttatctgtaattttaagatcttgacagcttatatttggctttgcttttgtgtctcaagagttctttccttgataagcctctgtggaaactacagaatcttacaaatataaaacatttccggaaaaaatacaaaaatggacacctgacatttacactccctaaggtcgtgatcctgttgaagaaaggagatgaacgcggctgcttttcagtagttcttcacttcaccttaccaggttcttcatctggatgctatgctatgggggccagaggaggaggctgggattgtgatggatcstactagattttacagctggagctcccaggaatgccctcatagggaatgtcctgaagggaatcatgggtaacttgtaagctacctcaacttatttttggaactatgtaaggtataagatggatggagctgggttcctgtgcctttctcaccttgtccgcatagagatgcagctgctcctgcaggccaaagttctgcaccaatcacctccacctgcttcccactgggagacaaaggtttgaaagcctgtttggcgatgaaccacgatgatctgacactcaagccactcctgagaaagtcgggtttctttctgtttccatttatatatgtaattttcgcttcaaacaaacatgacctcgctattctatgcacagttttgaatcctgcttttaaaatgcgatgtctgccttgtctttaaatattctgagggggaggagaggagatgtgtaatgcgactgtctataatttgaaaccggacctcactatttagcgtctcagaaaacgcggggttcattgccctggtcccccccgccttcccccgccccccgaaccttccggctggctctcttgcggtccccgcctcggcgctgatgtggtctggcagtggagattggcgcccgggcggagcacgatgggcttccccgcggcaggcaggcaggctgctgctgcaggtgggtcccggcgcccgcgccgccccgcgcctccsgcggtcgccccgcccctgcccgcccgctccgctccgctcgcattggcgctgcctgctgtctgtccccgcgcggtggggagggggcgcacccggcggcgggctctgcagagggcgccttgctccgggtgcgaccgcggctccctggaggcctgggcggcgggccccgcgagcgcgccgccacctcgggagcagtgttggccaaggaccccgacgccctacgtaagtaaaggcagggcggggagcctgcgggggaggagggtcgggggcaatgtccggtccgcggaccgcggagtgggcaagaggtgcccactggatacggggtatccgagccctctgaggtgctgggagtaagaacgcgggaggtcgcttgtccgctggaatccgcggccagggcgaccctcatcaggtctgcccacctatccccttcgcgttacagcttgtcttagaagcatgggttgccggtggcttttttccttctttatccctctttgagaaatgtgattttgggtttctggccattacattataattctgcagacagcctgaagctgggttatctgttccacgcccccggcattttcctttttgagtactttatcctgcgctctgtctcctgccataaggggcgtcaagccagaattcgagattccttcctccaggaggaagcttcgtggtccgtatctggtgctgggaaagatgcattgctttcctcgggtactggctgctcaagggaaaaaggaaagggggtgttttctgtgacatgagacttgcaattccatcaggaaatgagcacagggactttaagatttcctgaggcgataaagctacccttgctggttaagagcgaatcatttgcagtctgacattctgcaaagttttattgtctacagactgcattattttccctcgttagttaagtttctgtttgggtattcgttttatttctagtatgtgagatacattcaagtgagcttctcaaacgattgtctttgcgcaatccaggttagtttccaatgacagactcctaaacatctcatttcaatatttctattatgtggtaatacagcctctgcttaacaaaaatgctcaggtgctgaaaactcacaagaggtgagaagatttaaacagttatcagcttaggttctagtgctcactgaaacattgtgaggagaaacactgtcaaatgttcatattttagttccgtcattgttctagaatgactttatctttctgttagaggcayacagtatgaaacacccaacctaagataatatttacttagatcataaactgattttcagggttccagttccttctacagttcataaaattatgggttacccaaatgaaacttcagtgaaggatttacataaaaacaatataaagaatgagtccctttgcttattttagggcatccacccactaaaattcataggatctttgttggataatcacctcccatttccattctttggtgccatcataccattctaaggattaaattttcaatacacctttatattatctaagtttgccaattgcatagtttgccaacttatttttggcttttaaattagttcctgaaccaaaaaaataaaatataaagaatttcaaaagcttggttttcaaatgacaagaactcagtctactcgtggttcaattatgagttgataagtgccttatggttaaatgaccattaatcaattttttaatttttttactaatgaaacactgcagattagtatccccaaacaattcattttctgacgaaactcttaaagcccagtttcagaacataagctttaagcaacaagcaatcttgtgttaatctgagctctgttacagctctgccgtaatctcagccaaattgcttcatctgtacgtggtgataccaccatctttgtaatattgtggtgaggattagagatgtatgtaaaagtgcatgcactgcctaatacccaagaattgctcaataaatgtcagctattactactcttactgacttccaactatgtgcagattatggtggaaacatgtgatacagcagatacagtacttaaatgaaaatgtcaaaattgtacaactaatttaagagtgggaaatgacagtaatgctaaattttcctaagaatatgtatgaaaaatagcacttccttgatggaacatacatttttagaacagaaaccttatgttataatggtaaaactagagagtcaaagtctctagttctaactctggctatgaccttatctagttgcatggcttttgacaagacaactgctcccctctggagttcagttttgtcatctggctggatttgagtaatctcaaataatctctaaagtcctttgcagctttaaaattatctattgagtgtgataaagattacatcagcttgcttttcatcctgcacttcatttttggttcttgttgtttgcttaacttgcactttagagtcataagcaattcacacagacaacacaactaaagaactgataatatcagacttgcagggtaatccaaaatgaagtttcaacaaggaggataaaacaaaatagaatcacactgaactctttaatagggccaaagtaaaccccaatgtttattctccagtcatttcattaagttattatatggaaaatatgcctggtagaatcttatacattcactgaaatagtctccacagaaaataataggctcatagtgaaataaaataccactttcttttctctcatcaggttgatctttaaataaagcaaaaatttatccaaagaagggctttcatcaagaaattaaagagagaaattacaagccatagagaaactgggcatttctatactagagaaaccacctaaaacaactgtatggagtaagatgaaaggtatgaatatgcctggaagaaattktacctagtgtgacatttttgctcatctttttgtcacaaaaggctgctaaggaagagagaatacagttttctagagaataagagtgcagtgtaaaaatggaaaccacaatttcagaaattcatgtagaaaacaaggatgagaagagatcagcagaaggtagtcctggggctgaaaggcagaaggaaaaggcatccatgctttgcttcaagagaagaaagaaagcagccaaagcactgaagcccaaagctggctctgaagctgctgatgtggcaaggaagtgtccacaagaagcaggagcttctgatcagccagagcccacacggggggcctgggcctcactcaaacgtcttgtmacacgcaggaaaaggtcagagtcttcaaagcagcaaaagcyattggagggtgaaatgcaacctgcaataaatgctgaggatgctgatctttctaagaaaaaggcaaaatctagacttaagattccctgcataaaattcccaagagggccaaaaaggagtaatcattccaaaattatagaagactcagactgcagcatcaaagtccaggaagaagctgaaattttggatatacaaacacagaccccattgaatgatcaggcaacaaaggctaagtcaacccaggatctaagtgaaggcatctcacrgaaagatggtgatgaggtctgtgaatcaaatgtgagcaatagcayaacttytggagagaaagtgatttcagtagaacttggattagataatgggcattctsctattcaaacgggaactctaatccttgaagaaattgaaacgatcaaggaaaaacaagatgttcaaccccagcaagcaagcccacttgaaacttcagaaacagaccatcagcagccagtactttctgatgttcctcctttacctgcaattccagatcaacaaattgtggaagaagccagtaacagtaccctagaaagtgcaccaaatggaaaagactatgaaagtacagagattgtagctgaagaaactaagccaaaagatactgaattgagccaaraatcagattttaaagaaaatgggatcactgaagagaaatccaaatcagaagaaagcaaaagaatggagccaattgctattattattacagacactgaaatcagtgaatttgatgttacaaaatctaaaaatgtccctaagcaattcttaatttcagctgaaaatgagcaagtaggggtttttgctaatgataatggttttgaggatagaacttcagaacaatatgaaacactcttaattgaaacagcctcttctctagtcaagaatgctattcagttgtcaatagaacagctggttaatgaaatggcctctgatgataataaaataaacaatcttctacagtgacttactctccagagtcacggcagaaaaaacaagcttaatgaagaattcttttatacatttgtggcatttcttactcagtaacaaatgagagatttatcatctctagaacttaaaaggtacaattccagcgcagaagtgctaaagattaagtcaagtttataaaactctaccactgaaatgcagtcacttctggattggaggaagtcagcacagattgcagtgtaaaatgacataacatacagggagttgctaaaayggcatatggagattggagtgctttgggggaggaaggtgtatttattgagcacttatggtatgccataagctttttaatgacctctgatataacaaagtctggtttccttttgataattcagctctgtgtataggctaacatcacattaagtttttaaaaacttattttttacagtgcacatatatgtttaaaatggtgaataaggtgagctacttttgtgaatgtgatttgtaattgttacattcctaagcagcaggcttaactcaaaaaatacattgcattttcccaatttcagcagatagtgtgcagaatatgcatattgatattaaacgtgagtggtttcctagtcttaagtctcttataagcgctatttggccaggsgcagtggctcacgcctataatcccagcactttgggaggccaaggcgggtggatcagctaaggtcaggagttcgagaccagcctggccaatgtggtgaaaccccatctctactgaaaatacaaaaattrgctgggcgtggtggtgcaygcctgtaatcccagctacttgggaggctgaggcaggagaattgcttgaacccgagaggtggaggttgcagggagccaagattgcaccactgcactccagtctgggcaacagagcgagactccttctcaaaaaaaaaaaaaaaaaaaargagaaccattcacaaatccttcartcaggcaaattgttactaagtgcaaaagtgtagaaacagggagagtgggtttttcccccgcttttctttctgcctcaacagatctgtatatatccatttctgcatggatttatctgtgaaaagttaaaaaatgaaacagcaaaaacaaaacaaggggaatattattcttcatccaggagaagggaaaattcccaagtaaattatcacagataatataggattcatcttgcagaattacttctttaagagccatattcatcaacttctctccaaagaggggagagtagattcaaagccagcctggtagtaatggtcctggaaaatcctaataatctagtgcaaatatttattctcggccaaaaatgagccatgaatgtgggtgaatagaaaagtgaaaagttattgctaaagcacattataatttaaatgtcagtattccttcatgtctgtgtgttgagaccagtaaaaagcattttacatgaatattgaaagttaactttttcatcactattttcttttcttttttttttttttttgagatggagtctcactctgtcgcccaggctggagtgcagtggcgcgatcttggctcactgcaagctccacctcctgggttcacaccattcttctgcctcagcctcccaagtagctgggactacaggcgcccactacaacgctcggctaattttttgtatttttagtagagatggggtttcaccgtgttagccaggatggtcttgatctcctgacctcatgatcctcccgcctcggcctcctaaagtgctgggattacaggcatgagccaccgcacccggccttcatcactattttcaatccagatatactttacaaaaatgagaagggcttatttgcatttttatttacatattgaaagggaagcatctgatctcatcaatgattgccatattttttgaaaaagtaatcctatttcaatctttccttgtgtgaaatggccataataccagagtgcacttccctacctcacaggttaggattcaaagtgtgtattcccccattgtgtaaattgagtgaytgtgttactacttgaaacagatgaagtaataaagatgaagtatgagatgtaaggtatttgttcaagagctccacttggaggaaataatgcacattagatgattttaaatgatctgggtgaattcttgcattgtgyatggattgcatatagaaagtatttgctactttgtcctacagaatcatcttcatttctttctgtaaatacatattgagacctctaacaaaagaaactaatctgacttggaaattgaaccaaatcatggatattattagcaagattctttgctgaagtgcaaaaatatttcccccagattttcctaccttcatgcttataatccggggaggagggtggaaatcctgagcaagatgaaaagtgtcattcaaaacacatgacccaagaagtcaatttcttttaattgtacaacttttaaacattaaaaacaaaaaagacgagtcatcttctctgaaaacactctttaactcactatatgtggtgctaatggacttggacagctaccagctatcatatttaaaagtgaaccattttaaaaacctgactaaggttggtgcattttacagtgtattgaagaatcctgccctcatttactgcaaggatgcctccaagccaatacacttgcattgtaaatgtttagtaatctcatgaacaagcaaaaagtatagtacttagcagttattggaaatattttgggggatttttaaaaaaacagataaatggtaaatatgtgcaatgaattttttggttaagaaagtaaaattttatctaatactaggtttttacttttttcactgtggtttgatatatatttttggttagaatgtactgattgtttttatgataagatgtatattttacttgcattcattcttaagaggtttctgtttttctattgagaatatctgttgaattaagtaggatttcagttagaaaaaggaattccgaaattaactggtctcaatctgattatatgtgctacatggccaaatcctattacagtgaattctaaggtgattcaaattgttttattgttatagaaatatgcagaaatcagatggcttcagagtcataaaatatttttcttgtaatagtatttaagcaatttgaccttatatgcaaacgttaagtgaatataaataagttctgtttcaattcatgtccatttaacaacattaaaataattattaggaacaccacatgaattttctttacatttgctgtggtataaattctgcttttaatgaatgtttatttatttattagccaaaattcagtttctctttgaacccagaattttgcaaagctgggggttggggagggggattattagctacttgttaactttttcagcatattatcattcctcttttaagactcaagtattattcactttgcttcttacaacccagagaatgtgaaaattctcctctattttatgtagcactattcacttaacattttttcaaagcactttataggatataaaaatagtacccggtaacatttaagtaaaggtagcagaaaacaaaagaactttcaaacagaaattatgttccctgccacctcctccacctcaaagaataataagcatgtggcataaatggagttgttcagaaaagctgtctgcataattttccttcaaggtaatgtatttgacagcatgaagtttgtgatgatcttacttggtctactactcagcggagtcttagaatctcttttatttacttctgagagattgttatttcaccagtatatgtgaacaggcttgctaaaggcattaaagatatggatcatggaggcaccaaatttggcttctgtatgcaatccagcattaacttcatccatacatttctaacttcatccataaatttctaacttcaagttaccttattttttatagttaagaatgtttttcgaggtttacaacagaatttaaaaaataattgttaggctttagaatcccactgtttgaaaagatccttttaatgtcaactttattgaaatatgtagtctactttctaatttcatctgataatatagcaggatttgatttttctgcctgccatttgtgcatttaaaaaaaaatcctcatttaagatttagagttctttaggttcaaattcctatgatgttttattgggtaacatgaactctcttatacataattcaaaatttcaatccatggtatattttatggkacattttgaaaagaaaatttgtaatgctccttagttacaaaaattagaaggaagctacataaaattcaggtgtcctaattaaattcaatttgattcaacacacgtattaggcataactcatacctaacactatttgataagggagacaggctccctgccatccaagaactcaacctagggagcagtgacaacagaaaccgggttgggttaaggcaaagagccatggataatgctgcaacatgagtggcacagaggggagtacacagagagagcaattaatttggtgtggggaaggtggtgatctgaatacagcagcagtttgaaagtgttccgtttttaaataaacagtatgcttattttgatttgtgactaggtgtagaaaaaagcctgcatagtgttacatatttatagtagttctttgtaaaaatgttaagtggatgagctattatgaaagtaaaagtttcattttttctcattaaaattagtactaaattactatggatcagatgataatattaaatagtactctgtagaaaaaaggtttcaagttgaattaatttatgtactgattattaatacagaataaatgttatattgactcatgtttattcagatcttttaaaagaactgtgggcaaactatgttcatttcctataactgtaaagatcacattgatggaactactgagttcgcactaccaaaagttctactctgctaattgggaattggacagagattttacaacaacactcctaaaacagtccttcagcaagacaaatataaacacctacaatgctgaactaattcagccaaaagggcagttctgaatttgatgacatttgtgaatttgacaaaagcacactgttttcatctcttgatatactcattattttctgcattaacctatgaattgttcatctttatgatttttcaaaagactaatcaatgtgaaaatgctagaattattcagayggtacatactaaaggtgggtgtttaaaaagttctgtgtttactaagacactgatttcattttggtaatgttaacactctatcttttcgtaaccacagcccgatgataacaatcaggctctaggaaggactgtactttccaaatcttggaaccaatttaaaacttgataataccttaaaagtcctaaaacgaatctggcttcaaagcaaaatgtcttcttaatgtacaaacactgtaatagggtagctaatatttcacattttgcaggatttttaaaagttttatggccgggcgcggtggctcacacctgtaatcccagcacgttgggaggccgaggcgggcggatcacaaggtcaggagatggaaaccatcctggctaacatggtgaaaccccgtctctactaaaaatacaaaaaattagccaggcgtggtggcgggtgcctgtagtcccagctactggggaggctgaggcaggagaatggcgtgaacccgggaggcagagcttgcagtgagccgacatcatgccattgcactccagcctgggcgacaaagcgagactctgtctcaaaaaaaagttttattaaatctcttcttggtttaaaaaaaaaaaaaaagatacactacacttcacaaaagttgtcctcacaggcaattctgctaatccctttttagacctacctttaatgctgacgtctggagtccccaacccttttgtgaatacctacttttctttctttcttccttcctgaaagcttaagcttactgggggttaagttcccgagcttaggaaagagagtatgcgtgtctgtgcactacacattcacagaaaatcctct

SEQ ID NO: 13503 - DNA, 40987 bp, Homo sapiens
cactgcaagctccgcctcccgggttcgcgccattctcctgcctcagcctcccgagtagctgggactacaggcgcccaccaccacacccagctaatttttttgtatttttagtmgagacggggtttcactgtgttagccaggatggtctcgatttcctgacctcatgatccacccgcctcggcctcccaaagtgctgtgattacaggcgtgagccaccgcgcccagcccagattctttttttaaaaagcttcccaggtgattctaacgtgactgctcagttaagaaccactgcctcagaagaacacgggaccaaggaaacccaagaaattatttcacactctacaattacattgatatttaagagacaataaaaactttctttactttctagattgtataactctggattagttcaaaytaagtaagatagaacaactttatactagtctctataaataaacaattccgtaagagtgttcaaagtatggaaattatgttgactacattaaatgaacaaatataaacaactgtaattctaattgtaaccttaaaatattggccagattaagaaacaaaagtgctccatggccaggcatggtggctcgctcccagcactttgggaggccgaggcaggtggattacctgaggtcgggagttcgagaccagcctgaccaacatgaagaaaccccgtctctactaaaaatacaaaattagccaggtgtggtggcacatacctataatcccggctactcgggaggctgaggcgggagaatcgcttgaacccaggaggcagaggttgtggtgagctgagattgtgtcattgcactccagtctgggcaacaagagtgaaactccatctcaaaaaaaaaaaraaaaagaaaaraaagaatcaaaagtgctcctaaactggcaggatgggcatgggtgggggggtggaggaacacactattttcagacttcttttcaaatagtatttaggaaaaagaaatatttactctcttactccattacacctagattggatttcataacacctaaaaatgatacagaaattctaaatctgaaaatactgtttgaggtaaaatctgctgtaattccagacatctgcttattaagatctactgagaatgttagcaaagagggtatggagggggtagatgaaacaggaagagtagttatgctctagaaacctttaatggaactgggaaacgttagtttggggcctcctgcctgttggcagacatagccaacctccaagcacctctaattcccatctaacyaacattacattgtaggatgcctgataaagccaagcacacaagaatactaacaacagtaagcacaaattgttaatagacctttaaaaaaaatcagaacccggagaaagaaaggaaaagattcctctcagtccattaaagacaaaccaaatttctaaaagaaaaaataaggtactcaaaggacaggagaaagatggaaaattataatgctagtacagacctagaatacagtacaggcaagagtaactaaaacttctggatacaagtaaaccaatacttctttcgcaatggaagtatactcccatgaacacactactcaagtgggctaataaaaacctttgcttaaagtgcttggagatttcagaaaaaataaaacatccatgcatgactgatttgtaaccagagaagaaatgaattagaaaaatataaaaaataactgaacactctaagcactttttctcccaataaagcrmmaaaaaaaaaaaaaaaaaaargrgagagagagagagaaagaaaattcctgctagcaaagggaaagcagaacggtaaataaatgcctataatcccagcactttaggaggccgaggagggtggatcacctgaggtcagagttcaagaccagcctggccaatatggtgaaacygtctctactaaaaatacaaaaattagttgggcgtggtggcagacgtctgtaatcccagctacttgggaggctgaggcagaagaattgccaataagggggaaaaactcaaatgtccatggatagtcaaatggataaagaaaacatggaccaggcrcagtggctcacacctataatcccagcactttgggaggccaaggtgggcggatcacttgaggtcaggagttcaagacccgcctggccaacatggcgaaaccctgtctctactaaaaatacaaaaattagccaggtgtggtggcaggcgcctgtaatcccagctactcgggaggctgaagccagagaatcgcttgaatgcaggaggcggaggctgcagtgagctgaaattacaccactgcactccagcctgggtgacagaggtagactctgtctcaaaaaacaaacaaacaaaaaaaaccccagaagtataaaaaaatttaatcaataatcctgaaactgatgtttgttacaaacactttcttcttcctcctctatccctaagcaggttcaagtagcaatatctttcctttttagggagaatactattctggttattttcaaaacctattattataataaatactatatgcgaggccttgtgctaagtgctctatatacactatctcttaaaatcgtcactgtgatgactaatgtattattttcatttccattttacaaatgaggaaaaatcctaagcttaggacacacaatcagcaaatggtataaagtggagataaaaagccaggtctgtctccatagcctgtgctaataaactggagcaatattttcttagctttctcttcttaaaagactgaagttcacatgctatttggaataaatacacagaaaaggggcacaggaagtggtgcagaaagaagcactttataacttatcaagataagagcacctgcactgcttttttaaaacaaggaaaaaccctgcaataatataaaacccccaactcttttctggccctgttattgctaaaatggacaagttggtcaggcaccacctacggaccatagcaaataaatcactttggttcagtggtggggaggacattatgcaacacttcccagcacagccctggccaggatattttacggccaaggcacctcctccccagctagacagcctggctccttcacattcccctcaggagatagggtggaagctcacagctccactttgtaaggcayagagggcagctgaaagtcctgcttggcctctctgggcaaccacaggcgccaataaatcagccacaggcgattctctcattcccttcccggctgaaacaggagcaagatataatgcaaaacagcactgattggacttgagagataagcgatctaggcttaaattctactgcgaatgactgtattaccacagcccaggtaatgagcctgtttcctcaggcttgtaacatgaagacagtaccatctcctttttggtaaagacacaaagttcatctacgaaagcagctagtatgatacttggcccactgcaagtactcagtaaacagcggccaacttgagcagaatccatctctactacatgcaaataagacattcaaggtaggactggacaaaaaaggtgttagcaggttacgtgggttcctttctgttttcttcctgaccacaccttgatatttcactgactgccagctctcagaattaatctgttccatgtcatatcccatcagtgttctgttccctattaaggagttgatgtccgataacggattcacgatttacccttaactaaaatatatccagattgttaaagaagactttgatgccttaacataaggaagcaaccaatgctgcaaataatagagaacagcaatgaaaytttcaggggtggctggggggtgtaggcttttagttccaaaaatacaccataggcggcctacctcacctagaaataccatcaaacccacacagtggccatgcctgacttctccataamctgaatcaagccaagtatatataatgacctccgccggatacattctctacaggtgagtggggtaaactggcactgcggtcctggcatggtggagagtgcaatcaccaaggtgtctggagccttggagtcttagctatcaagaggtgtagctagctccagctacatcacgctcttcaggcctggtgtcttctctgtaaaacgagagggatgaaacagattttctataaggcacctctcggctctaaaatttaagattccaaagtgtactttacatacatgacagaatcttgtgagaggatcaacagctctgccaggacttgagtctcaagagaaagaatgccaaatttaatcccttggggtgatgcgggcgctaactgttgaaacatgctaggtgccgtcaggttccaggtactacgttgtgctatgcgctgcctccgcaactggtaacaactgattactccaaatactgagtgccagagaagacggtgataagatgggtcaagcttcaaaaagaaaaaccggatatgcttagaacaagataaacataatttgaagatagaaaagggggggatgtcttcttgccctagaaacgaggtaatcacaagctgggagtggaaacagtagccgcagcgtcctcccagcatctggaaagtcgcccgctcgtaagaggggtcggcgctacccgagggaggccgcaggcctactggggtttcctgctgggggtcgcacccggacccgcggccgggacggctctgcaccttcgcggcaccccgtgtgccaccctgaatcaggccccggcagccgctcctacgagcagcaaagggtggttctgggtattgtcggcccagcgctcactcgcggatgtattttcctcctgtgccctgcctgacatctcaatcggaccaaaaacacccctctccccagctacttgcatctgtcccgcgactggtgcagctgcaggccgccgccctgggtggctcgcggcaggagggactgagcccggggcagcccacaggggcaggaccgcgtcgcttacccagatgccgccgcggcggcaggccgactcctccgtgcaggaggggcgggctcccaagccgcgcactgcaagcagtggcgccgrctcacgcacccctcggccgcctctcgcgcggcttcccgcgccggcagcccgcgatggccccacgtgaccgcgtgtctggtagcaggggaaagaggggcgccagggccggggtgtgcgtgcgtgcgtgcgtgcgtacgtgcgcgccctcccgcccgcccgcctyaktggccgggcgggggtcggcccgcgctctgagtgcygccgccacagttmgcagttgtgactctgtaggcggaagcatagggacaagcctgagcgtcacaggctccccacaaacaaccgcgtgacccggggactttccccagggtgtgcaaaagcacaggcaccccctcagttctggggtgaaggtgggggtggggaaggatgcgcccgcgtgttcgctggggaagggatgagggcgcggggccagggaggccgagccgcgggagcctgggtggagaggcggactgggcgaggtggggcatggcgggggaagtgactcagggccagaggcagcaggcccacggaaggtggggtcgggggggcgcggggactgggcgaccctgaaccgacggggcagggcgaggttgccggagcactcgaggcggaccgcgagtgacggcccagctgctgggcccaacgggcaggggtctgacatctggacggagtgggaaagcagcctcgcatcctgccctggggagtcgggaggagcccagtyccatccagctgtgcaaacaggaggaggaggaggtcccaagcctacccttgagaggggcaagaggggtggtcaagccgccgccgccgcgacggcccccgcggtgcgggttgcgccagcctcctcggagctcgacgcagaaacttgttgcaacaaacaggcgaccgcgggtgcccctagcagccagcggcagagtgggtgggcgggcgagagggaggggaaggctggcggacgccgcagcgaactggtgggcagacccggagtcgccgcgtaagcggggccggctcagtgcggtgcggcaggcgcggctgtgcggcagcggaagtcctttgttgcagcacagtccctggcagagccagagcctctccgcgcagcccagcccgagcgccgagcgccgcgcgccgccgccactgcagctcgcggccccttcgccttcgcccgcctttcccgcggctgatttgccttaaactccctaaaatctccgcagctctggttcctgttgcggccggtaagtatttgccagttgtggggctatttgcgcaactttggcccaggccggagggcgacgggccgcgggcctggcggastgcggrgccggaggggcgccgatccgtgcggggagccggagcgcggcggacgcgctgcgaggacccggtgacgggcggctgccaggccgcctgcttgttgccggcgcgtcaggtcccgggcgtgcggcctccctgagtcggaggcgaagcccctacggagactagttcccaaattagttaccttcttttctttctttctctgcctttatttttttcgaggggggaggggaggtgtagacgggaggcgggagaacccggttgattgacgtgcctagagcccgcttctctcaacttacagctgcggctcggcggcgggtgggaggggaagtgtcccggagcccgaggctgcagacttgggcgcgctccgagggaggaggcgtaagatccgtgcaaattcttgytacgctgtttcccaccccctctcgccggcacacacgctttttgttcaktaaaaagtggaaggtctgagtttgggaattttaagtggaaaagatctgtttcttgggaagggagtgctttcgcttgcagcggtgggcgcttactagaagttcggtaaatgtgttggatgcagatcgggagtcgttactactaaagtatgtaggcagggtctgagctcagccaccccacccagtctccctttctacctaagcaacgcgtgtacatgatctgaagggttgacatgacattttctaaattgggcgaatcaggaagaggttgatgaaaatccttgacgttttctggggataggacatttgtgtgtgataacgttcttaagtcgaatttcagtgtggcagtgcacgcagattcttcattggtgttagtgtatttccatacggtatgtatcagtacaagaaatagtgttccctttgacactcgaacccaaggagtggtccgaggctttttgaggcaacgtaggatcaatgtctctgaagcagatttggtgaaggatgcaggtctcataatttacagagcaatcacagccttctttgaaacggagaaattagattctatgaaattttgtcagtgcagatagatatgatgtggagaaacggggaaaattgagtacaaaaagatgaggcttgaatgatggctggccaacatttgctcagaacctcaaaactttgcttttgaatcacttgctggatatctaataaagtctcaataataactggatgactttgggagctagaaagggggttcctcctcttaaagaaacaggaaactgggccgggcgcagtggctcacgcctgtaatcccaacactttgggaggcygaggcgggtggatcacccgaggtcaggagttcgagaccagcctggccaacatggcgaaaccccatctctactaaaagtacaaaaattagcctggcgtggtggcgggcgcctgtaatcccagctactcaggaggctgaggcaggagaatcgcttgaacctgggaggcggaggttgcagtgagccgaaatggcgccactgcactccagcctgggcaacaagagcgagactctgtctcaaaaaaacaaacaacaacaacaacaaaaacaggaaactgaagcatagtagaggtgaaatgcttttccaaaggttaataaacataacgtctacagtagagtcttcagttaacctcttacattcgttttatgagcaagcaggctttctccattaataccacattttcatggtattgaataactcaggttgaacagtctttcctgaagcctttctattcttcccactcctaatacgatggcctacttttttggggtttttgtggggaagggactggtgtatcattgtcagagaaaagagaaaccatatttaaccagggccttagcagggcatgagcacagtcacagccacttgctcttgaccttgtgctttgatttcagtttaacacttctaaatttttgtactgcttcctcattctcctcttttgccaggctctggggaagatatagttcatcgacctttttaagagtatctcgttttctttgtagcatcatttccctttctaatgtgcaggagaaaagaagtacctgctttcagacttgccctctagccaggaaaagcactaagcctttggtgcaaaggagaggaaactatttggtatagaaatacagaaaaatttccatagatttttgttaataagctgcaatctgttgtcttcccaaaaaaaatgaggtatatttgagaaacatcttcttgagaggtcactttggtctctatagaatgttttctcctgacattttcttctgtgctagtatctcatgctaaaatggtgaaattattttttctcatattcttatgtgaaccaaattaagggttactcgtgtctattttttctcaaaatggaaatgttttttattataaaatccatgctctttgaaaaattcagcctgtattgaagtacataaaatacaaaaatgaaagtcattttgactcccactccccagagataatcaccrtgtacagttaattccttgtttaaaacgagagaaggcaacatttgatcacagctgtgtgtgcctcactctgcctggggatggcctrtggtgattcatggactcatgttctctgttcacattactcaggttggtaagaattgccaggtagaggaaaggggagtgttttgcattgggctgatttaaaattatttgattaactgggctgctattttaggtttgtccttattaaatacttactgtatcatggtgggctatttttcatactttgttcatgttaatgttgttgcccagcctctgatggattgatttacagcagccaaacacatgaaaacaaaagcaaaccctcacctttatagagagtttcataatttataattaggaaggagtgggtatacttgccatgaagaccactgccaatatatccctgtgctgatatgggatggggttcctcttgatcagcaccaaagattgcatgctgaacatatggaaaggaaattggacgaaagaagggtcaatgaccgctgttttcagatgtggcatggaagagactgatactggggaggaagcggcagggtctcactccttagccatgtgtatttaagaagaatgaactgtgaagaagttgatgatgatctaaaaacagagccccaaaatagtacatagaaagttaattacaacattggttatttgagagtgttggggacgtgggtggtttttatactactctgtctttgaatttaaaatagttttcaaaataaaatttgaagattaaagaattaaccagattttcttttgtctatatgagatgcatgcagtcgtttttagagatgagttccatccccactttgaatctgaagtattagaagaggcatgctctggtggacagtggggagttagcagatggaaggggatttagggaagggactggacattcttcctgcaagatggagcagtaagagaatgatgagagcttttagattcatgaaaaaggtgactctaggaggcttagaatgttccaaaggggcacttcagctaatagtcatattcagaagagtgttgtctggtttacacaaactgaaacttagggctttgaatcaagagtctcagcttctacttacaagataagcagttttggggaagtcagccactgaacctgtttcttcatttgcaaaatgaggataataaaaatacctatctcagggtggttgtgagatcagttgtataatgtatgggaaaatgctttaaattttaaytttaattttaatttccaaccactatataaaagttgccatgattgaaataaacaaaaaattgataagcaaaataaaacttacctgtttaaacatttattcattcaaaaactcatcaagtatcaactaaatgtcagacattcagtaatgactgagatactgccctgatgtcaaggagcttgcagtaaagcaggggagccaaataattgcaatatctgccttaagygtggtaacagagcatcacagttgggatgatgcattattggtaccatattgttgtatgtataggctgttttggcagcacagaagaggcatctgcctcaccctaagatcagaaaaaacttcccaaagaggccaggcacaatgtctctcacctgtaatcccagcaccttgggaggcctaggcagrcggattgtttgatctcaggagtttgagaccagcctggccaacatggcgaaaccctgtctctacaaacaatacaaaagttagctgggcgtggtgccgcatgcctgtagtcccagctattcgagagactgaggtgggaggaacgcttgagcctggaagggcggaggttgcagtgagccgaaattgccccattgcactccagcctggatgacagagccagaccctgtctcaaaaaaaagaaaagaaaaaagaagtcccaaasagagtgagctagacattgaaaaggttctaagcaaaggaacagcatgtgtgaaatggcaaggcttttggtgtgttaggttatttgggatcgggggaatcttaaagcttaaaaatggagttaagtttcttagaatgaacatgcattttatgattttttaaaattggtttcattttgttgaatttcaattatatgattgtgatgttttcaggattttggtttgaattaaacaaaactggagccacaaaattggaaacaatacaattttttttaaaatgtgtaggatctggccgggtgtgtggtggctcacgcttgtaatcccagcactttgggaggccaaggcaggcggatcacgaggtcaggagattgagaccatcctggctaacatggtgaaaccccgtctctactaaaaatacaaaaaaaaaaaattggccgggcgtggtggtgggcgcctgtagtcccagctactctggaggctgaggcaggagaatggcgtgaacctgggaggcggagcttgcagtgagccgagattgtgccactgcactccagcctgggtgacagagcgagactccgtctcaattaaaaaaaaaaaaaaaagtgtaggatctgctcaaagaaggaaactgggtaatccctcccatcatcatagagctgtctcaccagttattcattcagtaacacttactgaatacttaatattccagagaaatgaaaaagccaaagtcctcgccttaaagttgctcacaatctcatgggggagaccaacacataattataaccaattcttatttagcacttactccatgagagatatacttaacaataattcttcagaggtagaaaggattaccatcccttcttagagaattgaagcacaaattgactaagcaaccttctcaaggtcacacacttaataagtggcagagccagaatttraacccaggcagtctggttagtttgtgctttaacacctactttatgtagctgttctgattattaaaatacagtgtaaaaagtgcaaaataaagaggtaatacacaatgagatcaaaacctaaaatagtgggagaggaaggtgttacagaggctttctgcaggaggtgataaactgatttttaaatgatatctgggaggttcagacccaaagaaccaatcggcatgagtaaaactgcaggggaagtaagaaatttatgaagtatactggrtgtgtgtggaggagggtgaaggtggtgatgagcagttttatgttgcttgaacatgaagtttgaagcaggcagtaactaaacatgtaagactagatgggtgggcatggagggctttgtatgcctcaataatgattttatactttagtctgaagatatgtgaggggaaccatggtagaatagtgtgatatgatttttcttcttcatgaatcatcttcaaaacagcattgctctgggaagaaaaagattacctgagagtgaaggatttgagagactggttgagcctattttaataactcaggagtgataacagaggccttgcaagagcaggaaaggtagggatggagtagatgggcagatttgagaaatatttaatgggaaaattggcaacacttaatggttgattatgagggagaagttmtaggtagctcccaagtagtctaggtgattggtacatagtggtggcagctgagacaaaatacagggaggggcatttttaagtgggttccagacaaaatctgagtccacagaattagtactttgaaatagaagtcctacaaaacgaaccctaagaatatgaatgccatgtgcaataagggatttcctggtgaagcgtttttagctgagaaaagcctactgtttacacagtgccctctggtggtcagaagatgctgtgctgtctcgttaggatgaatggattaaaatgtacttttcctcctctgcttctggagagggagagaggaatattccagaagccactgtgttccttctgctttctgtgtgggtaagttcatttcttagaatataatgcaactgaactacaggaacatctcacttatttgtaagttatttggttggcaacctcagctatccagtgccttggcctgatgcaaaagaggaaggaaatatgatcgcctgtcagcaaaattcaggaattaaaacttwacatcttatgagcatttccctagatcttcagaagatgttgtgctccctctttaggatgaatggatatgtagattcaattttcaatgagtttttgtctaatttcacagccaagaagagattgaaatggtgggccacaggagatcagcacacctttcagaagtgacagttgttggcttgcaagtaaagagacagaaaaatactaactagccaacaaagcccaatctccaaaagcataacagtctgaggccattttgtgtaggtgcaaacccttgcaaatttgaacaactactatgtttcagcaaaacataattgtttcagaggagaaaacagccagccgggtgatgctatatgtgtaggctgcagttagagtagtatgaagagccctagaccaggattgaggagaccaaggtcttatcctgacagccactaaaactaaatgtgactttgaacataccacttaacctcttagggcctcagtttgctttttgatctataaagcagtgggttgaacttgatcatttcataaaattctataaactgtaattatgacattaattttttttaaattgtactgtgcttggattgaaaaggcaaaggaacatttgtcatctctaatttatttaagagtcctctgagaagtatgattatcccaattttatagatgagaaaattgggcttaaagaagttcccgcatagctaaactagtggtagagtttgtattcaaacaaacagtatatgctctctggcttcttttttaattccttcacttgacaagcacatattaagtgtcaactatgtgggaagagtgtgctaggcacaaggaaaacaaaggccattaagccttgtccctgtctttgaggcttcagtacagtaggcattgctgtatcacactgctccttggatctcttgtcagtgctaatgatacaagtaatactactgcactgttaggcttaatatatagctccattatgtctttagggtgtgggtataaaactaagccaccatttatattattgtttctatgggaatatgtgtttcaagttccaaataaattaaaaataaagttttaggatataacccagttataattgcagaacttcctgtactaagtactgaatttggagtctaatgcacagccaccagtgcagatagtgcataaaattttctaaacttgatcgtgtttgtcacttaagtgcgttgaaataaaacctcttatctttgggagcctctacaactggttattcctggaagtttcaagragaaacctagagaatgtaatagagattggaccctataccctgcaagatggtattctaggaaagaattttgccaatgtgacattatttttatagatggcagaatctttaaggtcatgatcttgggcttagagtcatattgcctgtgttctaatcccatgaagtcctctctttgtgatattacaaaggttatataacactgtatgcctctgttatttaatcttgaaaatgagtcttatagcagcatctactttgtagggtttgttacgaggattaaatgctaaaatgatacttatatatgcatacatacacataaaatgatacctatatatggatacatacacagatatgcacacatacacacatacatgtatatacatacatgtatatatgcaatatatgtgtgcatatctcacacatatatattgcatatatccatatatatccatatgtgtatatgtgtaatgtatctgtgagagatatatatacatctccctatacatctgcctggaatagagcctggcatayagtgagacataacaaatgttagctattcatattattattgtattacagttgtcatttactctactttgataaccttcatctaccagtccagtaaagcaaatctaccttctgtcctgttacatttccagccaagctgctgtgtaccctcctcaattatttacatacacatctatataaatactcgaaatgcctcacccttgctttctgtttatcctactcattcatcaaggctttactcaaatcctacatccttcctaaagcctactattttggtataattaacgcttttcttctaaactcttgctgaactttattcaatatagtttatttttatttttatttttatgtttgagatggagtcttgctctgttgcccaggctggagtgcagtggctcaatctcagttcactgcaacctctgcctccaggttcaagcgattctcctgcctcagccccccaagtagctgggaytacaggcatccactatcatgcccggctgatttttgtatttttgtagagacagagtttcaccatgttggtcaggctggtcttgaactcctgacctcaggtgatccacccacctcagcctcccaaagtgctgggattacaggtatgagccaccgcaccggcctcaatatagtttattaaactcctcaaattgtttcttggtttcaaatttaatccctcatatacagttatctctattgtacaccatccttctccaccctccatttcaatgctctatccagtgttaggaacattatgagtattcaatagattctgatattctgatgttaaaatgtaagaatcctttcattacattttagacttttaaaatactctgtaatcctcaaatccatatgcatacatacattcaacctataagacatagaaataggtaaaaggaaacatatatacataaatcttccttgagatccagaggtaattgtaagtcagagattggggtgctgaattgggactgtgatgctaggctctctagactttcactgaggctaagcgaatcatcttcaaatgcctcattggtgctgcaagtctgtgacacaatttagagggtgattatttgcctcacagaaacactttaaaattcctttaagttacttctttattcattggatatgcttatttatagacccttaaattatcatttaccaaggctggagcaagagaaacttccagcaaaactgttatttccaatttgagagatctagcaatggaggaaaaatatttctgaaatcttactatgtcagtgagaaatttactgaaatagcttacacagtataacttagggaacacatctattgaataagactagattgacatgtatggataaagccacattacagataaagaattcagattggggtaatcacttgctcaatagcatccaaccaacaaaccctgtattaaggactcatgccctgtccttgtttagtgttctttccggaagaccatactgtayagtaccaaggaagtgccatatatagaggttattactatctgggtggtcaggagtccttagtcctagtatgtgcttcagcacagttaactataccctgatacattaaaaaccatgtatctttgccttctatggaataagaatgttagactagattagatctctctaagctctaaaaatgtatgattaaattacttaatatgcttaatgtgcttggtgactgtttttaaacttgagatgagccgttaaactttttcagactaaaattttaaaaatccagtataaaactttttggatcacctaactccttaattcttgctagagttctgcacagtgggtatccttctagccttagtgtaactcttggcattatatagcttgttttccttatccaaatgacattaagtcctttgagtcacattggaggttctgctctcagacctgakcccttgacttctagttgtgctaaacttgtcctaccagtgatgcagctagtagtacaaacaaaagcaatcacagatttcagtcgtaaaaacaagaacagctgaaatacaagctgtccatttacttaaaaccttttataggctttactagaacataaagttcattaactttttttggcagcattaataaagaggtcaaaaaaatkaaaaaagagcaaactcctcttggaatttgagtgaaattataatttaatgaaagtgaatgcctcataattttttttttttttttttgagatggagtcttgctctgtcgcccaggctggagtgcagtggcacagtcttggctcactgtaagctccgcctcccgrgttcccgccattctcccgcctcagcctcccaagtagctgggaatacaggtgcctgccaccacgcccggctaattttttgtatttttagtagagacagggtttcactgtgttagccaggatggctcgatttcctgaccttgtgatccacccgcctccgcctcccaaagtgctgggwttacaggcgtgagccwcggtgcccggcctcaaaaatttttaatgaaaaaattatcttcaagagataagctaaaagtctcacaggaatttagatcyctcctcccctgccgcatactcctctacctgtttttggtgtagtaatccttcttaaagcttttctgggctaggcacagtggtttatacctgtaatctcagcactttgggaggctgaggtgggaggattgcttgagcccaggaattcgagaccagcctgggcaacatagcaagacctcatcactacaaaaaatatacaaaaattagccagtcatggtggcgtatgcctgtagtgctagctattcagaaggtgtgaggtggaaggattgcttggagaatgagtacccatattaaagcaggaacagaatgctattgaggacattctgagctatgatggcaygccagcctgggtaacagagtaagaccctgtctcaaaaaaataataattaaaatttaagaaaaaagcttttctgaatgaggtgtaacaaggacagagtttctggtactaatgtgtcaatgattgctattataagttactgtgcctaaaatcagttttactcagaacttggacatttgcataataatgttacttaaactacaattctaggtcagcctaaaaactgttgtgttaggattaaaaattagacacagcatttgttcagcttccatttgttcagcttccagctctatagggggaatataggagtataaacatggatgcagtgggattcacactgtgatccgtctgactgagagcacttgttctttctactacagcatgatgccttcttctgtagagtgggcgctttgcagaatacgtgttgaatgaaatcactgatctaggaaaagtaaaaattcctcaaatgaatacagaatacttgtgctactgctgatgatcaacactttatacagtgcctggtataccaaaggtagtcartaaatgtttgttgaatgaataaatgtgcattaaaatgctataagtgctcttatttaaatgtyttagtgttttatgttaataaaagaatatgtatttttactcagttgaattgtgactatagctatagatgtgcctatcatattgatcttctatgtagttgtattaattttggttgctgatgataaaactgctgctcatctagataagaaagggtctttggaacttctgtgctctttatatcattatttcaagcctggactatttaatacttgaaagtttttatagattaactactggctttctaatggactgttatttggaaggaaattttaaggttatcaactcaaacttacctgatgcttaaataagcatcaccaccattacaacatccactattactttcattattacatgccaagcacgatgcattttacacattgcctctgtgaatcctcatatatgatactgtatttgaggtattatccctaccttttcagttcaggaaacttagggtcaatgaggataagcaagttcccaaaagtggcaaagctagataagaagccaggtctgtctgatcctaggcccatgctcttttcacttattatactgtcctcaatagcattctgttcctgctttaatatgggtactcattctccaaacaagtttgtttcattcttgaattactcttattaatagaaagtttggttttttagaaataatacctatccctctgcctcttactctatagtttattatttattaaatgtctctctgaatcctagaaaaatgactatagacatagaaatttcatcctacttaaaacgggcttgggtcaacatttttgtgtatttttttcatcttttttccccccaccttttgaataaggttgtggcgtggatttgttttatataattctaacataattatgtatcctgtgtttrtttatttggctctccatcttgaacatttttcccacttctgtagttgccatttagaaatatatatatatatatatatatatwtwtttttttttttttttttttgagacagtcttgctctgtcagccaggctggagtacagtggcatgatctcgactcactgcaacctccctcagccaggctggagtacagtggcatgatctcggctcactgcaacctccctctcccaggcgcaagcaattctcttgcctcagcctcccgagtagctgggtttacaggcatgtgccaccacgcccrgctaatttttatatattttttagtagagatggggtttcaccatgttggccaggctgatcttgaactcctgacctcaggtaatccgcccaccttggcctcccaaagtgctgggattacaggcatgagccactgcgcctggcccagaaatacaatttttaattcactgccacatgacagtgaattctggggcgtagatttaccttaagactcctttttttactaggcattcaaatgagaagtaactcattaatgactatctttgtgcatacattgctttttgtatttagatacatactgaacatgattcctcacagctttttacagatacctgagttacagaggtttgaaatattgtacttacttgaaacttgatctggcttccagaaaaggtgcagtggttgcaattttaagaaggcagcaggtttcatcataagccatcttcatttcaccagtcctgtatctctggctatggaactttatgtcttagaggtggcaggatgggcatataggtagtaaaaggggcgtatgacccatatgtgatcgctgaggaatggataaaaagcaaatagaagtaygtaaacgtagatacccttaattactactacagagcttgaagagtgaacattttatttctctaaacagcttgttacatgttctttttaagttcagtcaaattgcataggaacttatttttaagtagaagatagattctgaagctttatgtatacggattaaaaattgaggctaaaatttgatcttattttaactttataatatgataggatttctagtgcttttaatacttcctctcctttcttccttatccaaagtcagctccctacactaaaaatacttaaatgcccactaatattgtctaatgttaaatgaagaaaactagttgcagagaggtatatatatatatatatatatatatatatatagtatgataccatttaggttaaaaaacacaacaaaagcaaaactatgtgcctggcatctcataggtactcaatatgctaactatgtacatgtgcatctcaacaaatctgaaggtatataatccagagtgtttggaggggttacctctgaaaagaggtgtgtgatctgaggtgtgtttttattctatatgcctctatgtttgaattttttgctacttttttttttttttttgagatggagtctcgttcttgtcacccaggctggagtgtagtggcacaatctctgctccctgcaacctccgccttctgggttcaagcgattctcccgcctcagcctcccgagtagctgggattacaggcgcccgctatcacgactggctaactttttttatttttagtagagacaggttttcaccgtgttggccaggctgktctcgaactcctgacctcagcctcacccttccaaagtgctgggattacaggcatgagccaccgcgctcagccttacttttttcttttaacaattaaaaaaaaaaaaaaatagaagaggccaggtgcagtggctcacacccacaatcccagcactttggaagcccgaggcaggaggatcgcttgaactcaggagttcaagaccagcctggacaacatagcaagaccttgtctttactaaaatattaaaaaaaaaaaaacaaaaaaaaactgaatgtggtggcatgtgcctacagtcccagctactctggatgctgtggcgggaggattgcttgagcatgggagattgaggctgcagttagctatgatcatgccactgcactccagcctaggtaacagagcgagaccctgcctcaaaaaaaaaaaaaggaagaaaactttacactctaaggataaataaaataccttctcaaataaacccactgcttctttataccctgaaatgcatgttgagcaacatgagacacattctaactctatagaattattgcttctttgataattcaagaaaagacaaaggcactgatcaaacttgtttggtgccatttctatataatctaataaggttgttgttgttgttgttgttgttgttgttttgaaayggagtctcgctctgtcgcccaggctggagtgcagtggtgcgatctcggctcactgcaagctccgcctcccaggttcatgccagtctcccgcctcagcctcctgagtagctgggaatacaggcgcccaccaccacgcctggctaattttttttgtatttttagtagagacaaggtttcactgtgttagccaggatggtttcgatctcctgacctcgtgatccgcccgcctcggcctcccaaagtgctgggattacaggtgtgagccaccacacccagccctaataaggttttttwaaatttttatttttgggatagagtctcactctgtcacacaagctagagtacagtggcgtgatcatggctcaccacaacctcaaaatcctgggctcaagccatcctcctgcatcagtctcccgagtagttgggactgcaggtgcatcatcatgcctggctaatgtttttttgttttgttttgttttgtttttaaggcgagatcttgctatgttgcccaggcttaatagggtttttaaaatagattattttaacaacacatggccaatcttgtatcatctattgctccccacacccaccccatttatttttaagcatatctcagatgtatcatttcatctgtaaatactaaagtatatatatccaaaagataaggattctttttaacacaatcaaaatacctttctcacacttaaaaaatgagcaatagctccttagtattaatcatttaataagtttttcatactttacaatctaattgttaactttcagtttaagttgctgttttatttactttcattactcatatccttcaagagttgttttctttttttttttttcttttgagacagagtcttgctctgtcatccagactggagtgcagtggcgtgacrcaactcactacagcctctacctgtcgggctcaagtgatccacccactttagcctcccaagtaactgggactacaggtgatgccaccacacctggttaattttttaaacttttttgtagagaagaggtctcacactattgcccaggctggtctcaaactcccgagctcaagcaatcctcctgcctcggtctcccaaagtgttaggattacaggcgtgagccactgcactcggcctccttcaagtatttttaaattaatgtctttttttctgttcaaatttagtgtacatgttccccccaagagttgtaatgaaactaaaactgtcttttgcttttgatgcctttgttcaatatgaaaagcctgaataaatggctggatgtcttcatcttcaaatttaaaaaatgattcaagtatatattattgagttttattagaatggaaagctcttaatttcttgattgtaatagcagtcatgcaagtcacaaatcatgataaaagttaattttgtcaagtgcttttctatatcttgtttgactttaatatttttgttttacataggtctctaattaacagaagatggcaaagcccagccacagcagctatgtccttcagcagctaaacaaccaaagagartggggttttctctgtgactgctgtattgcaattgatgacatttactttcaagcacacaaggcagttctagctgcctgtagctcctattttagaatgtttttcatgaaccatcagcatagtactgcacaactgaatctcagcaacatgaaaattagtgcagaatgttttgatctcattttgcagtttatgtatttaggaaaaattatgacagctccctccagttttgagcagtttaaagtggcaatgaactacctacagctatacaatgttcctgactgtttagaagacatccaggatgcagattgttctagttcaaaatgttcctcttctgcttccagcaaacagaacagcaaaatgatatttggggtaagaatgtatgaagatactgtggctcgaaatggcaatgaagccaacaggtggtgtgcagagccaagttcaacggtaaatacaccacataatagagaggctgatgaagagtctttacaattaggtaattttcctgagccrctatttgatgtatgtaaaaaaagttccgtgtccaaattatctactccaaaagaacgtgtgtcaagacgctttgggcggagttttacctgtgatagctgtggatttggctttagctgtgaaaaattattagatgagcaygtgctaacctgtactaacagacatttataccaaaacacaagatcttaccatagaatagtagatattagagatggaaaagacagtaacatcaaagctgaatttggtgaaaaagattcttccaaaacattttctgcacagacggacaaatacagaggagacacaagccaggctgctgatgattcagcttcaaccactggaagcagaaaaagtagcacagtggagtctgaaatagcaagcgaagagaaaagcagagctgctgagaggaaaaggattattattaagatggagccagaagatattcctacagatgaactgaaagactttaacattattaaagttactgataaagactgtaatgaatccactgacaatgatgaattagaagatgaacctgaagagccattttatagatactatgttgaagaagatgtcagcataaaaaaaagtggtaggaaaactctaaaacctcgaatgtcagtaagtgctgatgaaagaggtggtttagagaatatgaggccccctaacaacagcagtccagtacaagaggatgctgaaaatgcatcttgtgagctgtgtggacttacaataaccgaggaggacctgtcatctcattacttagccaaacacattgaaaatatctgtgcatgtggtaaatgtggacaaatacttgtaaagggtaggcagcttcaggaacatgctcaacgatgtggcgagccccaagatctgaccatgaatgggttaggaaatactgaggagaaaatggacttggaagagaatcctgatgagcagtccgaaataagagatatgtttgttgaaatgctggatgattttagggacaatcattaccagataaacagtatccaaaaaaagcagttatttaaacattctgcctgcccttttcgatgtcctaattgtggccagcgttttgaaactgaaaatctagtggttgaacatatgtctagctgcttagatcaagatatgtttaagagtgccatcatggaagaaaatgaaagagatcacagacgaaagcatttttgtaatctgtgtggaaaaggattttatcagcggtgtcacttaagagaacactatactgttcatactaaggaaaaacagtttgtttgtcaaacatgtggaaagcagtttttaagagagcgtcagttgcgactgcacaatgatatgcacaaaggcatggccaggtatgtctgttccatttgtgatcaaggaaacttcagaaaacatgaccatgtacggcatatgatttctcatttatctgctggtgagactatatgccaggtctgctttcagatattcccaaataatgaacagttggagcagcacatggatgttcatctgtatacatgtggaatatgtggagcaaaatttaatttgaggaaagatatgagatcacattataatgccaagcatttgaaaagaacctgagtgattttctactgtactaatgtttagatgatagcagataaaacaccaaagcaaaggatatgagctatttaggaattgattatataagatgatttgttagaaacaaatttcaaggcccttttaactttaatatttttgtttaggattttaagtatctacatttaggtattaaatgtttatcatttttgttgtttcttaatagaattatttgtttttagtttttyttagctatgattaaaatttttaaatgtagactacaagyggttgttacccattcaatgactattaaactttagtttttcatcaataaggtgatgacttcactatttctatgtgtttttttttttttaaggttatcctgtgaaattttaaacccagaatcattggccatttctgtttaaattttaaaaattccttaagtaattatttgaaactatcccgtttgcttttagtgagttaactactctttattcccccttattaatgaaattcatattcttaaattgacaagcttattaggcaagttaggtgcactgaatctaacctttaaggttgacatgggctcaaacttggcctaaaaagattgatgaacctgaggaaatttttataaatgaatatttcctataattgataaaatattatcatttaattatcacatttaaaacttatattaagtgtaaattccagtggctttacctcacttgaaaaattagtggggataagccattttgttttgtgatattaaatttaactatgatagttaattaaaaagacatatcttgtattcattaaaaatattttaatttaaaatattctgatttctaaagtgtgttagcttatcaattatttttgtttataaatagactttaatagctctctaagaatatgacctctaaaggaaaagatgattttttacaatacatacttctggaactttgagatttgagaaagcttccatgtatattgataaatctaataaaataaagagatcaattataaacctggttgttctataaaagtagagtgcacaaaaaaatgtcttgtgttttatactgtctaagatttggaggaaatgtggcaaattgcagtttatcgccatattttattatcatttttttctgtaaaagactataaaacttgaggattataaaataatcacagagtatatcaatggaaacagtttatcattttttcagttaaagtagtagtattgttagttgttgctgacacagggtctacataattacatgtgaattaaaacattggcaaaactgacccaccaataaacacatctattgaatagaatgccttttaatgtgaattacttgcaatgtagtacccttttcataatgaaagggattttaattaactcctaattttaaaaatataaatttgtgattctgaacactaatagcattgctctttttgttcacatcatatttaaaatatgcaaatcatattttgtatacaatttacataaaagaacaagttgccaaaagaactgagagacatactggtgagtacagatttagttgaaagcattagagcaccatgtgagctcagatttgtggggatatgttgaagtgttaagtaaggataggaacagcacaggaaccaagtgcagaattcaaataacgggaagtaggcaggggacgggtagaatacacacaaaaattaaaaatttaacagcaaaagcaggaaaagtgattcatcttacccttacttagatacaatagtttatcaagtaattaaatttgaaatccaacttaaaatgaaatgtggtatgtatattactgataggaaccagataaaagttctctaacccagagaccatcagagagtggtataaagagatcagataaaccaagtttccaaactacagtatatagtatcataatggacataatttatttgagatcacttttttcgtgactcatcaaaatttttcttgcagtggctttccccattgttaaagaatagggctttttctaaatactaccactttttgaagaaacgattatctattccattaggaagggggcttaatttagtcttttgatatgtactaacagctaacaattagcaagcaaatatataaactttactctctaattttacatgactgagatgtttatagttttagaaagccatacctcaacttattttttattttatttatttatttttcttttttgagacggagtcttactcttgcccaggctggagtgcagtggtacaatcttggctcactgcaacctccacctcccagaatcaagcagttgtctgcctcagcctcctcagtagctgggattacaggcgcatgccaccacgcccggctaatttttgtatttttagtggagacagggtttcaccgtcttggccaggctggtgttgaactcctgacctcgtgatccaccggcttcagcctcccaaagtgctgggattacaggcatgagccaccgtgcccggccacctcaatttttttttctgagtttcatgttacacagaacatacctttttgttttggagctagctacagggaagcacaggcttctctagagtggaatgtacaattcttatcaaggcaaaaagttaaagactacttgctttttaaaattagggagaatgaaaaatatccagcacttttccccagcccagttccctaatatctccttcctctcctggggcagagctgcagagctgtcattccttgctgttgcttcttgccctccctgggtgtgaaggtaatgaaacaagtgtgttgaagctgccagatcttctgcctttgtaacttaggtgttcaggttccaaatctaaaaatgaaaggagaatctacacagatatatagtggaatcaaattctctttctgtctcatgaacaccatgagactcttttgctttggcccttttattctacacagcaagaaaacccagaggaatggttagcaagcttgccatcaactatagtacaatacaacttgcatgttctacgattccttagtaaacaggactaagaatctcagaaattaatagagcacaaccaaggcagcagtagattaggactcagaaatgcgtcttcatctccccyatgtttttaaggtaaaaatattcagaggccaggtgtggtggtttgcatctgtagttccggctactcgggaggctgaggcaagaggattgcttgagtccaggagttccagaccagcctgggcaacataacaagaccctatctctaaaaaaaaaatttgtttaattagcagggcatggtggcatgcagctgtagtccccagctactcaggaggctgaggtgggaggatcaatagagcctaggagttcaagggagcagtgagctatgatcatgccattacactccagcctgggtgacagagtgagactccatctytgaaaaaaattagaaatgacgcacatgggttaaatggtatatggcaaactaacagtttgagtatggacaaaaattcaattagaagaaaggatcccagaggggctaataattwaaaaaaaaaaaaagtttgctagagcagtcaggacactaattaaaaggaaaagtagaggctgggcaccagcaccttgggaggccaaggtgggtggatcacctgaggtcaagagttcgagaccagcctggccaacatggcaaaaccccacctctactaaaaatacaaaagttaggccaggcgcagtggctcaagcctgtaatcccagcactttgggaggctgaggtgggtggattgcgaggtcaggagttcaagaccagcctggccaacatggtgaaaccccatctctactaaaaatacaaaaaaattagccaggcatgttggcacaagcctgtaatcccagctacttaggaggctgaggcaggagaattgcttgaacccaggagrtggaggttgcagtgagccaagatcacaccactgcgctccagcctgagtgacagagcgagactccatctcaaaaaaaaaaaattagccaggcgtggtggcgcgcacctgtaatcccagctacttgggaggccaaggcaggagaatctcttgaacttggaaggtggaggttgcagtgaactgagatcatgccacagcactccagcctgggcaacagagcaagactccatctcaaaaaaagataataatacacacgaaaaatcatgttttactgtagctgaaaaatatatgaacaggatataaaaattgaataaaaaacatttgaaaattataggtgagatgagtagggattaaaaataatatgactataattatagaatgcctatggaacaattttatgaacatgccaaggatatgcctaaataattgagatttttgtaagtaatgatgagagaggaaaaagtaattgagatattatcttttatattctaaaaaaaagtaggaagagaagctggtggtggttgacaactttttccctggttaaacaatactcatttctctaagtcagtagttaaggaactttgtatttaataaatttctggaaaatcttccccaaaaccagtttagccattgtaatatttaaattaaacataaaacttgtgtcgttgttaacaaaaagccaaatcactaccaaaagaaaaaaatctgagtgtatgtgcacacatggttaagaataaagaaatctggtatacctaattttaactgggtttttatcatgaattaaaagttaaaacatttttcttttcttttttttttttttttttttgccattcatctattttgatcagttagttcctcaactttccttactactcccatctcctttgtaacatatacttctcagtaataaatggccagtgctctccaracatcctagcatcaacaacttctgggaytgcagggtaccaaaaagctctggkggaacatacccttgtagaatccctcccacatccttgataacctgaggtgcagtaaactggggatgataggatgaatgccaggaaactaaaacaagtagggttatatttggtgttaagaacttgaaattgcatcccatatttggaaacccatgatccatccatcctagggctctcacttaataaccccagcatccatttatttagcactctctatactctgcaaagtgctctacatacataattttaattaatccccacagccttatgaggtaagtatcatactaattttccagatgggggactgaggttcagagagattatttttcctaaatcacacagaaactatgtatcttagaactggagtttgaacctaggtttctgacttctacattcctgtactccacctatcaagaagtacaaagaagggccttttcagcctagaaacacatgtgataaarctcctatgagattgtgctccttgttcatctgtcatctgctgtgctggtaaggtggctagtaatagtgggtacccaattaacatgctgaataatgtgaaaacgtgagtggaaaacaaaactttatttaaatggttgattcagaatgatgttttagaaataaatattaaatgctgttatgttttgattttccttcatttaaacttaaaacagttagtggtactgtcagcctttttgaggggcccatagtaggtgggctcaattaaaaattaatttgaattcaacttccacatttctatgtctgtgaccttttcttcctttatttcccctattcctgtcctttatgttttaatctctcccgccaatctccatttccttttattggttataagactgttgagttgaaggactcaaatcatttgaaaataaatattcccaagaaaaagcaggataacagaataaccagtttcctctttttgccttaacagattatgtggataagaaattcatcatcttagccaggcacagtagctcatacccataatcccagcactttgagagactgagttgggaggattgcttgagcccaggagtttgagactagccctggcaacacagcgaaaccccatctctacaaaaatttaaaaattagccgggcatggtggtgcatgcctgtagtcccagttacttgggaggctgtggtcagagaattgcttgagcctgagaggtcaaggctgcagtgagccgtggttgtgtcactgcactccagcctgggcaacagagcgagaccctgtckcaaaaaataaaaacaaataaattcatcatatctttgactaataaacagaagaacccccttccccagttaccataggtgattgatttgattaagatttatagagcaatctaagtttgcctaaaaacaaatgttggttagtctagccacttataattcaatttcccaaaatacctatggatttttagggtaaacttatagagacagttttactcataaaacaaatgaaagataatttcaggaaatgacacatagctgcataaccaccctaacctagcagcaaactttaaaaaaggttatttaatggtttaagtgaaacaatctccctcaatctaatattattttaactttatgcgtctattaccttatttctatactactatgttaaacctactactttaatgatctggctaccgtctgccaaatgtcacttttcaagtgagaacagaagaatgagatwgtgaagattcygtggacaatgtctatataatcatttaagtgttaaatataaactaaatgacaatagcagcttgtaaattaatgctaattctggctgggagcagtggctcaggtggctcatgcctgtaatcccagcactttgagaggccgaggcaggtgaatcagctgaggtcaggagttcgagaccagcctggctaacatgatgaaacctctctactaaaaatacaaaaaattagccgggagtggtggcacatgcctgtagtctcagctactctggaggctgaggcgggagaaccgcttgaacctgggagatggaggttgcactgagctgatatcgtgccactgtactccagcctgggagacagactccgtctcaaaaaaaaaaaaaattaatgttaattttgaacaaacttaatatcacttacatttatatgcacacaattggttgaatttagcattaagaagtttaaatcttacttaagttgttctcttattcaggagaaccaaatcactgaagtcaattagtagtgtcaaaattgctcattctttccatcaaaatctaccacagatcactaagggacagaaagccattataatttctcattatccatctcaattgctgaccaaaaaagatagtatgaagattacaattaaatacttggctctgaactgaacatatcaatgtactaatcattattgtattaagtgaaaacacaggaatgtctagggccaagggatgaccaaaatttaaaagattatttcatatcagagtcagggatattaataattttatgtgagaaaatttgcagtttgttttctcctatttgaggaaggaacagttaattatacagcttaaaaagcccctacttacttaaaaagttaacatgtttttattctccttaaactaactgctcatatcaaacacaatcaggagagctcatttttagatgatagaaacattaattctaagcatccagattatgaaccatcttttttttcaaatgcttatgtttaaaaaatttwaaaaaaattaaggatcttattatgagggaaaagcactgttgccaaaaatataattttactcagaatcactagggcagattaggaggcttataagcctaggaatttgcaggaaaacccctcctcttcttttgtgcgtgtatgtgtgtgtgygtgtatgcttcattttcatttgcagagtggctgaagacagtaaaaagaatatgaactttaaaaaaattgttagatttatgtttcaatcagagatttgtcattaacaagttaaagtacattgtaaaatcattttatttgaaggaaaacacttcttaactgcttccttcctccctactttcctctatttgtctgacccctatctttttttatgttatatatttatatgtcctgctgatagattaataagaacatcttatatttgaatggtacgagttacattcgggaaataattaaatttaaattctaggggctatgcttgtgtttctattctctrttctgttaacagtgtgttggcctagtgccaaagccaakaaattctgatctaagaattatgttgtatcttgtagagcagtcaacttgtaatattatttttcttgagttttgtctttttctgtgtggcagtggtgaaatagggccttctaaacctgtggagaagtgagagatctgaatttggagaggacatggggaagaatcaatcttcaacagataatctttaagtacagacccaggaatatcagatctgaagtggcaccatcttttctgtcttcctgacaaacttccatcaacccaaaaagttccagttgcaaagatccaagaaaactcagtaaagatcactttggaatcactttgttgtaacaaaattgattcatggtgactctaatatttgtgtaaatctgctgaagaaaagtaactagaaaattcatacaacatcagtggttacagctatactaaaataaaactttatatgctaattatcttcaagggtctttctaaaataaaaggggttgttaggctactgcaaatataaagagacataatcacaaatctatttatatagatataaataattctaaacttaaaatcactagaattatagcttaaatattatgaaatgtacttagtcaacttaaaaacttacaccaaaaatctgtagtttagagtgtaagaagtaatgggtacagagaaaaaaaatttaagaccaatattttaacaggataatttggttattactcactatagtaaaacacttgcccttcttccttttccactgtatatgccagtcacaatcttgatcatttatatgaatgaaactcccttttaaacctgttaacttgaaggagaacagaaatggtattacttcaatagtggtagatttccacaaatcagacacattattttcttctgaacttggcaatataacctaataaggcagaataagtttctgttaaaatacttattctcaatatttatgtataaaccatgcttctcagctttcaaatttcaagataaaatttaagtattcagtaaaatgatggttaacatgttttaaaaaatctttaatggagaagttaaatatttggtgagattttagtctggctataaatgctttgtttgatatatatatgtgcacatatatatattacttaaccatatgaattttatttccttattctgaatatacttgtagttttacttctttctgtttatgtacccaattccttatgattattttgtttcttctgcaatatcaagatgttatttattttgagaaatgcttatttttatgactatttattccaatgttttaacaagaagcacagagatttatagtattcttaatagtatgtgcagaagttacatcatttaaaaaacccttgctgtaaagtaggataacttgaatattcattctaataattagactaagtgaaaatctgagaaagagttaattgcaatgtgatagtgggtagaaaggagagaaaaacccactraagggttcaaatacatgtgaattcwactgctttaagagaaataaaacaaataagcctagggaaatattagagtctaaaaaaccctagagttamtctcttttgggaacataaggaggtatacagaactgcagacctctaaacataagtaggaaaaagaaaaataaaagaatattaccaataattaaaggtgccagatcaaaatagtaataaatcaacaaataatttttgattgactggtggaattagatttactaaataaaaatggcttaaattttgactgtactaactataaatgtaatgaattataataattataaatggtataaatgcattctacaatgtgattattttctgtattttagtatatagtataaaatggaattattgggttaaagtacttttattacatttcttaatccattgtttttacctaataaaatttcctcctctatattccaaagttaaattgtctgtatattacttttatttatactgtattttttccaatctggccatttaaaaaaattattagtttgaaaattattaactccttccatcctctaataccacaataataaagtatctgatatagctaattatgatgttctcaggtagcttaagatgtgcacaaagagaattagctaaaattcttattgccagatcctgatttctttcaatatagaagaatgatctgttactcagcctggaaagtagtgccaagattatagctcactgtaacctcagacttctgggctcaagggatcctcccaccttagccaccctagtagctaggactatagattcccaccacgatgcctgctaatttttaaaattttttgtagagatggggtctccctgtgttgcccaggttagtcttgaactcctgggctcgagtgatcctcctgcctttgtctcccaagtgctgggattacaggtatgagccactgcatctggcctggatttccttcttaatacacaaagaaataattatttataaatatccattgataaagtgtttagctctttcagaggcttaattcatttttcaagtaaacacaatttactgtcagagaaataactactttgccagtataattcatttttttttcagtttaagaattaaataagtattaacaataattgcatattgaatctgattctccaagtataggacagcctcacttcttccagattatttcaatctattccacaagggtctataaggttagcactaaaagttgaagtaggtataatttgtctgctrttgtcatagattaacttctcttttggaaaaagccttccaggttcaggtctcttacccttccataccaggcatggaaatgtcttaccccagcctactgtgtatctacagcttaagtgtaacttcaagactgaattttttaagactcaaagaaacaaatggcaagttttttcctgtagtgataggtgaagaaatattttaggacacagcactttgtaagaattataaaatggcagtatttatagagatcttaaagataatcattagttgaatttcagtttgctcaagggccctcaaattagaggctgttattccatcttttcttcaggccaacattatctccttaagataatctacaacccttgtgaaggttgttcctgggtagagactgagaggattttaggaaaattcacgagttggggtttttttccctagtaattctgcaaaaatgtattattgctcagtctccttagggcaggtctaacacccaggcacatagttttaggccgtatcttattcacctttgtatctctagtacaaatattttcagatatgaatttgtttcaacttttggtctctgcagtgtcatttagtacagaaatataagaggtaggcagtgtatcttcctactataaagaaaaaaactaaattttttttttgttaaataatgtgtctcaggtcacttttaataaatactaagctagtgatttactactgctttccaggcactcttctgggtgctaggaattaattacagaggatttgacatatgttaaagctcttgttttttccaccatttaatctgtggagccttagtctttggattttaaaaatactttgaaacaccctagtatttataatctgccaaagagagagttcacttgttgaaaatcagcaataatttctatgtaagactaatagactttgtttcaactgttgatatggtttggctgtgtccccacccaaatctcaccttgaattgtagctcccataattcccatgtgttgtggtgaaagataattgaatcatgggggcggtttctcccatactattctcgtggtagtaasagctgatggttttataaggggaaaccccttttgcttggttctcattctctcttgcctgctgccatgtaactggtggtagtgagtaagatctgatttttttttcagcatccaaaatctttttattaagagggtaggatccaaggttagtttttgtagcctcggctggcctgtcggcctctgatgcactcgaacttccagcccttggagcagacatagggtttggtgtggctgtgcggggttcccgggccttgctgaaatgctggtacacctttcggcccttgcaaatactggagagcaggacagtaccgcagccctcgggggagtccaccccttttgcttggttctcattctctcttgcctgccgccatgtgcctttcgccttctgccgtgattgtgaggcctccccagccatatggaagtgtgagtccactaaacctttttttcccttatagattacccagtctcgggtgtctttatcagcggcgtgaaaatggactaatgtagctgttaatagtcaagttctcaaaatcaattgtaaaagcacagtaaggaaacttagaaaaattactgataattctaccttctagataaccaattttgatgcattttaaatctatattagattatcctacatataagaagatacaagtttcatatattttattcacttaattataccaagaacatttttccgtgtcattaaaaatcttgtaaaccatttttacggctgcrtaagaattcatcatatgcatgtactataatttaggtaatctcttatttttggatatttaaaccatttcctttctattatcattaacataaataatactacctgcattttctattatttccttagaataaatcccacaatgagtaatgctaaataaaaggcatgatcatatttaatgtaaagaaaaaatattggccaggtgtggtggctcactactgtaatcccagcactttgggaggctgagactggtggagagcttgagctaaggagttcgagaccagactgaccaacatggcaaaactccatctctacaaaaatacaaaaattagccgggcttggtggtgcatgcctgtagtcctaactactccggaggctgaagtgggaggatcgcttgtgcaagctgtgagcctgccactgcattccagcctgggtgacacagcaagtccctgtctcttaaaacaaacaaacaaatttttaaaaacccaaaatacaaatacagtgtcttttttgggaaaagcttaggatgcctcttaaactatggaacatacaaaacacaagttagggcagaaaaaaatatacatggctaatgaaaatgtgggtataattgctactgtggtttcagaaacctgtgttaaagatgaatgtggtggtcagattgcaagatgtgtttgtaatatctgggcacagaggtagcacagttattgtgcaaaagaaactattcctctgaagctctaattttagtgwttctatgtgagaactctggcctgcttgctcttttgcaatcttggtttgcttgaggtgtgttgagggctgactgaatgcaagagatttaaagaatttgtgtttctcacattctttgtttcagttgtagctgagactgtatctctmagtcatatatcatcagttctacaaagaatatgcattgcttccagcccactaattcccttttctaaaaaaacaaagaaaagaaaagaaagaaagaaagaaaaagaaggaaagaaagaaagaaagagaaagaaaagaaaagagagaagaaaaactcaggcctgtaatcccagcacgttgggaggccaagatgggcagacaatttgaagtcaggggttcgagaacagcctggcaaacatggtgaaaccctgtctctaccaaaaatataaaaattagatggacgtgctggtgcacataagtaacccagctatctggaaggctgaggcacgacaatctcttggaccaaggaggcagaggttgcagtgagccactgcactccagcctggcgacagaacaagactctgtctcaaaaaaaaccaaacaaataccccccacccccaaactacacaaaagacaagaatttccaagaataaaatcaagagatctgtactcacaatttatgacagtttcaattagaaaagtctgggttttatccttgttttcctaatattttcttttctttttctttttttttttagacagagtcttgctctgtcgcccaggctggagtgcagtggcgtgatctcagctcactgcaacctctgcctcccggattcaagcaatcctctgcctcagcctcccaagtagctgggattacaggcgcccaccaccaggcccggctaatttttgtatttttagtagagacagggtttcaccatcttggccaggctggtcttgaacttctgacctcgtgatccacgcgcctcggcctcccaaagtgctgggattacaggcatgagccaccgcgtccagcctttctaatattttctttaaaacgtcccctttttcaaaattttttcaaattcatggaaaagaggataggaattatggttaaaattagtactaactgatgacattaaccgattaataaccaattaygttcttaaaaactggaaatgatatacaccactagataaaataatcttaaatgttcattgactttatagaattctctcaacattactttttggtcacagataacttctgggttgacaaaagcttttctccagcgccatttcatacagcttttacatggctgcacatcactagcctgctttaaaggacggtgctcccagcccaaagcctcaggaaaaagaccatggctcaaaaagctctgagatgtatcctatccacctgaagagcctattgcttgcctgtatccctcccttctagtgacactaatcttctgtacagaaatcctagtccagcaaacattgctctcatcttcgcccatacacaayctatgtaaagaatggctttcctactctttgctggcgaacttcagctcccggattaggcatgccacctcttccaggtagctctcagcaacgcacttttccatcagcctgggtgtgcccctctgtgttcccatggcgctttgctttcagcgcttctcccaaattatgtttacctgtttattagactctccacctctgaagaccaggccatttcatttggctttttactgccacgtagtaggtacctgttcaagcttgatggaaggacttccccagcctccccacacatattatgtaaagtgatcgctgtctttgcttcctcctggagaccatttattttatttttttgagacggagtctcgttctgtcgcccaggctggagtgcagtgtcgcaatctcgactgactgcaacctctgcctctcgagtagctgggactacaggcgcgcgccaccacgcccggctaatttttgtatttttagtagagacggggtttcaccatgttggccaggctggcctcgaacttctgacagcaagtgatccacctaccgcggcctttcaaagtgctgaaactacaggcatgagcctccacacccgtccaggagcccatttatatgggagcctgcttctaaagattattacctggtgccagggtattttccagacctgtcctcacattcctgttaaacaggaggaagtgaatcgcgctccttttcatctaccttctcggagggtttatgcctccaatattaacctcagcacagccaaagaaaatcattccattccattgagcggagtcagaaacatgactaggtcacgatcacaaccccgtgtgtgccagggtgaccgagactgggtgactttatggtgtttcaacgtgtgggttttgactgattatattatgggttttccagtcaaaaactcaaagcagtggataaagcacttgcgacctaaaataagcaatggaatgaacaggaaggcgaaaccagagtttaaagcggcaggacaaacaggaaaaaggaagagtgaggcaggaagggtttaaatgcaggctcctcggaggacaagtcgccgccacacccctgtctgccgtcccgccagccgccctcacgcggcgcgggaaaacggtcggcctcgccctgggctcaggttctctccgcccgccaggcagtggggtttttttttg

SEQ ID NO: 13504 - DNA, 37907 bp, Homo sapiens
  misc_feature (1)...(37907): n = A,T,C or G, or insertion/deletion polymorphism (see Tables 1-2)
taaatgtgatggccctgagtcaggctctgggctgcttctgttgggaatggagggttgaattgggcctggtcaaagttctcaaagtcacccagcttcaccccaccagccatggtgcgcctgaccttgtccatggggtgtgttgttgtcactttggagttgaaagctccaggcagcatctagttgtcatctctgctgctctctggtctcatgtcctgtccacatgggctgttggctgccctttggtcaaacatcttgtcccacccagcctgaaggactgtttctaaatgggtagattctcaatggttgaagcttttcccctactaggttcttcctcttactcaggagccagcatcagaacctcttacctagagttagttgtggtttttcttctccagtggtatctgccaaggccccactgacctttggtttccctaactctttcttttccagttgtttattaagtgatgcgcataagcctttgcaagctacaaaccctccttcatcattgtgggacttagtcctcatcacaatgagggcaggtattcatggctcccattttactgatgaggaaactgaggccgagagaggctaagttgtctgcttaaggttatgcagtccataagtagcactgctaggtcaggtttaagcctgggccctgttagtctagactctagatcgtgacctctgggcctctgggtcccaagtctgtcctgagagttggatcaaggaacaacaggttgtgaaggataaacatctgcccaccactgcctctcctggggactctggagtggagaagcctggagccctggcttcagcacaccttatactcccattgtgagcccaagggacctagcataaagttcaaccacctgcccctaaggacygggtgtgccgtgaaacacagctgacatttgtgcagcactacaggtggtgtgcggagcacctcccatgctcatgatgtttctaatcctcccaaaccctccctgaaaccagaaaggggtgaagagctgccactatctaccaacaccgagcacctcacgggaaacagtgtctcaggactttatgcctatttgagtccaggagaataataatcatcacagtattaccagtagtactaggaatcatcatcatcatcagtagttaacgtgtattgcctgcatgctatgctcccagcaccgtgtttatttaatcattacaatggctcttcgaggtagataccattatcatctccgttttatggatatggaaactgaggctcagaaaggttacttgcccaaggccccacagctactaaatggcagagctgagattcaaacccagattaatcttctttcaaacttgtgattgtatccactatgccaagctctgcgggaaagttctggctggccaatcgctggggctgggattgggtgcactgggggtctcagctgcaccagctgatgccctcacacagcctcacagctgcacccactcccctagggatgctctaaagctgggctcaagcaagccctggccagaggtcctaaagatgctgactggggagtctgaggtgtctacaaatgtcttcatgacctacttcaaacccctactgacctggctgstgacagaacatgcagcaaggggacatcttaggctggccagacttcagctgttcctttgaaggtttgataatctgaccctggttccagctctgggccagccccaggctccaccttaccctgctctgtcctagtacctamccctacccagccttaacccctggctcattcatgacctggcttgaatcaacagcactgctgctgtgggaccctgtctgtaccaggcctgatgcagcttcagccaagaccaccgctcccaccacagcccctggctcagttgcttccttgcacactgtccagctaggttgccaggctgacatctgagcaaaggatcagcatcttgcctctggtcccttgcatgcaggggcatgtagtccaatcagatctcctctgacagccacaggagaccccaggggtccctctccagttctacccaccctatgagactcctatgtcttccacagaaaaagacacagacaaagtgacattcctgagtctgaagctggaccccaaccaggctaaatttgggtactgggtgctgttggccctgggctttgtcatgtctctggtggtgctggggctggcctgcaggctgcagtccctggaaaaacagtcactgactcaagacactgagatattcagcccactgcccaatgcctgcttcctgggcatagccatggaaccctgccaggctgctaaaggacagtggatgctgctgggcctctgccttgtcctgatgctgtgctcaatcagcctggccatctggattttcacacagtaaagcaggaagcctccaagggtaagagctgaatggtgaagttgggactagacaccagtgaactggtgaggctggggggcaggaggagggaggctgagccagagagttggggggcagaggaggggacagcctgcatgcatagtgcccaattataattgggttcagctgtggcagatctgggtacatgtgatattgtaattgtgtgtttgcaaactcatgtatgtgaggctgtgtgcacaaacaactggctctatgtgattctatgtgtgtcctgggtttcaggccaaactccttcccctggtggctcaggacctaaggttttattgacccagtggctgtgtccctgcaaaccagcccccaccccaagtcatgcccagaattggttctgcacacagccttgtttttttcagtaacccggctatgggactgcagtgcccaaggaatttctgctctggttagaaaaaggactctgcttcagtccacttctgctctggttagaaaaaggactctgcttcagtccacagtacataaaatgtactcaggtaggacaggacattcctttacgaatcaccagtgcccagtttatgagcactgtgcttttataccaaccagcacatctttctgctaatccttgggccagccctgtgttggactacataatccagcccccaaaagctctttgttgaccagttgagatgtaagtagcctcacaaactgccccatggctctctctgccccagcccaagcccttccaaatggagacagtgggttgctgggcattgagccaggcttgattaatgattgacttctttaatatttaaacaaagctcatctccaaccactctgctctggagatggccttgttcaacacacacacacctgctgcctggcccgttgccctggggagcgagcataggacaaacagcacctttycaggctcagtgggggatggggaggacaggaaggagggaactgtaggagaatacttgggaaattagtgctctagaaacaagcctggggaaagaacgggaaggcctctgcctctgcctttcctagttcattatcctcagcctgggtctgcctgccatgaggatcctacattcaatattggggattcagagcgtctggatggaggttgcatgggctcctggggaggctgggagtcagtgtctgtcagagaatagggaaaacttgaggggaaagggcattatagccagtaactacagagaasgggtaccccggctgcaactgagctggtgggagggtggccaaaagaggagaccaggtctctctgaattaagaatctgagccccaaactcaggtgttcaggggacagagatactaggctgagatctccatggaccctgcccctgtccaggtttcaaaaggtctttctgagatctggctgagcccaagcacttgctccagccccaggctccacagcacccttgtttgatgactctgtccctgctcttacttttctgtgccataatgtccttatttgtccctattactagctatcagctctataagagctggatgcacatcaggagtgtgcccctctgtaacaactctagtcagcacaggccatggtgcacaaaagggacttggaaaatgatggaatgagtaagtgaatgaatgaatgaatgaatgtcccactgcccaagtccctcctcagagctcagcaccccatgtactgagctcatgagaaatagccccttcttttcctccacagccagcctgtccaacagaggggcagccaggacatctctgccctcttctcatcccccagccacagtggccaaagaggcccccactaggcactgtggctctgcatgacaaacacacatccagcccaggactctaagcctctcacctggactccagtaaaaaccttgctgagcctccttgtctatccttcctcccccacccaccattgtaaagtttatgtcaccagaatatttctttcatgtctaattgcttaagaacttggttgttcatcaattaaatctagatgttcaaaatggcatctgagggtctttattaattacctccttcctccaaactcacctctcccacacccccttgttccccccaccccagcccctctgcactgacatcacctttggcctttgcctraggtgcatgccccatttgaatgcttgccctccaagatcaggctcaaaattgctcaccaaaccctctgcagcactacaagcccacccagatgctcagtgaacagtagtccccttctccccttcctctccaggaagcctctttcaataaacctattcccacccccatttgctttttctagtgtgttcattttcagtcagtactcagtactcagacacttttatcagtggtcacttgctaataggtggttttaaatctgttctccttccaagatgtacctgtatgctaagagctctcaggcctctgaagaaggcatcttattgcatacttctttctttctttctttttattttcagatggagtctcgcgtctcgctctgtctaccaggctggagtacagtggcgcaatctcggctcactgcaacctccgcctcccgggtacaagcgattctcccacttcagcctcccaagtagctgggattataggtttgcgccaccactcagctaatttttgttttttcagtagagacagggcttcgccatgttggccaggctggtctcaaactcctgacctcaggtaatctgcccacctctgcctcccaaagtgctgggattacaggcgtgagccaccgcgcctggcccttattgcatatttcttgcacgtcttcatgtgtactcctaccccctcctctcaggaccaggccctggctggacttggcggcaggagctctgcatgggacctaggtctcagctgagctggagatcacttgctataagagcaggccagaggcctaatggtatcattgccagggtcgggcccagtggtcagacccggaagaaagctttcagccaaagaccacctgaggcccctaacaaccccatctgtagcccccctcctgcctgggaaactccctgcactgggaggggagactgccctttggtactgggagggaatcggagaggtgctgaggccattggcccttaggacaggaacagaagcagctcctcagagaacacctgccctattccagggccaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngcgcctgtggctccgcgcaggggccgcggccgaaggagccggtccgcaggggccacgtcgctccccaaaacacttacctggacaccatcatccgcaagttcgagggccaaagtgagtgtgtgtatgttggggcggggggacgatctggagtcctggttccgtgaaagggggggctggacccctttactaacttctaaccgggcaaggtggtgagtgccgggtgctgaatgaaaaatccttcttttgatgtccccaacaccttctcctccagggggacccgcttgccttaaatgctgtcctcttttctggaacacaaggagcagcgtgcaggccttccctccctactgccagctgtttccttggtgccccaagttcgaacctccccttccagccactgcctgccccctcatccgcgtcctccagaggcttctctgagtccttcttttccttccttttcatatcctggytctggtcttcccaggagctttcccaggcctgacccccatctggkcacatscctgcctcccttccccacacttttcctgtttccaggaggccttgggccttccttccacctcaagaccctcactgccctagtcttcccacaatccccaggcctgactccctccctcattccggtcactgccctgctcctctgcctaaattccccttactgccaccaagagtccttatgatctttccctcccagccgctggatcctggctcccatggactttttgcctcccacctcccaccccaggtcggaagttcctkattgccaatgctcagatggagaactgcgccatcatttactgcaacgacggcttctgcgaactcttcggctactcccgagtggaggtgatgcagcaaccctgcacstgcgacttcctcacaggccccaacacaccaagcagcgccgtgtcccgcctagcgcaggccctgctgggggctgaggagtgcaaggtggacatcctctactaccgcaaggatggtgaggcatactcaggccagaggctttgcagggcaggcttggccctctgtcttgtccagccagggtggccttggggaaggcactgacccagggtccaaagggcctgaacaaaccctgtttcttctaggggccttggttcctccacaggcattggatatgatgccttctgaggtcctttgcaggagctagggatcaggctgggccacccactggtyctggcctggggcagggcctcctgctctgccatccctctgctgtgtccctggtctcctggctctccactatcttactgtcagccccagcggtcaggcagctgggatggaaattaaccttccctcctctccgtctgctccaaggattagaggaggagtcacctcctgaagacctctgtggccaggcaaggcatgggggcttttggctggcaaagtggggtgggcctgccttatccagtctcagctctttggggagacagggtctggagttttccctgaccaagaagctcattcagatggagtttgggttgttactgccagctggagcatactgcaagcagaacagaagcrtaagtcaggagctgaagacagatctcagcagcccttggaaatcctcccccaccccccaggaccacagggtcctcactggacctggcagcatgggtgggaacgaggaaaagagcctgaatgtcctgggaaatctcttgaatcaatggcccccaacctggttctgcatcagaattacccagagcatgttttccaaaacatgctttctctacagagaggctgactcagaaggtgtgagatgaggccaagcgggtgtatttggaaatatctccctggtggttctgatgtcctgcttactttaggaaccactggcttaggtaaatcccttcatttcatagatgtggaagggatttgcccaagatcccactgctagagtccaacctgggactggaacccaagtctctggattcctccctcggagatttcttttgagtaatcccaagaggagagaaaggaccccagctgcctttgtgtttacaggcaggatttctggggaaggaggtgctcaggggagagaagtccccagggaaggcaggcatgaggccacctgagtggagataaagaatggatgtctctggatcgggaccgaggagtgctgagagaccaggtttcaggggcctggagtgtgtgaaacatgagcatgtgtgtgcttgcatgtgtgtgcctctgtgtgtgwgtgtgtgcttgcaagttcacgcctgtgtgtgtgtgtttgcaggcttctcagagttacagcttctcgggtaggtcctggttgttcctgctgctgccacttgagtgagtggcagtgggaagtgcaacaggcagcggcagccaggaagggactgggaagaatctggcttagtgtggcagtactcacagggttaatgaactcagaatatttttaaaagctgtgacctcacctcctcacatcattgcagaggagaggtggcagtcaggggagtgagaagggtcctggggaacaggatgggacagcaggaaatgggggttacagcaggtcctttcttttcctctccttgacactagagctatacctgatcccagattcctagggatgtcaggtgatggctcttgaggtcccctcagcaccctgaaggtgtctgggcagagggcagaagtcaaagcctggccttggccccctgagatcaggactcagatcagaatcctgtgggagtcctcaggtctcagaagggaacctaggaaccttgtcttgggggctgaccctcggtgaaaatgggaaattgcccacatacctggtgccccataagtcccaatctactcccatcccaccctcggcccttccctatcttattgcccaaggctttgatttacctggaccttcctgaaattgtcctgaaacccagaaaggggagcttcctggcctgcattacactaagggaaggatattgtgctcagataactgatgttcaccttaaggtccactctgacctcatataatccttttttttttttttttgagacagggtcttgctctgtcacgcaggctggcaagaacatagctcactgcagcctcccatcccagcctcctgagtagctgagactacaggcgcgcaccctcacacccgactaatttttwaattttttgtagggatgggggtctcactatgttgcccaggctggcacatgatccatttttgaccatattcatgtacacttacagtcctgctgaggggcatcctaatggtgatttctttcctcctcgggtcagtacctcccttccccccaacccccaactccagggaggtgggaaggggtcctgagcagatctctagctgatttatgtataatcctcttttcctctaaaggggtaatccactgaaaattctcgaagtcaaagtggagggtttgtgttcacatagctccacgttgtgcagctacagacatttgggctcaaasaggccagggcacttggcaaaaataccccgggagacatctcagagacccctgggaaactggctcttcctctatttgcctttgctaggagtggtgagaacctaacagataaggaggaatggggatgtggcaggactagaactggtgagagtttggcaggaagaaaggagagcactcagatccccccactgtcacccacgcctgccccgcactggcacctgcccgggagcccaccccagcctgcctttcctgggtcctcttctctgaggatcccgaaccagagagtcccctaatccccaagccagatcagaggagtcctgggacttctccagtcctcagctcttgatgaggaggatgggacaaggggctgctgtctgcccccaccctcctcccatgtttaccatatgcacatctgtgaatgccaggaggaccaagctaggaggcagcatgcagcggccaccctctcagtggcagctttttggctttttgtagcaccagcctctccctggggactcaccacagtgctggrtggggtgtgcatcgggagacagaggtgaagacaacaaggaggttgtgagtgctgggaaactgaacgaaggagcacattcaagagggagagaagaggagagagaattggggtctcccaggggagagaagtggggtgcctttgctaagaaaagtaagaacctagcatataagaaggaatgggaattcccagggggcagacaaacctgctgcccttggtcagaaaggtgggtgctgggaggagctcctgcaaggaagaagcaggcagagactgtggctcctcctccagggccctggtgagggcacaggaacaccatccctcctgggcataacctgagatggtacagttacccacttttggtcacctagatgtgggcttttgttgtgtgggggctctgagccacgggtaagcaaggacaacctggggcagggggagagagaatgctctggactcttccaaatcctcctagcctcctgtctgcctacccaacaggccacaggcatgggggcagggcatggggtaccacgcactggcaccccaccccagccccagmcctcactgctataacgggctggtctttggtccattcccagccgcagttttccaattgcatcaattttccagtaacatcaattgctgggtgcagccacgccaagactgtgtattgacagcccccagcagcttagagagccctggaggccttctgcccctctgcccagctctgccctctccctgccccctgccaggacagatctctgcagtgccagagagattgacaatataatctggccttaggagcagtgtccgaggccactggccaaggaggctccctgtctaggtcccagcgtccacgtgtcaccatgccccaggctgactggagttatgggcttgggcctgggagtctgggcctatagcactatgtgcccaggagtgggtgaagcaggcaggcgcctctccccagtgtgggtgtctcccctgggcccaggcagcagatggtagatggctgcctggtgcctgggagtccagaaatccaatacgagagattcctactccccagggaggaaagcgagagggaggatatgggtggctcagctgcaccccagctctgatggctgtgaggaggggctgaggacgaaacaaggagtctggtggagagtcattccagtgagctccacagcagtgatactcccaccagcggccggcctgcgtcccccacacgtgggcttccatacattcagtcaacaaacaacacctgggacaggtgaaacagagcctaacctgccctcagggagtgcagctctgccttctcatctgcgtggtcacctgaggcccctgccccctgaggatcctgccctttgggcctgacatctgccaacagtttgagttgagggacataggactcccatggagagggtgctcgtggggtgcctggcctggggctcttgggtatggggtattttggttggttggttggnnnnnnnnnnnnnnnnnnnnnnnnnnnnnnnnnnnnnnnnnnnnnnnnnnnnnnnnnnnnnagtgcagtggcatgatcttggttcactgcaaccttggcctcctgggttcaagcgattctcctgcctcagcctcctgagtagctgggactacaggtgcgcaccaccacgcctggctaatttttgtatttttagtacagacggggtttcaccatgttggccaggctggtcttgaattcctggcctcaagtgattcgcctgcctcagcctcccaaagtgctgggattacaggcatgagccaccacgcccggccaggcatggggcattttagctggtattgttccatccaccaaagggggctgcagccagaccctggaggggcagagtctacgacctgagaggcacagagcagccagccgctgggtgtgggctgcccaagataatggggaaggtggccagaggggcctgccctgcccccacagggccatcctcctccctctgtggtgcccaggccactactctgcctgctccctgggcccagccctgccttgggaccccacactcctcctaggcccagagcagcagcctggttctggccccagcactctcctcccaaacaagtcccttcccttttccaagctattgtgtcctgcaaacccagggatcctctctccatgctccctcccagcccttgaaagtcagtttctgagaacctcaggctctcttctgcagaatgggggtccatgcctgccccccaaggacctcctgaggccaaatgttccaactggccccatgcccagcacttagtgtactttcaacaacaaattcctccctgcatcacaggagcagggcatctttgcaggatgggaatatgggaagagcgcccagggccaacccagctccatggggtagaatgcccagcctcacctccccacttaatccacccccatctgctcagctttaattacagcagaagcagacctcgaggttaagctctgagctgatggccgagcgtggacttgggcctgatctgatgctaccttatctcctaataagcagcttaaccgctctccccacctctgccctgtgggtggagcaccagctgagcagcctcacccaccctctgcccagtatctctggtcactgtccaagcctcttcacccgtggctgcccttcacttgaccttcactcagccccttccctagccaggccactgcaggaggggaccccttcagggcccaccccccatcctcccaatggtgttcgcagcctccagcttccgctgcctggtagatgtggtgcccgtgaagaacgaggacggggctgtcatcatgttcattctcaacttcgaggacctggcccagctcctggccaagtgcagcagccgcagcttgtcccagcgcctgttgtcccagagcttcctgggctccggtgaggcagagtgagggtggtggtgggagggacgcatgagggtcccctggccgtggctgctctkactcctggccctggtttcagagggctctcayggcaggccaggcrgaccagggccaggcacaggcaggggcaagtacaggaccatcagccagatcccacagttcacgctcaacttcgtggagttcaacttggagaagcaccgctccagctccaccacggagattgagatcatcgcgccccataaggtggtggagcggacacagaacgtcactgagaaggtcacccaggtgcgggcctgcagagcagggtgtgcagagctgtgccaggcctccagggtcccctcccaggctctgggcccaggcccttctggggccttggccgataaagagatcctgcctgtccagcctctaatatctggtttgagccccgggcctcctgtcctgtttgagacctaaagacctgaaggcctgccctgaggtcacagcccttgtgcccagctcctagagccagaggaggctggggtcagtagggcctgtgaatgatgccrcctcctaggcctggagaagccagggcaggggatggacatggaggccaccatgggggcctgaccaaggctcagcccgtcacagggaaggagaggcagagaggagacatgccaaggccatactgagaggagagctggtgtgggggggggtcccagccctgtgccagccctttgcctttgagacaaaagccaccctccctacttccttccaatgtgaacacaggatcctcctgcatgccaggcagggcaggaygaggctggcacctccagctatctttaatcagcttcctgggggccaggccctgaaggaccccggcagctcctccttggccaccccaaggcaggcttccctgggttctctgctccagctcaccctgctgtcccttctcatgaggccggaagccctgaccattccagagggaaatgcgaggagccctgcccgaggctccagtgaccacagtcctggcactgactccctgtgtgaccttggccaggggaactatcagccccctttctaggcctcagggctttcatctgcaggagasagatggactaaatggtctctggggacccatttgacattgagtagttctggccccaggaggcagacaaagctgtaagtcatagccaggggcccaggccaaggttgagcaatgcagagcatggaggggcctgctcccagctttcctggggctgtccctgtgttggggctggaggcagctcttttccccctgcctgttttcacctaaagcacagttgctgctggaaccaggtgtggggaagaccactcagcacctcactgacctcaaggatcctgaggagggtgggacgccaggctgcaggactgtgtcctctgaggtcaggcagagtggcccaaaggcctgaccctgggaagccccccagctgcttactccaggacatcttaggttgatgccactgttggtggctaccacggagggggctgttagactggagagtggtcggtaaagacagccaggcctggctgggcccatagtcccggcacctgcccaacctgcctacccgtttgttcctcagcttggcccctcttggtgtcactcccctgctccatgtgggtcctaggtccagggaggtgcctgacagatctcaggggaaagagcaggcgaggacccagatcagggaagtcacatcggcctcaaccagaacttaaagagcctcgatggctgtggcctcacactggagcctgggcatcctgagggccttgcagctctgggggacactgggcagggtgggctttgccacgaagagcctcgagctggctttggaggcagtgggagattttgggggtccccctgtctgggggccctgagragctgaggaactctattctcagcctactttaamccaccccccaccattccttctgtctccctcccactccccacccaggcaggcctagggaagggccttgtttcaccctagcagggtcctagcagccctcaggaggaggaggagcagctctgatgcccagggtgtgacggcagctgctcctgatcagagccccagtttgcagtgctcattcaaggacctgcagttgagagcccatgtggaccaagagctgggcacacagcggggagagggccagtgagggagccaaactcagtgagcccatggctcagtggagcaccaccatgcagctaggtggatacaggggcagggagaaaataaaaaaagagcccaagtctatgtggagtcggagggggcttcctggggaagtacgaggtgaggcctcaaggctgagcaggtcactgcagggtggggacatggtagccccactcaagggtttggatgtcagatagggaccctctggttgaaactaaatggatctgccttactgtgatcccatctgctaattgatttggtttgcaaggtcaaaccttacattgcaaattttcctaaatcagaactatccaccagatctcatctggtgggagaggaggtccatggaacacccctccggctccatccttgtctggagcagtgtctgatgaggctgagggaggaggagggtggacagggaattactgtgtagagcagcacctgccatctccatgagaatagatggatctcactaactacatgagaagagatgcatctcatttcctcactacccatggcttttgttgtcctttgtgattccattttgcagatgagggaactgaggctcacagaggttacaaaacttgcccaaggctcacctatagcacatgtcagacctgggattcaaccggggaggcctggcttcagtacccatgcccttcctaatgccctggctgtctctcatgttgggcagctgggcagagccagggcatgttgtgctgggacctagagatcctgggttgatcacagtcttggaggcgggggcrggaggggagaagggagaagggaaggctctgcagaaggtgatgattccaaacccttggagatgtggggaggagtcagttttccttggtgcccaggacccgttgagggtccaggttggctacacccctaccccatggactctttccatgggaggctctgagttggcctcagagagggcactcactggtcctggatccccagggccctcagaaaggaagacattcttctaggggtgacctgttcccatcaggaacccwgaccatagggagcctcctaagctcaccagagaggatcagcccaycagctaccccttctgtgggctcttgtgtggaatggktctatagatgtccatgggcctggccctcccctgcctggctccacccactccaggatgtttccaagggagcttgtgagcatcaaacctggtgtcgctatggggcggagccatacccctcctcttgcatcccaactcctttctctgcacttcctctcgaggcatctgtccccttaggaacttgccttctcagacaccccccaccccatctctccctcatcccctctgcccaccagagccgtggtcacccaccctctcccactacaccttccccaggcctcagccctctaggccagtctcaccagcagtggctgccccgtgcctgacctccctckgcccccacmcccaggtcctgtccctgggcgcggatgtgctgccggagtacaagctgcaggcgccgcgcatccaccgctggaccatcctgcactacagccccttcaaggccgtgtgggactggctcatcctgctgctggtcatctacacggctgtcttcacrccctactcagcmgccttcctgctcagcgaycaggacgaatcacggcgtggggcctgcagctatacctgcagtcccctcactgtggtggatctcatcgtggacatcatgttcgtcgtggacatcgtcatcaacttccgcaccacctatgtcaacaccaatgatgaggtggtcagccacccccgccgcatcgccgtccactacttcaarggctggttcctcattgacatggtggccgccatccctttcgacctcctgatcttccgcactggctccgatgaggtgagcagaccccctccaggccagcagccatggctgtcctctgcacgctggcctcaagccctccctgctgcacagcactgggtgcggagagtatctggcactgggcacctttgctgaagcaygtggaggtggagaggaggccccaaacatctgtcacctcccagccctggagaaggacctgccaaggctgcacccccaggcctctgtccctctgccccctctctgagcaggccctggtaagaggagcaggctgccccttccaggatgggcactcgtgtggtcccggcccctcatgctgacttccaaactgcactcaccctggaggaagaaagggatccccaggccactcccccagtgcaccctggctcccaccttgctccctagccctccactatgtccacctggctgcccataggtgacgtgaaggcatctacatgcctttctcatagcttccagtcccacggtctcctcttgccccctctcctcacgatcagcttttcactgaaatcaactctgccttctgtgttccagtgcccccttatcaccccagcctgtccagcagggggtgtccagcagggctcctctgctccaaagccccctaagaccacccctcaacaaatccaccctcctaccttgctgcccccacctggacactgagtggccttcgtactcacttgtgtcccatcaccaaacttgccagtctcccgcccctccacacagctgccacagcgactttcagatcgcctacctgaccctgtgttccaccctctggggtgtacagggtcctcagaattttcagtggcttcccaaggcctacagactagaagccaagttcatgatggaccctgaagcccacaggcagcagcccctgcccgccctgcccttcccaggcacggctctcactgctcctccatctcccatgtgcgcatcgggctgcagtgccacactcggtttcccayrtcggccacgcacttcacacctcagtgccgctgctcatgctgctccctgagccaggagtgccctttccctctctctcctgtctgtctggagccctagcctcctctctccaggctcagctcatgcgtcacctcatccatgaagcctcccctgacctccccttcctctgttctcccactggacttctgtcctagcaaccagaacactattctgagctttaggctgagatcctcaatgtcccatactgtgccacactgccaagtgcgtggcccggaggaagttctccataaatgtttgttgaatgagtatgtggttgtatgcatgagtgaacaaaagcaggcctgactgcacccttccaagggctgaccccagccctgtgaccatttccctacccctccagaccacaaccctgattgggctattgaagacagcgcggctgctgcggctggtgcgcgtagcacggaagctggaccgctactctgagtatggggcggctgtgctcttcttgctcatgtgcaccttcgcgctcatagcgcactggctggcctgcatctggtacgccatcggcaatgtggagcggccctacctagaacacaagatcggctggctggacagcctgggtgtgcagcttggcaagcgctacaacggcagcgacccagcctcgggcccctcggtgcaggacaagtatgtcacagccctctacttcaccttcagcagcctcaccagcgtgggcttcggcaatgtctcgcccaacaccaactccgagaaggtcttctccatctgcgtcatgctcatcggctgtgagtgagacctcatgccacggcctaacttcatgctctggtcttacccgtgaaattttatgtgtagttttgtactgagatagaacataacacatagcaacaattcatgcagtacactgatcctaagtgtgcagcacaatgaatttttgctggtgtgtgcaccaagtgtatacaatatttaacacccacacagcccatgctatctgccaggcaccaagacaggctacataatttgcagagcccagagcaaaatgaaattgtagggacccttgtttaaaaattattaagaatcggccagatgctgtggctcaaggctgtaatcccagcactccaggacaccaaggtgggtgggtcacccgaggtcaagagttcaagactagcctggccaatatggtgaaaccccatttttactaaaaaatacaaaaattagccaggtgtggtggcacatgcctataatcccagctactcgggaggctgaggcaggagaatcagttgaacctgggaggtggaggttgcagtgagccaagatcgtgccactgcacttcagcttaggtgacagagtgagactccgtctcaaaaaagaaaaaaaaattattaagaatttttcgccaggcatggtggctcactcctgtaatcccagcactttgggaggccgaggtgggcggatcatgaggtcaggagttcaagaccagcctgaccaacatggtgaaaccctgtctctactaaaaatacaaaaattagccggcgtggtggtacacacctgtaatcccagctactcaggaggctgaggcaggagaattgcttgaacctgggaggtggagcttgcatgagccgagatcacaccactgcactccagcctgggagacagagcaagactccgtctcaaaaaaaaaaaaaaaaaaaaaaaaagaatttttcgacagtgacagcagagtattaaaccaaatgcagggctcttagcatgcggctccgtgtgtccacatgggttgtacacatgaagccagctctgccaggcactcttttaaacactttacaaaagcccacatttcattcccttctgagcctggtttacaaagcaagaacccagrtagtgctaaagtgccagagggcacacagctaggaaatgtccgagtgactcaatcccagcccaggggttcagctccaaggctgtgctgttctcaatccctgctcccagctgcctgcctcccaagacacctggtttaggaaaacaagagtcagcgtggaattttacacatagattgagttgtgatgttcagagtatttagagatatgaaagtccagaaaaacaaaaacaagggaagaaaatgggtgaaaacaagaaattgagagtttgctcttttttgttgttgtgggtttttttgttttgagacagtctcattctgtcgcccaggctggagctcagtggcatggtcttggctcactgcaacctctgcctcctgggttcaagcgattctcatgcctcagcctcccgagtagctgggattacagacgggcatcaccatgcccggctaatttttctatttttttggtacagacggggtttcaccatgttgtctgggttggtctcgaactcctgacctcaggtgatctgcccacctcggcctcccaaagtgctgggattacaggcctgagccaccacacccggcggagagttttatctttattgtatttttacaacttaaaggagaaaacagatctgaactttaaaaatccattgccttccttctttcttctcgggagtttgaccgctaggcccagtaagatgccaagaggcacaggacagagggaggagggcagaaagcccaggggcctttgtcccgcatgtgccctggcgctgtcctggtcactcctgacttctccctggacagaggggtccttcaccagggggctgctggaaggaggaagacctgggtaagccctkggtggtgtggcccagtggggccgcggaggagctcactctccgccccgcccccagccytgatgtacgccagcatcttcgggaacgtgtccgcgatcatccagcgcctgtactcgggcaccgcgcgctaccacacgcagatgctgcgtgtcaaggagttcatccgcttccaccagatccccaacccactgcgccagcgcctggaggagtatttccagcacgcctggtcctacaccaatggcattgacatgaacgcggtgagccccgccgctccggctaatgccccgggcgtggggggggagccaagatcctgcgggggcggggcgtccccagagccctcaccaccctctcccccagccccaccccggccgcgtcccgctggacttggccgcccgccttgcaggtgctgaagggcttccccgagtgcctgcaggctgacatctgcctgcacctgcaccgcgcactgctgcagcactgcccagctttcagcggcgccggcaagggctgcctgcgcgcgctagccgtcaagttcaagaccacccacgcgccgcctggggacacgctggtgcacctcggcgacgtgctctccaccctctacttcatctcccgaggctccatcgagatcctgcgcgacgacgtggtcgtggccatcctaggtgggtccggcggagtggaccaggcctgtgttggggattggatggaagagggcgggattggagatgccctgcccaggccaccctcttcctgatgaggattttacttttactggcagccacttgcacagcatgtgcccgggagagctttagacccagctggctgaatccttaaaacaaccctctgccggaggtcccattttcctgagagggaagttgaggctgagggagatcatgctagtctgtggccaggcagggattccagggctgccagtgtgactcagaagcccaggcaggtcttcctaccttcttgcactcttggggagtttagggagaaaggccaagggtctttctgggtggaggtggatgccctggctggggaccccagtctcattcagtgcagacacagggatagctagacactttggaggaaggacatgagcactgggcaggggggacagacaggtcacaagcagcctctgtcacatacctgctgtgtgaccttgggcaagtcactttgcctctctgagcatcacagggtcctcttgattctcatcttccttgcctgccccatgacttcatctccaccccaacttcagcctcgccctcctttggtacccatgacctggctatcctccagcccctctggacaggttcccctcgggcagccctccccctctgcttcctctggactgctggtgatctgctctcctcgcccctcctcacctgacaccctcccctgggcctgctcctcgctcccacggcttcagccttcacctgtgccacaaggagccctgtcctcaccccactgtctccttagaccagaatattccatttcttcctgggcatggccgccctagtattctatgaacagatcaaactcaatgtatcccaacctgaaatcacctttcctcaaaaccagctgcttcagcatccccrtcactgtgaagcatctgcctattgcccacgccacagtctgccaagggggcatcctacttcattcctgcccactgtccaccagccagacttgtccatacctctccatctcacacctgtctccctgtccctgcctggatccagccctctttgggtccttcctggaaaggtgttgggaactcctttcccatggccctgcgtctggtttactcccatgcctgtcttccaccttctgccagtgacctgaaatagacatctgtacatctgcctcttctgctcaagatccctccacagttccccatggtccatgcatggcatccccagttatcccaatccgaccaccctgtcctaccaccctccccctggtacttcatgctccagccaaactacttagagttctctaaatctgtgcccttgcatgtgctgccattctgcctggagcgccctaccctgtgccagtccggcagatcccagttgtcctccaaggctgggcttaggcacaggtttctgtatgagaccttccctcactcccagcctaccttagacgtgccatccatggccaggcacggtggctcatgcctgtaatcccagcactttgggaggccgaggtgggtgatcacaaggtcaggagttcaagaccaacctggccaagatgatgaaaccccatccctactagaaatacaaaaaattagcccggcatggtggcgggtgcctgtaatcccagctacttgggaggctgaggcagagaattgcttgaacccaggaggtggaaattgcagtaaaccaagatcacgccactgtactccagcctgggtggcagagcgagactctgtctttaaaaaaaaaaagtrccatcacatgggagggatgattattattattaataattaagaagttaatccaatttaagtttcagttagagacatgaaacctctcattttgtcctgagtagaaaaagacactagatcagaatctttcatctactggaaaaccatcacattataatgttgcccagatttcaagcttcagggtttcatgtgtgaccctggcaagccgcttccctctccaggcctcagccccctcctttgtgaataccctttgatcctgttctcttgtggggacatgtctcagcctccacccatccttctgtgctaaactgttactgccacttgcactaacaagtggactttctgggggagtgggaatcaaagcagtcatgctccgtggcaccccggccctgggctctccacccctgagccctgacagtgcagtgctgatcacatgctgtttcttctgtcctgactgcctttctcatgggggctggtccttgtttctctcgacacagcccccacttcacttcctctgtaagccccctcctctctgccccagccacccctggcaggaggagcccctccctcctccatggccccataactcttggttcttcctgtttctagggctctacagatcatgctgtaaacttgttggctgcttacgtacctatcttgcagggatttgggagggtccttgtgggtggcacaacatcttatatttatatcctttggccagcacagcacctggcaccaggagggcccagtacccttgccacataccacatacctgaacatcacccatgtctaccctgggatattcccccttgccttgcatggacctagtcaggtgcctcttgctttttttttttttttttttttgagatggagtctcgctctgtcacccaggctggagtacagtggtgtgatctcagctccctgcaaactctgcctcccgggttcaagtgattcttctgcctcagcctcccgagtagctgggattacaggccaccatgccctgctaatttttgtttttgctgttgttgtttttagtagagatgcggtttcaccgtgttggccagactggtctcgaaccgacctcaaataatccactaccctcagcctcccaaagtgctgggattacaggcgtgagccgctgagccctgctgcctgttgctttttgagtcactttctcaagcatcacctcatctgcttccctgaacagtccagtggggttggcaaggcagatcaggttttatccattttagagatgaagactctggggtctagacagggggagtaacttccccaagcttccttcaccagggccatgctggttacctggccccacaattgggagtgggaagacagagaagcctctggccctgccctggcggagttaggtgctctggccctgggttccctgcaccctgctccacagcactggcaggccaagcagcaggaagacgttgagacagatgttgagcctttagggccccttcctgcccactgtgccaaagagtatgggctacaggagggagattctgatggagggtggttctgaagggcctggagacagtgagaggagccacaygccggatctctgtgccgctcaaaggacacaggaagagaacagccccacccctaccctgccacccacagccagcacatccagccatgtccccagagctctatcccaggcagcaggccccggcctagaaggatgtccsaggttgggggaggtcacggtcaaaggaccctcataagggagcatggagtcagaccctgaagagactcccacccctctggctggcaggaaagaatgacatctttggggaacccgtcagcctccatgcccagccaggcaagtccagtgcagacgtgcgggctctgacctactgcgacctgcacaagatccagcggrcagatctgctggaggtgctggacatgtacccggcctttgcggagagcttctggagtaagctggaggtcaccttcaacctgcgggacgtgagtcagggccaggtgggccagggtgggtggaaatgcccaggcagcctgcctggcctgagggcacccatctgaccaacacccttcctttcaaccccatcctgcaacctttgccataatttcttttgtgcctaccatggctggcgtcatgctaagtatgaggatagctactatttattaagcagtagggtgctaagggtggggcttcttttacatgatcttcttgcaaatggtattattatccccaattttcagatgaggaaactgaggattagagacaataaataaattggccaaagccattcagctagtcaacggcagagccaaaatgtgaatttaatttgtctgactccaaagcccaggcattcctactacatcataccaagctgaaaaagggggtgccttctgtccagagggctcacagtgccagacacaggggctgccaagaggtgacaaagctgtctcttctcatgctcatccctcagtagaggagattttgacaactcaagaaaaataaagagccacaaagtaaaacagccaaagtcacgaaggtataaaggagaagccatgtggagctcaagcttgctaaggagtgggacagccaggaccgacctgggaatgcccagagcggggtatcacggaggaggaaactaatgggaagaagggagtgtgcatctggcagggaaacacagagcccgggctatttcttccctggtgccccgcccctccaccttgggggagggccctgctggcgtaggccctgtgcccagcttcctgagcatagagctgggtgggctttctggctgtggacagccctccccacaccatcccctctccccctcctcagtttctcccctccctcccgcgatctgcacaggagactgacaggttaggactctgccctcggcccccagccatcaggtggccagaatgcccagcagctgggcaccaggacaggaggggtgtggtctctgcagcctgggccacctgcaggaagtcgtccagggcatcgctgctgtgcccagctgcttgtcattctttcacctagttgtgacagcaccatggggtcagggcagggaagaacaaagaggccccatcccagctttggttcctgttatttcaccctcttgcttcccataaggcagccgggggtctccactcatccccccgacaggctcctggcagccaagaccaccaaggtttctttctcagtgacaaccagtcaggtgagcaaagccagcccccacccccaccagcctgtagcccctgcccagcctcctacccctcccatgtcctctccatcctgcctccccagcgccaccccactccatgagtggagaggggctccctctctagacccagagctggagccttggccctccttcctccccagtctcccagtcctgatggtctgtgtcctcagaggcagagtgagggctctgtggttcaaatgcaacccccaggggtgtatggagactagccagccccctgaggttccacaccaaggcatcaggggggccactgggctgcagctccctgggcagtgaaaccagtgctaaaagtcctcaccctgccagggtctccccatgagctggggccccagttcccctctaagggctacagcctcctgggtcctgggagccagaactccatgggggcaggaccttgtgctccagggcacccaggtaaggagagccactcctcacaccctgtgtccccagggcaggtagggggtgggggacaggctctattgagaagggtcaggcctgtggaaccagctaggcccagctgagacttccctttccctcctgcagatgcagcccctcccctgagcatctcagatgcatctggcctctggcctgagctactgcaggaaatgcccccaaggcacagcccccaaagccctcaggaagacccagattgctggcctctgaagctgggctccaggctagagcagctccaggcccagatgaacaggtgtgtgtgctgtggtcagggctgggggctggkcatgggtagcccctcctagtggctcagacacatcacagggtgccaggtgggttttagaatggggcaggccatttagctgcaggtctccccatacctgtcattaagcacaattcccccartgacttcccctagcaaactctggaacatgccaagggagcttctcgggggaggggcacaaccatgtgcagaaacaaattccataggtcctgggaaagggagtgtgtcctgtggatggcagggctatggtggcagagcgagggcttagaggcagaacagtccaggttcaaattctggctctgttccctaccagcaagagtgtgggcaagttactwaacagctctgaacctagtttgcccttttgtgaaatggggataattggaacatccacatcaaagcatcttggggactgaatcttgtatgcttggtgcctgctcactggtgttgttaagagtcaggggtgtaccagggggattctgggccggggctgtggatcccagtaaggaaatagcttcaggtaggccccaggccgccattccatctagcaggaacagcacgcaggctacaagattgacagctgccctcaggaactacttttgccagccctgaccctgactgtggggttctgtctggcaggctggagtcccgcgtgtcctcagacctcagccgcatcttgcagctcctccagaagcccatgccccagggccacgccagctacattctggaagcccctgcctccaatgacctggccttggttcctatagcctcggagacgacgagtccagggcccaggctgccccagggctttctgcctcctgcacaggtaagaggtgaggggattcccaggggcttacctgcgagcagctgcatgccttccctaccctgacttgttcacagtgcrgcatcaggcccagagcctctgtggccccagagcagccagggcttctgcttacctcctttatgatcagagtcatgatagggttagcctgggcaaggtgctggcaaagcccagaatgtgactccagagcctgcagctggggccagggcagcaggaccctgaggtgtgggaagggcaggtacaatttttgcctgatcccatccctgaaatcagggtggattaacccgcagcctggcctggggtgcatccytctttcttgctcctcccagaccccaagctatggagacttggatgactgyagtccaaagcacaggaactcctcccccaggatgcctcacctggctgtggcaayggacaaaactctggcaccatcctcagaacaggaacagcctgaggggctctggccacccctagcctcacctctacatcccctggaagtacaaggactcatctgtggtccctgcttctcctccctccctgaacaccttggctctgttcccaagcagctggacttccagagacatggctcagatcctggatttgcagggagttggggccactgaactccaagataaagacaccatgaggggactgaaggtgggcaaggtgagagttaaggatcttggggaggtggccgggtgcagtggctcgcctgtaatcccagcactttgggaggccgaggcgggcggatcagaccatcctggctaacacggtgaaaccccacctctactaaaattaaaaaagaaaaaaaatagccgggcgtggtggcaggcgcctgtaatcccagctactggggaggctgaggcaggagaatggcatgaacccgggaggtggaggttgcagggagccgaggccgcaccactgcactccagcctgggtgacagagtgagactccaactcaaaaaaaaaaaaaaaaaagatcttggggaggcagacagccycccagatgggcctctcctaaagtagctacaaactgctgatccaggtgacccaggatggcgtgggtgaagaagctcacgacttttcccagcctcctccagggctccatttaaacagcaagcctggtgcagggtgggagagtctcaggtgtggaggcagcttacaggattgagggggcagtgaagaaagaggtttctgatctacatgagtaccttgctctgagcctcccagctcagaaccctccagcacctcatggctcagcaccaaggcccggggttggtcagaactcttaccatgagcctctgacctggctggagatggaggtatgttctgtggcagacatgtcaggacagtcctccagccctctgctcctgatggttctgtgacattgggtctcttgagggcagtggagtgtcacacagctaataaagtacacatttcatgttggactgggtgtgtaacttatctgaaggtcattacgtctttgactgtgctgtggctttctccaaacccttcttgtaaggagctgcagacttaccctccaccatatccagtgtgttggggacctgaaggtggttctgctgggcccagaggctcctggagcctggggctgttaggccgaggtgaagggaagcagaggcactggcttggtggccctaggggatcatgacaacagccaacacttcggtagcactcgccccgtaccaggcactgtgctgacagctctgcagatacttgttcatctaatcctcaaaacaaccccaacgggttggtattattatccccattttacagatgtgggatcagtagcagagagactaagacacccaaacatgagggggatttctgaggtgcaggtactgttctgtttcctgatctaggtgctggttacaggtgttcaggttgcgaaagagtgtgcttctgtgtgtaaattatacctcagttaaaaagaaaataaaaataaaaaaagaggccaggtgtagtggctcatgcctgtaatcccagggctttgggaggaggatgaggcaggaggactgcttgaggccaggagtccaaggttacagtaagccgtgattgcatcactgaactcacaccctgggcaagggaataagaccctgtctcaaaatgaaaattttaaaaatcatccccgtgcccaacacaataggaaaaggaggacataatttcaacctagatggtctggctttgagagcatgtgcaattaaccactgctgaaaagggctgttgtccaagaactacctggttattggttttcagtcctttgctccagtgttctgtaaaagaatttcgaatatgtatatccccctcatacatttttaagttgacatctgaaatattataaaatacttcaatgatacatttaaatagatgcaaaggatataatctcaagtgtcttgtaaatattgacactttataaaacaattccatccttcatttgtattgacccatttctmcccaaatagcagcgatttgagagccaccaccatctattttaaaaacacaagaaacccttctttaacatcattcttttttcttttctcataattcccacttattcctcccatagttttatcctacatgtaatttattggtatgcttcaaagcctaatattgatcaccctatcatatgtttgcaacacaaatatgtatacaggctgggtgcagtggctcactcatgcctgtaatcccaacactttgggaggctgaggctggaagattgcttgagccaggaattcaagaccagcctgggcagcatagctcaacctggtctctacaaaacaatttttttttaattagccaagcattgtgatgcgcacctgtagtcccaggtactacagggcttgctgggaggcttgggtgggagagtcacttgaacctaagaggtcaagactgcagtaagccatgttcatgcaactgtactccagcccgggtaacagagcaagactcggtctcttaaaaaaaaaaaaaaaagtggctgggcgcagtggctcacacctgtaatcccagcactttgggaggctgaggtgggcagatcacgaggtcaggagatcaagaccatcctggctaacagggtgaaaccccatctctactaaaaatacaaaaaaaatagccaggcgtggtggcaggtgcctgtagtcccagctactcgggaggctgaggcaggagaatggcgtgaacccaggaggtggagcttgtagtgagccaagatcgtgccactgcactccagcgtgggcaacagagcaagactccgtttcaaaaaaaaagtaggtcggtcatggggtggctcatgcctataatcccagcattttgggaggctgaggtgggaggaccagttgaacccagcctgggcaacatagcaagatcttgtctctacaaaaaataaaggaggcaggaggattgcttgagcccgggaggtcaaggctgcaataagcactgtttgccccactgcaccaccacctggataacagagcaagaccctgcctcaaaacgaatgtgtataaattaattgacattttaaaattaatttttgtaaccttaataaggctttaagggttacatctattagtagtacagttgttcaaaacaacataaatatatattcaattttctaataaaaactaaaattttattggaaatatacgtcataaaagagaaaatttcctccccccgttagttcctatatctgtggataaatatcattattttttattagaataagacaaggtaccgcgaattttgtacgtctttttctttcctttttaaatttgtttttaaactttcctccttacaggggatttcctttagctgggcatggtggcgggcgcctgtaatcccagctactcaggaggctgaagcaagagaatcacttgaaccctaaaggcagaggttgcagtgagccgagatagtgccactgcactacagcccgggcgacagagtgagactccatctcaaaaataaaataaaattaaaaaaaaaagaggatttcttggccagatgcggtggctcacgcctgtaatcccaacactttgggaggccgaggctggaagatcatttgaggtcaggagttcgacaccagaatggccaacatggtgaaaccccatctctactaaaaatacaaaaattagctggctgtggtggtgcacccctgtaatctcagctactcgggaggctgaagcaggagaatcacttgaacctgggaggtggaaaaatcatttatcattaaaaattatatttagtgcccagaatggtggctcaagcctgtaatcccagtactttaggatgctgatgtgggaggatcgcttgagcccaggagttcgagatcagcctgggcaacatggagagatctcatctctacaaataataatttaaaaatagctaggtgtggtggcaaatgtctgtggttccagctactccagaggctaaagtgggggaatcgtttgaacctaggcagtccaggctacagtgagcccttatcacaccagtgcactccagcctgggtgacagggcaagaccctgtctttaaaaaaaaaaaaaaaaagtatttaatgttatcatccaacaattcaatacaaacctccttcaattttgatgaaagctgagaattggaaataatttatataaaggtgtcatttggtctctggcccttccccttttccaactcacaggcacagatacctttggggctggattagcatttgcgttgggatccacggcgggaagggtacaggatgggaactgacaaaaacagagccaagctggtcgggtcggtgcctaccccagaattcggggacatttctagatcctgcaggaaagcgcgggagggcctgactcaagctggcctggccctgagcgcatctgcgcgcccgaagcctgtccctgaggcacggagagagcagctttcgggttaaaagggccctgggaagagatggggcgggaaggtggtacccgttgggcgcaggccaggctgccaggccgcagggctctgtcccgcgaaagtcagtaggtcttccactaaggcagaattgtacttttactcgacagcgtggagaggccgctcagaacagcagcagcggaggggaagtcagcgcaggtcacagacggtttcactctcagagacttggcctagaacttggaggcccgctgytacagcacgctcgcctccaggccacccacgcccccaccacccgcactgagccgttatctgcctgactgacatcttggccaaccartgacctttggggctgccaaagcgcctgcctccgagagttgggcggggcgagtagttgcaatgacaaacatttaacccaatagcgaggagatttcagacgctacggccgcaataaccaatgacaagaaagaatcctttcgaaaggacgtgtcaggcaaccaacggccggtgccgctgcgggggtccggcggcttccgttccgagagggcggggcggcgtcccaaaacggaaggtggttgtcgtccgttcccaagctggtttgaaactaggggtcgggctcggccgtcgtcgttgtttgtcgccgcatccccgcttccgggktaggccgttcctgcccgccccctcctctcctcccttcggacccatagatctcaggctcggctccccgcccgccgcagcccactgttgacccggcccktactgcggccccgtggccaccatgtccctgcacggcaaacggaaggagatctacaagtatgaagcgccctggacagtctacgcgatgaactggagtgtgcggcccgataagcgctttcgcttggcgctgggcagcttcgtggaggagtacaacaacaaggtgggccgggcaggggctcggaacccagctggcggggagcgggccccgggagcgccctttccgggccggagcccaggcctcagaaccctcttgcggactcgccctakggccacggagcggttcctctgtctggccctgtgctgaaggtttcgtactcgttgtctgtctcctttaatccaggcagcattcttgtgtagtcggcagtgtagtggggaaactgaggcacggttttgtgacttgcctgggtcaggcagctatttcggggtggaaacaggtcttaaaaccgggtttacgccccaaagatactccatttattcatcccgtgctctccactcctgccgcattgctttcgttggtgggcggggaagggaagagagagtgatagctgtgaaggaaaatgcaggcgcttctattggtggtcgtgcactcctggccacactagatttctattaagacgatctattgtacaagcttccccgccccctactcccaccccccccgggtactcatggatcctagcccttctgccagaattactgttgctcttgcttcctgatatccattctctctaaagcaatctctttggaaatcttggcctgtggcatgatcccgccgttgtttcctgaacacagaaggatgacagggccttatctcttggcttgtttcgtgctagtacagttgtgtgacctttagtagtaagtcttgctggacatacatcaatttgagaatcctttatagaagcacggtgtagtaggggagcttttaaactggcattgcaacaaactcatttttgaaagttgaataagtcagttggaagaattttctttcttccttttactcaaagttgtgaatgatagcgatcagagcaactgaaagctgtggctagtgatatttaaagccactactcctgctttatgccatgaacatcagatttaagaagagtaaaactggccgggcgcggtggctcacgcctgtaatcccaggactttgggaggccgaggcgggcggattacctgagctcaggagttcgcgaccagcctgggtaacacggtgaaaccccgtctctactaaaatmcaaaaaaaaaaaaaaaaaaaaaaaaaaaaaaagccgggcgtagcttagtgcgcctgtagtcccagctactcggaagtctgaggctggagaattgcttgaacctgggaggcggaggttgcagtgagccgagatggcgccactgcactccagcctgggcgacagagtgagactctgtctcagaaaaaaaaagaagaataaaactgttcagtgacaaggctgatgcaggggggaagaaaccaggtggtcctgtctggttattgactagctgtgagatgttgcacaggcctgttttattatctgtgacccacagtttgtacggaaggggttctggtttacatgtgagggtcttgtaaaaaagaaatttgaacatttcacagtttgtttacagtttttcaggagcacatttgtttctctagagtaggtcctctttgsagtccactttgagaagctgatgaaagctatggattctcattgtccagacattacacatacatgaacaatttacaaacaaatccaaggaatatgcactgatctttaagtccacccattgcccgggcgagatagagctttctttcctctgttgcttctttcttccttatggcccatagtggacagcagaactggaaatgggattcacgattctgatgtggacaccgtgttaataaaattaagaccactagaactattgtttaaagatacacgtggaaaataaaaaagtatgtctttcaaagggcttaagtctttttacacaaattaatgttttttcttgtaagtttttccagggtcgttgggtaagcaatagttactcctattccycagagaggagaaactgagccacagttaggctgcttggtaggatcagtggagtagtcaaactgctgttgcaggaactctaccccagtttgtcctttcatttagcaactatctggagcttcctctttgtgacaggcacacaggtagcatggcttagcagtgaaatgcaaactaataaccccactatcaacagcattagcagttaactatatcttaactcacatgatgtaggcaatgcgctgtcttaaaatcatttttgtgcctccacctatcagtagatcagggttcttaaattctgtgtgccatggtcatctgataccaatagaccccttctcatagttatgttttcaaatgcataaaacacatagaattacaaaagaaaccacttatgttgcactacagatataaacaacatgttttttaaagtggtgatgtagtcatatgtacttttaataaattaacttattgatttacaccatccactgtaattattaatgtaattttgaaatggtgacaagggtaaacagcatttcaagatgcttaacaactgtgctgtggtgggaaaaaaaaattctcttgctggcaaagtcacagacagtcataccactgtgagcacctgaccccatttgtaattgaaggaaacaaaaaaatttagctagaggttaatggaaatatggggataattttccaattcaagttcacagaccccaagttaagaaaccctgcgagagagaagtatgtgtagtggttggtgagcagcaaatcctgccttaaagtgattctcaggctaagtttgtgagaaaccctgccaaagaggtggtcgacttcataatttggaggaactttagaattattggttggaatttttagaccattggttcctgcttgccatggatagtggtcaccagcagaggataaagtaaaatggacacagcaaattaacactgatgaaaaaggctagaagtggtcatctttttagtgtggagacattcactaagaaaacatggttgtaatttttaaaaatttgcattagcataatcatgttttcctaacgtaaaattgtacctagttgatccatagaattaagtctatcaacagtttaagaaattgacttccaggtgttccttcatgtgaataaatttgggaattgttgcagagtaaagaaacagattctatcaactacacttggaataaaaagccccattatagggctgggcgtggtggctcacacctgtaatcttagcactttgggaggctgagatgggagaatcgcttgagcccgggagtttgataccaacctgggcaacatggagaaaccctgactctacaaaaacattaaaaaattagccaggtatggtggcatctgcctgtagtaccagctacttgggaagctgaggtaggaggatgctttaagctcaggaggcagaggttatagtgagccaagatcacgccactgcactccagcctgggcgacagagccagaccctgtctcaaaaaacagcctcattattggttattatgtttctaccttcttttgttgtggtctcttgagggatacagcaagattggtgttggagcaacaggttctctaaattttagtgtgtgagaatcctgagggagctgcacattcctgggctccacccctgaagttaacagacttggagataggtgacagacacactagtggttgagtggtccagatggcactctcagaacatggccctggagctgccttggcatctgttggccagaggcgagaatgtgatctttttgtgtctgcatgctcctaaacattggttctgcccttccatccaagttcacccatgaaaaaagctctgtgattagcctgggttatctaagtcctgccacttcccagttttgtattgccttgggcaagttatcctctgtgtctcagtttcatcatctgtaaaattagggcaataaataataacatctaccttgttcaaagattaaatgagttaatatatgtaatggacttaggaacgccacccggtgtggaataagccatatagagatgttagctgttatttaattattatcattactgtacctgtaattgaaatataaccaaagagaattatatggctgtttagtaaatttacttttgtattttccagaaaggattcaggaataagaggtcagaaaggtagctgaaaaggtcattatttcattctctgccttttaaagactctggggggaaaattcccttatctctttcaacccaactcattttgtagtctagcagattctta

SEQ ID NO: 13505 - DNA, 13818 bp, Homo sapiens
gaggctgagatggaaggattgcttgagcccaagaagttgaggctgcagtgagctatgatggtgccactgcactccaacctggatgacagaacaagaaactgtctcaaaaaawwaaaaawaaaaaaaaaaaaaaggtcaggcacggtggctcaggcctgtaatcccagcactttgggaggccaaggtgggaggattacttgagcccaggcagtcaagaccagcctgggcaacacaaggagaccctgtctctaaaaaaaattttaaaaattagccaggtgtggtggcacatgcctgtagtcccagttactcaggaggctgacaagggaggatcgcttgagcctgggaggtcaaagctgcagtagccatgtttgtgccactgcactccagcctggataacagaacgagaccctgtctccctgtctcaaaatattaatgtgtgtgtgcgtgygtgygtgtgtgtgtgtgtgtgtgtgtgttttggtctccatcctggctcctggccagacctcctaaagcccttgtaatttcctaaatgataaagtgaagggagcttttgttattcataacaagctcttttcaaccacaactgagtttatgttagtaagttgacttttagaaagcccctaaggttggggtttgttgccaaggtaggcaactgtgtgattagagagttagaacttttagctccaaccctctgacctccaactaatggctattgaatcaagtatgcctgcataatgaagcctccataaaaaaaaacaaaaaagatgagggttggagagctgccaggttgatgaacacatggaggtgcagggaggtgcccagagaggacaagaaarctccaaatcccccttccccgatactttgtccggagcaactcttccatctgactgttcctaagttttatccttcataataaactagctaacataagtaaagtgtttacctgagttctgcgtgctattccagcgaattactgagccagaagagggagtcataaaaacagttaggaggcctggacttgtttgtgattggtatctggagtgggggcagccttgtagaactgagcccttcaacttggggattagataactggtaattatgggtagagtgtcagaactgaattaaactgcaggactcccagttaatatctaccaagaactgaagaattgattggtgtgggagaagtctccacatgattggtgtaagaagtggtgttcttggccaggcgcagtggctcacgcctgtaatcccagcactttgggaggccgaggcgggccgatcatgaggtcaggagattgagaccatcctggctaacatggtgaaaccctgtctctactaaaaatacaaaaaattagccaggcatggtggcgggtgcctgtagtcccagctactcgggaggctgaggcaggagaatcacttgaacctgggaggtggaggttgcagtgagcagagactgcaccactgcactccagcctggccaacagagcaagactccatctcaaaacaaaataaaacaaacaaacaaaaaaaactgagattctttgcaaagagcctggaataacttccttttagtcctggactataatgatgatgataaatatacctcgatgtaaccctgagatcccaagattcactagcccttgaataaaaaaaaggaaaaagaaaaaaacagtatattttttcgttttgcaaatcacagttcccttattaagatgraattgctgccawttacagagaagctatttgcctaagccaaaaatccatgaggttcacatggacttayagttacacaaattagaaacaaatgttatatttaaaaccatagagaaatgcccaggtgatgaaagctggggtgaaggagtctgcacattcatttcaaactgttaaaggatttgtgggccatgcaatggtcccttgcattagagaagtcaaagagctttgtgcaatcctctcctgtctgtgatctggaagacacgtgctcatcacagagctccagctgctccgagactttactcctttcttcagctgcacgcactgctctctcgcttttgttaggaattgactaattcctcctcttcctcttcctcctcctccttgccatctctaggcccagtcagcatctcttgttcatcctctgatcccatgtccagctatggttctggattcaacactagcagcaacagtggcgctgactccactttaggatcaataaatatttttctggctaggcgcagtggctcacatctataatctcagtactttgggaggccaaggtgggtggatcacaaggtcaagagatcgagaccatcttggccaacatggtgaaacctcgtctccactaaaattacaaaaattagttgaacatggtggtgcgcacctgtagtcccagctacttgggaggctgaggcaggagagtcgcttgaacccaggatgtggaggttgaagtgagccaagatcgygccactgcactccagtctagcgacagatggagactctgtctcaaaaaaaaaaaaataagtatttttctttctagccgtatatccaccttacatggtccctcaactccccaagcccactctgcctgccccatctcctccttccacatcctctcctcaacctagcacttggttggcaatgccttcctcgatcctctgccaaagaccctctagccagtgcttaccctgtctgttctctctctttacccaaagaaatacataaagtttgaccagaatggaaacagagatatcagtgaaaaaaggtgatttggggaagtgtgcaggcctaggaagacagaggcttgttcctttgcttgcttaaaatctttgatcaaacggccaggcgtggtggctcacacctgtaatcccagcactttgggagggcgaggtgggcgaatcatgagatcaggagttcaagaccagcctggccaacatagtaaaaccccgtctcactaaaaatacaaaaaattakccagctgggcgtggtggcaggtgcctgtaatcccagctactctggaggctgaggcaggagaatcacttgaacccgggaggtggaggttgcagtgagtggagattgcaccactgcactctagcctgagtgacagagtgagactccatctcaaaaaaaagaaaagaaatctttgctcaaatatcactttttcagagaacgcttctctaaccactctatttattttattattttattgtattttttgagacagggtctcactctgttgcccagactggagtgtaatggcacrgtcatggctcactgcagccttgatctcctgggctcaagcgatcctctcacttcagcctcccaagtggctaggaccacaggcgtaagccaccgtgtctggccagaccaccatatttaaaactggggacaagtcaggctcacacctgtaatcccagcactttgggaggccaaggtgggaggatcacaaggttaggagttcaagaccagcctggccaacttggtgaaaccccatctctactaaaaatacaaaaattagccgggtrtagtggtgatcgcctgtaatcccagctattcrttaggctgaggcaggagaatcgcttgaacccgggaggcagaggttgcagtgagctgagattgtgccactgcactccagcctgggcaacagagcgagattctgtctcaacaaaaaaagctgggtgcagtggctcacgcctgtaatcctagcactttgggartccgaggtgggtagatcacctaaggtcaggagttcaagaccagcctggtcaacatggtgaaaccccgcctctacaaaaatacaaaaattagctaggtatgatggcaggtggctgtaatcccagctactcggaaggctgaggcaggagaatcgcttgaacccaggaggcggaggttacagtgagctgagatcaagccattgcactctagcctgggcgacagagtgagactccgtttaaaaaaaaaacaaaaaacaaaaaacaaaaaactggggaccattggcaataatactcctatgtcccctcttccctactttgttttcctccataggcacctggcgccttttttttttttttttttttttttttgagacggagtctcactctgttgcccaggctggagtgcaatggcgcgatctcagctcactgcaacctctgcctcccgggtttaagcgattcgcctgcgtcagcctcctgagcagctgggattacaggcacgcaccaccaggccctgctaatttttgtatttttagtagagatggggtttcaccatgttggtcaggctggtctccaactcctgaccttgtgatccgcctgccccagcctcccaaagtgctgtgattacaggcgtgagccactgcgcctggccacctagcacctttaatatacttatttatttgtattgtctgccttccccaattagatcaaccatgaagacaagagttttcatttgttgggttctctgggcctagaggcatgtctggcatatagtaagcattcagtaaatatctgttgagtgaacgtatgaataaagaagtgagttcctcccagcaggcactgagaacattgggagtacagggttgcagctctctctgcagcaggagaatgtagctgcaataaagggaagtcaagaagccagagtccagccaggtgcagtggctcatgcctgtaatcccagcactttgggaggctgaggtgggtggatcacaaggtcaagagatagagaccatcctggccaacatggcgaaaccccatctgtactaaaaatacaaaaattagctgggcgtggtggtgggcgcctgtagtcccagctactcaggaggctgaggtaggagaattgcttgaacccaggaggcagtggttgcagtgagccgagattgcaccattgcactcccgcctgggcgacagagcaagactccractcaaaaaaaaaaaaaaargcagcagcagcagccagaggccactccagcatctcccctacctggcttgggtcagggagasggcagtgagaagtgaaaactcccagctacagaaaaggaaatatgttgsggggaagggagaaggaaaggtgtcttcatcaatgccggggcagggtagatggagccctgggcagggagtttggaccaggaaatctcaatgagggaaatgtgctgtcctcacctctccaagaagcgactggccaaacagagtgacagaggggataaaggttatgcctagggaggcatgtgtcagaggctatcatccactctgttgaacccacagtgaccagcaccaccatcacacaaacatgcctgcatgtgtgcacgcacgygcagtgtgcaaacctgatgtcagcctcactccctggctcttctgtccacaaacgctgtttctttaagtaccactttcagttcctccaaagaatctacttaaactcttaaattcctgatctctatagattttactaaagatttcaaaggagataagatgagagggttacgttgcacattctaaagcaaacaaattaaaatgttttgttagacatttccatatttttaagggcctccttggagctgccaggctgggagtgaggtttctctccctttctaaaccctgtgcccatcttgtcaccctcctggagctgccagcagacttcagattcttctccgatctacagagcagaaaaattcagccagcccttccttgtcttcctatccacagctgcctgcccagactcatgaaacctgacaaaatgcaaggtcttatcattacctgaaccttggacctgttcaaaaatactagttcctgagaataaatatccctggtgtcttcctgcccttcctgcacacctccagtggcttatcaaaatatttgtttcatgcgcacactgggctctcatttaagaggaatttgggagaatgttattttctaatctgcatttcacaccaggctccccctccttcctggggtgctagtgtcagcagaacctgatggggaagtgaggtctgggaggcagaggaggaaggaatgaggggaaaggggaagtttgggaggaaggcttctgagaagactggtgggagagaaggagagcctgcagacagaggcctccagcttggtctgtctccccacctctaccagcatctgctgagctatgagccaaaccagggatttacagggtagggagggtgggataggcagcrgcattagatcrgaggaatgagatggacagacctgggctgtgggctaggagggcagtcagctggcctagggtagcccgggctggtgtcagggtaaggagaggaagggagggatgagggctgattaatttttttcaccccacaggaggaaaagctttcrgactgctgaaggcccagcaggaagagaggctggatgagatcaacaaggtagaaggaagaactaagggggcagagccagggggatggggcgtggatggggagggcctaccctggctcttattttcccctccatagcaattcctagacgatcccaaatatagcagtgatgaggatctgccctccaaactggaaggcttcaaaggtgagggggaaactgtaggcggtggagacagggctgggggtaggagggttaggatttccacaagaacaaggcaggaacagcagagataaaaagtttacttttgtggtagcaaaaggggaacctgcctttattgccctcctgccacactgcggtccctttcccgggcctgcctctctcagcatcccctctagctccttacamcctagcggggcccctcaactccccaaccccacttcctctgcctgcccctcctcctccttccacgttgtctcctccacctagcagttggttggcaaccccttcctcagtcccckgctgaaaaccctcsagtcagcgcttatcccttctgctctctcccctcacccagagaaatacatggagtttgaccttaatggaaatggcgatattggtgagaaaygggtgatttgcgggggcagggtggtgtgcaggcctaagaagacagaggtctctcctacatgctccattcctcatgatttgggagggggcccacctaccacagtgggaggaaggagaatggggatgcggaagtgggagaggagagagagggtctccccaccttytccccatccccatcctctgcccccagatatcatgtccctgaaacgaatgctggagaaacttggagtccccaagactcacctagagctaaagaaattaattggagaggtgtccagtggctccggggagacgttcagctaccctgactttctcaggatgatgctgggcaagagatctgccatcctaaaaatgtgagtgtcaatttccaacctcccctgtacttacctgttttctcctcccccatccctacccttgtccacaggctcaacatttctacacgttgcccatcatcccttcttccatccttagagggacccttccaaggtcccgaccccatccctatccatagtcctggtccccagaaactccaacccctgcccttcctcttcccccttccaccctcacatccccatccccttctagcctttcctagcaccctatgatttattcccttgagaggagtgttccctgatccctgtgcctcttcccatctcaaccaggatcctgatgtatgaggaaaaagcgagagaaaaggaaaagccaacaggccccccagccaagaaagctatctctgagttgccctgatttgaagggaaaagggatgatgggattgaaggggcttctaatgacccagatayggaaacagaagacaaaattgtaagccagagtcaacaaattaaataaattaccccctcctccagatcaagtcagcttagtttttatttgggtgatttttttcctgggtttgggaaggagagacaggtcttgagggaaaggtggcaaggatttggccatatgaacaatccatcaacaacgctatagtgtgtccactacagcagatggtttcacgcaccaagggggattccagctgtgtaagacagccttaacctcaaagaatgcaggcaggwcaaaaacacatgtccaaacaaggtactcaggcccatgacagatttcatgaagagcaaggaataccatgaaccaacattctccaycactataagctttgtcactttgacaaatcactcagcctctgtgaggcttttttctaaaaatggggataaagtgacctatgctattgtgcctgacatatcataagccctcaataatgtttaaaacttgaatgagcyggggccgatggcttatgcctgtaatcccagcactttgggaggatggggtgggcagatcacctgaggtcaggagttcgagaccagcctgacgaacatgaagaaaccccgtctctactaaaaatacaaaattagcctggtgtggtggcgcatgcctgtaatcccagctacttgggaagctgaggcaggagaatctcttgaacccaggaggtggaggttgtggtgatccgagatcgcatcattgcactccagcctgggcaactaaaaagcgaactccgtctcaaaaaaaaaaaaaccgaacatacaaacaaacaaaaaacacttgaatgggtagatgaatgaaagaactggtgctattaaataaagcaaagaatttacagctgggcgtggtggctcacgcctgtaatcycagcacttcaggaggccgaagcgggcagattacctgaaatcaggagttggagaccagcctggccaacrtggtgaaaccccatctctactaaaatacaaaaaattagctgggcatggtggcaggtgcctgtaatcccagctactcgggagrctgaggcaggagratcgcttgaacccgggaggtggaggttgcggtgmgccgagatcacgccatggcactccagcctgggtgacaagagtgagactctgtctcaaaaaaaaaaaaaaaaaaaaaaaaagactggaaggagaaactcattggagacaatgactatggacatcccttttaagaattttgctgcaaagggtaacaaaacggtatgtgtggtagccggccggggagaagggagaagagaatcattttggaagtttgaaaacagaagtcatcttaaatcttactgagcctctgactaaaattctcatctgatttcygcaaacttttctgccttcacttttcataatgaataagccgcctcctttatttagccatatcagcctaggcacaggcccccaaactcatgcctccactaatctgttctctgcacctgagatgtacaccttcttctgaaacttgggtaagttctaactcgttcttcatatctatttatttatatatttttgacagatatctactccgatcattcttcatatcatttttttttttttttcctgagatggagtctcatgttggccaggctggtctccaactcctgacctcaggtgacccacccaccttggcctctcaaagtgctgggattacaggcgwgagccactgctcccgctcccggccctttttttyttctttttcttttttttttttttttgagacgtagtctcactctgtcgctaggctggagtgcagtggcgtgatctcagctcactgcaacctccgtctcccaggttcaagcgattctcctgcctcagcctcccaagtagctgaractacaggcacgcgccaccagtccagctaatttttgtatttttagtagagacggggttttgccatgttggccaggatggtctccatttcttgaccttgtgatctgcccgcctcagcctcccaaagtgccaggactacargcataagccaccacgcccrgcctcatatctcttaataagagtttttctagaaacatttctcaatcaccccaggcataatcatattttatttctctacttctttcttttttttttttttttgagatagagtttcgctcttgttgcccaggctggagtgcaatggcacgatcttgsctcaccacaacctccgcctcccaggttcaagcgattctcccgactcagcctcccgagtagctgggatcataggcatgcgccaccacgcctgggtaattgtatttttagtagagacggggtttctccatgttggtcaggctggtctcgaactcgtgacctcaggtgayccgcccgcctgagcctcccaaagtgctgggattacaggcgtgagccaccgcgcccatccttctytttttttttttttttttttttttgagacgtagtcttgctctgtcacccaggctggagtgcaacctccgcctccctggttcaaggaattctctgcctcagcttcccgagtagttgggattacaggcgcccgccaccacgtagggcaaatttttgtatttttagtaraaatggggtttcatcatgttggccaggctggtcttgaactcctgatctcgtgatccacctgcctaggcctcccaaagtgctgggattacagscgtgagccaccgcgccaggccttatttctctacttctataatatcctgtgcattatctccagcgccttcaaatcatagtcattgaatgatctgttgaatgggtataactctgatgggagcagagagttctagaatcgggtagtaagagacaaasgagggtaacagtactgcatttcacaaaatgaaacccattgttaagaaattacaaattcccaataatttcaaatataaaaatttattcatgaaaattataggttataaaattaaatgtccgtcttagtcgatggttgcccatattttgatgaacgagtcattcctagcctatctttgttcaaatgatttgcatacattatgcaaataggtagaactgcccgaagaatgcctacgctgcgtggtgcggacgaaacgcttcccggggcctttggattggtctgtctagccacctcatttgcatgacgtaatwtaataactggaaggccccgcccctctggtgcatttccccgctccaaccacctcctcaaactcacggcraagggatgcgagagctggaactcttaccaggcctgcggaaactcagccctccggcagctaatcccgcccgccascccccgtcctctctctctttctccctagctgaaggcgccacgggccgtgtgtcgttgccttccacttttggcgtcccaacgtctctccgctcccatctttctactaacgtccgacgcacgctccgcctctttctcccamattcgtcgtgtaaattctgcgtcccaaccgcccagccgacctgcaccgcattcccgccccctcaacacggctcaacggccgacgctgggggcccgcctccttagccaatcggggtcctagtgcccttaagtccctcctctttatgcaaataacctccgcatgctccgcgcgcccggcccttttttttttttttttaaactaaagacagccctggaagtagagggttagggtakaaagtgccccgccctttatgcaaattaaggggcgtgtctaggcgcggagggaggtgggaggtgggagggggtgctcccgggggcggcggttgcccggatgggccgttagtcggggctcagccgcggagtgagcgagggagacgggaggagccgaacccggcgccatccgccgccatcctcccccgccccaccgccatcccgtcccggggagcccctaggcccgggtcccggatccccgcgcacccggccagktgagtctgggtgaaccgtkcsctgacgcccttttccggcgcgggagaggtggtggcggtggcggtggcggcggcggcggcgktggtgggccggggggaggagaagctgccattagccgccgccattttgtcctcctgctgccgggcctgcttgcccctccccctccggtacctctactccgggacccgcacctccggcagttcattcaggatccgtagtctgcccctaaccacccaccgtcttggcttcagggggtgacccctgcgcctgggtccgtaactccctaccctccgctgcgctcctggcttttcacccccatttgtgggccccctccccggctgccgccccgtggtgggccgcgcccgacggttctctcggaagggcgcttttcctccatattggaccccctcctatcatccagcgctgtgttcccccctctggacgcccctcttcgtgtcgagccactcccactctagaatcctgcttttatcccagcatctttgctttctatgttgctcagtcgccctatgtctgctttttcatttttcctkktcctcgtctcctttctcccccaaccccgtttttcttcttgggcctctgcccccttacttcgttgtctacatcstttttttttttgccattcctgtttccatatattttccacctgctttcgtattcattattttctgttagttttggtctattcgctacatgactcttgtattcgttttcccttcatatatttatcttcacagattggcctcctcaaacacctacgaagcaacatccatcttatctctagcttgtcataaagttctttctccccaattttagctttcattctgggcctgtctggatttccctgctttcttccccactatttctcatctctttacactgttcccgtccataaacgaatgcctggtcactctggaatggactgagagacctgtcgtccggcttgcttagggagctggaggtatcgagtaaagaaacactggtgatggacatttttaatgaggataggaaaacgragrtggctctggccttggccctctgttttctggcccatggttacagggtgctaaggtggctycataatgctttttctcagttcttcatatggtaaaacagtatttcatctggaggcgattttttccaggagccaatacaggagcaagtttaggaaaagatgggatatttcaaatacttgaggttcctatagcctgggagtatgtacagccctagttgttctatgaggatttctctggtaccaacccccattccggctgagcaagctcataaaatccttaaactcccagcataccttcctgcaaaccttcccagatggacacgaggctgctgggctgggagcctggggtacagggccctgggggcatgattagggagcttgtgtccaataaacagggaatctaaagtgttgtttcttcttctctgatggaattgtatgcttcttttttagttttctcttgcttgaatttgtcctgttgtaagtctctgaaacgattttggtggagagagaagagattattacttgtagggaattactctttgtagacaggcacaaagggcagagtgtttatactaggaggatgctggatttttacttagatttccttgacaaagktgtctgggggaaaggagggaacatggcatttgagctatgagggagctaagtagatcatggttgcttragaagagtgggcagtttacatagactggaggaaaagacaccagagggcctcatatctgagtccctaatgataatgcaatggagtttttaagtttctgttatggtctgtacaggggacagagactgagacacttgmtgtctggcccacaggctctggcacgttttgggggaggtgcctgcaggacccaacatactcaatgagcttccagcgcaatgtccgatcgctcggggccgactgccaagggaaaggatggaaagaagtattcctcgctcaacctgtttgatacgtataagggcaagtccttagagatccaraaacccgctggtgagagtcctgcaaagatgcttctgatggttgaaagctaggcatgcatggggcatacgttttagagctctttaaagggaagtggctgtagtagaaataccaaaagactagaggagatttcccaactttac

SEQ ID NO: 13506 - DNA, 17797 bp, Homo sapiens
  misc_feature (1)...(17797): n = A,T,C or G, or insertion/deletion polymorphism (see Tables 1-2)
agcagcacccagaacctcgtagtagcgctgcaagaagggctggaggcgactctccagccgctgtagctcctggagcacctcgacatactccgcaggggaaggatggctgtggacaaacccaaggggcaatgagccaaagccttcctcagattcccaccctcacagtcaacagggaccacatgtgccctctttctccctggtctcccagagccctggcccaatccttctctggaccagcagagcttctattctcttcaacctccgcctcccaggttcaaacgattctcctgcctctgcctcccaagtagctgggattaagttgcctgccaccacacccggctaatttttgkttttttttkttttttttttttttgagacagagtctcgctctatcacccaggctggagtgcagtggtgcgacctcagctcactgcaagctccgtctcctgggttcacaccattctcstgactcagcctcccgagtagctgggactacaggtgcccgccaccatgcccagctaattttttgtatttttagtagagacggggtttcatcatgttagccaggatagtctcgatctcttgacctcatgatccacccgcctcggcctcccaaagtgctgggattacaggcgtgagccactgtgcccggcctgtattttttagtagagacagggtttcaccatgttggccaggctggtctcgaactcctgacctcaggtgatctgcccgcctctgcctcccaaagtgctgagattacaggcatgagccactgcacccagccaaagcttctattctttactcccacccatgagaggatagggagaagaaaatgaactgctcccaccctccccaccacaatcctgcacctacaatggtgaaagactaattctaagaaagagagcaggccttcgtgaactcagaggagaattccgatcaggctcaggagataccatttggatttccttgccrtagggagagcagcagttcttctcagctgcctgtcctagcgtcatttacctataccgagagagcccctcctcgcccctcaatgctaacccttcaactaagacctccaagtaatcctttccctcccttgccatggttcatttccttctccccatacttcacttaggattccccacccactaaagattccctccatctctcacttgggtgcatttgtttccggggcaggtgttgggcccgctggggctgggccakgagtgagctccgggttctgggctggggcacgctcctccacttcttctgcctccatgggctcccggggaggtgcttcactttcaactggttctgaygtttgagagctcaaggctactggctccggggtcacagccggtggctgcgggggcggctgactgtgctgcggttggggccctcctcgacactgaaggtaggggagagtcaggataccaaaggcagggtaagactgctgcagaggattactctacaggagactgaacagagaaagtatcctaactagactccctgaaggcatggctctgcaattttatctccgactcgctagcaactagcataagactgacacaaattagatgcataataagcatctgtaatttttttttttttttttgagacagagtctcgctctgttgcccaggctggagtgcagtggcatgatctcagctcactgtaacctccgcctcccaggttcaagaaattctcttgcctcagccttctaagtagccaggcctacaggcgcgtgccaccacacccaactaatttttgtacttgtagtagagacagggtttcaccatgttggccaggctggattggaactcctgaccacacgttatccccctgccatggcgacccaaagtgctgggattacaggcaggagccaccacacccggccacagcatctgtaatatttgtaaataaatttctaacaaagagtagagattgtggtttcctttcctccacaagttggtttcccagcctccacaagttaagagagtagaatcctttaattgaaaagagatgccatgagactaagtctgaaacaaactccccagataccaggcaccaagaggattggcagaaatgagagagcctcacaaagatactttttctgcccaaaagaatgaatactgcagagaagactagattatgaaggccaaaccctgtgratgtggccagtgaagccctaactcccaggctgagagaaaagggagagggagggtggagagagaccctagccagccttgcccacttacctccatccgggatagtaaggtctgtatatccctgatcatgtgctgagccatcaccagccgtacccggggctcactctacaatgagagaaggtttatcagggtaggttrcagatgaagccatgagttctaccacctactaaatcaggtcccagccatctctcagccaggtccaccccacctcccagcctccttctcccagatccccttccctgaccctcggaggcccctcaatacctgaatcggggcctgttccatgttgatgtgaacatccacagcagagccgtcactctggggaaagggtaagggaagttgttctgggagaagccaacactaaggcctccacacctccaattcattccctggagccctacctccttttctccttaaagactgagaccaatagcacaccacagggccccctgaacccaatctaaagatggaagcatctatcttattaattccctggtgctaccacaaccaaagctacccacaaaagccctcccctgtggaacataagcttacaggaagattgaaggttccaaccatgacatagctgttggcattccggtcatgaacagaggccccaggcccccgagtaccagggggggatcccccaccatgagtggctgaggcagaccccgtcccagaagatgccccagaagggaggtgagtctgaggaggagcccgttccaccaggtggataacctttcccccaacatctgcagaaaaatagacacacaccaaaacatagtatgaacaggtaaacccatggcctcagttcatccctccagacagtagccccaacctctgaactgcctccccagcccccttactgtattcctgaagcttcttatcatcttgcagaactcgtccctggtaaatgagccgttgtttttcagatgggatgctgacagaggcagcaatgtgctccttaaactcttttacattcatctgaaaagaagaggcatgcacaggaatggaaagaatggaggaaagaggaagaacaaagacagacaaccgagttgtggaggtgaggggtaaaaaccaccacagaatcactacccgtttgtcttgaccgtgagatcattactgtgcaaacccttaaactaaagtaacagctgtcaaaatacagacaataaatttggcttggcgcggtggctcacacctgtaatcccagcactttgggaggccaaggcaggcagatcacattaggtcaggagttcgagaccagcctggccaacatggtaaaaccccttttttaccaaaaatacaaaaaaataagccaggcatggtggtcgcctgtaatcccagctactagggaggctgaagcaagagaatcacttgaattcgggaggcggaggttgcagtgagccgagatcgcatcactacactctagcctgggtgacagagagggactccatctcaaaaaattaaataaataaacttaatgaagctcaggttatagatccaggaaaaataacacggatgaaaaacaaaaaaaaamcacatggacattatattatctgtctggcatccaagggagtatgtgtctagagacatcagtgacccctttccaaacacaagatgataccagtttatttaccagactctcctgtgatttccaagattaaaaaatggcaaagaagatggggtctggtatcaggttamtgaagaaagactaagaagataagaaagcaaaaaaggtcccagcacagtggctcacacctgtaatcccagcactttgggaggccgaggcaggtggatcacctgaggtcaggagttcaagaccagcctggccaacacggtaaaaccctgtctctactaaaaatacaaaaattagccgggcgtggtagtaggcgtcgtctgtaatcccagatactcaggaggctgaggcaggaaaattgcttgaacccaggaggcagaggttgcagtgagctgagattgcgccccagccctccatcctgggcaacaagagcaaaactccatctcaaaaaaaaaaaaaaaagcaaaaagagaaatatttttcctaactacaaactgactcttgggaagtaccagagtatttatatacatctaatcacaagtctatatatggctttcttatatccaggtartatcacattttagaaaaccatggaccaccccacatgcaatttgtctccaagtattacaggagtaaagacacagatagctatgtccaaggctttaagctcaagagactcaagctatgccataaaaattagtaatttcactcaacagtctatcaaggmcctatctccattatgggttctgatttctaccctttaaraacacagcatagacctgaccaatgtctatcagtaagacacacttgcttagggttcctgtgctgtttcccttcccaaaggccagagccatgcctgtccctttgggttggggtccacccatgatgatgacacacagattcttccttcctctgtatttccctctgcattaagttctatccatgtggaggacagaacaaaatcagcctcactcacaaaacatcagaaaacgttctactggaatacraacaaagggatcaataaaaakaaaatctgaggccaggtgcggtggctcatgcctgtaataccagcactttgggaggccgaggagggcacatcacctgaggtaaggagttcgagaccagcctgaccaacatggtgaaaccccgtctctactaaaaatacaaaaatcagctgggtatagtggcacacgcctataatcccagctactcaggaggctgagataggaaaatcgcttgaacccaagaggtggaagtttcagtgartcgagatcgcgccactgcactccagcctggaagacagggcgtgactccatctcaaaaaaaagaaaaaaaaagaaaatctggtgaccagaaaatcaagctcatctctcaggctaaggggcctaaacgaggaaaagctaaaggtgtcttccagaactagtgaggtgtctcacctgggcccccacaataaaggtacgagtttgagagtccaaggtcttcaccaacacctccaagctgtcaggctcctccacagcggtactggtactatcattaggctccatggccgacaggtctctaaagaagaacgaaggaaggarggcccgctgttgcccagaccagagtgtacccgaaagactccctagcattaatccctgccccaatacctaaaaagtwtctcctgcacacacacacattcacacctgtccccatcccccttctgattccggggcacagggagagaaacacaaagggcaggagatcgacggcttagggagctggaggacgagaggtgggaggggctccacgacgccaatcacaataagcagggagccagtcagattaggaaggaagcacgagaccagagactagtgtcatcaccggtcacggcaggacaagcgccccagaggtcggaaaatcctgggacaacgcgaaagcggtggtcgccccacactctgcggagaaagtggtttcgcgcacgcgcgccacgcccatcgaaccctcctaactcactatagacccgaaacggcactcacggggcgacrgacctgctagctgactgcccgcgtctactgccttcccacggtgttccagcagaacggcacaactaacccacagccaaacacacacacacacacacacacacacacacacacacmcmcacmcaccaccccgcggctccgcccccgacttccccacggaccgtcacttccggtctcccccaaacctgccaccgacggccacttccgtttccccgatagtatttggggatctcgaagcgatacttccggctccccccaggtccccaagctttacttttgtggggcacgacgagaaagtccgcagccccaaacagtgagtttctgagggcgagtcgggccggggccggcctakgtgggagggagccgagcaccccgaggagccgccaccgctgtcgcccgggggaccgtactacgcctgcgtgcgtcgcactacggatgcgtggacacttaagcatcgccccaccccctyccccctctggcggcgttcacgtctgtgcgcgcgctkgagcgctagaagattgaggtggctaccgtaaatgcctgaaaaacagtcaccagctgggactctaccactgcctcgagaggggctatggacggtcgtatggaccttggactttggagatgggggattatgccacattcatctatgtttaaatcttggcaggctgataatttcaggcggcactgtcctagccagctaaaactcttctccaccctattgccctcgctgcgccctttcttctgtgcctccggaagttactctttcagtaggcgtttgggggcggcactggtcaattttgttctcggttgcttggttgggctagatttcggttctgccgggtgggcgttttaagggctgtgggcgtcacattcgtcggtgtgtggccaaggggacatgacacgttttaggaaaagtaaacgtgctactaagttgcacgacttgtcaagaaaagaggcgcttccgagtttgagaattgggagcaaatggagtccgagtggacagaaagacaagaccctgaccgtggggaatttaaaggccggccagcgtgcttccgaaggccgggggtggaggcattacckcctctccgtgccctcttctcttaacctgccctgggccaagggcctcggccccgcgaaactgcgagtcctccagaaagacacatcgctgttggggtgtccaacctttctgggattcgtagtttatacccaggtcctggttatattttagttaagagttctaataagcagctgtttaatgagcacttgtgccagcccatatactacgggttttgtgtattattttaaaaagccttttaacgagcttttaacattttttaagtgagtacacttagacgaacataagtgtcagaattgacaaatccaggcctacaggactccagatcgagcacttgtactttactgccccaataaaaagctgttaacattttagcttatttttttgagagagggtctcgctttgtcgcccagsctggagtgcagtggcgcaatcacaactcactgtagcctctgcctcccgagcccaaccgatcttcccacctcagcctccctagtagggaccacagatgcacaccaccacacctggctaattttatttttatagagatggggtcttgctatgttgcccagcctggtcttgcagacttggcctcccaaagtgctgggattataggtgtgagctactgtgcctaaccacattttagctttttattacaaaaattttcggccgggcgcagtgactcacacttggraggatgaggcgggtggatcacgaggtcaggagttcaagaccagcctggccaaaatggtgaaaccccatctctactaaaaatacaaaaattagcctggcgtggtggcgggcgcctgtaatcccagctacttgggaggctgaggcagagaattgctttgaacccgggaggtggagattgcagtgagccaagatcgygccamtgcactccagcttgggcaacagaacgagactcccatctcaaaaaaaaaaaaaaaaaaatkcaaacattacaccaaaatagaacagtattaataaactctaatatactggtcacccaaattttgtttgttttttaactaaatcgcaagcctcagccctyggcaaattttttgtggcagtccatgggatataaatttatcaagctaggtgtggtggctcatgcctgtaatcccaacactttaggaggctaaggtgggccgactgcttgagctcaggagtttaataccagcctggggcaacatggtgaaactccgtgtctacaaaaaattagctaggcgtgatggcgtgcacctatacctcctactcgggaatcatctgagccggggaagtcaaagtcatgcctgggcgacagagtgagaccctgtcttaaaaataaataagtaaataaataatctatcgaggaagatccatctctcacagcattaactgctccagtcacttggtgctatccaaggacaacctatttggcaattcttactgcctattatttgagaacttattacccaccagaaactaagtgctttgcaaacattactattaattatagcaaatatatactttggamttaccatgtgcaagtctttgctaagggctttatgtgcattatttcatttaatcctrtaagattgatgatttgccaattttacagatgaaaaaacagacatagcagttaggggttggtggtgttttgtttgtttggagacagagtctctgtcgcccaagctggagtgcagtggcacaatcagggctcattgcagcctcgacatcccaggcycaagcaatcctccctcctcagcctccctagtagctgggactacaggcgtgtgccaccacatcggctaatttttgtaytttttgtagagacagagttttgccatgtagcccaggctggttttgaactcctgggctcaagccatccgcccaccttggcctctcaaagtgctgagattacaggcatgagctacctgccctgcctgtagttagggtttggacacattctgcctgacaccaacatctatcctctctaacagccagattacatagcctctttgtagtaataaatgttgagtgaatgtgtcagtgaacactgccagggtatacatatttttctaattgtaaactaaagagagcaatccaccgtgccccagcacctgcatcatacctgttctaaagcatttaccaagttgtattgcaatggtttgtctacacagctagttttccctctaacgacttcttcaagatcaggggctatgtcttattcgtttttttatgtccccggggattagctagttcttgggaaacaactgggacttgggattcaaaacagtttgctaagtgaatgaatgagaggcccagtcaagctacttcccttcagtgctgcacagtgcaacaaataaccagctcagatacaggttcaaagaccacaggcttctccctggacagctcagctctcctcataactcctgagaaaccctggacatgccagggtgtactatggagtggttgcatccggaagagggggaggaagtcccaaacactaagtaatccaggtttgggttggaaaacaaggttgaagttactcattagcaggtgaaagggtcaagggtcgaacgcaagggagctgaaagcagagtggactgagcagccagtaggggagagagcagttaaggcacacagagcaccagctccctcctgcctgaagatgttccaccaaatttgggcagctctgctctacttctatggtattatccttaactccatctaccagtgccctgagcacagtcaactgacaactctgggcgtggatgggaaggaggtatggactgagattrggggaagcctatggtggaggctctgagggacttgggtggatggcctaggatgactggagaccatcttgggaaaggaagagaggaagggggtgtgagtgttgtgataatgaaagcaagaagaaaaatatcagtactgtggccatcaatgcagaggcatggcagaattggggggtggggtggttacccaggttgactggggaggggcaaagaggaaaagtcatttaatgactctttgtcatggatccaatccccagttggaaagaggaaggcagccaacacctctacccctaaatcttgctgttttgactgatgaagaggttgaacccatcctgtgctggaacccaccctcttttgctcccttcattgtctctccagttcccagaggtccacttgggccagtggtactttatcgcaggggcagctcccaccaaggaggagttggcaacttttgaccctgtggacaacattgtcttcaatatggctgctggctctgccccgatgcagctccaccttcgtgctaccatccgcatgtgagtggtaaggaggcagaagcatcactgggttcagtctctgcccaaagtgtgagaatccacccaccaagagctggcctcttagctggtatatctactatgcttggcccacggaattcagtggctgtattaattgccctctggagaaagatgtgcctaaccaatgcttggtagcttgaaacccaaggagagctgggcttcaataacaaatacaatggagtaaatagaagccgggacaggccagacgtggtggctcacgcctgtaatcccagcactttgggaggctgaggcggacagatcacgaggtcaggagatcgagaccatcctggctaacacagtgaaaccccgtctctactaaaaatataaaaaactagctgggcatggtggtgggcacctgtagtcccagctactcacgaggttgaggcaggagaatggcgtgaacccgggaggcagagcttgcrgtgagccgagatggcgccactgcactccagcctgggcaacagagtgagactctgtctcaaaaaaaaaaaaaagaagctgggacactatggttggggtgatgctcattctttcctccttgccaccaccacctctgcaggaaagaygggctctgtgtgccccggaaatggatctaccacctgactgaagggagcacagatctcagaactgaaggttggttcttcccagccctcaccctcccttgagtttggttctgcatctctgttctcatacttctcccacctgccttgacaggccgccctgacatgaagactgagctcttttccagctcatgcccaggtggaatcatgctgaatgagacaggccagggttaccagcgctttctcctctacagtgagtagggatacaaggcaggaagggttggagggaaacaagggagggcaggagaactmctcactctgggtcctatgayaccctcccaggaagagctaggtgcttccaggggttttgactggcctgaccccaccttgcccttccagatcgctcaccacatcctcccgaaaagtgtgtggaggaattcaagtccctgacttcctgcctggactccaaagccttcttattgactcctaggaatcaaggtaaggkgttaaaatctcataaaacaggattaggactcacmaagtcttctggtgttacagggtgaaagaggctcgtgtgatgtcaccagagggatgtggctaagagctgtgatgtcacctgagggaggcaggatgggttctgggctactcaaaagagaggtttctgagtttgcactggataaagggggcagagggtcatacgtggagggaaaagagccttagagactcccctttgacacagggaatgaaagaacacgttctcccccaccccattactatcaactttgcttttctccctggacttcccttctgtccttctttttccctccccccatcacagaggcctgtgagctgtccaataactgacctgtaacttcatctaagtccccagatgggtacaatgggagctgagttgttggagggagaagctggagacttccagctccagctcccactcaagataataaagataatttttcaatcctcatctcattctggggtttgtctccagaygtcattcccactcctcccatttcaacattccccctggatcctctaccacctaaactcccagctggacggtgtcagtaagaacagagtggcagtaactctcactttgtagtgktwtatttaggatttgatgtgacacagttatttattgctgagtgagcaaacccctagcccccaagtggggactacaggcttcagtgcttcccccacactgcctgagctaccagcccttctgcactggccctcctgccaatactgcctgcactgtccccactccctctggctcccatgatcaccagatccgccctgcaggctccctgtcacctgtggggccctatccagaccccctaatccacttgcctagcagccccactcttccctcgatggctcagatcctgagatccaaggaacaccctgggtttcccaaccactctcttactgcagaggtctgtctatcctgccctggtctcctccaccccaggagagttttcaaaggtagagaggaccctttggtctttattcaccaccatcatacttttttttttttttgcttttaaaaagtggaggtggaaaaaaaaaaaaaactgaaggtgggagaaaagtaaaagcaaaaataacagctggtgaatccaagagcagtgccctcactgtccataaacacaaacaccctaaatagttctgttctctcctgtgtatgaaggggggccctgcaccctcgtactcgggtttcttccccatccctgaggtccctatgcttacaatttgggtcatgcctcacacttttctcctaaagcccacactctcttcaccctttgcccccaccccacggtcacagcccctttcccgggtctcccctctgctcctcaccttccctctccaacccctcactctcccagtcagtggccgcctcatccccattgggctcccggaggctgacagccagcaccaaggcctgcaggagaccaaagaggcaggcgaagtgcaaagggtgggcagtaagtaggctcagaacagcatggagcccatgcagggcagccaggaaggacagtaggccatgtagccagaggcccagcggtccacgcaggcccagtgtgtccaaggctgcccgcagtggtcgtgagcacagggccagcagggcagaggccagcagctccagaagatgcagggtcaggttggtggagatctgcagacactcttctgggccccccaagtaccgggagggagctcctggttccccccgcagccagcccaacagcttctcacgcctaccaggtttctccaatggggctcctggcccagggacgctcagtcccccttcaggggacacccctggtctcctggtgccacctgaatccacatgatcccatctgagtttgggactggcccctccagcctccagtctcccagactcttgagtgctagagataggctggtcccasttgagggaatccattcttttgctccctagctgctcaacttggggctcctccttgcttggttcggaagcagcccyagaaaccctcaatgcccccgagtccttagtcttgggatgccccacatcttccatggtttctggggcactatcccagtcacttcctgaattctccgaggagctgtccacccgtctgggttctgggtaaggcgggtcaggcctcattggtttccggcggccccaagggcgaggtagccagccaccaagccgtcgcaggaacatggctggggtgtgtaatgggcccccaaattctgaggctgcttcctggcactactcagactctcaggatctcctcagaagccagagtctttctggctcagaacaggtatttgcctggtgatgcagtcctactctgaattcagaagtggctcctcccttctctgaatagtcatgcagcctcaagtgtggcaagtagtttgcttcctcttcagttctggggtaaaggggggcatacccaaattcattcaccatccacacccccacaatctgagattccaagaatctcagatctgacaaggcctgggtcaccaccagagagtcctctctgcgtttccggatttccttcccagcaggcagcaccccaagtttcactcaccaaggccacaccccamggtgtcccagaaactggggaggcagtgctccatccaataaagcgggcaggaaggtggccccaggtcctaggtgctcctggatcgtgtagtctttaactgctgcccyaagggacctcaaggaataggaattctctttgttaggaggtggaatgaaagtgtccagcaaactccagccagcagcgttcgtcccttgatttagagggctatgatttctacaaagtggcccgactggcccgcgaacacgcagcagagacgcggcctccacaaggtcagaactaagatgtcctcagagatccccagttacgaagcaaagcgcgggcctacttcgggacctacgcgtccgggcgctgtgcgcggggaccgctcccgggcccagcgtcggggccgcggccttggggagccgccgggagccgcgaagcccggaagcagctgcaccaggactggaaggacccgcgggggcggtgccgcagctcatggggcggaccctgcgaatagaccgcccccgtataccccgcgctgtctgtgcgcgccggaccgccaaaccgagattagcaaggaccaggaccttaatataaacccagctccccattttcccgggtttctcatgcttccctaaactyggtcgccccctacagccccctgcccctgggttcttttccacatcccccaccactcctccatttcgcatccaagacttcatgaaaggctttcccagaaaagaaaaaatgaggagtcttgcgacttgaacagccctcccctgcccgtctgcaaatttgaattcctggatttcacaacagtgagctcttcttgtgcctaccacccggcatgagcaagacaagggggtgggtggtgggagagtggggaagtgtgggaaagaaaagtgtagacaaatgggtggaacaaagaagtntaaagtttagatttgggggctagagttctggtcccagttcaactaagtgtacaagcttgataatcgtgggccytcctatcacactggcctcttccagcaaaaccctacccattctcatctctagaggccttgacttcccttatcaccctgcattataatatttgataacatgggccgggagtggtggytcatgcctgcaaccccagcactttgggaagccgaggccggcggatcacctgaggtcgggagttcaagaccagcttggccaacatggagaaaccccgtctctactaaaaatacaaaattagctgggcgtggtggggcatgcctgtaatcccagctactggggaggctgaggcaggagaatcccttgaactcggggggcagaggttgtggtgagccgagatcatgccattgcactccagcctgggcaatgagagcgaaactgcatctcaaaaaaaaargaaaaaaattgrtaacatggcactttccctctccagctgtgaactctttgagggttgggaatgtctttacctgtattcttggcacatagtatatggacttatgtttgtgaaatcagtgaattggctgtagtcagggaactcctcctggggkaagtgagacttgcacgaagctgggcaattcttggtccagggggsttgaaagaataggtgggggactcccaggagggtctgggacctgaaagtgaacccagattggcagggaggtgaccttatcatgccacctggagaggctgccccttctgactcaggtgggacttgcatgtggctcccaggcttctgtttggcttcctcaaaatagcttccagaaaagtgaataaaccacaaatggttgatttatttctgactctcagcccgtctctcacgaagacagagcctattgaccaaaaacttcaggatctgcatctgrgcagatcccaggaaggggaagtcaaagggcccaggtcagagrcccaagttcagacttcagcagcagactagggtcagactttaccaaagtcagaactcgaggttcatgtaagtccttagatcccgctcccaagccctgtctttctcctccctccttctctcctccctccagctcagtgtggccacccgagggggtctctccctcccagccacagctcgkgtatcccaagctgggaaatgtgtcactcggggctggggtgctgatctgtagcctagtccttcctggtcyctcttgaggacagtggggatgggattggcacggccctcaccccggggtcccagccccattcctggctcccagccccccctcagcagcagtttgaagcccgggctggagatgggcaccccaagtggaaggttgggaggctgaggaccctgcgacagtgacagcaggtgarcagtggatgtgcggtggttggaatcttggaagtgggtgtcacagttctcgcagtactggagggagggagtaggagmcctgcagagaaagaagaaaaagcattaagggcaggggaaggaaaaggggaagagttgaggcctcagagggggctggcagggtagaataggatcttttcagcttttctgctaaggaacaaattgccagctaggcatagtggctcacgcctgtaatcccaacactttgggaggcagaggcgggcagatggctttgagctcaggagtttgagaccagcctgggcaaaatggcaacgcctgctttttttttttttttttttgagatggagtcttgctctgctgcccaggttggagtgcagtgccatgatcctggctcactgcaacttccaccttagcgattctcctgcvtcarcctcccaagtagccgggattacaggcacatgccaccatgtcccggcaaagcctgctttctacaaaaaatatgcttgagcccaggaagcggaggttgcagtgagctgaaatcacaccattgcacaccagcctgrgcgacagagtgagatgagtgagactttgtctcaaaaaaaaaaaaaaaaaaaaaagggacaaattgccttccttcctacttaacagtgagggatccaggctggtccaaaggtggtggtgagttatctgaattaattgttcactcagttacagatcaaactccttactccacttttcccctccttctcactactgcacttgacttgtcttaaaaacaaatttctttaaaccattgtgggatccagagcagaatagttgaaagaaaaaaatggtaaccagacctagcaaactcttgggcaaggggagggacattagtcataatgactatagctaacattcatgtattgcatactatgcggcatgcactattctagcattttacatatattaacccattgaatcctaacaacrattcttactacccccatttctaagatgagaaaactggaacatgtagacattargttgtttgcccaagtaagtggaatcaggctttaaatccagggagctcatgtttataaccacttgactatactaccctgtcaacctacacatgaggataaggaaagaactcttcagcactgtgctggggcgtctggtgtggtgtggctgggagaggcagaacacaatgagacatgggtctgagctaaagtttccccttaccggttttccgggctccttgtctctccatggctctccctgaccatgcgggctacctcagggaagccagcttcttcagcgagctgagccgcatccctgccactcagctcacagacccccacccaggcagccccacggcccaggagatagctcacagctgccccctggcccgctcgagcagcacacatcagtggggtccaccagaaggcatcccgggcgttgatattccccccagctcctcctgcctcatgcggttccagcagtctcctaagttctggcaggtccccctcctgggctgccctcagtatccggtgagtcatcttatcctcagcctcaagggatctcccttgtccatgtcttcctg

SEQ ID NO: 13507 - DNA, 14769 bp, Homo sapiens
  misc_feature (1)...(14769): n = A,T,C or G, or insertion/deletion polymorphism (see Tables 1-2)
cacctgtggtcaggaattcaagaccaacctggccaacatggtgagaccccgtctctactaaaaatacaaaaaaaaatttggcgggcttggtggcgtgtgcctgtaatcccagctactcgggaggctgaggcaggagaatagcttgaacctgggaggcagaggttgcagtgagccaagatcgtgccactgcactccagcctgtgcgacagtgagaaactgtctcaaaaaaaaaaaaaaaggaaaagaaattttctgacytatctcatctgatagtaggttataagaccctcattccagaagaggttctgccctatacctgggaggaaggaatgctgtacagagagaccaagaagaatatggccaggccttgctgggatccccccagtcccagtctgtgaccattagatgatactccttttgttcaattacatttctgcacagctgttcattcttcatcaaatctaagcataaaaatagktttcccctgggtccttgggtcttcatttctgaaggctcccatgtcacctaaaactttgattaaataaatgtattatgcttttctcttgttaatctgtcttttattataggagtattggccataacccttatgatgggtcaggaagggatcacccctttctgcccctacagaaataatagctaagactagtaaagcataaaaggcaaaggggcaggtcctcaagtagagaagaacaggagaaatagctcatacacacccagaatgttacttacatgtccctccatgttacaccaagacccctcagggaccttgtgcctggggagagaagtggtctgccccatgcaacagtgggctttaccccgggtcaccaccagccccagctccaacccctctaacactctccaagtaaaatcacatsagtagcagtaataatatttgaggtgacaagttrgtattatctcaaacttaggaaaagtgaataaagtcatctttagaaactgctttttttaaaccttgtaacttgcaagctaagtgaaaatgggctcatgtatgagaatgttcgtgttagacattttttgtgttagacaaaaactagaaacaaaccaaatccccatcaacagaatatattagaatatattgatacaatagaatattacatcataattttttwwaaaaacattactgatacatacaaccacgtatatgaatctcacaaacataatgctgactgaaagaagtcaaacagaaatgagtacattctgtgtgatttcatttatatgatgccccaaaccaggaggaaataatctatggtgataaaagtgagagagtggttggttatctttggagggtatcagcagggagggggcatgagggaacctgctggggacctgaaaatacgtggagctgggtggtggctacatacagatggaaaaattcatcagctgtacacttaagaggtgtccacctcatacctaagttacatatcaataaaaaggaaaaaaattttggaaactttttttttttttttttgagacagagtcttgctctgtcccccaggctggaatacagtggtgcgatcttgactcactgcagcctccgcctcccaggttcaaataattctccagcctcagcctcccgagtagctgggactgcagatgcgcaccagcacgcctggctaatttttgtatttattatagagatggggtttcaccatgttggccagctggtctcaaactcctgacctcaagtaatccgcccacctcagactcccaaagtgccaggattacaggtgtgagccactgcaccaggcctggaacaattttaaaataatgtattggctctgcaaatgcagcttcagaacaagtcccttagctgtccccaccccaccctaagtcaccacccttaagcctcacccatgtggaattctgaaacttcctttgtagaaaactttggaaggtgtctgccacattgatcctggaatgtgtgtttatttggggttatataaatctgttctgtggaagccacctgaagtcaggaagagatggagggcatccttcaggagtgagatgagacctcatcatacttgactgtccagcatcatctctgagtraggggaccaaaaaatttatcttccaaactaggacactttcaagagtggaagggggatccattaatattttcacctggacaagaggcaaacaccagaatgtccccgatgaaggggatatataatggaccttcttgatgtgaaacctgccagatgggctggaaagtccgtatactgggacaagtatgatttgagttgtttgggacaaggacaggggtacaagagaaggaaatgggcaaagagagaagcctgtactcagccaagggtgcagagatgttatatatgattgctcttcagggaaccgggcctccagctcacaccccagctgctcaacyrcctcctctctgaattgactgtcccttctttggaactctaggcctgaccccactccctggccctcccagcccacgattcccctgacccgactccctttcccagaactcagtcgcctgaacccccagcctgtggttctctcctaggcctcagcctttcctgcctttgactgaaacagcagtatcttctaagccctgggggcttccccgggccccagccccgacctagaacccgcccgctgcctgccacgctgccactgccgcttcctctataaagggacctgagcgtccgggcccaggggctccrcacagcaggtgaggctctcctgccccatctccttgggctgcccgtgcttcgtgctttggactaccgcccmrcagtgtcctgccctctgcctgggcctcggtccctcctgcacctgctgcctggatccccggcctgcctgggcctgggccttggtgggtttggttttggtttccttctctgtctctgactctccatctgtcagtctcattgtctctgtcacacattctctgtttctgccatgrttcctctctgttcccttcctgtctctctctgtctccctctgctcaccttggggtttctctgactgcatcttgtccccttctctgtcratctctctctcgggggtcggggggtgctstytcccagggcgggaggtctgtcttccgccgcgtgccccgccccgctcactgtctctctctctctctctctttctstgcaggttctccccatgacaccacctgaacgtctcttcctcccaagggtgngtggcaccaccctacacctcctccttctggggctgctgctggttctgctgcctggggcccaggtgaggcagcaggagaatgggggctgctggggtggctcagccaaaccttgagccctagagcccccctcaactctsttctcccctaggggctccctggtgttggcctcacaccttcagctgcccagactgcccgtcagcmcccyaagatgcatcttgcccacagcamcctcaaacctgctgctcacctcattggtaaacatccacctgacctcccagacatgtccccaccagctctcctcctacccctgcctcaggaacccaagcatccacccctctcccccaacttcccccacgctaaaaaaaacagagggagcccactcctatgcctccccctgccaycccccaggaactcagttgttcagtgcccacttcctcagggattgagacctctgatccagacccctgatctcccayccccatcccctatggctcttcctaggagaccccagcaagcagaactcactgctctggagagcaaacacggaccgtgccttcctccaggatggtttctccttgagcaacaattctctcctggtccccaccagtggcatctacttcgtctactcccaggtggtcttctctgggaaagcctactctcccaaggccacctcctccccactctacctggcccatgaggtccagctcttctcctcccagtaccccttccatgtgcctctcctcagctcccagaagatggtgtatccagggctgcaggaaccctggctgcactcgatgtaccacggggctgcgttccagctcacccagggagaccagctatccacccacacagatggcatcccccacctagtcctcagccctagtactgtcttctttggagccttcgctctgtagaacttggaaaaatccagaaagaaaaaataattgatttcaagaccttctccccattctgcctccattctgaccatttcaggggtcgtcaccacctctcctttggccattccaacagctcaagtcttccctgatcaagtcaccggagctttcaaagaaggaattctaggcatcccaggggaccacacctccctgaaccatccctgatgtctgtctggctgaggatttcaagcctgcctaggaattcccagcccaaagctgttggtctgtcccaccagctaggtggggcctagatccacacacagaggaagrgcaggcacatggaggagcttgggggatgactagaggcagggaggggactatttatgaagkcaaaaaaawtaaattatttatttatggaggatggagagaggggaataatagaagaacatccaaggagaaacagagacaggcccaagagatgaagagtgagagggcatgcgcacaaggctsaccaagagagaaagaagtaggcatgagggatcacagggccccagaaggcagggaaaggctctgaaagccagctgccgaccagagccccacacggaggcatctgcaccctcgatgaagcccaataaacctcttttctctgaaatgctgtctgcttgtgtgtgtgtgtctgggagtgagaacttcycagtctatctaaggaatggagggagggacagagggctcaaagggagcaagagctgtggggagaacaaaaggataagggctcagagagcttcagggatatgtgatggactcaccaggtgaggcygccagactgctgcaggggaagcaaaggagaagctgagaagaygaaggaaaagtcagggtctggaggggygggggtcagggagctcctgggagatayggccacatgtagcggctctgaggaatgggttacaggagacctctggggagatgtgaccacagcaatgggtaggagaatgtccagggctatgraagtcgagtatggggacccccmcttaaygaagacagggccatgtagagggccccagggagtgaaagagcctccaggacytccaggtatggaatacaggggacrtttaagaagatatggccacacamtggggccctgagaagtgagagcttcatgaaaaaaatcagggaccccagagttccttggaagccaagactgaamcmagcattatgagtctccgggtcagaatgaaagaagargrcctgccccagtggggtctgtgaattcccgggggtgatttcactccccggggctgtcccaggcttgtccctrctmcmcscacccagcctttcctgaggcctcaagcctgccaccaagcccccagctcyttctcccsgcagggacccaaacacaggcctcaggactcaacacagcttttccctccaaccccgttttctctccctcaaggactcagctttctgaagcccctcccagttctagttctatctttttcctgcatcctgtctggarrttagaaggaaacagaccacagacctggtccccaaaagaaatggaggcaataggttttgaggggcatgrggacggggttcagcctccagggtcctacacacaaatcagtcagtggcccagaagacccccctmrgaatcrgagcagggaggatggggagtgtgaggggtatccttgatgcttgtgtgtccccaactttccaaatccccgcccccgcgatggagaagaaaccgagacagaaggtgcagggcccactaccgcttcctccagatgagctcatgggtttctccaccaaggaagttttccgctggttgaatgattctttccccgccctcctctcgccccagggacatataaaggcagttgttggcacacccagccagcagaygctccctcagcaaggacagcagaggaccagctaagagggagagaagcaactacagacsccccctgaaaacaaccctcagacgccacatcccctgacaagctgccaggcaggttctcttcctctcacatactgacccacggctycaccctctctcccctggaaaggacaccatgagcactgaaagcatgatccgggacgtggagctggccgaggaggcgctccccaagaagacaggggggccccagggctccaggcgktgcttgttcctcagcctcttctccttcctgatcgtggcaggcgccaccacgctcttctgcctgctgmactttggagtgatcggcccccagagggaagaggtgagtgcctggccagccttcatccactctcccacccaaggggaaatggagacrcaagagagggagagagatgggatgggtgaaagatgtgcgctgatagggagggatggagagaaaaaawcrtggagaaagacggggatgcagaaagagatgtggcaagagatggggaagagagagagagaaagatggagagacaggatgtctggcacatggaaggtgctcactaagtgtgtatggagtgaatgaatgaatgaatgaaygaacaagcagatatataaataagatatggagacagatgtggggtgtgagaagagagatgggggaagaaacaagtgatatgaataaagatggtgagacagaaagagcgggaaatatgacagctaaggagagagatgggggagataaggagagaagaagatagggtgtctggcacacagaagacactcagggaaagagctgttgaatgcctggaaggtgaatacacrgatgaatggagagagaaaaccagacacctcagggcyaagagcgcaggccagacaggcagccagctgttcctcctttaagggtgactccctcgatgttaaccattctccttctccccaacagttccycagggacctctctctaatcagccctctggcccaggcagtcagtaagtgtctccaaacctctttcctaattctgggtttgggtttgggggtagggttagtaccrgtatggaagcagtgggggaaatttaaagttttggtcttgggggaggatggatggaggtgaaagtaggggggtattttctaggaagttyaagggtctcagctttttcttttctctctcctcttcaggatcatcttctcgaacccygagtgacaagcctgtagcccatgttgtargtaagagctctgaggatgtgtcttggaacttggagggctaggatttggggrttgaagcccrgctgatggtaggcagaacttggagacaatgtgagaaggactcrctgagctcaagggaagggtggaggaacagcacaggccttagtgggatactcagaacgtcatggccaggtgggatgtgggatgacagacagagaggacaggaaccggatgtggggtgggcagagctcgagggccaggatgtggagagtgaaccgacatggccacactgactctcctctccctctctccctccctccagcaaaccctcaagctgaggggcagctycagtggctgaaccgccgggccaatgccctcctggccaatggcgtggagctgagagataaccagctggtggtgccatcagagggcctgtacctcatctactcccaggtcctcttcaagggccaaggctgcccctccacccatgtgctcctcacccacaccatcagccgcatcgccgtctcctaccagaccaaggtcaacctcctctctgccatcaagagcccctgccagagggagaccccagagggggctgaggccaagccctggtatgagcccawctatctgggaggggtcttccagctggagaagggtgaccgactcagcgctgagatcaatcggcccgactatctcgactttgccgagtctgggcaggtctactttgggatcattgccctgtgaggaggacgaacatccaaccttcccaaacgcctcccctgccccaatccctttattaccccctccttcagacaccctcmacctcttctggctcaaaaagagaattgggggcttagggtcggaacccaagcttagaactttaagcaacaagaccaccacttcgaaacctgggattcaggaatgtgtggcctgcacagtgaagtgctggcaaccactaagaattcaaactggggcctycagaactcactggggcctacagctttgatccctgacatctggaatctggagaccagggagcctttggttctggccagaatgcygcaggacttgagaagacctcacctagaaattgacacaagtggaccttaggccttcctctctccagatgtttccagacttccttgagacacggagcccagccytccccatggagccagctccctctatttatgtttkcacttgtgattatttattatttatttattatttatttatttacagatgaatgtatttatttgggagaccggggtatcctgggggacccaatgtaggagctgccttggctcagacatgttttccgtgaaaacggagctgaacaataggctgttcccatgtagccccctggcctctgtgccttcttttgattatgttttttaaaatatttatctgattaagttgtctaaacaatgctgatttggtgaccaactgtcactcattgctgagcctctgctccccaggggagttgtgtctgtaatcgccctactattcagtggcgagaaataaagtttgcttagaaaagaaacatggtctccttcttggaattaattctgcatctgcctcttcttgtgggtgggaagaagctccctaagtcctctctccacaggctttaagatccctcggacccagtcccatccttagactcctagggccctggagaccctacataaacaaagcccaacagaatattccccatcccccaggaaacaagagcctgaacctaattacctctccctcagggcatgggaatttccaactctgggaattccaatccttgctgggaaaatcctgcagctcaggtgagatttccggctgttgcagctggccagcagtccggagagagctggagaggagccgcattctcaggtacctgaatcacacagccaagggacttccagagattcggstgtctaggcttcaaatcaccctgtcctaactctgcaacctgaaccagccacttaacctatctatccaatggggataggaatgtccaccacacatagggcatgtgagagaaggcctgacctccatcagaggacctcactcagcccttggcacagtgggcacttagtgaattctggcttccttcaaccagtttccagctgttctatccccttccattctctcagtgggtgaaatcgaagagactgaggacaataaagaacaaggaaccraactgccggacgtggtggcatgcaccygtaatcctaccactttgcaaggccaaggtgagaggatcgcttgaacccaggagttccagarcaacctgggcaacatagtgagatcctgtctctattttttaaaaaagaatgaaacataggaataagatgtgggtgaaggactcacatgccggcttggtcccactsgtctttgtggtgaaggaggggagagrtgagaggtgggtaatccggaaagagaaaagcaccccctccctggatgaaggctcttctggagagagtcaaagacaaataagggtggggcgcagtggctcatgcctgttatcccaacactttgggaggctgaggtrggaggaccacttgagcccactagttcaagaccagcctgtgcaacatagcaagaccttgtttctagaaaaaaaattaaagattagtcaggtgtagtggtgcatgcctgtaatcctagctcctcaggaggctgaggcaggaggatcactcaagcccaggagtttgaggttacagtaagctatgatcatgccactgtacccccgtctgggtgacagaacgagaccctgtctcaaaaaaataataattccaaaammaaatatggagacggaaattgagcccccctagactgggagcccccactgagttyggaaattaggctttacctccagccctggggtgccaggcargagaaaaccatgtrgtaggctgagggggtagggtgacccattggggtgacctakatagggccttgggtcaccctctgcctcctccagcctgtggctgaaagtcagccatgaagtaatgggggacactgttactcatcccagaagcacccayacttactcacttttgggaagggggacctaaagtgtgaaaaaaaggtgaggattttccgtctcaccctaaatgggacaycctaagtggggcatcggtttttcctcctccccagaacttcctggtgttttcaggcaccacaggctccttcctgccatccccatctctctctaatattctcccyttctttctccttcagcctcctcccttyagaccccatgagccttgaattaagctccttggaggagaagagttgactgtcgggtaggagacagagaggccttcaggcagctctagggggagaagtgcggggcccctccaggcttcattcctctgtcatgataggggcttactctgctgctgggcctttctgagtggtgcttgctgggctctgtaatgacccctctcactgttggggggtacccaagagaaaagagtatggtgcagagtctggttgggaccatgtggccctgaaaatcaggatgcctagagaagcttcggagtttgagaagtcccccttcctcccaccctccaactgggctaatggtggggcctggccattcagaggcagggagggggtgggacagrcagaccatcatccctaggagcaaaggccatacactgtgttgtgatgaattgtttcaagcaaccagaagastactgagaatatttaacccgcacccgtgcacccaccctgaattaagacgtgtgtcgcaactcagcatctttatcggcagcactgaagctttccattctttaytttcatcaggttcaaaatcaatttccaaacagtctcctacatttttcccactgccatggggtcctgggcgtccgggcccccartattcacgcactcgcaccacgcactcatattccctcaccccaccatcacggccccaaagaaggtcttccctctcgcraagtccaccatatcggggtgactgatgttgacgtacaccctctcgcccctccggagctgcaccaggccgccgaaccccacgctcgtgtaccagagaggcccgtacccttgtctcctggccgggtccagcactggagtcaccgtctcggcgccctcgagcagcagctcgggagtgcccggcccgtaggcgccccccgcccggtacagagagctgcgcagcgtgaccgagcggccytgggggtccccgccgccagggggcgcccggccccggtagccgacgagacagtagaggtaatagaggccgtcctgcgggagcgccagcccctcgkcgtccgagaactgcgtcccgctcgtcagaaacgsctgttccttcgtcgtctcccagcctagcccctgccccttcagcggagcgcctgcggagacacgggccgacgcgctcttgggaatgcgatcctaaaggcttgggacttctggggaagtggcggcttttagcccctgcgggagccgagccgggccgggggaggagggatggtgctgtttcwgggatgagtgcgagttgggggccgagggaacacggatgtggggtgcagaacgctgtagtggggacctccaggccggcttttgcttgcaccggagggaagaagaaactacactgcggggacgagcgtaagagtgggcacgagcgacaaaaggtcgtgaagcgggtgggaaaccgagcactggaatcatggagccgaaggactctgggcgagcagaamtggaaccttcggattatttacactcttattcaggtcttggaggtccttacctatgaggtgggcagctgggarcccgggsctgagatctgtttctggctcctcctctggcagcttctgaaacyctggaaggggcaaagagtccacgattgggggcagggcagccacccatgcaggctacccttgagagaacagggcgcagggatggggagcctggattcctagaggaagaggtatctggggacgcagcagggagctgggagcccctgagggkctgaagcggggaaggagagacagtctgctcttacccagtccttgctgggcctgtgccccggggtcggccgtctccgttacctggttgggtggggtcacagtgcccagagytcagattcagytcatgtcaccccwacccctctgaaagtggacccaagctgcaggcctggggtttctcctaccagcaccatccccaayacacacctccttagaagggagaasaagcaaggcataggtacttgggcrgagaaacagatgtacctcgggaagaggagaggagacacaaggggcttatgtcgggacacaagcacaacatcacaggaacatggaaagagagtcagcaaagagacaagacatccccaccagggacagccgagccagctgagccagagggggcaaaagaccacaggcacaaccagagggagccaagcatccgcargatwcaactctccaccagggcctgttgcagccactcaccagtcctccctgatcctggggcactaaggccagcacagccaggacagtgataggcaccgccagcaacaaggtcaccagagaagtggctcctgccacagctagcaggagggaacccctcccctggagcctcccacccctgccctccagccccagtgcccccattgagactgaaccagagccagagcagggggctttcatacctcagggacgggcccaccccckccctgtagacctgcacacctggctgggactttccgcacacccctgctcccctcacccagcttcctgtttacccagagctggggtggggcagctggatgcctgggttctctgaactggggaagaagttgaggttagggagacaggctctcagggtggaaccaaaggggtctttagacatcttctggctcagcagagagrgaaactgaggcccagggagggaaggtagcttgcaggaagccagtcagcagagctgaaatgagaacacagatctccaggtttccaatrtggtttgcattcttctatacyctcaaggtaggtgctggaggaagagctgatcccgtctctgaggtcaagggccggactaggacaaggactggaatcttgagggatggatgtctgggttccctgagaagaactgattcccatactgggctgacctcctcccgttcccttgctcatctccagccccctgtgctgagtgagaaagggagaggtaagccttagcctcaccactgactactgactcactaaggagggatggaaatggagctttacctcccttgctacaaaaagtaaagacagatggacgaggcatactcccaccctcagagagcttccaagtctacaatgagccctatccattagtaggtgcttactaaatgtttatacataaatgaataaaaggacaaataaatgcaggaataaccaaaacaaagcagcaaggaccacatgaatggtagatgtaggcagcatgagtggttaagagtcaagggagtagccggggtagtggcttacacctgtaatcccaacastttgggaggctgaggcaggtggatcacttgaggtcaggagttcgagaccagcctggccaacatggtgaaaccctgtctctactaaagatacaaaaagttagccgggcgtggtggcacgcgcctgtaattccagctacacaggaggctgaggcaggagaatcacttaaacctgggaggcagaggttgcagtgagccaagattgcaccattgcactccagcctgggcaacaggctgagactctctctcwmaaaaaaaaaaaaaaaaaaaaaaaaagagtcaagggaagaaagaccaggtccaaggaagctggaagtggctccaatcatctccccttcttggtaacatctctatgtgtttccgtaatactaataataatatagctgacccacaaaatgcacttaacatgtttatgccactgatttacacactttaataatttttttttttgagacagggtytcgctatgtcacscagactggaatgcaatggcaggatcatggctcactgcagccttgacctcccaggatctatggattcacctacctcagcctcctgaatagctgggactataggcacatgccaccatgcccagctaatttttgcattttttgtagagatggatttttgccacattgcccaggctgggctcaaactcctggactcacgtgatctgcccgtgttggcctcctaaartgmtgggattacaagcatgagccatcatgcccagccaataattataatcctgacaaaaaccctaagaggaaactgaggtacagagaggttaagaaacttatggagctcacagagtcagtggcagaaccagaatttgaacccaggcatctggctccagagccttgataacaagacagtttaaaaactgaatactggggctgggcgcagtggctcttgcctataataccagcactttgggaggccaaggaaggtggatcatctgaggtaaggagctcgagagcagcctgatcaacatggtgaaaccccatctctactaaaaatataaaaattagcggggcgtggtggtaggcacctttaa

SEQ ID NO: 13508 - DNA, 16837 bp, Homo sapiens
ctttttgttcactaatgattcccaactcccaatcatctggctggctccagcccagtctagaaaagtcttgttccctttccagctctccttcctctgatgtaccgaaacactggggacccaggtggagcacacatgcacacacacacatcaacacgcatatgctgttttgctctccctgcccttttacctttacaactgttacacaaagatgtgctttcctccttgggatgccttcaccatcccctctcttcatccctatccatctcttctcccaaactctcttgtaaagccctgttccctgggaagtcctgtttgatttaccctcggggcagttttccctctcctgacagcactctgggcctctcagactattggcctttacctgagagcagggagaagatgaagaaaagagagaggaagcgctgaaggggtgggagggccaagagagctcctggagtaggctgggctagcgcctaggtccaggaggatggcggagcctccagaagtgttgcagtatctccgtcacctctctgtccctcccccaggactgcctttgctcccaccaaaaacaccgatatttcctggtgtctattctaaagtccttctatgggctggaagctggaggcccagagataaaaaaggaatgggggccctattctcaaaasacccacaatctaactggaaaaatgatgcaggaaaagaggagcaaaaatataaaatagcaacacaataatgtggatgaattaaaaggaaggcagggtgtcaactggccaagtaggtgaggaagaggtgccagaatttggttaatgatgggctaggtgtggtgtctcatgcctgtaatcccagtactttgggaggctgaggtgggaggatcacttgagtctaggagctcaagctcctatattgtccagcctggacaatataataataagatcctgtctatataaaatacttttttttcttttttgaggggggyttcgctctcgttgcacaggctggagtacaatggtgtgatctcagctcactgcaacctccgcctcctgggtttaagcaattctccttcctcagcctcccaagtagctgggattacaggcatgcgccatcatgccaggctaatttttttgtatttttagtagagacgaggtttcaccatgttggtttcaccaggctggtttcgaattcctgacctcaggtgatctgcccacctcggcctcccaaagtgctgggattacaggcgtgagtaagcacacctggcctaaaaaattaaaaaattagccagatgtggtggtgcgtggctgtggtcccaactactctggaggctgaaatggaaggattacttgagcccatgaggttgaggctgcagtgagctgtgactgagccactgcactccagcctgggtgacagagtgagaccctgtttcaaaaaaaaaagaatgtggctagtgatgaggggagtgaagggagggtccttgtaagctgaaagcttggagttcaggggaagaaatgatctctgagcaccaattatgcctcatcctcatttccccttatcccatttcaatccccaagatgagaaactaccagggggttctggggaaggtgattcagccagctaactgaagcagagtgtgtttcagggtcattgtctacgggaccctgaatgtcaggtggagcacaggttctatggtaggggaggacatcgaggaataacacacaccgggacctgtgggrtcggggggcaaggggagggagagcatcagatcaaatagctaaggcatgtggggtttaatacataaatatatggactgggcatggtggcttatgcctgtaatcccagcattttgagaggctgaggcgggcagatcatgaggtcaggagttggagaccagcatgatcaacatggtgaaacctcgtctctactaaaaatacaaaaattagccgggcacggtggcacgtggctgtaatcccagctactcaggaggctgaggcaggagaatcacctgaacccaggaggcagaggttgcagtgagccgagttcgcgtcactgcactccaacctgggcgacagagccagactccgtctcaaaaaaaacgaaaaacaaaaaacataaatacataagtgatggattgataggtgcagcaaaccactgtggcacatgtttacctatgtaacaaacctgcacattctgcacatacatcccagaacttaaagtaaaatttaaaaaccaagaaataaaaagtaaagtgcccccgaaatccttgaggagaagagaattatgggatcaggagcacatttcagcaggaccagtttggatggtatgtgtgggagagatggcagaaaacagaggctgcaggttagctgaggtttacacagtagttcccatcaggcccacgtcagccttaggccatgtcatgatgtgatgtggtcattgaacttcctctctgggactttctgtctgtggactgtgccactgtttctcgtctcaaatttaaagctgaatatggtccaggcaggccccttcctttatcccttgttctcaaaaggaagtcagcacttggggcaccatgaatttagagggacgggttgagtgtgagagacacagcatgaaggatcagaaaaccagggtataatgtagatgcggaggaggaagttccagtagagtttgtttatggaaaagcttaagtgatagcccaagctatttagcctttcctcagcctggaagaaacttctcagcaaacccttctcacacaaaggccagacagaatccgacagttttgtaccttggcccacactcttggtctgagtgctgaacatgtgcttcagatttctgccctgggtactaaggcagagggcatcccaatggcaggaaggcagagttcaagcgtctcagtctgcaaagagacyggttagaccctcagtgctgatggccatacaactggggatcatgctagagggagggggaaacagggaagtgtaatcctggggtggtgggtggaactggactgtgcaatcgggcttagaatctagaaagtaacagctgggcaggtgggagcggcaggcagggagaatytgaggcagtggtagcagcgtgggaagcgggggctggaaattgaggagggttgaggagggagtggtggatgttaraagctggcaaagtgttgggctttttctgaacgataacctacaaaggagtagcacagccytttttttttttttttttttttttttttttttttctttgagacagggtctcactctggttgttccaggctggagtgcagtggtgtgatcttggctcatcccttccaccttagcctcctaggtagctgggactaaaggcatgcaccaccacwyctggctgatattttgtatttttagtagagatggggcttggtcatgttgcccaggctggtctggaactcctgggctcaattgatcctcccaccttggcctcccagagtgctgggattacaggcatgaatcactatgacaaacatctttaaagagccacatcaatctgggtgcagtggctcacacctataattccagaactctgggaggccaaggcggaaggatcacttgagcccaggagttccagaccagcctgggcaacatgtcgaaaccccctctctgctaaaaatacaattagccaggcgtggtggtgtgtgcctgtagtcccagctacctgggaggctaaggtgggaggatcttctgagcccaggaggtcaaggttacagtgagccgtgatggagtcactgcactccagcctgggaaataaaatgagaacctgcctcaaaaaaaaaaaaaaatctagaaccagaccagaaataccatttgacccaacgatcccattactgggtatatacccaaaggaatataaatcattctattataaaaatacatgcacatgtatgtttattgcagcactattcacaatagcaaagacatagaaccaacccaaatgcatggaatactatgcagccataaaaaggaatgtgataatgtcctctgcrgggacatggatgaagctggaagccatcattctcagcaaactaacacaggaacagaaaaccaaacactacatgttctcacttataagtgggggctgaaaacaatgagaaaacatggacacagggaggggaacaacacacactggggcctgtggcggggtaggggctaggggagggagagcatcaggtcaaatagctaatgtatgcgggacttaatacctaggtgttgggttgacgggcagcaaaccacatggcacatgtttacctatgtaacaaacctgcacattctgcacatgtatcccagaacttaaaataaaataaaataaaatttaaatttaaaaaagagccacactgggatcctgcaagagcacagccatctytttccccttcccaacttcccacaggctttccatcttattcaggagcaccaacccgaagtccaggagaaagaccctaagaccctagccagaaccatgtgtaggacaaaataaatagtgataaagggtgtgcagcaggaccccagtactctggaacccatctctgacagccttggttccagggagcttggtcagagcttgtggcagggggttgaagagccttggtggaaggggtgctttctctcacccctttcccaattttgcccttcctctcctctgccctggtctacttctcccatcagcagtagcttctcccatcagctgccccacaaccctctcctccctgcctctccagtctgcatcagtatctcagggaaacaggaaaacaccattctccaaacacatgtcctagggtcccagggttgcatggcgaagcgggctgtgctgacaaygaggttcgtattatttctatttacctaaaagttcaagaaggccttgctgacattgttgcttggggcccagcatttaaacttagtcactgcccagagcccttgttttaggaaagaatgagatggtccctgttgcataacccagagttgggtgggtgtgggttgcmgaaggaaacaatccctcttcctctctcttgtgaggcctggctaggagtgcctgggatgggcgggacactgcctggggaaggcgggtggggagcggtggaacccgacccttggagcgaaggcggacaagtaggyaggcaaagatgctgagtagtccctccccaaagtcccctgggcacaagacagtctgatgaatctagaaaaccccatggatgactgggagggaaggaaacggattctgggagaggagaggaatggagragcgagcttacctgaaggacggggatggggaggggggtggggtctgcyctctggccactgtccccaagagcatcccgaatacgagttcctttaattctctccctctctagtttcaacctgccaatttccccctttccctgcctcccagccagttctcaccctgcacacagccctctccaatccttccagactccgcatgcgcccaccacaatgctagggtctcctacggttcattcaagttgtatccctccctgcctcccggcccttcccccattggcttaccccagtctggttcccctcgggccccttttctccatagtcttacctcaagggtgctttctcttactcctttcccaattttgcccttcctctcctctgccctgttctacttctcccatcagcagtagaatttcccaagaccccgttatccaccctctccatcttttctctgtccctccacatttgcccactcctcttgtgatccacacacaccatctcttctcagttccctttcagcccccgkcttctcactccccaccgggtccctgcatgcccctcgtcgtcctacacatacacacyaagtggattgcactcccgtcctccccttcttccgctcctccccaccctccagtccctccagccagctgtacagctcccaaattccgggccgagattcccgggaacaaagcaagaaaaatcagagcaatttgggaagtaaacagaaactggaaaggragagggaaagaagagtggggaggacccaggttgggggggccctctccagtcccacccagtttagggaatgcccctgccctctcccccaccccccttcacctggctcttaaagggcccggcccctggccggcggctacttaagacagaggggcggcggcgggcagcagctgcgctgcgactgctctggaaggagaggacggggcacaaaccctgaccatgaccccccacaggctgctgccaccgctgctgctgctgctagctctgctgctcgctgccagcccaggaggcgccttggcgcggtgcccaggctgcgggcaaggggtgcaggcgggttgtccagggggctgcgtggaggaggaggatggggggtcgccagccgagggctgcgcggaagctgagggctgtctcaggagggaggggcaggagtgcggggtctacacccctaactgcgccccaggactgcagtgccatccgcccaaggacgacgaggcgcctttgcgggcgctgctgctcggccgaggccgctgccttccggcccgcgcgcctgctggtgagtccgcgccccgcccctgccccgcccacgtgagacccgcgtcctccaggcagggtcctggggagacgggagtgggtggcccggcaagcctttccgccctggcccttgacgcttccgactttggggggcacatttgtgtgggggagaaggggcaagtgcaggaagctgaggtgcagcsaggggacctggtgatacagcagaaggtgtctgcgctctcggccttcttttttgctccatttattttcccttgatggagtgtgcgtgcaggtgggaacttgggggagkcagggggagaaatgggagggttttagggccatcccatgggctccagcaggcccagctcctacaaccctagacggccaagctggggaaaggacccaaatgttgttctcagcttccacttggagaaaaggrgaggggaaccccagactctgaaattctgcacacactgagaaatgactcctttcctcctaataccggtgttcgaagcacctaaacaggaggcgtctagaaccgaagaggccccaaatccagggttgtattagacttgagtagggactgagggcaggctagggcgtaggttaggggagaggggagaaagagtaggggaaagrgggaatctgccaaatcagggttatgatttaaacctgctcagaatcgytcacccatcctaccccaccctgctccagggaggagagcagaagctgagtcacygggtgggtgggacagaagtgaatcagccgtgaaaacatggggggcagcggggagatggggagggcaggaaatgcaaactgcgcatcccagaggctctgggttccttccacgggaggggatggagaattcacttggagtttctttcagttccaaatgcccgagtgcaggcttctgggcgtcctcctaaaaggtggtctgggtggatgagaggaggcagtttggaactaaatggttgggtgctaaatgtagggaatgaaggagaaggtctggggaggggtgggcatcctgaggaagaaggatcagactcaggaytgcaggggaaatgtctcctgggttgtgagtggtagttagctgggagcttgtctttaggcacagaggaagaggatcccttcaggggttctgatatctgattagatgttaggcaaattccaagcagtcagtacatgctcccctttctgccttttcctgtccctgacttatttcctcaccccttcccagtcctgagctctccccggaccctccggaaactttctccagagccaggagcaacctgcaggttggaagcccctcattccttgcaccttcttaatctgccctcagcctatcttggttaagggttgaatccatgtgctcctgggaccactggggttgagctggcctgggtcacagggtaccagaagggagrggttcccactgcagtgccccagaagtaaccacatctcaggcctgggaggggtgggttgagtcatagcaaggtcacagcmgggacacacattccttttgggtccctgttggcccccctcctacatcygttgctcttctgccccagctctcyggcttcgtgcgcccccttctggcctctggtggaacagccaggtcttttcacccaaagcccaaagccccaaatagtcctttgaatttgttctccattttttcatttattttattatttattgtaattaattgattgatttttaaattagttaattttttaaaattaagtaattagttaattttttaaaattaagtaattaattaattttttaaaattaagtagttaattttttttaattaagtaattaattaattttaaaaagtatttatttattttgagacaaagtctcactctgttgcccaggctggagtacagtggtccagcgtctcactgcaacctccgcccccccgagttcaagcgattctcctgtctcagcctccggagtagctgggactacaggagcctgataccatgccaggctaatttttgtatttttagtggagacggggtttcaccatgttggccaggctggtctcgaacgcctgacctcaagtgatctgcccaccttggcctcccaaagtgctgggatgacaggcrtgagccactgcgcccagccaataatttatttatttttgagacagggtctcactcggttgtccaggctgaagtgcagtagcacaatcatggctcactgcagtcttgacttctggggctcaagcagtcctcctgcctcagcctctcaagtagctgggactgcaggtgcacgccaccacacctcggtaattttataaattatttgtagagatgaggttctcattatgttgcccaggctggtctcaaactcctgggctcragcaatcctcccacctctgcttctcaaagttctgggattacaggcgtgagccattgcayccatcctcattttccatttttgctttccaaaattcatctcctttataagccttaaaaatcagtatgggaaatactggggaatattgtcaggaaaagtaatataactatytgtcagagaaagaaactagggccagcatcatgcaacagcggggcataaggccctcccttccttacttcagcaggtgatgtgggcaaggcccttctccacatggctctgcctgatttctgacctctccttctcctattcctcctccagttgcagaggagaatcctaaggagagtaaaccccaagcaggcactgccsgcccacaggatgtgaaccgcagagaccaacagaggaatccaggcacctctaccacgccctcccagcccaattctgcrggtgtccaagacactgagatggtgcgtttggagctggtagggagcaggaggggtgggaagccytggagacttccatctgagactgctcccttgggcttggagacgtctccattgtctgtcctgggtgcttgcctggtgggccagaaggttggaatggggagctgggctggagcggttctaagctgcctactctcccttccccagggcccatgccgtagacatctggactcagtgctgcagcaactccagactgaggtctaccgaggggctcaaacactctacgtgcccaattgtgaccatcgaggcttctaccggaagcggcaggtgagactatttttcttctcctcctgctccagcagaaggctcctgccagggagtgggggcggtgctgcttacaaagctgcataaataagacactgccccatctttaaggatcttccaactttaggagaacatagagaatataatttattaaacaaacttagagaataatcaaccacacactgtgagagaaaacccacttaaggaatgccctaactcagtggytcttgaacttgaggcatcagaatcctccggagggcttatgccacacagatagctgagccccaccggcagccttcctgattcaggaggtgtggggtggggcctgacaatatgcatttctaacatgttccctcgtgatccggatttgggaacgtcactttgaaaactactgttccaggctagcagaatgcacacaatttattggttgaagagggggaactaaagagagggaacactgggccgggtgcggtgtctcatgcctgtaatcccagcactttgggaggccaaggctggtggatcacgaggtcaggagttcaagatcagcctgaacaacctggtgaaaccccatctgttttaaaaattacaaaaattagccagatgtggtggcatgcacctgtaatcccagctactcaggaggctgaggcaagaraattgcttgaacctggraggtggaggttgcagtgagcagagatcatgccaatgcattccagccagggcgacagagcgagactccatctcaaaaaaaaaaaaaaaaaaaaaaaaaagagagggaacccccgaggagacgctcaggtgtttttacatcctcagactcagatgtcccctctcattctcctgstggaagcctctggcctcactcctgacctgtgtgcctctctctccagtgccgctcctcccaggggcagcgccgaggtccctgctggtgtgtggatcdgatgggcaagtccctgccagggtctccagatggcaatggaagctcctcctgccccmctgggagtagcggctaaagctgggggatagaggggctgcagggccmctggaaggaacatggagctgtcatcactcaacaaaaaaccgaggccctcaatccmccttcaggccccgccccatgggcccctcaccgctggttggaaaragtrttggtgttggctggggtgtcaataaagctgtgcttggggtcgctggcttgtgtctctgtgtctgcctctcacaattctggaatccctggccctctctttaccccactacagctcactcacagcatttctcctttcctgtggatacctttagtccttcctgtgacagccaggcagaagcttcaagccatcaagcctcacagagctgcccaccaggagttgggagtgggaaggggagacactgagatcatggccttaatctgaagttgtgaccttgtttctaacactgatctttggacacaaagggaggggaaggattaatagttaatcccagcaggaacccagcaaagaggaactctcaaarcacatacccttctgttacttcctactaaaaaaagaaggaaattattactaatatatgagctcatcccatggcccygaaccatgtgattttacctggacaacctcattttgagcttacgataaccttgtgatatagggatttttacccctatttttcagaggaggaaactggcttaaaatttggggtcacttgcctgaaattatatagctggtaaatgacagagggaggtttgcatccggttcttccatatgtgacaatasytggtattccctaggtgctgaatacgtgtttgtttagtctcctttctgcctacatgctcacccaagcaggtgtcaggaagcggccctgtcagttcaggggccctgacactcagcctttcctggaggggccccagttccgtgagtagcacagtgccaaccccatcagaatattaccacatgtgtcaatcacacaccttgtggtgaaagcgagctgaackcactgatacatgaagacatttctgactcctccctgaccttcagcctgctgggagagagacyggaaggccagccatgctaggtgacaagcttctgagaggcaaagttccyctccccaagatgtacccagccactattcctgtgtgtgtgtggcggggtggatagcacccttggagctgggcatctggatggtggttggggtgttagggggatgtggcgatccctgcgacagacagcagagtgaggtctgaatctgagaagctctgcctccagatcagataacctatcgcactcccagaggccccctcctcctgaaaggactttagtctttggagctgtcacctgagctgagtgggacaagagctctrcagggcaggccacactgcgaaggaaggaggcaacacgggcaagggctgcctgctgcccgctggagaccgcaccatggagccaggcggggcccgtctgcgtctgcagaggacagragggctgggaggggagcgggagcgccaaccctgtggagatggtgagcygccctcgggggtgcagaaggcacaggcaagtgggggggaggcggggagagatgcgctatggagagaaggctccaactgcctgatgccaatccttcctgctgtccagagaggccaaggaaggtagaccctggcctcagcccagagccacccagctggaagatggaacagaaaagagctatgtcagagctgtggcctggccttatccttctgactgtttagccccagatagtgaatggagtagcttcccrttccctgagtgccctgttcccagyaatgtcaccaggccccctgcttgcctatggcctcctcaccactggcaacagcaacttccccttctagtagccccaaccrtgatactagatattggctggttggggtgagggcagctgctgagcacacaaagcatttcctgaccacaggatgcctctgggtctgcagaaccccaattcctcctgttgactgtgcctttgatccctsctcacaggaaacactgagacgcacagagccccggacttggtacaatggacccgacacatggaggtgagkgatgtcagaggtcagaggtcaagtggacagatccttggtagcaggaagcaggagtgaggcttggtgataaagatgacttttttttttttttttttttgaaacaaagtctcgctctgttgctcaggctggagtgcattggcacaatctcggctcactgcaacctctgcctcccaggttcaagcragtagctgaactacagatgagtgccaccaggtgtggctaattttttttttatatttttagtagagacggggtttcaccatattggccaggctggtcttgaactcctgacctcaagtgatctacccgcctcggcmtcccaaagtgctgggattacaggtgtgagccacggtgcccagcctgatgacttgttcctgagtgcaaagatcggattcgaattaaggatggagatggaggggtttgaagcacaggtcccaaaggtcaccaaaagtcagccagtagatagagtcttcctgctartgyggctggaggccaggggtgaggagtgacaatcggaggtgaccagrctggaattcagacccagggaggggaarccttgctcctgctgtcactccctgatcctcgctgctgccccaggaagccagaaggagatcaactctgggcagggatcatggcttgttcatctttttaccacagcacttagcactgcggggtcctaccccaccagcagacccatcaccaccccaccaatgcctgcccttccccccrcaggcctgccaccactgaacccccatccctgctgaccccccaggttgtttttttttttwaaaaaagcactgtgcctggcatagacagaaattcagtgaatgtctggtgaatgaaaggatggctgactggagggacagtgggctctrccctggctttgtcccgtaggctgtgaaggcacaattgctggagcaagcgcagggacaactgagggagctgctggatcgggcyatgcgggaggctatacaatcctacccatcacaagacaaacctctgcccccacctcccccaggttccttgagcaggtgagtctggggaatggctgcgcgggctcctctgtagcaaggatcatgagctagaaacatcacgttatgtgcccttgccagctttatcaggaccgtgactccagccttccctcttccccccttgtcttcctaacactgacctccatctactgggcctcgctctgccctggccctgaccttctacccggtcctgccctctggccctagccctgacctttccctaccactccccttggctcccaagtattgaccttctgcatggccctgccctctgcccatttactttttcctgaccctgaacaaacatctcaattcaggacccaggagccatccctggggaaacagaaagttttcatcatccgcaagtccctgcttgagtaagtcggggtgrtgacaagtaatgggaggaaaagaaagggmtttggctaggggtcaaggtacctcatttctcatccccagsctctaggtggtttgtggrgaggacttggaaagggtttctaaggtgcrggtcccctatttgccctaggcatggttgtggaagaaaggmckttagctggaagttctggatcgctaggcyccatgcctcatgtgtacagtgtctgagctagttcacacaaccctgaggaccctcccacactgactttcgggcccctgtccctctagtgagctgatggaggtgcagcatttccgcaccatctaccacatgttcatcgctggcctgtgtgtcttcatcatcagcaccctggccatcgacttcattgatgagggcaggtaggtccccttcccacctgggacaggcacacctatctgatcagaccctctgggtcctcagtgccccacctgcccttggggcaagaggacacaggttccccctttggttattggacatgtaccaacattgctcccawcaacctttccacctgaaacactctctaggatcccttccttccccagccttggttggccctttgtctgtcctcccagggccrgccaytctcaaatgcttctcaatgacaccttgccctgaggcagatgtgtgtgtgtgtgcacacatgcacacccatacacactcctttccaagtcagttctattcaagtaacctccattgagcacctccygagtaccagtcctagtggccagagaaatgaggggggcagaccccactcctgtctgtgaggcactcccagtcttgtggggaagacagacatgtaaccaagtgcctgggtgggtcatttccccsacagagcaccccatccaactgtgaggatgagcctcagagagctgtatacccctgggggtctgtattttcatacctcccmctattcccagaccaaactgagggttggggctgctatttctcatggcccaataacgagatgcagatgaactggggaggaagtgagtttttatttctgtaaccagttacagggagaaggcctggaaattatcaccaggccaactaaaaattacaatttccagagcatatataccttctaagctctacatctatgtgtaggtgtgcattcatctaaagacataagtgattaacttcttttaatctataactaaggtctgagtcttgaagaccttcttctggagcctcagtaagtttacttaatctaaatgggtccargtgctggggtgattacccttctcttatctcctgctaaataacggaggtttggggagtttcttcagacccccagcaaaacttgtttaatcatgctttgaggttcaggaaaggcctaggcaaaactcttggtgggcttttgttacattccagcctttgtataagggcactggtttttaacatttaacttaaccactcagtcagtactgaaacagttgttatggaggtctgcattagtgagacctgcttgtcacagtccccactgtcaatttacacgatttttatcatgyrtggatatttatttatcatgagaatcgcagggagatggggagtcgtaatctttctggctacttcctgctgagagggggtcgtcgttatggggcaccaaaagcagcagtggagtggaagaggttgatttgttcgcagtagcactctctgtttcggggccttggaggcagcacctgctgaaacataatagtatgtaacagtacatataaataggctactgctcttttcttctgaagtttaagttgtctagtcttcagtttgcagggctttaagaaagcagagcttaggtttcagtgattaccaattaggaagaatgggggaaaatggaaaagaaagaggaaaaaattgaaaacattattttggagacctgtagccagaaaagttagaatttaatccaaactgcagaaaataataaaaactgaaaaacatcaggcaagactagaatttaacaacagatgtacttttttttttttttttttgagacagagtctyggtccgttgcccaggctggagtgcagtggcgtgatcttggctcactgcaacctccgcctcctgggttcaagcgaatctccaacctcagcctcctgagtagctgggactacaggcacgtgttactgtgttcggctcatttttgtatttttagtagagactgggtttcaccgtgttggccaggctggtctcgaactcctgacctcaggcgatctgcccaccttggcctcccaaagtgctgggattacaggtgtgagccactgagcccagccatagtttttgaaacataatttttctctctccagtttcccatttttattaaaagacagatcatagtaggactggtttgctttattatacttggkttaattatttgtatacagtacagcaagaataattagtttcacataggccttttaaattggctttgatggaacttcgttccatagaaggaatctgagataagtccttttaaagccgagcccagccatggatttgtaccaataaatacctatgagttgggtgaattcctcttctcttgaggttccaagataacttggggttcctggcctgtcagaaaatgacattctttacctaccacagatcagaaaccctggacagggactgtgtacacaaaatatgatgccagttttcaagggctttattggcttcataagtcaagttcgattccttaa

SEQ ID NO: 13509 - DNA, 40000 bp, Homo sapiens
  misc_feature (1)...(40000): n = A,T,C or G, or insertion/deletion polymorphism (see Tables 1-2)
tatgagtttgccatgtgggtccctctaaccttcaggcaggaaactgcaactccatgcctttggccagggttagggtggcgagaggaaactccccagggagcaggtgcgaggggtttgcacctggcatcagggtggcaggagggagctccccggggagcaggtgygaggggtttgcacctggcatcaggktggcaggagggagctccccggggagcaggtgcsaggggtttgcacctggcatcagggtggcaggagggagctccccggggagcaggtgcgaggggtttgcacctggcatcmgggtggcaggagggagctccccggggagcaggtgcsaggggtytgcacctggcatccgggtggcaggagggagctccccggggagcaggtgccaagggtytgcacctggcaggggtgctgccccatctgcagcaccactcagtctgtcccagctgcaggagggcaggcagggcagctccccacagaccaggggagggtgagcagcatccctacctcgtgccaagctcctgaggggtctgttccaggggagccagggctctccgtgtcccgacgcggttgcctcaccccatgcccctcaggaaatgctgaaatacagcaggaactgcgagggggctgaggacctgcaggaggcgctgagctccatcctgggcatcctgaaggccgtgaacgactccatgcacctcatcgctatcaccggctatgacgtaaggcgcccagatgcccggtcttccccgccgcctccrtggaatacaccagcccagcaacttggcggcctccctgcacacgcccctcgctttggtgtgaatgtgcaggttctgggcaggaggtctggggtggtccctagatragcccactcccaggccccacagccgggtccacagaccccacagccgggtccacagaccccactgggctctctgggacgtggagaaaatcaggaagcgtcccttgcttggagggcacgcatctccagcaggaaygcagctcagacctcctcactccttgtcttctcctggggaggaggcgtggctcggagcagacgtgacttctgttttctgggctgcgatttgcaggctggtgacttagagcaagtggccccagaaggcagatgtcactttccccgtagagccccacatcaggtcacagcttattcatcttttgtccgtctttatgtccacccagcactcattctcaggtgttttttttttaactaatagagttgatttattgcagcaatttttggtttgtgagataattgagtataaatcagaggccctgaggcttcccctagtgttgacatttagcatgggtgccacacctgccacacatggtgaactagcgctgatgctgattagtgactgagggccgttccccttggagctcactctgggtgctgtgcattctgcggtttggacaggygtgtaacatcctacacccagcgctagagcatcacacagagcagcttcactgtcctagaagcccatgtgccccgccagtccatccctcctcccccagcccctggcacctgctgacctgtcagtctccacgagcttgcctttcctgggacgccctgcagctggaatcccaccgtgggtgggctttgcagagtggctgctttcactcagcgatgcgcgtccatggccccaggcccatcccgtcctgaacacagccctgctgtcgcacatttaggggaatctcggcgacctgggcaagctgctgatgcagggctcrttcagcgtctggaccgaccacaagaggggccacaccaaggtgaaggagctggccaggttcaagcccatgcagcggcacctgttcctgcacgagaaggcagtgctcttctgcaagaagagggaggagaatggggaggggtatgagaaagctccctcctacagctacaagcagtccttaaacgtaagtgaggccgggtctgcagyagcacrctcctggccacagaccccgacgggggaagtctgtaactcggtctgaggtggmcacgctgacacccagctctcagccttaggtgtaggggtggggtattctgccattcttagccctcacccccaaagtatttccatcatttcgtgcctgcaccaacaccttttaaaaacaaggcagtgggttcactgtgcacgcgaaccccatctccactctctgctcgcagatggctgccgttggcattacggagaacgtgaagggagatgctaagaagttcgagatctggtacaacgcgcgcgaggaggtctacatcgtccaggtgggccacccaccctacccctggcctcttacacattgccacgaatggtttctcatgggaaccagtgcaaggatctgccatgaagttgcatcgagcccaggagcagccgctgtacacttcaggatgctgccctgggctgtcttcaccctgagctggacccagaatgaaatgtggggaaaagtacacatcagacggggtgctgcgaggaaacgggctctccctccccaggggagctcatgtgtccctggacggtgcaagtgtgcatctggcacgcagggcygattstcacggtggggagggtgccgtgccctggktgccaggcacagttcttcagtcagtcccgtgcatggggcacagagggtcccgcaatgcggggccacccacagtgctttcctcctctcccctcacacgcagccacctgacctttgactcctaagattatctttggatgttccgagagtgaaaccaaagcgtgtttcctygggggcctgagtactcacctcctggcytttcttttggggaaacaggcgccaactcctgagattaaagccgcgtgggtgaatgaaattcggaaagtgctgaccagccagctgcaggcttgtagaggtgaggctgtcttcaagcgatcgtttcccgtagcttccgctccaggtgcatttttacytatgttcagagcaaccgcacagtccccscatgcgcaaggtgcctcggcgttgaagtaaagacgctcgttcacgtggtttgtctgctccctcctcgcagaagccagccagcaccgggcgctggagcagtcacagagcctgcccctgccggccccgaccagcaccaggtgagaatggacacgctgccgcaggcctgcgtttctggagcagtcccgagcaggccatttgcacgccagggtcctcggcctctgtcagtgggaccctgtggttattggggttttccttgaggcccctggtgtttatgtgctgacgggtccgtcccagagggtgtacttcacagatgtgtgcctccgacaatgcccagtcyctctccagctcttcccggggtgggctgttccacagcacggcagtgcgcacatggcctgtccagatcacagccacgccccagcactcctcagacagtcggggctcagctgggagccggcactgatggcccagcacacacgtgggcacgtttcagactccgaccctgaccgtggcttcgtcgtgtctcttctgcccttgttttttctttattttgttcatccacttatttttttcactttatcctgtttcttatataagctacctttaatcattcatggaacaggatatggcctaaataaataatccgtagaacagtagttttaaaaaagaaacactcccccgcccccccccccgccccccgaaaaaaaaagcctcatacttcagagcaagtagggtgggcgtctgytctcatccagyccgtccgggtttaacttagaagtgtgtggcccctcagaagcaggagggtgggcrtctgctctcatccagyccgtcygggtttaacttagaagtgtgtggcccctcagaagcaggagggtgggcgtctgctctcatccagcccgtctgggtttaacttagaagtgtgtggcccctcagaagcaggagggtgggcgtctgctctcatccagyccgtcygggtttaacttagaagtgtgtggcccctcagaagcaggagggtgggcgtctgctctcatccagyccgtcygggtttaacttagaaacacgtgcaggagatgctgctttaggatcaggccgggagctcagagatatctgaatgcctcaggtcctmagggcgttctgaaagactaaccaggcaacacactatttcctttttgatttgtctgatgtcatcagtccctcaagaggaaactcaaggaacatcaagaagctggaagaaaggaaaacagaccccctaagcctggagggatacgtcagctcagcgccactgacaaagccccccgaaaagggcaaaggtgggtatgtgcagggaccgggcctcacacggaggcctcacacggagctgctcacggagtgctcactgcatccgagaaacctgcgcttcctgcagtrtgaagaagctttgcagagcattcagggccccttgctcccctcttaacagagccctaggaccccacagaagagcccctccctctccattgctctgcacccctgcatcagcaaggccagccccagaaggagcctcggccgagcgtgcaacccggagccgccttgggccctccctgcgacagccggacccgcctccgcatcgggttgcgatgccctctgcatagtttctttctyttccttcatagatgacacggtcactagctctgcctcagaaagctctgcgctttccagaaagcgctttaccytgcagggttttgctaacctcaaaggtcagaaaggtaaaagtagtgcctgccccaaacccaccctcaccgtggtggcgtctgtcatgcatcgtgtgtgaccattcgtgcctccttcgtcacaagggcggccacgcaaaagcgtttctttccacccaatcacgtgttccctgatgctgtgtctcgcgcacagacaccagagttatttagaggtggctttccttcgggaaratgaaggcgagcttttcaaatggaggcttgctcagaaacggagctgtccttggctttccaggccccctccttcctctccctgccccccacccccgccttctcccgccttctcaggtgagttccctgcagggtgctgaccttgctggctgcgtgtctctgctccgcctggtggcagaggccgctcagccatcttctggggcatccrctagtgaacagggctgatgggacccttgagacggagacgtctaatgccctgctcacctgcgagagctccatgatgggaaatacatggcggggaaatgggcccaggaggccctggaagccggccctggcgtgcaggcggctcttctgggaagccctgaaggccagcgtggacaagggctctttccagagaagtaggagtgttttccaatttataaaatgcttttaagttggcctgagacttgaaacaaacaaacaaacaacagattctggtgctgcaaactctgctagcgcagaactaagaaaacgtccctagagacgggccccgaaaggacgcctctgagtgccgcagcccccactcccrtgccctcccggcccctccttcactgcgcggcccctcggctccctgtgttttgctcacagaagctcctttttcatcggtggaaaggggccacaacgtcggtgtccccttccagcacgagcgcgggtcagcctcctcgccgcctccctccgtccttcacactctctctccggttgtatttctgcctcctcctcctcttgcagcttctcctaccagtcctgacaaaaaagccaagcggcatgaagtaaagagcgacccgactccctttggtgtgcgaggtagagtggcaccctcgggcacggcacccactctgcgttggcaggaagcgcggcccagctggctgtcaggtggccgtcaaggccacctaagggggatgctckcgtgggtctttatgctgcggaggcagacacgcggttgtgttcaatgtgtgatgctctggtgacaggtcctcgaggacagcacgcctctcagccaactcctcacagcaggtctatctggagcctgcggaactgcccaccccgtcggtggctgctggccacggctgctgcgctggtcacctggccgtgctgggtggagctgggtggggtctcactgcccagtggctgctgtcggctatagggcaccctgttccctgcccttccctgtggcacagtttgccccgacacttcctgctgggaacacagagcatagcaactggcagggccgacccrgaccctcctttcccggggccaatgaggccgagctccctgtccgacccggaccctcctttcccgggccgacgaggctgagctccctgtggaacctggcccttctcgtttcctgcctcccttatattctcagggtgaaaactgccctgtgaagcccagagacctcccctggcctgttgaggaccttcaagtgcagggacggggctcatgtttgcaatcttgagttttcaaaaatttgcaaaggttcccaggggtgtaagcagaaccagccttcccattccgcccgcctccacagcctcctcacatgacacrgcgagcctcacagaaccaggcagaagctgtggccaccctgggcatgagttcagaggcagggagctggcccggcgttactgactgtcctgcctgcaagtgggtgggcgcccggcttgctgcttcgaggccccaggagtgcttgggagaagggagtcatttccctgttgacagtctcctgggagaggctattcttgtctgtcaaaccctctccgcttgtgaactggagtcggcagagccggtccctggtggagaaggtgggccgggtgggccctgtgggccaaatgccgcttctgctgcactttggccaagctcagcctctgcttccgtctcgtcatccatgaatgaagacagtacagccttgcagggtctcgagaaagccagtgtggtgttgaagccgggccactgcccgtgggtcatttccaccgtggtcagtgtggtgtcaragccgggccactgcccrtgggtcatttccaccgtggccagtgtggtgtcgaagccgggccactgcctgtgggtcatttccaccgtggccagtgtggcgtcgaagccgggccactgcccgtgggtcatttctgctgtggttggtggtagtgagcccaggtggttctgggtggcctgagcgctgcccagcacccactccccaagccctgcaggtggtgactccaatgagcaaaggccaatggctgttttacagaaaacagagggcaccttcctggccatcacccggcctcctgccttcacacagaatcccccagctcctggtgcagcagtgctggcctggcctgtggctgcccactcccaggcactgccgttcccatcatggtcagacctctgcgttttgctgttggcctcccccgcgccctgttccagcacrgcgctcttgayggcccgcagagaggctctggggagcactgagcacccacggccagggcagctcaagaatccttttgtgtctctggtggtgccaggggcagagtcgcttgggtttcaccccgcacaggccggcctcgctgcccctgtggacaggttcgtgtgtaaggtcctgcccacgccacaccagctcctgtgcacacacagcagcccccctttttttgttcccactgtcctcaatcagacttttggttctgtctggccagaggccccacgtgcggtgcctcagagcgactgggggcctggacggggagggcacgctggcagccaggccccacaggccagtccctgctgctgtagaggaggcacctgggcccccacccttgctgtstctcagcctcccttgctgggggcagctgcaggtgcactcaggaggccaagctgcaggtctgcaaccggaaaatcacagtcctcaattctcacacagatgcaggcctggtgtggtgcctggaaggctcaactgcctccagctgtgaccccaagaaggcaaagcacccgggtggggtggaaggagcagccccgtgctctgctggctgacagtggtgcccaggcccagctcccttctctgcacagacagcagagttccgcttagcacaggcttttccttgccagcgcagacgctgtcagccattggaactggcctgcaagacagcttgctgtggcggctttgcaggcacagggcacacaggcatccgtgcacgcagctcctctgtcctcccatgccccacaccctccatcgcaaggaaacgcttgcttccagtggtaccaaataggatttggaaccagtttgtgcccaagctcaaatctcgttagcatctgcctgtttccctggtgtgcatgtgtcctgcctcgatgcatttggcagcaggtgggatgcgctgggcctgctgcctggttgctgsctttgcgtgtttatttagccccaatggcgtctcccatctcccccgcatgggaaaggccggtgctgccctctgggagcctggcaggaggaacactgggttggggaggggggcatgtgtggtcccaagtctggaagaagctccttcctcttctcccgctgggagctgcgtggccgatgggagcccatctccaccgcggcacctgcatggtctcagcsttccggttcggtgccgctgtgccgggggctactctcttgccagtggggaccacagccctcggtatcccataggtcaagggmgtcaggccctctcagtgagcttcagtcattcactttagaaactgcttcccggctcggtctgctaggtgttgaacatgaccgtggcactcactgaaaacacctgcctgggagggcatctgcggcaggaaggctgcttccctcctggctgaggggcactgccctgcctgacaagrgcgtggcttcccagggcctggggatcgaggtctcccacagggtggcccagcaattggaagcagatggtctcaaaccctgaaacgtgccaggcattctggaagtttgcaggggtgtcctgctcagctctttatgaaccygggaagatgacaggctctgttgggggcccacggcacacatttcagggggtctgtgggacttagctgaccccacctcagacagatgcagacagcggctcatcaccggggggtccctcacgggtgtctgtctctcttaggttggagcaaaacgtcccactcactggaggcacctgaggacgacrggggctggtcaagtgcagaggagcagattaactcgtccgacgcagaggaggacggcgggttgggccccaagaagctggtaaccacggcttccctgtgggcacttggggtgggggctgccctccggggattaggggtgcttctggcaggtccacccaggcttgggtcttaggacacagccccagctcctcctaaccctggaaggtccacatgggcctgggtcttamgggcagtgccagctcctcctaactctctctggaaggtccacccagacctgggtcttggggcacagccccagctcctcctaactctctctggaaggtccacctgggcctgggtcttaggatgcagccccagctcctcctagctcctctgtctcagcagcactttgtgtttctgggttaatttccaggtgcccacccagcctcctgtagagcccactcgtgggtgcaccttcctcagaggagacagtccccacccccctaccctttatgtcatagaatgctgtcactgagccttcctaactatacatacaattctcattttgtaagaaaatggaactgctaagcatggatttgcatttgaaaaaacattcattgttaatrtcagaagcaagaaaaagctgccatgtgttaatcattccagtgagggttacaccaagaagtgtctgctgcaccttctgtgctgtgcgtggtccatgccycaaggctggaggtgcaaaggggacaggtcccggaggctctggaagggcagagaagccaggcgtggaagggtrgggagagccctcggggcctctggcctctcccacagagasagcatgaaggaaggcctgggcgtgagaacagatgtgggggacacagaggcggaggccacgtggcaggaggggaaacaggctggtggaacagggtgcacggggcctggggagggatttggatctcattctttgtggggtgtggggagtgatcctggctactctgggcaccacagaggcaggagccagtacaggccatcaygtgagggcaggcagcccagtcaccgtcctcttgctccaggccatcatgtgagagcaggtggcccagtcaccgtcctcctgctccaggccatcacgtgagggcaggtggcccagtcaccgtcctcctgctccaggccctgcagccggcagcacccctccgcagcccaccacacgcagcaccaggaggctgtgaatctccccactctgtaggaacagctgccgcttcctgggtccccattccccaacggaaygtgttccatgacatctgtgcagcatccgctgtgtgccaggcacagttctaggccccggagacaaagcgggaacagcacagacaggaacctccactcttacagtgaggagagaaagaggagtgaggcttggggaggttgggcaggacagctgcagggagagggagggcagaggacgggcgagtcggggagtaccaaggaaggcctcagcaaagcagcatggaaataagacctgaaagcacggaagggccctccgggaggcgggtatgcaggcgcaraggccctggggccgagagctgtgtgtggagaccagcgtgaggggctggggcagctgggcccaaagacagattcacagacgccttccatcgccgctgcggtagtcatgccctgcggcgtagcctcctcccaaggctggagcccttccccggagctggtcgtggccaggagctcccaccrgggcagggcgctaaggcccggcactccgcctggctgctgtggggctgctgccggggcgggtgctgacgctgtctgtgcccctgcccgtctcccaccaggttccaggtaaatacacggtcgtggcggaccacgagaagggaggccccgatgcgctgcgcgtgaggagcggggacgtggtggagctggtgcaggagggcgacgagggcctctggtaagaccccgcgctcagccccggactgccccgcacgtggctgccgctgaccctcgccccttgcaggtacgtcagggacccgaccactggcaaggagggctgggtgccggccagcagcctgtccgtccggctcggcccgtccggctcggcccagtgcctgagcagctcaggtaaggcccacgtgccccgagcccacccgtgacgctgccaagggcccgggcgaggaagctgccccgtgtgtgcccggcagagccgacgccgaagcccgtccccgcctgatctccccgcagagtcgagcccggggtcggccgtgctgagcaactcgtccagctgcagcgagggcggccaggcccccttctccgacctgcaggggtagcgcggcctcggcgccggagacccgcgcgctgtctggggctgcggtggcgtggggagggcgcggcccccggacgccccgaggaaggggcacctcaccgccccsacccagagcgcctggccgtgcgggctgcagaggacccctccggggcagaggcaggttccacggaaraccccggcccgctggggcttccccggagactccagagcccacagaggaggggccgcagggaacagccccgggcggcaggcgccgggcagcggcatctcgtcctggctccaccgtgctgcttctgcctcyggacggtgctttcaggggacgcgcggaccgtggtggagctgcttccggagaagtggaggatcctctggccaacggcctgaggagagcggggcacggggtctctttagcttttacaagttttaggattttttcaagcagggatcaatcccgtggccattttttgtggtactttggcctcaattcttcaccaggaatcactgtgtttacatgaaatgacaatttgatactgtatttgatagaaaactatttttttgttaccggggtttacrtagaagcacgttgtttataccactaagtgactttggsggggctctcccatggaaacggatggcactccctgaagctccctggtcacaggtggatgaaaacgtgtccgtgggtgacatcaggtggtgtctccaccaccaaaagcagttagaagccaaggagattcctttatctacctagggttcattttcaaaagaaaatttaaactataatttaaacaattaacgttcttttctacaaaaaaaatgcagggacttgatttttttaaagagcttcactgaattaggatatttttattgcttttaaagaaaatacaaagwtgcagtttctgcagggtgtggcgtggaccagtgctgccgaccatagctcagagagccctgcccctgcctcactgcactgcagcctcctcggaggccgcacctccactccactccccacgcgccccctgcctcccacccaggtccacctgccacctggtgaccaccttgagtacagaagtgaaagtggggagagtattttattcaagtcacagcagaactggaaaaaaactcttctgttttaccaacttcttgtgtttcagaaacatattctgttcaaaacttttgaagccctttcggtgtctagtctgcagatgtttttgtatgtgtgcacctctgaccatgtgtgtacatatgtgtcttgctggaaaggacatattcgctgtccccgtgctgctgggagggccgcctcacagcctcacggttcccagccccagcacagtggaggcaggcgtggctgcattcccctcacgctaccctcccagcggcttgtagccgtcactggccagacctccagggtgcggaatcaaataggaagcatgcagagactcggcagcttttcctctgatgtgtaagttatttggaacgcgtgctgtgtcccgcgatgtccctgatgtactgtgcaggcgcggtgcctccgtctcgtcgcacagctgcgcgcccttgtgtgaccctccccataaaggcactttacagcttcatgtttcatccmctgtcacttttttttaactgctgatgtaaatggaattttaaaagcagagttctttattgtatggrtgacgtttgaataaatatcagcaactcctgccatctgcctttgtctgtcaagacacagaacgtctcagcrgtcggggtttccagggccgcagtgcactgtgcttgcacatggtaagtcattgttgggacggaaaagaagccggcagtgggcagggcccagcgtgcggctcaggcaccgagcaaccgctttgctttcttctgtcagacggcgatgatgacaaaatagcaacaaggttgtgcgtgtcagaaacgcaaaggcagcagaggaagcgtagtggaaccattacagaatcacaatgcagccgacactctccagaccagaaaagggagcayaaagaaagggtattgatccaatagaagaagggaagggtggagaaaggggaaagcatggttaacaggaaacaacaygtaacggaagagacagcccagatgtgtctggctcacaacagacgtgatcatgttatgctggcctggaagagcatcrgatcagacgtgacaagtcactgcttagagaccatcaagcaaatttatatatagattggagatttaaaataaaagaagacagaacagacaaacaccataagaaagctggtgtagcagtatcgatgacctgaaatggrattcaggacagttcatagagtaaagggggctgcgtggcaatcaggaactcataagccactgactataaagctcaaaayacagcaaagttggcagtcggcagacagcaatgttgactgtcatgaaaagtgatccctgtttgcccctaaacgtagagaaatctgcgttattttccagcacacatggagcacaaacaaaatatttgcaaaacaatgggaagatcattgaaacactgtttggcaatttaaaagcttgtttctaactcacgggatgcgggcagtctgctctctagaactggacagcgtgcacagagccacgggagggagcagccacggccagctcagattggtgtcgacagcttagtggtgtctgattttatacatgacaaaatgaacgagttaaccatttaagccaaaaaaataagacyagcgtaacccaaagaaagtatttaaatacttctgtcaattaggacagttgagaaaagagaataacaaaatcaaaagcaaaactcaaactttgtacctgaaaaatctaataaaactgactaatttatagaaaacctaagaaactccatatcaaataaaaaattttaaatatgagagaaccattatgaacacctttctgccaatatatttgaaaacagataaataggatttattgttagaattggtcaagaagaaatgaaatacttgggttgatgaataacagttacagaaattgcattgcaattaaaaaaaaaattaccccaaacagataccagatctaggtgattttgtaagcatacaaacatatttataaaagctatttaaaagaatataacaagagaaagcaactcaataaagttatgaatcaaatttaaccttggtacccaaacctgacaaagattatgtaagaaaagaatcagctgggccaggtggctcacatctgttcttctagtactttgggaggccgaggtgggagagttgtctgagaccaggagtttgagaccagcctgggcaacattgcaagacaccatctctacatgaaatttaaaaattagccgggcatggtggcacatacctgtagtcccagctacttgggaagctgagaccttacaagtgagcccaggagtccaaggctgcagtgagctrtgatgatcatgccactgcactccagcctgggcaacagagcaagaccctgtctctcaaaatcaaccaaacaaaaagacaatgtaagaaaaaataaaattatgaagatgaatgcaaaaattccaaatgaaatataattaagtaaaacccaattctgtgttataaataaaggtaatactttctaagcaagtaaattcatcccaggaatgcaaggggtagtatgttaatgtggctataatttgccatattaatgaagtgaagggtaaaatcaccagcttaacaaatgcaaaacaataattcaatttttattcaacatgtacttgtcatgttaggccaactaggagtagaagaaaatttctttaactaaataatatrtatcaaacaaaatctttgcagcgaactttttttktttgtttgtttgtttgtttgttttctgagacggagtctcgctctktcgcccrggctggagkgcagtggcgcgatctcggctcactgcaagctccgcctcccgggttcacaccactctcctgcctcagcctcccgaggagctgggaytacaggygcccgccaccacgcccggctcattttttgtatttttagtagagacggggtttcactgcgttagcyrggatggtctcgatctcctgacctcgtgatctcccacctcagcctcccaaagtgctgggattacaggcgtgagccaccgcgcccggctgcagcaaaaattttaagtactgaaatcctttagaaccatccccattggcagcagaactgaacggggccccactactctccagcgccatttagccgcagtrctagtgactaccaccgcaaaggaaaaggaaacaaggccagcgcggcggctcasgcctgtcatcccagcactttgggaggccgaggcggcagatcacgaggtcaggagatcgagaccatcctggctaacacggtgaaaccccgtctctattaaaaatacaaaattagccgggcgtggtggtgcatgcctgtaatcccagctactcgggaggctgagacgggagaatcgcctgatcccaggaggcagaggttgccgtgagccgagatgtcgccattgcactccagcctgggcaacaagagtgaaactccatctcaaaaaaagaaaaaaagaaaaaggaaccaaggcatgctaattgaaaaataacttttcatatctagaaaaaccaggtgaattcataaactattgaaactaagaagtccacaagatcaacccacaaaaagttattaacattcctagcaataacaatactattttaacagcaacctaaatactaaaataaatgtaacaaaagttttggacaaaattatgaaacatgatagaaggtcataaaagaaggcctaaatgggagatttttatggatgggacaattcagtatcaccaaagtgttaactctcccccaagttaatctgtgtatttcatcaaaattccaacagaattctttgtggaattaggaagttgattgtaataaacatagaagataaaggtctgagtatagccgtggtgattcggggagcagaggcaggaggaggagggctcacctaccaggcatctggatagatcataaacctgtcatcagtcgtgacaagggggagagaggctaaactggtcgagcagaattcagattcccaggcagggatgtgtgcagggacctggcttgtcctggggctggtcaatctttggcacggaatggcctcttcaggaacgggtgttattgggacagctgcctttccatgtggatgatggcataaaagtatagcccccccaaacttaagattaaaacattattatgaggaaacagaatattcttattgcctagggcaaggatagatttcttacaaaagacaagctacactttaagagatggacaaaaagataagatggacaatctgagcacatcccatggtgaatttctctccacgctaagaccccrgacaagggtgaaaagcaggaccaaggcccagagaagaaaaattctgctcaaaatcataactgttcaaccttgcatacattctctctcttaaactgaaagttagcatcctacagcactggtgtgacacccggcaggcccgagggctcagctgcctccagctgtggccccaagaaggcaaagcacccgggtggggtggagggagcagccccgtgctctactggctgacagtggtgcccaggcccagctsccttctctgcacagacagcagagttccgcttagcacaggcttttcctcgccagtgcacacactgtcagccattggaactggcctgcaagacagcttgctgtggyggctttgcaggcacagggcacacaggcatccgtgcacgcagctcctctgtcctcccatgccctgcaccctcygtcacaaggaaacccttgcttctaggattgcaccaaataggatttggaaccaattggtgcccaagctcaaatcctgttagtggctgcctgtttccctggcatacatgcgtcctgccgagatgcatttggcaccaggtgggatgtgctcactggttcccaaaacgagaacacatagcagtttccctggatgtttgttcaatactattcccgggacctgcccgtakattcmaattccttatgggtgtggaagagcctggaaatcacgtgtgtgtaggtgtgtggcatgtgtataggggtgtgtttatgtggtgtgactttggggtatgagtgtggcatgtgtacggtgtgtgtgagtgtggtatgtgtatggcgtgagtttgggttgtgcgagcgtggttctcatgtacgagtgtgagcatggagattctttggtagggaaggagtcagggtctccctctgtcgcccaggcttgagtgcagtggcacaatctcagctcattgcaacctctgcctcccgggttctctgtctctgggaccacaggcatgaaccaccaagcccagctaatttttttattttttgtctagctttggtcttgctatgttgcccaggttggtctggaactcctttcctcaagcgatcctcagtcctcagcctcccaaagtgctgggattacaggcatgagccaccacccaagagattctgatgtcacagacatctgactcacacactccctggacagctcacgtgtgcccaccaccacagtcagggatggctgcagatgaacaaggtgctgacgtggtttctgtagcccccaaacaagcaacttgccttgagatgacaaccaaagttttcctgtgtcctcyacactcaagagtgactgtgaggcggaggggcccagcccttcttgcaggcgggaatgagtggatgggtggatyaacagaggctgccacaggagagagggaggcctggcctgggaacagagctgtgaccgtgcccttccccarrgtaggggctgaaggaccctcccatcctartgacagggccacagcatgtccaaggaggccccagaggaggtcccgggagtcctgggagagcctggttagcctccctgaagggaggaagtggggttttgtgagagggatggtgcagcagcccccacacctgctrctccgtgtggccgggtccagccccaggcaaggttccaggcatgcccctgggacagacrtgggagggagaccagcaggcaggtccccctcagggaggtatggagcgggtccccggggccaggtggagcccctcacacctgtgtcctcaaggacccacaccaggacaatggccataggcgggcacctgcagccgccctggccagcagtgagacgggcagagagcccagccagatagcccggttcctgccccctcccgcctgcccgcacagagagggctgcatgcaggtgagggtccatcacctgaagagcttcaccagcccsgaggccatgagccactgaatctctcagggggttttggcgcttgaggttccccaggtcattctgctgcccagagagggttgaggacctctgacctggagccccaaaggggaagggtaccctaagaccagccagccatctactctcaggtgggaaaggggtagggtttagatatggccccctcccctccacgtcctgaaattaccttgggctgtgctggccgagagccgcrgggaccagatttgagctggacgtgagctttattccagacggagcagctactttgtaagcgatctccctgggatcgatatcatggaggggcacagatgggcttcagctgtgctgggtggaagagaaaacatgccctgtcggcccctcagcaagtgctctgctctctggactgagatgcaggtcagcagcaagcagggaggctttgggggtgctgggggctgctttgaaaggcacccctgagctaagacttggctgttgggaaggaatcacctccctccctccagccgtaaaaagaactggacatcagcttccaaagaagtcatcagcaatgcaactgttcacatggaggatactccctgcttgaggggtcagacaggcctgctgggcaacccaggaggcttggatgaccgtctaccccagtgtttttgggatggaaagttccacattctgagaaccctcagtccctgggcaacctggggtggttagtcaccacagcttgtggcttgggcccatgacagcaggtagaaatgaygtggactgccgccagccgggcacagtggctcacgcctgtaatcccagcactttgggaggctgaggcatgtggatcacttgaggtcaggagttcgaaaccagcctggtcaacacggtgaaaccccatctctgctaaaaaaaaaaawaaatatatatatatatatatatataaattagccaggcatggtgacgtgcacctgtggtcccagctactcaggaggctgaggcacaagaatcacttgaacccgggaggtggaggttgcagtgagattgcaccagtgcactctccmgcctggcaacagagcaagactctgtctcaaacaaacaaarcaaaacaaacaaaaagacgtaagatgtggaccgctggagaatgggggtgctgcctgcagtcaaaacrgagtgggggtgcccagctcagggccagaatgatcctattcccggcacttctcagtgaggctctgtggctcacctaagaaaccagcctcccttgcaggcaacggcctagctggcctggtctggaggctctcttcaaatatttacatccacacccaagatacrktcttgagatttgactcgcatgattgctatgggacaagttttcatctgcagtttaaatctgtttcccaacttacattaggggtttggaattctagatcgtatttgaagtgttggtgccacacacaccttaacacctgcacgctggcaacaaaaccgtccgctctgcagcacagctggggtcacctgacctttctcctgtcccccccacttgagctcagtggctgggcagcaggggatgcatggccactggccggccagstgcagctctcagstggggtgytcagaggacgcctgtgtcctcccctcccccatccctctgtcacccttggaggcagagaactttgcccgtcagtcccatggggaatgtcaacaggcaggggcagcactgcagagatttcatcarsgtctccyaggccctcaggctcctctgccttctgcttgggcttcagggctgcctggctgcaggtgcgtcyrgggaggttttctccataaacttggtggaagggcagtgggcaaatccaggagccagcccgggcttcccaaaccccgcccttgctccggacacccccatccaccaggagggttttctggcggctcctgttcaatttctttccttctagaaaccagcatccaggcacaggaggggaggcccttcttggtrgcccaggctttggcgggattatttttcaaagaactttaggagtgggtggtgctttcctggcccccatgggcccctgcctgtgaggtcggacaagcgcagggagtctggggcctctcagagtgcaggaagtgcgcacagggtgctcccaggctggggagcacaggtaggggacggtgcgtgggggatggcgcctggggcatgggggatggggtgtgggaaacggcatgtggggcgtargggatggggtgtggaggatcgggggtggggatggcgtgtggggtgtgggggatgggccgtgggggggtggggcctgggaaacagcatgtggggcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggaatggtgagtggggcatggggatggcgagtagggggtgtggcgtgaggatggctagtggggcgtggggatggcgtgtggggatggcgagtggggggtgggctgtgagggacagtgcctgggatgtggggctgcagccctagctcacagcatggccttatgaccccggccaccttcctgccccaggcggggtcgctaaggcctcaggaggagaaacacgggacatgccrtggaagccggggcctcacagargtgagcagggactgccactggttttgtcctggggcccagtgggggccaacatcacctccttcccctcccatggcaaagagccagcccgcggggtggctactgcagtgccccccaaggagggtgttccctgctcgagaggaagtgaccgctccagcttggccttccctgggactggggtgcaggcgattttatcttctttgctccattctgttccttccagataatcgtgtgttcttcatcaggttttcctcagttcttgagagcttttctgatgcaaatctgctttcaccccagggcggtcaccggctctgctcacaccagcctccaagggtgtgggtgtcccgggagtgtgggtgtcccggrggcgwgggtgtcccrggagtgtgggtgtcccgggggcgtgggtgtcccgggagtgtgggtgtcccgggggaagtgggtgtcccgggagtgtgggtgtcccgggggagtgggtatcccgggagtgtgagtgtcccaggggcgtgggtgtccgggggcgtgggtgtcccgggggtgtgggtgtcccgggggtcgtgggtgtcccgggagcgtgggtgtcggggactgcagggacatgggcctcccctcccactcctgccgcccagggcacctcctgtgaggactcggagtccgtgagttcccacctccttgagcccgattctttggtgtccccgcctgcatcctcagcctccttccaaaccagaccagttctctaggggcgtcgacgtgtgaaactgattttaaagaaaacaggcrgtggcctttctctcggccccacgtggcccagtagcgctcaccttccgtcccttcttccgcgctcagtaaccaatttaggccgctcctgcagaactcgggctcctgcccaccggcccacagcgtccacctgaggcctcktcctcccagcaaaggtcgtccctccggaacgcgcctcctgcggcctctccagagcccctcccgcgcgtcctctcagccccgctcgcctcctcccggggcctccctctcccgcctgcccccaggcccgtctcccctcgcgggctgaggcaggttcgggcagcacggccgccccggggcgggggtcactctccaccaccgcgtggtgcccacagctcacggcgctcccgggtgacggtcccctcggctgtagggcgtcctgaagagcggcctgctcggagctgagcgcacggggttgcctssccctgggcgtctctggccctcaccagccccgtcttcccatgggcaaaacggcggtcctgtttgtccacaagtaaccgtcggggttacggaggggccaggagctgcggcggggggctgtgctctcaggaccggccccaggaggatccgcgcgaggtctggagctctcaggggtcgcgggggacagaggggccccaagcggaggcggggaaggcggcagaagcccaggaccgccaagagctggcgaggaagcccggggctcgctgtcgggggagccgggcaggggccgcgcctcggaccaggacggaggcctggggaaggcggatctggccgccggagacgcggtgcgggtggagacgagggatttggatttccgcgggcggctgyacggatttccacgcgcggttcacgtgggccccagggggktgcccggcacccggggccgcgccgccttctcctssccggcatcgacccgcagcctcacgtttacgcggcggcgcccgcagcccccttcggcccggcttccgcgcgtgcccccgagcgcgccctcgggatcagcccccggaagcagagaggccaggccgggaaggatgggcgamsggggtggctgacccgggagcacggcagggaggacacccagccaggcccgcgagcagcgccgctcccctcctccaggacgggcgggaacctgcgatgcccccgccgcgtgggccgtggggcggtctccgaggcactgggcggggcacgcggtgggcgcttcacggaactcgcatttcccagtcttcgtaacccaggaggaagcccacggcgtcctgcaccggcgccggcgcgccaacgcgytcctggaggagctgcggccgggctcccwggagaggragtgcaagsaggagcagtgcyccttcgaggaggcccgggagatcttcaaggacgcggagaggacggtgagcccagcctcggggcgccccgcgccgcggacactgcaggcggcggtgaaccaggccgcgtggggccrcctgcgtctctttggctgcggctgtgggcggcgaacacgcagcggcgcccgcgcggcgctytctgcgggggtcgctttccgcccggggtgactccgctttcctgggcgatgccccccacccccaggcacgcgctctccccgtgcggccgcaccgcgcatgccggttttcacatcagaaaatacgatttgcaaagcacacttagggtgtcccccttaacttcccaagggagtccccccagtccccgaagggtccagggcagcctgcgcatcgcagacgcgcgcggctcgcagaagggacgtggtgagaagctggcccacagcatgccaccagcggcacctcctcagggcacgtgtcggggagaaacaacacttagggacctgggactttctccagctcacgctcacgggtcacctcacactccaagatcacctcaaagaggacacctcacacagggcacacttcacactcacaggtcacctcacactcacaggacacctcacactcacagggcacacttcacactcacgggtcacctcacactccaagatcacctcaaagaggacacctcacacagggcacacttcacactcacrggtcacctcacactcacaggacacctcacactcacagggcacacttcacactcacgggtcacctcacactccaagatcacctcaaagaggacacctcacacagggcacacttcacactcacgggtcacctcacactcacaggacacctcacacaagacacctcacacggggcacacttcacactcacaggtcacctcacacccacaggacacctcacacagggcacacttcacactcacgggtcacctcacactcacaggacacctcacacaagacacctcacacgggrcacacttcacactcacaggtcacctcacacccacaggacacctcmcacagggcacacttcacactcacgggtcacctcacactcacaggacacctcacactcagggcgcacttcacactcacgggtcacctcacacccacaggacacctcacagaggtcacctcacacaggacacctcacactcagggtgcacttcaaacccacaggtcatttcacctcacactcacaggacacctcacacaagataccacacggggcacacttcacactcacaggtcacctcacactcacaggacacctcacagaggtcacctcacacggggcacacttcacactcacaggtcacctcacacccacaggacacctcacagaggtcacctcacacccacaggacacctcacacaggacacctcacagaggtcacctcacacccacaggacacctcacactcataggtcacctcagtcttacaggacaactcacactcacaggtcaccttactctcacaggacacctcacactcacaggtcaccttactctcacaggacacctcactctcacaggacacctcacacagggcacacttcactcccacaggtcaccatacctcacacagatcacctcatactcacagatcacttcattctcacaggatacctcacactcagggcacacttcacactcacaggtcacacctcacacagatcatctcattctcacaggacacctccctctcacaggtcacctcacactcacaggacacctcacagaggtcacctcacacccacaggacacctcacagaggtcacctcacacggggcacacttcacactcaggtcacctcacacccacaggacamctcacagaggtcacctcacacccacaggacaactcacagaggtcacctcacacaggacacctcacaaaggtcacctcacacccacaggacacctcacactcataggtcacctcagtcttacaggacaactcacactcacaggtcaccttactctcacaggacacctcacactcacaggtcaccttactctcacaggacacctcacacagggcacacttcactcccacaggtcaccatacctcacacagatcacctcatwctcacagatcacttcattctcacaggatacctcacactcagggcacacttcacactcacaggtcacacctcacacagatcatctcattctcacaggacacctccctctcacaggtcaccttacactcatctcacactcacaggtcgccacacctcacrctcacaggatgcctcacactcacagaaccacatytcatatgcacaagacacctcacactcaggacacctcatgctcaaagaagcctcacactcacaggaggtccagctgtctgaggcaaaggctaacatgaccctttccagacaaattgaggatggtcatgcctagcatttttatacacctagttttgaaagcatttctcatctgttgtattctcacagcaccccgtgagtttaagttcaggtggccaacagtttcttcagcaatcacttttttctgtggagtgcttttgctgtttgtggaatattttgcawctgctactgcaccctctccccgtatgtgtggccaccctgtcagaggtggagctgtggctcagagcctgtgtacctcgtcccaggtccacagctcagcgacagaagagtcagggttgaacctcgggtgttctgacttgggagcaggaaatgtgtggtcacccatagttccagatgtcctggggaggggccaagattagaagaaacctacctcagctccagaggaaagtctggcttcctgagcccaccccgccagacccaggtccaagtcccccaaccccagttcatggtgtgtccagtgcttaccgttgggtgctctggtgaaggtgcatctcacgaggcttgctctcttgttccttcagaagctgttctggatttcttacagtggtgagtggatgatcaccaccagtcctgcctgcaacccttctcagcttactgacaccagcccactccacagatggggaccagtgtgcctcaagtccatgccagaatgggggcycctkmaaggaccagcyccagtcctrtatctgcttctgcctccctgccttcgagggcyrgaactgtgagacgcgtaaggccccactttgggtcccatatttgcagagggccctggggagctggtgraggtggcctggccaaccgggctgcagggtgcacaacctggtggggtgtgtaggccgggcattcagggctcagccccagttggaaattggtctaggtgaccttkaaatcccttccagtctgaggtctttgacagggacccaaggttctgattatcagactcagtggccccttgggctcccggccctgggcaattctcagccctsgagatggcccagctgagagtccctgtgtccctgtcccacttccacatcccaccaygcaggaccgcttggtaaacttccccttctctactttccattacaaaggtttgaggggtttkttttttttttaaccatctgaatattaaattatcacaaagtttrrggcccccaacctcccttgggttcagtaattcactagaaggacwcatagaatccactgaagtggatacactcacaggtaccgtttattacagcaaaggatgcaggcttaagtctgcagagggaccaggsacaagcttccccttgtcctctccctgtggggtcatgtggacagtccttaattctcccagaatgacgtgtgacragacgtgggaagtactgccaacttgggaagctctacgagccccggtgtccagaggtttkatcagggctcaatsacatagacccagctgaccacccgcatggctgacctcagtctcagcccctccagaggctacgccgatartgcggcccaaggccccaccatacatcacattgtcagctagaccatccagcatggctcaaggcccaggtaaacaccaacattccctcaggcaagaccttccaagggcttagcggtcatttcccaggagccaaggcaaaggctaccctttctctggcacagcagttcatccttgaccacccaagaccacattcttmcactgaatgagctctcctgtgcagcagccattttcttctctaagcagaagagagcccagcaagctggaggaggctgaagagagaggcttcctgctggtcatctgggtccagaatgcctgsagatctctgctcagccctggtgcccagcagccctggtgtgcatcctgcagggcaggccttcccgccggagtcctggacttgytcagggccactccccttgcccatgtcaaccaaagtcaggctgccggttctgcttcttctgtctgagcccatgaccagtgctgggactaactgtccccaggcgggctcacggtggtacgaggccagcttggagaactgtctcagctctctggtcctctcgtcagttgggtctctgattggaaagtcccttggrcacttttaccatccccatkggactttcactttcccccaggctcccatcagctgctcggaagagtggtcaccctggaggccactgcccaccagccaggcaccccccaaatgcaaccgcagccagcactgccagccactggcaaggctgttcagacatgtggctcctctgatccacgccttgtcctttggatcagtccacggagcaggtggtgccaagctcaggctctgtcacccacagctcagtgccaccttccaggcagaacaccactgctgacccagggcatggccaccccggggrctggctctcgctgacccccagaagcccctctcagggtgtccccttcctgtccccagacaaggatgaccagctgatctgtgtgaacgagaacggcggctgtgagcrgtactrcagtgaccacacgggcaccaagygctcctgtcggtgccaygagrggtactctctgctggcagayggggtgtcctgcacacccacaggtgaccaggcttcatgtcccagtcccagatgacaccagtccctgtcccactacggattatcttactggacaaaagacgggtgggagtggcttcacatctactgagcactaactatgcactgaccaattgtgaggtgggatctgggcaccaagggtggcacaggccagagcgacagtgactaggatgggcaccctgggggcaatccctgaatggcctcaggccccctgccaattctaggcagaccargggagccaagcaaggcactatctcacgtccaactcccactcgcaggacctccgccagggttcatgaatctacttcggcacagccaatgtctgtactgactgctgcccactctgcattccaaaactcgtaaaggctcctgggaaaatgggatgtttctccaaaccagcctggaacgaatgggctgcacttccaaaagcagggacaccccacacccactgtstctcaaagaggcggacgtgcccaccctggccacacagcctgggactcagcctgccacctcctcgggcttcytttctggcccaagacctygattgaagcagatcaaaactaagcatgggatcaaaacaacacagtttgattcatctttaggtagaatttcattcaccttctactaaagtcaaacaacacatcttctccctgaaaagtgagcagagggcggttttaagacgtaagccctctgtttcctccaaaaccagccctgaccattgtctcctcagccagccacttcttcaaggrcctctcatggccgggccccaccagtcaggcccagccgaggccctgccttccaccacccctgggccctgggagctcctgctcctgggggcctcccatagcctcggcctcaaggcctctcagaggatgggtgtttctgaatctttcctagtggcacgttcatccctcacaaatctctgcatctttctgacttttgttttacacagttgaatatmcaygtggaraaatacctattctagaaaaaagaaatgccagcaaaccccaaggcyraattgtggggggcaaggtgtgccccaaaggggagtgtccatggcaggtaaggcttcccctggcttcaggattccaagccctgagggtcttgaagccttttgaatgtgaacaacagctctggaagggaaaatgggcaggtcagccccaagcccaccaggctccaagtcagcacacctagcacctccagctcgcggcacccccatgcttttagtggggcaaggaaggagaaaagaaaacgacactcactgagggtctaccctgtgcagagaaccctgcgagatgccccatccgagttgtcacgtcgtcctcacggttactctttgaggtgggatctttgcctgatctttgcaaaatcaggagcattgratcaaagctatgtgaagatcctgtgaggtgaacagtgaaatctcacagcgacatttgtattcttgggccgtgcccaagagcacgtmtcggctagagaggggcacagcctcccakagccaggtctgagcagctttgcctgggagggatctgcaaagaccccaggatttcagaaagaaattgtgcaatgccagaggttccttggcatgcccgggagggcgagtcatsagagaaacaatgacagcaatgtgacttccacacctcctgtccccccgcccaggtcctgttgttggtgaatggagctcagttgtgtggggggamcctgatcaacaccatctgggtggtctccrcggcccactrtttcgacaaaatcaagaactggaggaaccygatcrcggtgctgggtgggtrccactctyccctgtccgaccgcggtgctgggtgggtgccactctyccctgtccgaccgcggtgctgggtgggtgccactctcccctgtccgaccgcggtgctgggtgggtgccactctccsctgtccgaccgcggtgctgggtgggtgccactctccgctgtccgaccgcggtgctgggtgggtaccactctcccctgtctgaccgcagctctcaagtgtctcaggggctgtggctctgggcttcgtgctgtcacttccacagacagacagacatccccaaaaggggagcaaccatgctgggcacgactgctgtggccaccgtgctctcagccactttcccatgcccaaataaaacgataaaagactgggggcttctgcccatcctgcctcacttgaccaagagcccagaagaggatgcgacacccagggcctcatgggaccaccggctggcaggggttctgctcactgggtttatgggtgagacgagcactcccaggagggccactgggccgggaagaactgtggagaatcggggcacgccctgtcctcccagctgccagggcacagcatcccttccccacctcaacacccagaccccagattcaccccagttcacttgtccccacaygagccacaggctgccacctggggcaggctggccccaccttggggttagatgcaggtccccttgccccagaaggagactgcagcccctgcagacctagaaatggccacagcccatccccatgcaccagggggtgaggtggcaggtggtggaaagggcctgargggggcttcytccttccaggcgagcacgacctcagcgagcacgacggggatgagcagagccggcrggtggcgcaggtcatcatccccagcacgtacgwcccgggcacyaccaaccacvacatcrygctgctcyrcctgcaccagcccrtggtcctcactgaccatgtggtgcccctctgcctgcccraacggacgttctctgagaggaygctggccttcgtgyrcttctcattgktcagsggctggrgccagctgctggaccgtggcrccacggycctggagctcrtrgtccycaacgtgmscyrgctgatgacccaggactkcctgcagcagtcacggaaggtgggagactccccaaatatcacggagtacrtgtycbgtgcyrrctactcggatggcagcaaggactcctgcaagrrgvacagtggaggcccacrkgccacccactaccrgggcacgtrgtacctgaygggcatcgtcakctgvggccagggctgcgcaaccgtgggccactttgrggtgtacaccrgggtctcccagtacatcragtggctgcaaaagctcatgcgctcagagccacgcccaggagtcctcctgcgagccccatttccctagcccagcagccctggcctgtggagagaaagccaaggctgcgtcgaactgtcctggcaccaaatcccatatattcttctgcagttaatggggtagaggagggcatgggagggagggagaggtggggagggagacagagacagaaacagagagagacaragacagagagagactgagggagagactctgaggacatggagagagactcaaagagactccaagattcaaagagactaatagagacacagagatggaatagaaaagatgagaggcagaggcagacaggcgctggacagaggggcaggggagtgccaaggttgtcctggaggcagacagcccagctgagcctccttacctcccttcagccaagcccacctgcacgtgatctgctggcctcaggctgctgctctgccttcattgctggagacagtagaggcatgaacacacatggatgcacacacacacacgccaatgcacacacacagagatatgcacacacacggatgcacacacagatggtcacacagagatacgcaaacacaccgatgcacacgcacatagagatatgcacacacagatgcacacacagatatacacatggatgcacgcacatgccaatgcacgcacacatcagtgcacacrgatgcacagagatatgcacacaccgatgtgcgcrcacacagatatgcacacacatggatgagcacacacacaccaatgcgcacacacaccgatgtacacacacagatgcacacacagatgcacacacaccratgctgactccatgtgtgctgtcctctgaaggcggttgtttagctctcacttttctggttcttatccattatcatcttcacttcagacaattcagaagcatcaccatgcatggtggcgaatgcccccaaactctcccccaaatgtatttctcccttcgctgggtgccgggctgcacagactattccccacctgcttcccagcttcacaataaacggctgcrtctcctccgcacacctgtggtgcctgccacccactgggttgcccatgattcatttttggagcccccggtgctcatcctctgagatgctcttttctttcacaattttcaacatcactgaaatgaaccctcacatggaagctattttttaaaaacaraagctgtttgatagatgtttgaggctgtagctcccaggatcctgtggaattggatgttctctccctgccacagcccttgtcaatgatatttcasagagaccctgggagcacctgctcaagagtcagggrcacacgcatcactaaatgcaagttcccaggccctggctgcagtgggaggacctggcaagctgcactcttgctgagtccccagggtggtggaagaagaatgagaaacacatgaacagagaaatggggaggtgacaaacagtgcccccactcagactccggcaagcacggctcagagagtggactcgatgccatccctgcarggccgtcctgggcaccactggcactcacagcagcaaggtgggcaccattggcactcacagcagcaaggcaggcaccagcaacccacctcggrggcactcaggcatcatctacttcagagcagacagggtctatgaactacagccgtgggctgcttccaaggcaccctgctcttrtaaataaagttttatgggaacacacccatattagtgtccatggagtggccgtggcagagacgtccagccggacagaccagctgacccgccaagcccagcatggttagtgtcaggacctctgctgaagatgcttgctgaccctggccagaccccggttcctaatgccccctaaacgggacgggagccagtggcgggccctgatccaggtcagagctggctctgctttctcttttgtcygagtgaccatgcctcagtttcctcatstgtaaaacaggagcccaccgtgatgcttatggtgggatgagatcagcatggatggaacaaggccctggaagggcccatgccatggtcatcgacagcaaagccactctgcagacagatgcttcagtgaattggtagaaaattctgcaaccagaatgcccggggctcctgagggcctaagcccagcccagggttctggaagccrctctgacttcttgggagtggaagttggcaggactcttcctgggaagaagcggagggtggggatgagaggacagttcaggagcccacccagacccacaggaggaaactaggggagtcatgcggggtcctggtggagcgccagcctcccttcctgccaatgggaaatgcaggcgcccacctcatggtgctgccggaggagggggcccgggactccccagagscttcgctgaagggcytgggcgcccccaaaggctacatgtttcatatgggacgtgccacctgccacggctcagctccagctttctgtgagtggcgagatagaatacggggaggccactggccatgggcctgggacagggtgggatgaggcggcaggcttgggccaccaaagccagcatcgccacccagcattgatgacaaagactgcgtgtctgccatragcatcctgctgttggtgcacacaccgcattggtctctccatacaaacatgcctagaggcgatgtcagagggtggagaccaggagaggcaggagtcagacatctggtgccaccaggaaggcccttctcagaggaccaggctgtgcgtggtgcccgcmgtgggaggccagcctggcgttggcatccagcatcatcagtttgtgcagtygggtggggctcagtgagtgcctcctgtgtgccaggcacaatgacgcacaatgtgtgcacaccaggctcatgtgcaggtggctgcgagacagggygacccatcaaggcagatgcaccatgaggcagtggccagtgcygtgggtgttaggggcattgctccccggccactacggcatagcaggcagtgatcgccacactggccaagctttagaccatttattccagagaccccagaggcaaaaagcccggctgcacctcccagtgactcccacagscattgagcagagacrctcaggaccttgtsatgggaggtttctgcactggagaacgagcccagaagccctctcagcctcggaacagtgtggccagtggtgggcaggtcaggaggggcttcagacacagcctgtccctccagatggtcacgggaaggtcactccccacagaagtacgttttggggccatgcgggcacagaaggtttgggggtgggtggggcaggtgccagcctggcctgtgggaggccatggtgcagatgccaagcccccccgtgacatgagaccacctgataccacccagagagtggctgtgagcgraagggcccgcccagaaacaagcagggccttggggcagaagtcctgggctcagatcccacgctcactgccagcggcctcggctcaggcttctgcgctctctaaacttagttttctcttctggaaaaatgatggggaaaatgatatttgtatgtgattgtgaggactgagagttaaatgtaaacatctggaaactacaaaatgagcacgaaatgatgtttttattcttagaacagaaagtccccacacccgcggccctggtgactgatgaggatgaggttcygmggggcctctctggccgcccagctctgcctggggaaggtggggccagagtggatgtgttcccagcgtggtcactcccctgcctcgccagcaggtctcggctccaatcaggaggcctaagccaagtgataagcagccagacaacagccatcccagctgrggcrtggactttgctccagcagcytgtcccagtgaggacagggacacagtactcggccacaccarggggcgcccactgcacmtcgtcctgctcagtgcctccctggctggcctcctgctgctyggggaaagtcgtaagtgcccctcgcccttcagacccaaaagcagcgccagggagcagggaggggcggcagttggggaaaccctctcatctctgcagcctggacggtgggtgccttgagtgctgccagaggctgggctcggatggctgggcttggcctttccagccaacggcatcctcaaggccagctgtggctccctggggctgagagtcagacgggcggatcagaggtcacagagacaaaaacacaaggacagagtcagagagagaaagggagagggarggagaaacggagacacagtgagatgggaggccaagaggcagagacagaggtagaaagacggagacagagagagagggaggggttggggcaggcagagacaggacagttagccatctgccaccacagggaggcacaggacgaggggcacagcagaggagctcccagggaggaggaggctgagccgagccagtgccaccactctcggactggctccgtcggggaaggagctgcctaatgcacagctggacaggtgggggcagcagggctgtccaggacccccgggtctgtccaaaagcagaggcccagacaggacagaagccaggcmagcctggggacagcggaggaagaggaggcccctctggtggggacacgagagacagggaccctagacttgtttgcatcctggacaaagtggacaggcaggggcaccaaggggacccaggmctgggaagggaatgtgtgagggagagacggagcagggggagaccctcgtggggtggaaaggggagaccccygggaaggctgagtggatcctcagtgcatcactgacctaaacggcccctccgcctggtgacttggagctccagtcacatcacacgggggtcttctccatcccaccctcaaccccctgccctccccagcctctgtcccctgagccacatcttcctgtctcccacgcggaacgggactcccgtcttcatggggtactgtgtggctccaactcgcccagccttcttcctccccstcaggccacactgccccctgcaggagcccactgtgatgcttgtggtgggatgagatcagcgtgggtggaacaaggccctggaaggacccatgccatcatcatcgacagcaaagctactctgcaaacagacagatgcttccgcgaattggtagaaaattctgcagccrgaatgctctaggatcctgaggccctaagcccggcccggggctcccgaggccctaagcccggcccgggactctggaagctgctctggcttattgggaatggaagttggcaggactcctcttcctgggaagaagcagagggtggggatgagaagacaggccaggagcccacccagacccacaggaggaaactaggggagttatgcagagtcctggtggagcgccagcttcccttcctgccaatgggaaatgcaggcgcccacctcgcggacctctgggtccacagggtattggcacccttagctgtgtgatgcgggcctggctcataaccatggcctgtggtgtccccgggggccggcctggaccctgggtggacatggccagccccggagagccagggccaggccatctctctcccctactctgcctcagaggcctcggcagctgcactgtggggtgggtggggctgaacacaggtcccagaaggtcccactcaggaccctgctgtgcacacttttgattttaataaaatcagaatgcgcacagcatctgcagtctagcctttaaacgagcacagctgtcctggcagtcacggaagttcttctggggcggtgggacctcagcattcctttgctggtactgctacaagaaaggacaatggaccaagtagcttaaagcaacagaaacatttctcccacagctctggaggctggaagttcaaaatcaaggcgtcagcggggctggttcctccagaggctgggagagagtctgctctaggcctgtttcctggcctyggggtgccagcggcctcacagcccrtggcttgtgggagcattgctcccatcgctgcctccatcatcgcatggggttctcaccatggctgtttttctgtcttcttttctctcagaaggacaccagtcattggattta

SEQ ID NO: 13510 - DNA, 40000 bp, Homo sapiens
  misc_feature (1)...(40000): n = A,T,C or G, or insertion/deletion polymorphism (see Tables 1-2)
ttttttgagatgggagtctccctctgttgcccaggctggagtgcactggcatgatctcagctcactgcaacctctgccttccaggttcaagtgattctcctgactcagcctcccaagtagctgggattacaggcacatgctaccacgcctggctaatttttgtatttttagtagagacaggrtttcaccaygttggccaggctggtctcgaactcctgacctcaggtgatccacccgcctcagcctcccaaagtgctgggrttacaggccatgagccaccacgcccggcctctttttttccaaccataggatttggtctcttgttttagacagttattatctgatcctctctctctctctcttttttttttttttttttttttttgagatagagtctcaccctgtcacccaggctggaatgcaraggcgcgatctcggctcactgcaacctccgcctcccaggttcaagcagttctctgcctcaacctcccaagtagctgggattacaggcgtcagccaccacgcctggctaattttatatataatataaaatataattatatatatattttgtttgtttgttttartaaagacgggttttcaccatcttggccaggctggtattgaactcctgaccttgtgatycattgtccccccccccagcctcccaaagtgctgggattacaggcgtgagccaccgtgcctggccacatctgatcctctctacagttttgtagccagcttttttcaaacacatgcctcagttgtagtggctgtttaatattatgtttttatagttggaggccctactccttaaaacctatgaatgtaaacctcccatgcaagcctgagcactcaccatgctcaccacctgagctcaggtggggaacaagcgaatgagagacaggaccaggtactttctgggtgggacaagttgagagggtctgtgacaggtcacagcagcactagggagaagtgccccccccaccaaccctgatgtgatttgggtagggatggtgggccttcgccagccacacctgggccattctgtcttcttgccttcctggccttgccttcccctattccagctttctgccaggtaaacagtactttccagcactaccaaataaagatttaaggactgctagcccatttcctcttaccccggggaaagaaagtaggtccacaggaaggaaggctgcctccctccccttcttctatcccccaagtgaaagaggtggttggtggccacagcaggtgggcctggccaggatgcctgggttggcagtgaaggaagtagcatggcactcagctaaccttgggccagatgcagcaaggttgggactgaagaaaaggggagttcaggaacgtcggttcctctcctgttttctctcagcccatgggtgagaccytytgtcacactccactccctttcccctgccctaggtcagcagtcatttggaaagagcttgctctgccgccggccatagttgttgccggttcacctccccacccctctcccatcatcccctggtaaggctggctgagagaaattcccctgaaaacatttattttactcagtttattgataagtgataataaaagataagtattacatatttgtgtatttattaatggcccagagtagagcattcagatattttcccagtctgatatatggtttcaggtgagaaaataagggatttatatagtgacaatatttttaagtgaaaagtggaatacatagtcaaagaatttgggcactgccttggtggctggaggcaggtcagaaaatgtcagttggcatggtagaacttctaggaygctgaaatagtttgtggagacacaagtaagaattttttttttttttttttgagacggagtcttgctctgtcacctaggctggagtgcagtggcacgatctcggcttactacaagctccacctcccgggttcacatcattctcctgcctcagcctgccgagtagctgggactgcaggcgcccgccaccaggcctggctaattttttgtattttttagtagagatgggatttcaccatgttagccaggatggtcktgatctcctgacctcgtgatccgcccgcctcggactcccaaagtgctgggattacaggcgtgagccaccgcgcctggcygagaatattttaaactaccacacttaccatgcatgtggtaaactatcagtctgtatttatcagtgatggttatttcctaatacccaggaggcatccatgtgagccacccttccattgctttaagaccaagggagygagtgaccagcaggattcaagatggcagctctgcygaggagtgggagtcccagctaacttctgctccctgctctcccaccaacagcctacaccgatttcttcctcccgctgctaagccgctgtccctcygccatgggaataaagaataaggatggggagacccctggccaaattttgggctggggacccccctgggattctgctgaagaggaggaagaagatgatgcctccaaggagcgggaatggagacagaagctccagggtgagctggaggacgagtggcaggaagtcatggggaggtttgaaggtgagaagtccactgctatccacagctgcccttccccactggctgctttccatctgcatgaatgcgtcacactaggctcctctgccccctcctctgtgcttccctgcttcttggggcccatcaccttctcacagcctctctccaactacccccatcccaccctcccaaacaggtgatgcctcccatgaaacccaggaacctgagtccttctcagcctggtcagatcgcctggcccgggaacatgcccagaagtgccagcagcagcagcgagaagcagagggatccygtcgacccccacgtgctgagggctccagccagagctggcgacagcaggaggaggagcagcggctcttcagggagcgagcccgggccaaggaggaagagctgcgtgagagccgagccaggagggcgcaggaggctctaggggaccgagaacccaagccaaccagggccgggcccagggaagagcaccccagaggagcggggaggggcagcctctggcgatttggtgatgtgccctggccctgccctgggggaggggacccagaggccatggctgcagccctggtggccaggggcccccctttggaggaacagggggctctgaggaggtacttgagggtccagcaggtccgctggcaccctgaccgcttcctgcagcgattccgaagccagattgagacctgggagctgggccgtgtgatgggagcagtgacagccctttctcaggccctgaatcgccatgcagaggccctcaagtgaccctagggaagaagcaagaaacttcggggctgcagcctcaggatgaggcagaaggaagggtaagggaaaggatggggaccacaaggaagagccaggtgctgctcagcagaggatatgggtgggagcgaaagttgtaacaagtgggggtggggggtgcgggccgccaccactgctccttgactctgccgtttcctaataagacctggttccacatctcactcccagtgtctcctctgtctttttccattgctgtggttttcatcacccatgacatctcctttcccgccccgcctgctgaaacccacagctcccacacacctgcaacacacacgcacacgctaacacgggctctgagctggaggcaagaagcctctgcatgccccctcagttcagccctaagaaggcccagtttgccatccagtctcactccactccctacactggggtcttgtccaccctgcaatctgyggctggagaaatagatgcgaacagaggcaaaaaggggaacaaaaccagtttccctcccctccctggctccccaagctgaaccacatcctcctccccacttaacacccccttcccccaacacagggctttccctttgctgagtcactgaatgagcgagttgggggtagccggcgctggggggccatgaggaggctgggggaggatggggaatacaagcagaatggctggaggaagagccctgtgggggagtggaatttcagttgctaaaattaggagcaggggaaggaggtggaaagagcaaaattatgtaacatgggttgtctgttcttgggcaactggagctccacacccaaagccagccaggctgctggctccatccatctctgccctctagcttgtcagttgtatcyctcttcctccagggccccaatcctcatctccgccattcagctgctgccccatcctaaacctgagttcatctctgggcagcccaggcatggccttccctataaacatttccttttccaagaaccagtmgttgaagtcctgagaggtggagggagagtctgggattcccacggaggagagaggggggctccctggaaactaagataggtagaccccactaccatcgcccaggacacaactgggaacttggcaaaaagaaaggacagggctgcaaggagagtacagacatgtgctggtgagtgcactgtctgcatagttacaccaragcatsttatcaatcagaaacttatctttcaggttttgagcccagttctctacaggagaatcccaggagtggaagtggaaggcagtagaagacagggagggcacgcctytgggaacacgggaacatgggtgggcatgagatccttgaataagacagcctgaagttcggaagagaccaaggcctctgaaggaccaggcagatgttcagggtgcaggagggggaagggctggtgagaaagatcctgtgagaggaagctgctgtgattcagagaagagacttcaagctgtgtgtgaccctggcgtccggttcctctcacaggctggagcttttcggaagtggcatgcaaagagtccaggtttggccttggggggagttggggttaggatccctaagctggaggttgagaagtaaattacagaaaactctggtgaccaaatttgctcctccacccaggagatttctcactggtttttaagcacatcatttccccttctgcaagagttacataaaaccaaagcaaaataagccctgaaacctgggyccaccggaccacagtcttttcaacgtcccttcctggtgtctggmccccagccctggtgggggttcccctgagataagggctgttcactttctctgaccacatggtttccgcttctgtgtctcttgtttcctaggctgataaaaatactgagccctagaggccctggcttcctctgaccccttggggcaggcagcasgcatcctgtccagcatggtgggggcagggacaggggccagggattcccaaggggtgactcagtgcctgccatgaaacagtgggtaggtggaagtgtatctctgctctctagagctggcaccaggagttgagtctcagtggaggatgcattgggattcaattggaggaacaggcctggaaaagaataatgagattgaagagggtcagtttgaggactcaggttggggcaggtttggattaagttaggaaaaggatctgggagggactctgttcagtgtaggtcaactgagcattatgtagcccaaagataaatttaaaccctgcttcaagcttacaatctagtggggaggcagacccatacctarttaactgattcaaggcatgatgagtaaactttaagatgattacagaaagaggggagattaagtccatttgaaagcatccagggagcctctgaggagacagcatttgaacttgctctaatgaatgggttcactaggtggaggtggatggaaaggttccataggcgaataacacgtcttgagcgagcctgacaagtcagaaaatgcagtatgttctgggaaaggagcgtcctgagggagaagaagcacaggtgtgagggaacatgtgatgaagaaaggaccacagaaagtcaaggtcagagattggactgcatcctgtgggcagtggtccaggtgacgatgaaaaagagggagaacaggtgagtgctgcagtacagacaaggagtaagaaaacggccatcatcttgtgaattaatacctactgtgtgttaaccagcccttttcctaacaccacaaatcctctcaacgtctgtccaaaaggtgggtggtggtggccaggcacctcactcctgtaatcacagcactttgggaggccaaggtgggagcactttgggaggatcacttgaggccaggagttcgagaccagcctggccaacatggtgaaaccccgtctctactaaaaatataaaaactagctgggtgtggtsktgggcacctgtaatcccagctactcaggtrtctgaggcacaagaatcacttgaacccgggaggcagaggttgcagtgagctgagatcatgcctctgctctccagtctgggtgacagagcaagactctgtatccaaaaaaaaaaaaaattattaagcacctattaggagcagggcactgcttgacaataggtataaataataaagtcactgccttcatagaacttgcagtctaatgagacagtatacaaataataactatacattatagttataatgtataggtatgcctgcttagggtaataaagtgctcaatgaaggtttgaggtaccagcatgactctcaggtggagatttccagaaagcaggtctggagctcaagagaagttgggtctggaggaacagatttgggcatcattcccttcccagtagaggttgagcctttgagtggacaggatcttcaagggagggggcggagtgaccagaagagccctgagcatgatcaaaggaagagaaccaataaaggagaggttggggagcagtcagagaagyagggcacggggggcgggggatgccaagcagagacagggcagccatgtttgaggcttcaaagaggtctagtaaatgagggttgaaaagattgttgggttcaggaactagacgattacaaattttgagaaaaccgtttccatttaatagaggggcagaaatcactttacataggttgaggaatgagtgggaggtgaggaaaaggaggtggtgggcatgaggtcagaatggtgaacacagaataactgagaatcatctcttagttctacccacagattttacagttgagggaaattttaccagttcctgaaaaagtggttcrttaagggggctagtcttttgagacatcacacgaaaacggaaggtgagatagactggacatttgagggagaaayattccaaggaaggatcttttttgttgtttattttcaagaaataaaattgaaggtaaaatgaagatgcttaaagagacaaagataggccaggtgcagtggctcacacctgtaatcccagcactgtgggaggccaaggtgggcagatcacttgaggccaggggttcaagactagtatggccaacatggcaaaaccgcatctctacgaaagatacaaaaattagccaggcgtggtggcacatgcctgtggtcccagctattcactgaggtgggagaatcgcttgaactcaggaggcagaggktgcagtgagccgagatcacaccactgcactccagcctgggtgacagagcgagactcagtctcaaaaaaaaaaaaaaaaaaagcccaggtgcggtggctcacccttgtaatcccagcgctttgggaggctgaggtgggcagactatagatatcaggagttcaaaaccaacctagccaacatagtgaaatgctgtctttactaaaaatacaaaaattagctgggcgtggtggcacacgcctgtaaccccagctactcaggaggctgaggcaggagaatcacttgaacccgagaggtagaggttgcagtgagccgagatcgcgccactgcactccagcctgggcaacagagcaagcctatcccaaaaacaaacaagaaagggagagatagtgaaaacataagcaagaagtggggagagaatatagtaaagatagaggaagtgggatagagtacagataaaaggatcagtcttggaaacaagaaaaagtactgtgagtcagtatgtaaggaaagattaaatataacaaaattaaggaaaaagagggaagtgagatccacacttgatggccttaagctcaatgaaatattaatagatgagagtgaagaacatcagaggcacggagatttagaacatcacgcacagkagtataatggggagtcaacaaagaatgagtaaaagttgtgtccaagaacactgatgactctctgagattagctggccaggattagttataggcckcttatggtgactcagctgtctactgcagcgcttggcagcctaagacaaagccccaagaatgagaccacttagtttacccaagtcaatttttgagacagagtttcactcttgttgcccaggctggagtgcaatggctcaatcttggttccctgcaacctctgcctcccrggttcaagcgattctcctccctcagcctccagagtagctgggattacagttgcccaccatcacgcccagctaatttttgtatttttagtagagatggggcttcaccacattggccgggctggtctcgaactcctgacctcaggtgatccgcccaccttggcctcccaaagtgctgggattacaggtgtgagctacggtgcccggcggtaagagattctaaaatgcagacaaagtggagttgaaattgttgaccatgcagtacatgttaaatcaacaagcaaaaccaggaaagcagaagcagccggaagtcttggtaagaataaagaactgattcaaggggaggcagagagtgggagatgtgaaaagtgagtggttgtgatgagaagggtaattcagagatcaagatcttgaaggcataattcttccaagtgatgctggggtttgaggtacaaccttactcctgggtggctaaaatggaggagggaagaagaggctgtaaaaccagtagacttgagaaacttggagaattgagaggccagactgtaagactcatctgatctgtgtggcttctttttttatttttatttttttcctctgagacgaagtctcgctctgtcacccaggctggagtgcagtggtgtgatctgggctcactgcaagatccgcctcccgggttaatgccattctctcgcctcagccttccgagtagctgggrctacaggcacccaccaccacgcccagctaattttgtttttgtatttttagtagagacgggrtttcaccttgttagccaggatggtctcgatctcctgacctcgtgakccacccgcctcagcctcccaaagtgctgggattacaagtgtgagccactgcgcccagccgatctttgtggcttttaaagtcactaaagatggtggtaggaggccgggtgcggtgggtcatgcctgtaatcccagcactttgggaggctgaggcgggtggattgcttgagctcaggagttcaagaccagcctaggcaacatagcaaaaccctatctctggaaaaaaaaaaaaaatacaaaacttagccgggcayggtggtatgcrcctgtagtcctagctactcaggaggctgacgtgggaggatcacttgagcccaggaggtcgaggctgcagtgagccaagatcacgccactgcactccagcctgggtgacagagcaataccttgtctcaaaaaacaaacaaacaaggatgatggtagggataagatgtggagaaagactgagctagttatacaagttgttaagagcataataaatattttgatggataagattgtgctgtgaagrcaggraragcatggcaratgcaraaggcacgtgctttgggagatgaggaggagtttatcagtggtctgggggagagaaaataacgacccctctcttctgccttcattcccctagtgatggaggtcgaagaaagagcaaccttcaccacagagaggagtagcatcattaggggaaagccaggtttcaaaatgcccagaggaaaatgctttcaaacatagaagacaggatttgaaaatgtgaagagttccaccaaatattgtgaaatggattggtagaagggtccttgtggggtagggaattgaatccagggaggttaaatcccagtgggaattcagaagactaagtctggagagtttagcttctaggagcaggaggttgttgcctctggaattcagaatggaagatgcactgcatccattgtgaggggaaacaagtgcctcaaaggggtcttatagggatgcacaagataagttccatggctttaaacaccatcctcatgctgaccatgcccaggtttctttctctagcttggaccttgcccctgaaatccagatgtgtatctgcccagtgrcatctctacttgcatgtctaatagacttagacttaccacacccaaaatagaattttttagtttttccatccatcagaatcctgcttctctcccagtatctacatctcccacccatcaatccatcatctagtcctgttgtttctacccctggaatgtataatatatcccaaacttgtctacttctctccatctccatggctgccactattttctcttcaccatcaatgycactgccacctgtctcctaccagccagcctaaacacaggagccacagtgatcttttaaaaacaagtccaggctgggcgcgttggctatgcctataatcccagcactttgggrggccgaggtrggtggatcacgaggtcaggagttcaagaccagcctgcccaacatgatgaaaccctatctctactaaaaataccaaaattagccaggcacggtggcgcatgcctgtwatcccagctactcggggggccgaggcaagagaatcrcttgaacctgggaggtggaagttgcagtgagccaagatcatgccgtagcactccaacctgggcaacagagcgagacgccatctcaaaaaaaaaaaaaagtccaggcaagrctcagtggctcatgcctgtaatcccaacactttgcgaggctaaggtgcaaggattgcctgaggccaagagttgaaggctgcagtgagctatgatggtgccattgcactccaacctgggcagaaaagtgagactccatctcttagaaaaaaaaaaccaggccgggtgcagtggcacatgtctgtaattccagcacttcgggaggctgaggcaggcggatcacttgargtcaggagttcaagaccagcctggccaacatggtgtactttctatactaaaagtacaaaaattagccaggcatggtgacatgcacctataatcccagctacttgggagactgacataggtggattgcttaaacctgggaggcagaggttgcagtgagccgagattgtgccactgcactccagcctgggtgacagagcgattctgtcttaaaagaaaaaaaaaaaaaaaaaaggctgggtgcggtgtctcacgcctgtaatcccagcactttgggaggccgacgcaagtggatcrcctgaggtcaggagttcgagaccagcctggccaagatggtgtactttctctactaaaagtacaaaaattagccaggcatggtggcatgcacctataatcccagctactcaggaggctaagacaggagaatcgtttgaacccgggcagcagaggttgcagtgagctgagattacgccattgcactccagcctgggcaacagagtgagactccgtctccaaaaaaaagaaagaaaaaaaatccagggccagtgtggtgactcatgcctgtaatcccaaaactttgggaggctggcccagcatggtggctcacacctgtaatcccaaaactttgggaggctgaggcaggcggatcacctgaggtcaggagtttgagatcagcctgactaacatggtgaaaccccatctctactaaatacaaaaaattagccgggaatggtggcatgcacctgtaatcccagctacttgggaggctgaagcaggagaatcgcttgaacccaggaggcagaggttgcagtgagatgagatcagtcattgcactccagcctgggcaacgagcgaaaccgcctctcaaacwaacaaaaaaaaactttgggaggccaagatgggcagatcacttgaaaccaggagttcgagaccagcctgagcagcatagaccctgtctcaacaaaaattttaaaatattttttaaaattagccaggcacagtggcacacacctgtagtcctagatacttgggaagctgaggtggaaggatgacttgagcccatggttttgaggttgcagtgggctatgatggtgccactgcactccagcctaggccacagagcaagacaccatgtcaaaagaaaaaaaaatccaatcacctctgctcacctccctctttctctctctctctctctctccctccccctctctcccctgcamcacacacacacacacacacacacacacrcacrcaygcacgcaccacacactctgacgacctttaaaggcttcctgtggctggatgaaatctagaggctttacccttcttgcatggccctgcatgacctggcccctgccctcctctctgacctcatctcccacccgcctcccagtctctctctctgctccagccacactggccttctgtttgtcgtcaacacccccagcttggttccgccttccagcctttgcagtagctgctccctttacctgaaatgctttgctcccaaacttttacctggtcactattttttgtcatttgggtctcagctccagtgccacccaaacactcaaagaggattttgctgactactgtatttaaaagtagctccctgccactcttacaacatcagcctgtcttattttctcatagtaccaatttcttcttcagtttctttcttttccgtctggcctcactggaatacaagctccacaggtgctggtaccttctctgatccctttgcctccatgtccctcctgccttaggacaatgcccagcatgtgttaggcacgcagatactcactaaatggaggaatggatgaataattcataaagcaggataaagttcaactttaggcttgtggctcagattggacttacatttagagtcagatttaagtttagtgttaggagtggtggtaaactggtttcaagattagccctagaaacagggttgggttggggtagaggagaagttttatttagggggttattaattgggatgtgtttagatttraggttagggttacagttggggttgagtttgagttgtgatttgggttgaggttaaatttgggttagggttgatgttggtattaaatcccaattcaggttttgaggctaagttcaagtttgaagctaatgtcatttcagtctcatttggaggcttcagagatttcactagtttctccacaaagaccactataaagactgtatttccctgagtctggggcacaagactccagtcatcagctctcccacccagggaaagtcccaaaccaactgctggcctgcccaagaaagaaaccaaattcatacaacctccgaaactgagattgaaaccaagattggcccatctcaaggagcatccttcgcatatctcacatgcaygtgacactgagcctcagcccagtcttacccttccttcctctgtgtctctcatgtctccccatcacccttcttgccttcccttttttgtctttcaatgtcccattcttcctctttaatttaaatttctctctgtgtctcactgttaattgcaatacctttttttgtttgcttgttttgttttgttttgttttttggttkgtttgtttgaaatggagtctcactttgttgcccaggctggagggcagtggcacgatctcggctcactgcaacctccgcctcctgggttcaagcagttctcctgcctcagcttccctagtagctaggattacaggcgcgtgccaccatgctcggctaattttttgtatttttagcagtgatggagtttcaccgtattagccaggattgtctctatctcctgaccttgtgatctgctcgcctcagcctcccaaagtgctgggatgacaggcatgtgccactgctcctggccttgtaataacattttatattttaatatagctcagctggggtcccagtccatcagctcataccattagagaagcagaaagagacaacaggaagcaaaaaggaccctgagagaaagggcaacacagagaaaaagaaaggagcaggggctaaaagggaaacccacactgacacaagagataataaggttaaaagaatgagaagaaggttgggcscagtggctcacgcccataatcccagcactttgggaggccaaggctggtgggtcacctgtggtcaggaattcaagaccaacctggccaacatggtgagaccccgtctctactaaaaatacaaaaaaaaatttggcgggcttggtggcgtgtgcctgtaatcccagctactcgggaggctgaggcaggagaatagcttgaacctgggaggcagaggttgcagtgagccaagatcgtgccactgcactccagcctgtgcgacagtgagaaactgtctcaaaaaaaaaaaaaaaggaaaagaaattttctgacytatctcatctgatagtaggttataagaccctcattccagaagaggttctgccctatacctgggaggaaggaatgctgtacagagagaccaagaagaatatggccaggccttgctgggatccccccagtcccagtctgtgaccattagatgatactccttttgttcaattacatttctgcacagctgttcattcttcatcaaatctaagcataaaaatagktttcccctgggtccttgggtcttcatttctgaaggctcccatgtcacctaaaactttgattaaataaatgtattatgcttttctcttgttaatctgtcttttattataggagtattggccataacccttatgatgggtcaggaagggatcacccctttctgcccctacagaaataatagctaagactagtaaagcataaaaggcaaaggggcaggtcctcaagtagagaagaacaggagaaatagctcatacacacccagaatgttacttacatgtccctccatgttacaccaagacccctcagggaccttgtgcctggggagagaagtggtctgccccatgcaacagtgggctttaccccgggtcaccaccagccccagctccaacccctctaacactctccaagtaaaatcacatsagtagcagtaataatatttgaggtgacaagttrgtattatctcaaacttaggaaaagtgaataaagtcatctttagaaactgctttttttaaaccttgtaacttgcaagctaagtgaaaatgggctcatgtatgagaatgttcgtgttagacattttttgtgttagacaaaaactagaaacaaaccaaatccccatcaacagaatatattagaatatattgatacaatagaatattacatcataattttttwwaaaaacattactgatacatacaaccacgtatatgaatctcacaaacataatgctgactgaaagaagtcaaacagaaatgagtacattctgtgtgatttcatttatatgatgccccaaaccaggaggaaataatctatggtgataaaagtgagagagtggttggttatctttggagggtatcagcagggagggggcatgagggaacctgctggggacctgaaaatacgtggagctgggtggtggctacatacagatggaaaaattcatcagctgtacacttaagaggtgtccacctcatacctaagttacatatcaataaaaaggaaaaaaattttggaaactttttttttttttttttgagacagagtcttgctctgtcccccaggctggaatacagtggtgcgatcttgactcactgcagcctccgcctcccaggttcaaataattctccagcctcagcctcccgagtagctgggactgcagatgcgcaccagcacgcctggctaatttttgtatttattatagagatggggtttcaccatgttggccagctggtctcaaactcctgacctcaagtaatccgcccacctcagactcccaaagtgccaggattacaggtgtgagccactgcaccaggcctggaacaattttaaaataatgtattggctctgcaaatgcagcttcagaacaagtcccttagctgtccccaccccaccctaagtcaccacccttaagcctcacccatgtggaattctgaaacttcctttgtagaaaactttggaaggtgtctgccacattgatcctggaatgtgtgtttatttggggttatataaatctgttctgtggaagccacctgaagtcaggaagagatggagggcatccttcaggagtgagatgagacctcatcatacttgactgtccagcatcatctctgagtraggggaccaaaaaatttatcttccaaactaggacactttcaagagtggaagggggatccattaatattttcacctggacaagaggcaaacaccagaatgtccccgatgaaggggatatataatggaccttcttgatgtgaaacctgccagatgggctggaaagtccgtatactgggacaagtatgatttgagttgtttgggacaaggacaggggtacaagagaaggaaatgggcaaagagagaagcctgtactcagccaagggtgcagagatgttatatatgattgctcttcagggaaccgggcctccagctcacaccccagctgctcaacyrcctcctctctgaattgactgtcccttctttggaactctaggcctgaccccactccctggccctcccagcccacgattcccctgacccgactccctttcccagaactcagtcgcctgaacccccagcctgtggttctctcctaggcctcagcctttcctgcctttgactgaaacagcagtatcttctaagccctgggggcttccccgggccccagccccgacctagaacccgcccgctgcctgccacgctgccactgccgcttcctctataaagggacctgagcgtccgggcccaggggctccrcacagcaggtgaggctctcctgccccatctccttgggctgcccgtgcttcgtgctttggactaccgcccmrcagtgtcctgccctctgcctgggcctcggtccctcctgcacctgctgcctggatccccggcctgcctgggcctgggccttggtgggtttggttttggtttccttctctgtctctgactctccatctgtcagtctcattgtctctgtcacacattctctgtttctgccatgrttcctctctgttcccttcctgtctctctctgtctccctctgctcaccttggggtttctctgactgcatcttgtccccttctctgtcratctctctctcgggggtcggggggtgctstytcccagggcgggaggtctgtcttccgccgcgtgccccgccccgctcactgtctctctctctctctctctttctstgcaggttctccccatgacaccacctgaacgtctcttcctcccaagggtgngtggcaccaccctacacctcctccttctggggctgctgctggttctgctgcctggggcccaggtgaggcagcaggagaatgggggctgctggggtggctcagccaaaccttgagccctagagcccccctcaactctsttctcccctaggggctccctggtgttggcctcacaccttcagctgcccagactgcccgtcagcmcccyaagatgcatcttgcccacagcamcctcaaacctgctgctcacctcattggtaaacatccacctgacctcccagacatgtccccaccagctctcctcctacccctgcctcaggaacccaagcatccacccctctcccccaacttcccccacgctaaaaaaaacagagggagcccactcctatgcctccccctgccaycccccaggaactcagttgttcagtgcccacttcctcagggattgagacctctgatccagacccctgatctcccayccccatcccctatggctcttcctaggagaccccagcaagcagaactcactgctctggagagcaaacacggaccgtgccttcctccaggatggtttctccttgagcaacaattctctcctggtccccaccagtggcatctacttcgtctactcccaggtggtcttctctgggaaagcctactctcccaaggccacctcctccccactctacctggcccatgaggtccagctcttctcctcccagtaccccttccatgtgcctctcctcagctcccagaagatggtgtatccagggctgcaggaaccctggctgcactcgatgtaccacggggctgcgttccagctcacccagggagaccagctatccacccacacagatggcatcccccacctagtcctcagccctagtactgtcttctttggagccttcgctctgtagaacttggaaaaatccagaaagaaaaaataattgatttcaagaccttctccccattctgcctccattctgaccatttcaggggtcgtcaccacctctcctttggccattccaacagctcaagtcttccctgatcaagtcaccggagctttcaaagaaggaattctaggcatcccaggggaccacacctccctgaaccatccctgatgtctgtctggctgaggatttcaagcctgcctaggaattcccagcccaaagctgttggtctgtcccaccagctaggtggggcctagatccacacacagaggaagrgcaggcacatggaggagcttgggggatgactagaggcagggaggggactatttatgaagkcaaaaaaawtaaattatttatttatggaggatggagagaggggaataatagaagaacatccaaggagaaacagagacaggcccaagagatgaagagtgagagggcatgcgcacaaggctsaccaagagagaaagaagtaggcatgagggatcacagggccccagaaggcagggaaaggctctgaaagccagctgccgaccagagccccacacggaggcatctgcaccctcgatgaagcccaataaacctcttttctctgaaatgctgtctgcttgtgtgtgtgtgtctgggagtgagaacttcycagtctatctaaggaatggagggagggacagagggctcaaagggagcaagagctgtggggagaacaaaaggataagggctcagagagcttcagggatatgtgatggactcaccaggtgaggcygccagactgctgcaggggaagcaaaggagaagctgagaagaygaaggaaaagtcagggtctggaggggygggggtcagggagctcctgggagatayggccacatgtagcggctctgaggaatgggttacaggagacctctggggagatgtgaccacagcaatgggtaggagaatgtccagggctatgraagtcgagtatggggacccccmcttaaygaagacagggccatgtagagggccccagggagtgaaagagcctccaggacytccaggtatggaatacaggggacrtttaagaagatatggccacacamtggggccctgagaagtgagagcttcatgaaaaaaatcagggaccccagagttccttggaagccaagactgaamcmagcattatgagtctccgggtcagaatgaaagaagargrcctgccccagtggggtctgtgaattcccgggggtgatttcactccccggggctgtcccaggcttgtccctrctmcmcscacccagcctttcctgaggcctcaagcctgccaccaagcccccagctcyttctcccsgcagggacccaaacacaggcctcaggactcaacacagcttttccctccaaccccgttttctctccctcaaggactcagctttctgaagcccctcccagttctagttctatctttttcctgcatcctgtctggarrttagaaggaaacagaccacagacctggtccccaaaagaaatggaggcaataggttttgaggggcatgrggacggggttcagcctccagggtcctacacacaaatcagtcagtggcccagaagacccccctmrgaatcrgagcagggaggatggggagtgtgaggggtatccttgatgcttgtgtgtccccaactttccaaatccccgcccccgcgatggagaagaaaccgagacagaaggtgcagggcccactaccgcttcctccagatgagctcatgggtttctccaccaaggaagttttccgctggttgaatgattctttccccgccctcctctcgccccagggacatataaaggcagttgttggcacacccagccagcagaygctccctcagcaaggacagcagaggaccagctaagagggagagaagcaactacagacsccccctgaaaacaaccctcagacgccacatcccctgacaagctgccaggcaggttctcttcctctcacatactgacccacggctycaccctctctcccctggaaaggacaccatgagcactgaaagcatgatccgggacgtggagctggccgaggaggcgctccccaagaagacaggggggccccagggctccaggcgktgcttgttcctcagcctcttccccttcctgatcgtggcaggcgccaccacgctcttctgcctgctgmactttggagtgatcggcccccagagggaagaggtgagtgcctggccagccttcatccactctcccacccaaggggaaatggagacrcaagagagggagagagatgggatgggtgaaagatgtgcgctgatagggagggatggagagaaaaaawcrtggagaaagacggggatgcagaaagagatgtggcaagagatggggaagagagagagagaaagatggagagacaggatgtctggcacatggaaggtgctcactaagtgtgtatggagtgaatgaatgaatgaatgaatgaacaagcagatatataaataagatatggagacagatgtggggtgtgagaagagagatgggggaagaaacaagtgatatgaataaagatggtgagacagaaagagcgggaaatatgacagctaaggagagagatgggggagataaggagagaagaagatagggtgtctggcacacagaagacactcagggaaagagctgttgaatgcctggaaggtgaatacacrgatgaatggagagagaaaaccagacacctcagggcyaagagcgcaggccagacaggcagccagctgttcctcctttaagggtgactccctcgatgttaaccattctccttctccccaacagttccccagggacctctctctaatcagccctctgycccaggcagtcagtaagtgtctccaaacctctttcctaattctgggtttgggtttgggggtagggttagtaccrgtatggaagcagtgggggaaatttaaagttttggtcttgggggaggatggatggaggtgaaagtaggggggtattttctaggaagttyaagggtctcagctttttcttttctctctcctcttcaggatcatcttctcgaacccygagtgacaagcctgtagcccatgttgtargtaagagctctgaggatgtgtcttggaacttggagggctaggatttggggrttgaagcccrgctgatggtaggcagaacttggagacaatgtgagaaggactcrctgagctcaagggaagggtggaggaacagcacaggccttagtgggatactcagaacgtcatggccaggtgggatgtgggatgacagacagagaggacaggaaccggatgtggggtgggcagagctcgagggccaggatgtggagagtgaaccgacatggccacactgactctcctctccctctctccctccctccagcaaaccctcaagctgaggggcagctycagtggctgaaccgccgggccaatgccctcctggccaatggcgtggagctgagagataaccagctggtggtgccatcagagggcctgtacctcatctactcccaggtcctcttcaagggccaaggctgcccctccacccatgtgctcctcacccacaccatcagccgcatcgccgtctcctaccagaccaaggtcaacctcctctctgccatcaagagcccctgccagagggagaccccagagggggctgaggccaagccctggtatgagcccawctatctgggaggggtcttccagctggagaagggtgaccgactcagcgctgagatcaatcggcccgactatctcgactttgccgagtctgggcaggtctactttgggatcattgccctgtgaggaggacgaacatccaaccttcccaaacgcctcccctgccccaatccctttattaccccctccttcagacaccctcmacctcttctggctcaaaaagagaattgggggcttagggtcggaacccaagcttagaactttaagcaacaagaccaccacttcgaaacctgggattcaggaatgtgtggcctgcacagtgaagtgctggcaaccactaagaattcaaactggggcctycagaactcactggggcctacagctttgatccctgacatctggaatctggagaccagggagcctttggttctggccagaatgcygcaggacttgagaagacctcacctagaaattgacacaagtggaccttaggccttcctctctccagatgtttccagacttccttgagacacggagcccagccytccccatggagccagctccctctatttatgtttkcacttgtgattatttattatttatttattatttatttatttacagatgaatgtatttatttgggagaccggggtatcctgggggacccaatgtaggagctgccttggctcagacatgttttccgtgaaaacggagctgaacaataggctgttcccatgtagccccctggcctctgtgccttcttttgattatgttttttaaaatatttatctgattaagttgtctaaacaatgctgatttggtgaccaactgtcactcattgctgagcctctgctccccaggggagttgtgtctgtaatcgccctactattcagtggcgagaaataaagtttgcttagaaaagaaacatggtctccttcttggaattaattctgcatctgcctcttcttgtgggtgggaagaagctccctaagtcctctctccacaggctttaagatccctcggacccagtcccatccttagactcctagggccctggagaccctacataaacaaagcccaacagaatattccccatcccccaggaaacaagagcctgaacctaattacctctccctcagggcatgggaatttccaactctgggaattccaatccttgctgggaaaatcctgcagctcaggtgagatttccggctgttgcagctggccagcagtccggagagagctggagaggagccgcattctcaggtacctgaatcacacagccaagggacttccagagattcggstgtctaggcttcaaatcaccctgtcctaactctgcaacctgaaccagccacttaacctatctatccaatggggataggaatgtccaccacacatagggcatgtgagagaaggcctgacctccatcagaggacctcactcagcccttggcacagtgggcacttagtgaattctggcttccttcaaccagtttccagctgttctatccccttccattctctcagtgggtgaaatcgaagagactgaggacaataaagaacaaggaaccraactgccggacgtggtggcatgcaccygtaatcctaccactttgcaaggccaaggtgagaggatcgcttgaacccaggagttccagarcaacctgggcaacatagtgagatcctgtctctattttttaaaaaagaatgaaacataggaataagatgtgggtgaaggactcacatgccggcttggtcccactsgtctttgtggtgaaggaggggagagrtgagaggtgggtaatccggaaagagaaaagcaccccctccctggatgaaggctcttctggagagagtcaaagacaaataagggtggggcgcagtggctcatgcctgttatcccaacactttgggaggctgaggtrggaggaccacttgagcccactagttcaagaccagcctgtgcaacatagcaagaccttgtttctagaaaaaaaattaaagattagtcaggtgtagtggtgcatgcctgtaatcctagctcctcaggaggctgaggcaggaggatcactcaagcccaggagtttgaggttacagtaagctatgatcatgccactgtacccccgtctgggtgacagaacgagaccctgtctcaaaaaaataataattccaaaammaaatatggagacggaaattgagcccccctagactgggagcccccactgagttyggaaattaggctttacctccagccctggggtgccaggcargagaaaaccatgtrgtaggctgagggggtagggtgacccattggggtgacctakatagggccttgggtcaccctctgcctcctccagcctgtggctgaaagtcagccatgaagtaatgggggacactgttactcatcccagaagcacccayacttactcacttttgggaagggggacctaaagtgtgaaaaaaaggtgaggattttccgtctcaccctaaatgggacaycctaagtggggcatcggtttttcctcctccccagaacttcctggtgttttcaggcaccacaggctccttcctgccatccccatctctctctaatattctcccyttctttctccttcagcctcctcccttyagaccccatgagccttgaattaagctccttggaggagaagagttgactgtcgggtaggagacagagaggccttcaggcagctctagggggagaagtgcggggcccctccaggcttcattcctctgtcatgataggggcttactctgctgctgggcctttctgagtggtgcttgctgggctctgtaatgacccctctcactgttggggggtacccaagagaaaagagtatggtgcagagtctggttgggaccatgtggccctgaaaatcaggatgcctagagaagcttcggagtttgagaagtcccccttcctcccaccctccaactgggctaatggtggggcctggccattcagaggcagggagggggtgggacagrcagaccatcatccctaggagcaaaggccatacactgtgttgtgatgaattgtttcaagcaaccagaagastactgagaatatttaacccgcacccgtgcacccaccctgaattaagacgtgtgtcgcaactcagcatctttatcggcagcactgaagctttccattctttaytttcatcaggttcaaaatcaatttccaaacagtctcctacatttttcccactgccatggggtcctgggcgtccgggcccccartattcacgcactcgcaccacgcactcatattccctcaccccaccatcacggccccaaagaaggtcttccctctcgcraagtccaccatatcggggtgactgatgttgacgtacaccctctcgcccctccggagctgcaccaggccgccgaaccccacgctcgtgtaccagagaggcccgtacccttgtctcctggccgggtccagcactggagtcaccgtctcggcgccctcgagcagcagctcgggagtgcccggcccgtaggcgccccccgcccggtacagagagctgcgcagcgtgaccgagcggccytgggggtccccgccgccagggggcgcccggccccggtagccgacgagacagtagaggtaatagaggccgtcctgcgggagcgccagcccctcgkcgtccgagaactgcgtcccgctcgtcagaaacgsctgttccttcgtcgtctcccagcctagcccctgccccttcagcggagcgcctgcggagacacgggccgacgcgctcttgggaatgcgatcctaaaggcttgggacttctggggaagtggcggcttttagcccctgcgggagccgagccgggccgggggaggagggatggtgctgtttcwgggatgagtgcgagttgggggccgagggaacacggatgtggggtgcagaacgctgtagtggggacctccaggccggcttttgcttgcaccggagggaagaagaaactacactgcggggacgagcgtaagagtgggcacgagcgacaaaaggtcgtgaagcgggtgggaaaccgagcactggaatcatggagccgaaggactctgggcgagcagaamtggaaccttcggattatttacactcttattcaggtcttggaggtccttacctatgaggtgggcagctgggarcccgggsctgagatctgtttctggctcctcctctggcagcttctgaaacyctggaaggggcaaagagtccacgattgggggcagggcagccacccatgcaggctacccttgagagaacagggcgcagggatggggagcctggattcctagaggaagaggtatctggggacgcagcagggagctgggagcccctgagggkctgaagcggggaaggagagacagtctgctcttacccagtccttgctgggcctgtgccccggggtcggccgtctccgttacctggttgggtggggtcacagtgcccagagytcagattcagytcatgtcaccccwacccctctgaaagtggacccaagctgcaggcctggggtttctcctaccagcaccatccccaayacacacctccttagaagggagaasaagcaaggcataggtacttgggcrgagaaacagatgtacctcgggaagaggagaggagacacaaggggcttatgtcgggacacaagcacaacatcacaggaacatggaaagagagtcagcaaagagacaagacatccccaccagggacagccgagccagctgagccagagggggcaaaagaccacaggcacaaccagagggagccaagcatccgcargatwcaactctccaccagggcctgttgcagccactcaccagtcctccctgatcctggggcactaaggccagcacagccaggacagtgataggcaccgccagcaacaaggtcaccagagaagtggctcctgccacagctagcaggagggaacccctcccctggagcctcccacccctgccctccagccccagtgcccccattgagactgaaccagagccagagcagggggctttcatacctcagggacgggcccaccccckccctgtagacctgcacacctggctgggactttccgcacacccctgctcccctcacccagcttcctgtttacccagagctggggtggggcagctggatgcctgggttctctgaactggggaagaagttgaggttagggagacaggctctcagggtggaaccaaaggggtctttagacatcttctggctcagcagagagrgaaactgaggcccagggagggaaggtagcttgcaggaagccagtcagcagagctgaaatgagaacacagatctccaggtttccaatrtggtttgcattcttctatacyctcaaggtaggtgctggaggaagagctgatcccgtctctgaggtcaagggccggactaggacaaggactggaatcttgagggatggatgtctgggttccctgagaagaactgattcccatactgggctgacctcctcccgttcccttgctcatctccagccccctgtgctgagtgagaaagggagaggtaagccttagcctcaccactgactactgactcactaaggagggatggaaatggagctttacctcccttgctacaaaaagtaaagacagatggacgaggcatactcccaccctcagagagcttccaagtctacaatgagccctatccattagtaggtgcttactaaatgtttatacataaatgaataaaaggacaaataaatgcaggaataaccaaaacaaagcagcaaggaccacatgaatggtagatgtaggcagcatgagtggttaagagtcaagggagtagccggggtagtggcttacacctgtaatcccaacastttgggaggctgaggcaggtggatcacttgaggtcaggagttcgagaccagcctggccaacatggtgaaaccctgtctctactaaagatacaaaaagttagccgggcgtggtggcacgcgcctgtaattccagctacacaggaggctgaggcaggagaatcacttaaacctgggaggcagaggttgcagtgagccaagattgcaccattgcactccagcctgggcaacaggctgagactctctctcwmaaaaaaaaaaaaaaaaaaaaaaaaagagtcaagggaagaaagaccaggtccaaggaagctggaagtggctccaatcatctccccttcttggtaacatctctatgtgtttccgtaatactaataataatatagctgacccacaaaatgcacttaacatgtttatgccactgatttacacactttaataatttttttttttgagacagggtytcgctatgtcacscagactggaatgcaatggcaggatcatggctcactgcagccttgacctcccaggatctatggattcacctacctcagcctcctgaatagctgggactataggcacatgccaccatgcccagctaatttttgcattttttgtagagatggatttttgccacattgcccaggctgggctcaaactcctggactcacgtgatctgcccgtgttggcctcctaaartgmtgggattacaagcatgagccatcatgcccagccaataattataatcctgacaaaaaccctaagaggaaactgaggtacagagaggttaagaaacttatggagctcacagagtcagtggcagaaccagaatttgaacccaggcatctggctccagagccttgataacaagacagtttaaaaactgaatactggggctgggcgcagtggctcttgcctataataccagcactttgggaggccaaggaaggtggatcatctgaggtaaggagctcgagagcagcctgatcaacatggtgaaaccccatctctactaaaaatataaaaattagcggggcgtggtggtaggcacctttaattccagctacttgggaggctgaggcaggagaatcacttgaacccaggaggcggaagttgcagtgagccgaaatcatgccattgcactccagcctgggtgacaagaacaagactctgtcttaaaaacaaaaacaaacaaacaaaacagtattaggccaggcgagatggctcacacctataatcccagcactttaggagaccaaggcaggtggatcacttgaggtcaagagtttgagaccagcctggccaacatggtgaaaccccttctccattaaaaatacaaaaattagctggatatggtggcacaaacctgtagtcccagctacttgggaggctgagacaggagaatcgcttgtacccagaaggcagaggttgcagtgagccaagatcacaccactggactccagcctgggcaacagagcaagactccgtctcaaaaaaaaaaaagagtactgacttgagatttgtatgtaaaatttgccttcctcaggccagaaaagaaatggggaaataaatactgaactccagtcaatgttaagcttctgaagggtttagatgtaaaatgtactgatatttgtaattttaaaagatatttaaaagtgagatggattgataaatatgtgataaagcaaataaaaaatgttaatagagccaggtgcagtggcccactcctgtaattccagcactttggaaggctaaggtggaaagaytgcttgagaccaggagttcaaraycagcctgggcaacatagtaagaccccatttctacaaagcctcatgtggtagctggtgtctgtagtcctagctactcagaaggctaaggtgggaggacctctgagcccaggaattcaaggctgcagtgagctatgatttcaccactgcacttcaggctgagtgacagagtgagaccccatctcaaaaacaaaacaaaacaaaaaatgttaatagtagcatctaggtggtaagaatatgttcactgtacaattattctcatttcaccctatgtttgcactttttaataataaaatgtaaaaaaaacaaaacaaacaaacaaaaaamcctgaatattattcagcatrgggaacatggaggatggggagaagggtgggggaggaagtagaaggttcttgaatttggaaggggaaacgcaaattaatatggacccacccaggcaccacatctcctcctcaccccttgccttacaggcgctccccagtcttcaccctcctcaaggagtgggtgtgcaatcctccagcacccatctccttctccatcacagtgccactaagaagccttcacccaggtctctccagagagcctcaggccgctgcctttacttagttctgtgttcaatgccagaatgctgcctcctacaggaagtccacctgtattgcccacacctcctttcctgtcaccaacttgtcaccaactttctgtccttgatctatccacagggctcatgtagatctagtatggctgcctttaactctcatgtttgttaatcagacagccaagcagcctgctgcatagagctgcagaacaccaagtgggtcaccagaacaccaaatatgccagagctcccagtctgaactggagcagggtacatgtgtccacagacatatgccaagatcaagaggtctcaacagatgcagtgtaagaggtaatagagaagagttaatcaaggaagacacctgaaggtggtgggtgtttgctgactagtggcaggatcagtgaaatgactggagctgaggcagattatggccctagctacaggcccagaagtttgaaaagaaagatgttgtaaccctaaccctggagccgaacttcctctcctaacaatgctggggaggaacccaggctgggggagaagttaaagccagaggaggggcaggaatgtctgaggtggcaacacttctcttcagccagacagcactggccagtttggagtctgtccatcctgcaggccacaagctctgggtaagctgggaatgggcagggaccttggtggaaggatggtcacaccccagagtggggtgaagctaagatgaggggagggagagtatgggtttgagtttccctgggccgtcgaggaatcctctgagtctctgctccccaaagaaattaaagacaattcatttctgtgcccacggcccttatggcctccacctgcacttctgctccccaccccccagaattcctcttaaacccagaagggtcccagtttccagaccctagtcagtatatctggctctggggtgaagagaacrgccccctcttcaccctcaaacaggaaccagtggttggaggggaggaagtgcctgaggggaagttatggggccccagatactcctccatgccccacttcagccctagcagcatctgcctgtgggaagcagctctccacaccagccaagggggcccccacactcccgcgctgctctgcggctcagggagcagcccacctgctgggtgtgctgatatcaccctccctwcttcccccyagtgcccacacccacccaggcccaggctccttcccctccatcatccccttaccagcacctagaaccatccagggctgaaaagtcccctccaaaccacstggtcagcccagggcagaggaaagggctgggctctggagttgggcagagctggccttaaaccccagctccacctttctgggatgggtgacctagtaaagtccaggcttgaatctcgggtctttacttgggcaacgggcaccatgataccctatgttctggggattagcagtgaggaatggaaagtgcccagctcagggttggcacataagggaggctccccagcctgggaacgattataacagagggcccctcacttcacagatgaggaacttgaggcaagtcaccagcccctgatcatttcgcctaaaagagcaaggactaragttcctgacctccaggccagtccctgatccctgacctaatgttatcgcggaatgatggtaagtaaagtgtctcttgcatctgcatagagagrgtcctgggagcttaggaagtgatggggaacagtgatgtatgcagctcatgactaggtgracaggcctctggggacagctggtacaggagggaaagggacctcacgggaggcccagaaacctggtaagaggtgaggtattaaggtctgggatggagaagctctgagggtatatttttctgcctctaaaactgttggagagggaatctgagaaagctgcaaccaaccaggaggctggggtacgctggagaaggaatgggcttcmtaaccttgagccctcttccctgaagatatatgtatctacgggggcctggggctgggcgggctcctgcttctggcagtggtccttctgtccgcctgcctgtgttggctgcatcgaagaggtgagcgctgcactccctccctccccctgcagcagtgccccctgtgcccccacccccacacgctttcccactgctttcccagaacactgcctggccctggagccactgggaagccaacaggggagtccacgcctgctggtggggggrgcccgggagggcccgggagaagcacaaagggtgggctgtgttgagcttcttcttttcttccagtaaagaggctggagaggagctgggtgagtctggggacagggaagggggagggcaagagagatcctgagtgggtgagtggggagaagcatggctgagcrctgagaggagggttggggacgggagacaaggagagagaaagtaggagcatgagagaggcagagaaaatcgaggcaaaagagaaagagaaaatgagacagaaaccaagagaaaaagtgagacagaggataggagagacagggagaaaatgagagtgagagagacacaaagagaagagcaatgaaagagagagagagagagaggctccagaaccaggcacagtggctcacgtctgtcattccagctatcgcaaggctgaggcaggaagatagcttgagctcaggggttgaagacaatcctggacaacatagtgggactctgtctccaaagaaaaaagagagagagagagagagagagagagagrgagagagagagagagagagggagagaagtaagaaaggctggaggtgggagcagaactcacagggaaggatctgacggcatcgcctcccatcagcaccttctgtcctggtcccaggcccagggctcctcagagcaggaactccactatgcatctctgcagaggctgccagtgcccagcagtgagggacctgacctcaggggcagagacaagagaggcaccaaggaggatccaagagctgactatgcctgcattgctgagaacaaacccacctgagcaccccagacaccttcctcaacccaggcgggtggacagggtccccctgtggtccagccagtaaaaaccatggtccccccacttctgtgtctcagtcctctcagtccatctcgagcctccgttcaaawtgatcatcatcaaaacttatgtggctttttgacctttgaatagggaattttttwaattttttaaaaattaaaawwaaaaaaacacatggctcacccttccacccactctggggtcaaatagtaatttrttgggtgaatgacagtgttcagggacccaagctcccctaacagccagaagagggtatgtgtgggcctggcaggaaagggcagttgccaaggaggagtcatatctgatccttcccatttctcaggacaatcaggctcagccycctgggactgggggaagcagatgtgctgagctcccacatggtggtgggaggggcgctgggaccacagccggyagctgmcttcttggacctttccaggtcagacctggtggaagggaaagtrcagagttgggggaatccggagagagtagatttggcatctggagaatggagaagaaaacacttgagactcatgaggagttagtggtggggcagatttattggggtcttttgaagaggactagggacatctgggctctggaatcactcctcggggcccatctgaggagtggcagtgtgttcccatgtgacagtggcctggtcagagagaggacaggagctgctcagtgttgcagtcccgaggctctcctcttcctgrtctctgtcctccctcctcccactctcttactgcccctcccatcccgtccactattgcccctggctccattactcacatttgccctggtaatagacggtgctgrccacggccacagagagaaagctgacagcatagaatccagcccgaagkaggaggactgtaccagcccctagctgaggatgttctgcatggggcaatggagacgggggttggggaagaagtgcacacaggctcagggagggaaggggcctcagaggagcatccytgcctcccaaggacattgcctcttggggcctccagccaggaggagacaccacctcccagcatctcacctttctccaccaccagccgagtcccattccctgtcccgacaccaaggcccagcacctccactctgcacacgtagatgctggygtcatggcctcgcacgtcccggatgtgcagctcagcctggtggtcatggaggaaacgggaagaagcaagtggggccaggcggcccctgaactctggggttccattcctcacctccttccctggaaccacctcatctcggaaccacgtgacrgagccaatggccagtctcccttggctggcattgaaggagcagggcaggaaggcagaggatccttccagggtacgaatctcagggggctgggacacccagagagcacaggatcctgggggcagaaggaagacccagagaaacacctccccagttattccaaagagaaaagacaacagagcttggagtagaacatcccagctttctccaggcatagggtgcatgggaatagatactttgggtgcctcattaaacccttccctcttaaccaatctgatttcttaacattgcttattaaatcatttttcggctgggtgcagtggctcacgcctgtaatcccagcactttgggaggccgaggtgggcggatcaccaggtcaggagatcgagaccatcctggccaacatggtgaaaccccgtctctactaaaaaaatacaaaaattagccgggcatggtggtgtgcacctgtaatcccagctactcgggaggctgaggcaggagaatcgcttgaacccgggaggcagaggttgcagtgagccaagattgcgccattgcactccagcctgggcgacaaagcaagactccatctcaaaaaataaaaaataaaaatcatttttcaaattcttcctataccaactctcactctcaccctctgccatcattctccagccagttcagtagtaacttgtctagctgaaatgtaaaccatcatggtgaaattaagctcattaatgaatgcagctgcctagttaactaatatcactcattatattatccaggtattattttagtacaaatggcattgtacagtaagccatccttcctctttttcttttttctttttttgagatggggtcttgctctgttgcccaggctggaatgcagtggtgcaatcttggctcactgcaaactcygtcccctgggttcaagcratcctggtgcctcagcctcccaagtagctgggactacaggcacccaccaccacgactggctaatttttgtattttcagtcgagacagggtttcaccatctggtctcaaactcctgacctcaagtgatccacccacctcggaccaggctggtctcaaactcctgatctcaagtgatccacctgcctcggcctcccaaagtgcacccagccactcttggttttcgttaaagaaagtaactaattaaatctccaggtgaagacgtggccttaattggttgagattcctatttaacccgtccatgttgatgaattaaaccaaatattaaaatccctgattaaattatctacttagggaaatttacaagtcattctatttcagtggttctcaaacttgagtgtgtatggaaattacctggagcatctgctagaacagattcctgggcctaccccccgagtttttgactcagtaggtctggagtggggcctaagaatttgttctaggttcccagaaatccacattttgagaactcctgcatttagttaataatatgcctgatagttaaggtctctcagttcattaaaaacagtttcggccgggtgcagtggctcacgcctataatcccaacactttggraggccaaggcgagtggatcacctgaggtcaggagtttgagaccagcctggccaacatggtgaaacctcgtctctactaaaaatacacaagttagccagcagtaatggcatgcacctgtaatcctagctacttgggaggctgagacaggagaatcatttttacccaggaggtggaggctgcagtgagctgagataccgccactgtactctagactggacaacagaatgaaactgtctcaaaaaaaaagtttcaccaccaggcgggcgcagtggctcatgcctataattccagtaatttgggagaccgaggcaggcagatcacttgagatcaggagtttgagaccaacctggccaacatagcaaaaccccatctctactaaaaatacaaaaatggctgggcgcagtggctcaggcctgtaatccccgcactttaggaggccgaggcaggcagatcacctgaggtcaggagttcaagaccagcccggccaacatggtaaaaccctgtctctactaaaaatacaaaaattagttgggtgtggtggtgcgcgcttgtaatcccagctacctaggaggctgaggcaggagaattgcttgaatctaggaggcagaggttgcagtgagccaagatcatgccactgcactccagcctaggtgacagagcaagactccgtctcaaaaaaaaaaaaaattagccaggtgtggtcgtgcgtgcgtgtagtcccagctactcaggaggctgaggcaggagaatcacctgaacatgggaggcagaggttgcagtgagccaaaatcgcaccacggcactccagccaggcracagagcgagactcagtctcaaaaaaaaaaaaaaaaaagtttcaccaagaaatttatcatagatttacttggatctctcaaactaaaaagcctcacagtgggtgacacagagagactgtgaattgggggagtccactgagtgtcacctttggagcagtcccactcctccctcagagccgtgtgtttcagcccccaccaagcccgttccctatagcatctagtccagcctcctggatctccctcctcccacccacactccttggggtcctgagcgcacgccctgtcacctggatggaccatgatcaagatgagcaacagcatccaggccatgtcggaagatgtcccagttggcgaaggggatctgagcagtgaggtctgggtggaggaggaaggactyactacttgtagccaggcctttggtcaccagatggggatggggagcttcctatgacacacgggactcacacatcacttgccaaggaccacaactgccagggacctygagcatcaaatgcttgcctccctgaggagagrggacagatgctgctggaggagatgtcagggtctctaggaggccaaggggccagcttgtggcaggctagctaagcgtgtgagggggagggtggggcttagakggctgctaacccaagggtgagtgggcggttgggcgggtgagaccaggatgtgggttcccccaccttccgaggttcaaggagaccagcttttacccagaacaagcctscaggagccctccttggcccagaagctaacctacttacyctccctgctgctcaccagtacccagacccatcccacccattcccttcctggaatctggcctcactgcaccccagggctactccaagatttctatgagggattaggagaagcaagctgattggtgaagctatatttaatttgcatagcaatcaccttgtgtgtgtgtgtgtgtgtgtgtgtrtgtgtgtgtgtgtgtgtgtgtgttgtttggttgggtttttttgttttttgttttttttttgagctggagtctcactctgtygcccaggctggaatgcagtggcacaatctcggctcactgcaacctctgcctcctgggttcaagcaattctcttgcctcagcctcccaagtagctgggattacaggcgcacatcaccaagcccagctaaattttgtattttttgtagagacagggttttaccatgttggccaggctggtctccaactcctgatctcaagtgatccaccagcctcgccctcccaaagtgctgggattcctgttttggttttttgagacagggtctggctctgtctcacccaggctggagttcagtggcgccatcayggctcactgcagcctcaacctccagggctcagytgatcctcccacttcagtctcctgagtagctgggactgcaggcgcrcaccaccacaccaggctaatttttgtattttttgtagagatgggrtctccctgtgttgcccaggccggtatccaactcctgggctcaaacaatccatccacttaggcctcccaaagtgcatgagtcaccatgcctggcgaaatgtatttcttraataatgagacttgaaagtctaaattactccttaaaccatggactacaggatggatgttatgttagcaggcaggaaaacaacattcagctgggcgtggtggctcatgcctgtaatcccagcactttgggaggctgaggtgggaggatcacctgaggtcaggagtccgagaccagtctgatcaacatagagaaaccccgtctctactaaaaatacaaaattagccgggtgtggtggggcgcacctgtaatcccagctactcgggaggctgaggcaggagaatcacttgaacccaggaggcggaagttgcagtgagctgatatcgcaccattgcactccagcctgggcaacaagagcgaaactccgtctcaaaaaaaaaaaaaaaagaaaaagaaaacaacattcrtctctttggacatctccatcagagctcttggataactatgtacattgtcaatgagcagtaatcattttaaagaaatcttgtttttcggagcagtagacctcaacagtaggcttaaaatattcagtaaaccagcggggcatagtggcttacacttgtaatcccagcactttgggaggccaaggtgagaggacggcttgaggccaggggtttgagaccagcctgggcaacatggcaagaccctgtctctacaaaaaaatttaaacttagctggacatagtggcacacacctatagtaccagctactcaggaagttgaggaaggaggattccttgagcccaggagtttcaaggatgcagtgagctatgattttgccactgcatttcagcctgagcaatggagggagaccttgtctctaaataaaatacaatttaaattgggaatagtagtaaatggagtttaaaaaawaataattttggctaggtatggtgggtcacacctgtaatcccagtactttgggaagcccaggagggcagatcacttgagttaaagagttggaggccaggccaggcatggtggctcatgcctgtaatcccagcactttgggaggctgaggyggscggatcacgagttcaggagatcgagaccatcctggctaacacggtgaaaccccatctctactaaaaatacaaaaaattagctgggtgtggtggcatctgcctgtagtcccagctactcaggaggctgaggcaggagaatcacttgaaccttggaggcagaggttgcagttagccgagattgcgccactgcactccagcctgggtgacagagcaagactttgtctcaaaaaaaaaaaaaaaaaaaaaagagttggagatcagcctg

SEQ ID NO: 13511 - DNA, 12872 bp, Homo sapiens
cctcctgaaacaattccaaaagataaaagaggacagactaactcattctatgaggtcgtcatcattctgatatggaacaacaaaaaaagaaaacttcaagccaatatccttgatgaacacagatgcaaaaattctcaataaaataccagcaattgaatccaagagtacatcaaaaagctaatccaccacaatcaagtaggttttattcctgggatataaggttggttcaatgtatacaaatcaataaatgagattaatgacataaattgtattagtcagggttctctagagggacagaactaataggatatatatatattttatatatattatatataatatatattatataatatataatatatattatatattatattatataatatatattatatattatattatatataatatatattatatattatattatatataatatatattatatattatattatatataatatatattatatattatattatatataatatatattatatatattatatataatataatatattatatgtatataaagggggatgcttattaagtagtattaactcagcggatcacaaggttccacaacaggccctctgcaagctgaggagcaagaaagccagtccaactcccaacgctgaagaacttggagtccgatgttcaagagcaggaagcatttggcacaggagaaagatgtaggctgggaagctaattcagtctagtcttttcacatttttctccctgctttacaatctggccacactggaacttgattagatggtgtgtacccagattaagggtgggtctgccttcccagcccactgactcaaatgttaatctccttttgccacaccctcacagacataaccgagattaatactttgcatctttcaatccaatcaagttgacagtattaaccatcacaagtccaastccttgtcaacttgaacccatacacacatcctgaaatcatacataatcttcaaataaagacaataataaggtcataattatgcctaatrtaatacaactatcctcatacaaccagaaacgcaccaatccccaaaccaaaagttattacataaggttaacaatatttaaatgctgatatgaacaacacttaaatgcttaaatgctgatgtgaagtccataaatctaaggtcacatgataaaggaaaaataaaggaaataaaataaagatattttcttagcacaagtgtacacatgcatttagaaagtggatatagtgctgcagctgtccactttcgggtggtgcctgcatatcgtgcagaaccatctatgaaccagtccttagtcttcccttcctctgtcaactgatcatagggaactccccatgaggccattggtgcaggctgggggagggaaggcagggtggcatgagtggagaacatgggcatttgagccacttccttatgtaacttacttgtgccttcaggacctgctcaagcccgatcacatacacaccacttcaatttgatgatgaaatgccgctgtgctgacccacttcatggctagatgggtcagaaagcaaccagttcatgataggcaggttcaggtagcatggtgactttatgacccacagtcaaacgttcagttaccaccaaagcccrataacagaccaatagctgtctctcaaaaggagagtagttatctgcagaagtggcagggccttgctccaaaatcctagaggtctccactgtgattcacctatgggggcctgccaaaggctccaaacagcatccctatctgccactgacacctcaagcaccattggatctgcggggtcatgtggcccaaatggcagagcagctttcacagcagcctggacctgtttcagagccttcttttgttctagactgcacttaaatctggcagcctytcaggtcactygataaatgggccagagtaacacacccaaacgaggaatgtgttgcctccaaaatccaaataggcccaccaggcattgtgcctctttcttggttgtaagaggggccaaacgcagcaagttatgcttcaccttagaaggaatatctccataggtctcatgccactggaaccctagaaattttaccgaggtagaaagtccctaaattttagctggatttatttcccatcctctggcatacaaatgtctcaccaataagttcagtgtgtttgctacttcttgctcactgtatccaatcatcataatgtcatgaatgtaatggaccagtgttatatctcgtggaagtgaaaagcgagcaaggtctctccaaataagattatgacacaaagctggagagttgatacacccctgaggtagggtggtaaaggtataatgctggccttgtcagctgaaggcaaattgcttctggtgggtcttatggacaggaatggagaaaaagccacttgccaagccaatggctgcataccaggcaccaggagatgtgttaatttgctcaagcaacaaaaccacaactggtagagcagctgcaattggagtcaccacttggttaagcttaaaataatccaccatcattttccaagatccatctgtcctctgcacaggtcaaatgggagagttgaacagggatgtggtgggaatcaccacccctgcgtctttcaagtccttgatggtgacactaatcacttcagtccctccagggatgggatattgtttttgatttttttatttttctaggtagagacagctctaatggcttctktttggcctttcccaccataatagccctcatcctaccagtcagggagccaatgtggcatttctgccagctaataagtatgtctatacaaattatgcattttggcactgggaaaatgaccagaggataagtccagggacccactggaaccactgtaagtcagaaatgagctaaaactccattaattacctaacctccataagcccctactttaactggggaaccacaataacgttttgggtaccctggaatcaacgtcagctcagagccagtgtccagtactttctgaaatgtctcattacttccctttctccagtacacacagttaccctggtaaaaggccagaggtctccttagggaaggatgggagaaagagtaacagcataagttgtcagtagcctagtggtgtccttcctcaaggggatccagcctccccttcattcagtgggttctggaactgtaacaggttcgagtctggaaattgattgagggcccatgattctctgtttttataattcagattagtctttagtccattctacctggcagttttttgtttatataaatcaagtaggaatacagtaggtttcccatcaatttcacttctaggaacaccatgattaattagccaatgccagagctctacatgagtcagactattctgatggctgctttgcctctkctgtctattatggtagttatgcccaccttgcctttgatggttcagtgccaacacttggcccctgccacctcaggatccaattattcccattgtatttaaattttgtagttgagtgactgtggttcctactgttagatctgacatacagagaagagcaattacgggctcttcaaaaatacaggtgctgctctcacaaatctatttcacaaagcktcggccaagggtgtatcttctggaccctcccagctgggatgagtaggtctaaagtgactaatccactccaccatcctaatctccctaagcctttggatcacttcctctacattaaaccaaggcatttccagctcactaacattggaccatcttttaatccatatttcagctaaccaagcaaataaactattataactttttttttttttttttttggaaatggagtcttgctctgttaccaggctggaatgcagtggggcgatcttggctcactgcaatctctgcctcacaggttcaagcagttctcttgcctcagcctcccaagtagatgagattacagttacgcatcaccatgcccagctaatttttgtatttttagcagagatggggtttcaccattttagccagaattgtctcaatctcctgatctcgtgatctgcccgcccccgcctcccaaggtgctgggattacaggcgtgagccactgctcccggccctatcagaaccttttctaagtccccgagctgcaacattaaatgcagaatccctacttagtagggccaaaccaataaattcagcttgatccaactctatgtcccttccaccattatcccttacccttaatatccattcccatgcctgttctccagatttctgccaatataaattagaaagcttaagcagttcttttagagtataatgcacctcctcatgggtcacactctgaacctcacctctggggcccgcaaggaatttagcctagttataggtctagaagcattcaggggcattaggggtgcctcttgaggagaatcaacattatcttgcctggcagctgcctcagggaaggccatcactgttgcctcaagcagtgcagggtttacatcctcagacaaaggtggaaaggctaatggcagcacgggtcagggaggggatgttaccactactggggatgggraaactgtttcttctggcaaaaaagtttcatcagagttcacaaactcagtgtcctcagcttcatcagggttctcccacacatccccactccaagttccagggtcccatttttttccagtcaatgccctcactttaacagtaaacacctggcaaggctgtgcatgcacctcttgttgcagatcagctactcgcatgataacagcttgtctctgttttttcacaatttcaactctttctctacaggagttaaaactctcattcagggcaatcttagcagatttgtggctcagtatctgcttctgaaggtgggagacagatcccctgagatcatcattttctttcatctctttctccagagaacttaggagcaatcaaccaacttcattatgttccttggttctccacatatagtcaaaggtattatgtatagagtcactaaactccttgcctctcataagtgatgaatcagtagtgtcaaatgcatttattttgcataactctctaaacaattcaggccaagtactatcagtgttctccatactattagaagtagagtccttagcattttttggtctaatcatattaatcagccaacaccagaagtcccaaaaccaatgaaagaattccatccttaatattctgttcctcaagaaccacttytggtatgaaaatctgtattagtcggggttctctagagggacagaactaatggagattatatatatatatatatgagagagagagagagagagtatatgtatatatgtgtatatatagtgagtatacctatatctatctatagatatagatatactcacacaaaggggagcttattaagtggtattaactcacaagattacaaggtcccataataggccacctgcaatctgaggagcaaggaagacagtccaagtcccacagctgaagaacttggagtccgatgttcaagagcaggaaggatccagcacaggagaaagatgtaggctgggaggctaagccagtctagcctttttacatttttctgccagctttatattctggctctacagcttgggggcagcaggggcaggggcctcagggtgcttgcagggatgacacactggcctcttttccatagggtggctggggcacactggggtgtgagtaaagcactcaggatcttttttccttccctagtccaagtacagcaagggcagtatgactgcagtgttagtggcagaaggactttcagtcacctctgggagcttcaccccacaaaaacacagagtgcagccagtggaaatgttcaactgagttcgaggtgcctgcactgtgggcccaagccaggagccttgcctggtgaagagtagcaggtgaaagctcacaagaaagagaaactggaattctttccctgctgtgtgctggaggtgtcagggaagtggccaggtcccttctttctcaagcccaagggcattaacggtggtactgctgcagctgaaatggcagaggggctgtgggttgtctcttggatttcctccccagagaagcacagagccaacactgactaaaatgttcaggcagggccagggtggctgtgctctgcccagtgaggaatagtaggggcagggaccagtgcagaaaacagtgtggccacttttccataaggcagctacactgtgctggaggtccgtgagagtcctgaagctcctcgctccctcctgagcccatactttaatctcaagagtttgagataaacagtggtaaggaagaaagtacaacgggtacggctaatgaaacccaggaagataagtcaatgcgtagaagtaattccaacctaaagaaatactttttaaaaatcatatttatagaggtttgcagtgatactaaagacaatattgcaaatcattattaagaatacaagaagtacaatgtttcttgtttctttaacacctgtgatacaggtgtttgatatgaattctacrtaatggctgcattgcttcttgccaccacccaaagaaggttgtatagcactcagatgtatactaactgcaaccgtgtatctcttaggaatttctcctttgccctcttccctccctatcagcatgtatctagcagcattctgaaaagttaactgcacagtgagcgactgctgggcatcttarggggcattcttttctacctaggtattccccctcctccactcatgtctagcatgcaggacttgggtaatctctggggtttcagattctccagacctccattctctcaggggcttccacctcctgctcatatctagctatctgcctagtctaaccataaaatcttaaataagaataaatcatgtttgctcttgattgccatgtcatgataaaaaaaataagacaccatcagtggcaactgtgttgccaagattgatgttgatctgctaatccctgtgtagaaatgaaccttggaggccattgtttgatttcttacaatatgtgcattggttgtaacactgtcactttgacagttgataagcatcttctgaatggtccctcctttagttacaaaaatgttggtgcatggatgatgttgggaataaataaaaagtgaactaaattatgttctcatcttgggcaaaaattaagcaaaaaaaaaatggaggatatgaagctcctccacaaagaaggycatttttgtactaggcttactacagtgacacaccactattagttggggagaattcagtttttccaaggtgttgataggcatccagatttcagaggaaattgtaaaaaagcagaacctgggaccaatactgcccacgatttttctttgagatcaaatctgaggcaacaaatctgttcaaaagctgctttctgcctggttgtggcaaagggtggccaagtggggctcagctgtgttcccattgcaaggctactgagcatcccctgtcctgaggctccttaggacacctggctgagcttcagcagccctcttccaagcctggagatgccagctccatctctggcacaaaatgtagtgattttcacagggtgagaggccaaaagaggctaataaaatgaagatagccaagcttccatggaattaagcaacaggacaaccttgaccactttgaggggtgtggtgggggccacatgcagatggagtgggttaaagagtgactagaagagcagtgggggtggcagcaggagagaagcctggctctgaaagcagcgagacttctagggaatacagggtcaggggaggttctgaaagatgacacactgcagagaacatgtgtttgtaygccgatgacaagtatccagtagaaaggcagatgaacagattctcattctcagaaaggcctgtcctgacctcctgagagtacacagaccatgagggcagggcaaggaggaggatgcacgctcactgtttcatgcaaagtccttggccacagtccacctgctccccacctctgtgactttgtccttcctcaatttaatatgctctatgctggaaaactggattattgaacaggcaytggctgatgcattctgaacctaatccactaaaaagcacttgatagatatatcaaaatatcattgagaaatagatattttaggcccatatccatgtcttcacccygcactgtttctcatttgaactctcttttccaggaagagttgtgcttgrgtaaattctatagctcacagtgtgacttcaaaacacacaataaattaataaggtgcttcctacagtgagttcagttaaacattttgaagagtgtttttgaaatgtagcagagcaggctacaattgatattcaaaaagaggaaacttccatttatttccccctttaactaagttacctgtaactgtgtcattttattatgcttcatagagcatcactgctgagatcccctccccagctcatgttgctaggaaatatcccaaaacagaatcaatttttctttttttaacctgatgatttttccacaatccttttgtttctctgattcacctccagggctcatatggcaatggggatttaatagggtttatttgttggtgaagaaacattaaacaaatcttttaataggaaaaatacttttatattayaggcaaaatgtagatgtatattgctactgaagtaaatgtattttattaatggtgtgagaatttcttcctcactgtggtgtgtgaatgtgtatgcatatttgcatgtgtaaaagacttagcaatttgtgaatagaagatgtttctccgcttctcactgagcatggctgtaaaagaaactttttcctctccccgggcattccagcacacaytggaaagataacacgtccacagaaagcctggctttccaaaagagcttatsagagaatgtgccccccaggtcgattaaaacatatgttaatcctgtggcagagaagtttgttctagcctttgggtgtagcctgctgaataagttcacagtgayctacatcctagtttccatgggctgaaatagaatattcatatcccctgcactccctacacacacagacatagacaccaatttccccaaaaaactctttgcttaatcttctcctgctctgtattttctttgatattttcttgaatggcttccactaaattcaaatgtgtttgactttaaagtcaacttgtaaaattttatctggtaatttatagattaaattgcaagcatctacctccctttcatcagactctccctgcagggcaagttcatctaactatgtatgtgcttcaagatggaactcctgagttcacaggtgatttataaaccaaagcatgcccactacaaaactctcaccctccagagatttgcctcaagggacaacaccctgctcacaaaggcaccagcaggcaactgctcaactacctggtggataaggtgcccaagctagcatggacccctgaatccttgctcgcctcctctgttgccttttaaaagtgccactttctgctcctaaagtgaagtrgtacggcaggactgctgcatttcttcccctaagctagctttggaagcaaatcactttctttataccagacttctctcttcttaattggattctgcaagtggcaaacaattaacctgctcttcagttacattggaatgtgtttagatttattttttcaaatgttggaacaaagatgaaaaagtgagaagagccctagattttttcttggaaatctggcttaaatccaggtttctttatttccttgatttgggaatttggtcacgagacaaataacatgattttcctaagtctagatttctttgtttataaaatggggatgactatgctaccctacctataccatgagctaaataagctagtatttgtaaaggacacacacttacattcacaatcacacacggtgtgtatgtgtgtatgtatgtataaaaatgtggggacctaacccactcaacaaataccctgagtatttgttgaatcattatatgygtatatcatctggcaaatggatgtgtataatttctccagggataagaagcaaatgtataccgatggaaagccttactcaggccataacaaagagagaaatgctgagtcccactccatgaacaggtcaaggaaccaaacatattcaaagagttatttcattgtttcaacttgctagtgaggggagcatggcacctgaacagagatgatataaattaatgaaactgagaaccaagcgaagagcttagccatcctttgcatagttagctacaatggctatttatttttcagccagactggccatcatgtaggcacactcttttagattagaaaaatcaaccattattttttctgcccattcattccagcaccgtgacagtcttcacggggaaattaaacttatttttttaagaatttttcaatcatatacaagattttgaactgggaatttcatgaatcaaaaattaaatgaattgcacawaaagccatggcatatgtatttttactacattgtgggagaaaaaataattcttataatttaaaaaaactatgtcttacctgatttcaraaataaaagaagtagaagaaccacttccttatgttccattttgggactggccagcagtgyccagaaagtgkgtcccaatcccaggacrttgttgacttacatgagagtaaacgcacccacaaaccagatagtcaaattaagttaatgattmtytcagagacccatgccactggctcagcagggttcaaacattaccttgaatatagagtcttataaaatatttgagagtgcaatgtcaatagatgctgggaagtggtgaaagccatttcccccctcagctgctccacattgcctttatgtctccttactccttccctcacccctagaccttcatctttcctgattagtcttgtttcctcccctcttctttcattctctttcttttggataaaataaaatcataaaagtagctcatatttgctggtaacttccatgaccagaccctctgccaagtgctgcacatccatagcctccctcaagctttccaacaggcagtgctgtacgaggagggggytgaggccttcccgaggttgtgtcgctacccaggggtgcagctgatagacacaaccctttcaggtcttagtttacgagcaagctaggtataaatgttaacatctccacatcctataccaaactgtgccgaaatgacaacataagtgaaaatcttttattatcttcaaaatttatttattcctagtgaactcacatgttttctgtaattataaattatgttataagatatcaatccttccaggagggggtggtggctcatgcctataatcccagcattttgggaggccacggcagatggatcacctgaggccaggagtttgagacaagcctgggcaacatgccaaaaccctgtctctacaaaaaatacaaaaattagctgggtgtggaggcacatgccagtcatcccagctactaagtaggctgaggcactagaattgctygaacacaggagatggaggttgcagtgagccaagaatgtgccactgcactccagcctgggtgacagagcaagaatgtctcaggaaagaaaaaawaataataaataccaaataaaattaataaaatatcaatccttcctattctagtagttgtggcttaaataaataaataaatatttttaaaaataaaacatagggtygagtgcggtggctcaactctgtaatcccagcactttgggaggccaagacaggtggatcacaaggtcaggagtttgagaccagccaggccaatgtggtgaaaccccatctctactaaaaatacaaaaattagccaggcgtggtggtgggcacctgtaatcccagctactagggaggctggagtattcacttgaacccaggaggtggaagttgcagtgagccaaaatcacgtcagtgcacttcaaccggggtgagagtctcaataaaataaaataaaataaaataaaataaaataaaataaaataaaagcatagtatcaatctttccgcaaatgaattcatggtgcaatcttacattttcgttctcatgaagtaaagcaagagtggtagaattaagtggaaagagtctatctctagtgtagtcacgtcagtggttgtgtcaagatggttaggaggctcctcccgtttaaaacagtatccaagccccagttgtaaatcaattggggagacacgccaactctgatcatcagcaatatctgagctccagtctcagatattgtgtgcagttagtctctgtcctgtaccctctacctccttccctaccagaaaaatcaccactttagtccctggccaccgggacaccccaggagggtgagtggtctgaggtagttatggcacttatggctcccttgctgctgatctggaactcaagccccaagaagtccccttggatgatctgaatatacatttgggacagatctagggagtttctgagcaacacttagactggggtcttccattgattaaatcctacttgaattcgctactttgggactcaagtctaagggactgagactgagacaggagagcacaagactaactttggtctcttgatcttttcttaccttgcaactgtcaatgcctccagccaaatgcccagcacagagctcagtggatttgactcttccattcagaaactcatagcgattgcacacttcattctcaatcacagggagctgggcttcctttagaaagccaggccccaaaggtacctgtgtttaaaagattaaaagaaatggtaactacgtccacaacatgttcacaaggaaactccaaaagaacag

SEQ ID NO: 13512 - DNA, 40000 bp, Homo sapiens
  misc_feature (1)...(40000): n = A,T,C or G, or insertion/deletion polymorphism (see Tables 1-2)
gggtttgctcagtatcactggagggcactggcccctcccagccgtccaccctcttctgcaggctccagctttcacctggggaggggcgcccataggaccagcactggcagggaaagcgcctccytcccctctgtcctgtcctgcttatggcccagcggagaacgccaaggggtccccatgttctcaacatgggtcattcctgggagtcgggtgggggcttcacacatgtgccaaagaccctactggcccacatcacyagtgsgtggggggcattctgatgctgcagctgggtcagagtcagcccagagcacccacagtggcaatgaagaccagtggccactgcatgcatcccaggggccagccctggaggactccacactgcgtagacgcaaacgcggtaactgcaggccggagccrcagacgtcttctgagmgtcatttggttcatttggctctgggtggaattacatgccagtcatttcagaggaattatcaaagaaaccattttctctcccggatgaaacccaacctccacttactcctggggaggatccaatggcagttgcaggtggactcagctttgttcwttcactgggaaaggactgtgacgttccacgccttgtctaaactctccagaaaagtggggtgccatgagtgccaatgtccacaccctcaaatcacacagttagtaacgcccttgctaacatctgtaactataacttggcgttgccattggggatgagagtctcttgtcccttttgggtggatgtaatgacaccatatggctggtcaacctggcaggggctccatatcctcttttttttttgagatagagtttcgctcttgtcgcccaggctggaatgcaatggcacgacgttggctcactgcaacctcggcctcctgggttcaagcgattctcctgcctcagcctctggagtagctgggattacaggtgcccgccaccatgcccggctgatttttattttgtgtatttttagtagagatggggtttcaccatgttggccaggctggtcttgaactcctgacctcacgtgatccacccatcttggcctcccagagtgctgggattacaggcgtgagccacctggcccggcctgaccattttgattaatatgtctaaagcgccagctgagggtgtaccaggggcccctctgccccagccacccacaagatcagagtctgaaaagggaggtgaagcccactttccccacttctggtgtctacaccctcagctcaggacagatgtccagtaacacagctgtggccctgccctrcaactgctgtaataaatgactatttttcatggccctgctctcagatcgctgtgggatccctaaatgtttgtgtgtaactaatctcgttgggcttcargatcacagtaaagacagcttagaaacatggaagctctccattcgggcagcacctccttcttttagcaggatggggcygacctcgccagctggagcagcagaagtggccacaaacgccaccagggatggcagacggtgatccaggaaggggctgtgctcacaaggaccccagacctgctctagtcctctaggtttggaggccacgcctctcccaacggaactgcccaggggcacggggcaaggctgagcagccaggaagtgtcacaagtgttgygaggtgacagtgagggttagctggtccagctcaccttcrgcctctggcctcaagtgacacagccgggtgcccttggtyggcagtcagagggtctcccccgggcactgggctctgcccttcctcggccccttcatgccagccccttttggtcagcgggtgcggcagacctcctccaaattcactccttttagggaaatgagcagaaaagagggccgtgacttggtaattaaaaacagccctgtggtgctgggcaggaaccaggctcttcccgccctgcagctgctgtggaggccagacccaccctcaggtcctccaacctcctcggcccccggaagccagcaacggggccttctgggaagcaggaaagacctcagcagagggggcaccataggagcacactggacatccgtccccagttgagggtgtagacaccggaagtgaagacatggggcaccacctccctttccagactctgaccttgagagtttgtgggtggctgggacagagaggccccaggtccaccctcagtggtgacttgcagccctggtgcagggcgggaccgtgacatccagggtgaggacagaggacttggccagcatgactcaggccagggtgaaaaacgcctggaatgacaactactcagaaaagatattttgttggggagggtgcggaggagggtggggcagagaaggtaacagggtgcacaacagagatcagggaacagaagcgcagcctcagccggggccacaccgcctgccagcgggcacctgggggtgctccaggccctgccgccccagggaatgctccctccccggctgcctgagattctagtgcacgtgagctgctggccactgggtgcccgtctccatggagaccagctctcccatctcacttcctgcccattcgttttggctcctcttgggaaacagcatctatcagagcacctcagccacgcagagcaaagccgccctctctgcccagccttcctgccgccctccccaaccccagggccctgccccctccctctgcagctctgggaggacctcggggcccacgtcccgctgccctccctttccctggtgggccagcaggtctcatgccagagcctccggctcggcccttcccattcacgtgctgctgaatcacttgaaaacaatgcaccagaccccgggaggatttgctgagaacagtgcggctttgtggagggaagtgcagctctgcattttctccgtcaagacccacggaacagccaagctcagccctgcaaaccctaagccagagccggagcagggacaggagcaggaccgtgcagggcaggaggcagagggagcctggagaggcaccgaggaaacccctacccatccctgcaacccgcccccctacaacagatgagcagggggccagggtgacaactccggagccaggggcagcagcagattctctcctcgcactgttgctggggggctgcracagcgcgaggtgggcagggcactgttcctcccaagccgatccatttttggggacgaacgtgaggtccgggcccaggcttcaggctcattggcactgactgtctttgagccctggctgttcgtcggacccagggtcatgtggcctgtgggctgagcctgacttgctgcatttctcaggagacagaaacagggacatgaaggacatgaaggctggaatcccagggtccacacacccaggaaagaatgaaagcaggggggctgaggtccccactcccctttcccttcctcctcagcacagcttcccaaacaagccccatgctgagcggcgcccccagactccctaagcttgtcctrgggggtgtgcatctgtgtagccccgtctccagctggaggacttggcctgggctgtcacagcagctgcaagtgcaggctgcaccccagccctccgccccgtgtcttcttggagatctcgatataacccccttgccatttgcacgaactggaagaatgaccacaggtcagggagggtgctctacccacccgtccactctaaaaaccctatttccttttgtcttatgtgtcggagatcctggtcacacagggcttgaaggggaagggagatttgtgcggagagaagatggacgccccagggcagctctcagggtggggtcacatccaaagcccaactggccagcaggttgggggggagcaggccaggaggtgaacaggtagcacctgccagaccctgctggcccccctcagcccatggacagctgacctcggcagaaagcacaagcaacgctgctgctccccgtccaagcctcacggaccaacagggcgacccacgcaccactgctcagccacggaggccttcctgggtccctgtggtttggggagaaggacccacaaggcagggagcaaagatggggccggaggacgaaggttccagcaaatgcagagtgaggcgcgaacacggaatctgtcccccaagggtgggggcagaagcaccaaaccagagcagagctctagaaggtgcaaagtgttcggagcaggagarccgtgcggggtacctggaagtgccttaggatgaaggtgaacacggccaccacatctgggatcctcaccgctgctggcatggcagtgctctctggaaacctcaggagccccacacccttccgggtggctccatcccttgttttacagtcaaatgaaggctgggcaagggctggggtgtgagtccagggggcacccctgagcccgccaacatagccctatgaggtgcctggcacttcggggaggatttaggctcgcaaggcagggggcaggccctgygcacttgtgtccggaagagaggtggtgggaagagagatgctggaagctgggtgtgaggggtgtgaggggtgtgaggggcaggaggtggagggccaggccttggaggaagtgcagaaaccttaacactctgcccaggtcacctagctgctggcaaatggcagagccagggctccaaccccggcagtagggctctcaccagctcctggtggaggctctgggtggaggcatgggacggggtgagccaggggaagctggaggctgctccacagccctttctaccgcagtccagctgtgccaaggtgaccaaggggggaggggaacacaggcactgccaggccctgggatggaaagttactcatgacatctccgtaagaatcactggagggccatggttttgggtgtggacatcctggagggctgttttagtgcccacaccaatgccctagttaaagaaccaccctgtccccttagccttctgcaggacaggtgggaaagggccgggtgtctggtcctgctgccaggggacagtgcaggtgtgaccgtccgggcagagatgagtcaccctccacactgtcttgctgcccgtctccacgcctagttttagctcgtgtggtcaagaaggggcgattcctcacctagaacacatgggtcacaaatgctacctttgaaaatggaaacaaaaataacccactcaaaggcaggctggttcccccatcagactgtggcttccaggctaaggcaggaagacctcggctactcaatgtttgggccccattgtggccatggcttttaactcagtcatgccataacaccctctctgccctctcagacagaggtgatgctacactgacaggcggctacgctccaggtctccgtgtgcaaaaaatagctgggcacaaggcaagtgcagaaacagcaggagcacggtgacaccccaccccgagaaatctatgtggcttttgaaaaacagcagccctcctgacccccagtttccttcttaatcatgttgagcctatagcaaattgtggagtggctttgcaaccctagcccatgacattctggaagcagaggatagaaagaaaccaggctaagatcaaaattttcttcttctttttttttccccctaagacagggtctctgtcactgaagctggagtgcagcggcgcaatcacagctcactgcagcctcgacctcccaggttcaagasatcatcccacctcagcctccctagtagctggaactataggtgcacgccagtatgcctggctactttttgtttttatagagacacaatctcactatgttgcccaggctggtctcatattcctgggctcaagccatccacctgctttggcctcccagagtgctgggattacaggtgtgagccaccatgcccagcctcgaatttcctctacttggcctgaagcagaaagccacagacaacagagacctaagctactaatgattaaagaacccaaaagcaaaaacaaaagagtcttgtgggatgctactcccgccccgtccaaatgagcgtaacgcttgttggttccacgagcttcgcattcgccagggaagtccggcttgagtttctcagaggcgtgcacttggggtcccactgagcaccttgtcctgcacagccatagttccagcttttactcactcatcatctgcgtcctccaccagaacgggagtcctgtggttccatgtgtgtggctcactgctcatctytagtgactgggacagtgtctaggactcatatctgtaaatttatttatttattttgagatggagtctccctctgtccccaggctggagtgcagtggcatgatctcagctcactgcaacctccgcctcctgggttcaagcgattctcctgcctcagcctcccgaatagctgggactacaagtgcgcgccgccacgcccggstaatttccgtatttttagtagagacggggtttcaccctgttggccaggctggcctcgaactcatgacctcaagtgatccacctgcctcggcctctcacagtgstgggattacaggtatgagcaaacgcgcccagcctcatatttgtaaattaaatattttataagagcaggtcaatctttttytggggaaaaaaaaaaaaataggaaaaaaaaaaaaagagcaataaacgggatctttcccacacctacatcccagctgtgccaaaagcactttttgacacccggtcctttgattcaaatgcatcagagatatagtcctctttttggaaacaagcacgaaactggagaagctatgatcctggaaagaagctcatacacgcgatgaggatatgctgcagtgaaaatgagtaagaggcgtttgtgtgatgtggatgaattcagtaaccgtgccgaggccaaaaaacctagctttcaaaagactccacataatatcctttttataaagttcaaaaccaagtaaaactaaacactatgtttagcatacatatatggataaagatagggagggctaaaccccaagttcagcaggtatatawctttttgtttctttttttttttttttccttttttgagatggagtctcgctctgacacccaggctggagtgcagtggcgcaatcttggctcactgcaacctccacctcccggattcaagcaattctcctgcctcagcctcctgagtagctgggattacagatgccaccaccacgcccggctaattttttgtatttttagtagagacagcgtttcacagtgttgaccaggctgttctcaaactcctgacctcaagcratccgcccgccttggcctcccaacgtgctgggattacaggtgtgagccaccgcgtccagtatctttttgtttctgagacagggtctcgctctgtcacccaggctggcagtggcgtgatcacagctccctgtgcggcctcagtctctggggctcaaatgaacctcttgcctcagcctcacgagtagctgggactgtaggtgcaggccgctatgctcagctaattttttattttttgtaggatagggtctccccatgttgcccacgctggtctcgaattcctgggctcaagtgatcctcctgcgctggcttcccaaaatgttgggattgtaggtgtgagccatcagcaggtatatgtccaaggaggcagcagggggatggaaaagggaggtagcgcacaggtagtgaatattctgggtcttgggtctgggtgatgggctcatggtacttcattatattgtctacaaaatatacataagtaaggccattcgtggaccaatgatactaatgtgtcatgaacaaagattggttgatctaagtcaatgtatctgaggttgttggaagggagggagagagacagactctgaaaccatcctagtacagggatcagcaaactatggcacaaagggcagatgccgcycaccacctatttttgtagagtctcattggaacctggccacgccctttcatttacatctcatctgtggctgcttctgagcagctgcagtagagctgggtaattaccacgggggctgcacagctggcaaaggctaaaatatttactctctggctctttgcagaaaaagtatgttgatccctgtgcctgtccctaagactgcaattggcagaagagaagctacccagtgtgaggtctccatggctctggtggatgccaggtcagtggcaaagctagcggggaggaaactgatcaaacacccaggtgccgacacccttgccagccccagagggaatcacccagcggggcgagggtggcttgtcttctcttttccgtctactctcttttctcttaaagttataagaatgtattaagcgacgtgctatttaaacaatgttggttttgttgtgactttgaaagactaagaggttttagctttggttcaatctccgttaatgtctcagccttggctaagcactaagtgatctatctcctgaaattgtgcccgtctgaccttgggtgcccctgaaaggccagtgtttatttggctaaaacatctgaagggcttaaatgacctggagtctccatctgtgcctgtggcccctgaaaacagactgtcacccaggctggaatgtagtgacatgatcggctctgggagatgcatccacagcacatgggctagacacacccactgaaacccacacgggttcctatttttgtatataggtggtttcccaaaagggacttcgttttaaaggcaagactaggccaggcgcggtggctcaagtctgtaatcccagcactttgggaggccaaggcaggcggatcacgagatcaggagttcaagaccagcctagccaacatggtgaaaccctgtgtctattaaaaatacaaaaaattagccaggcatggtggcaggcgcctataatcccagctactcgggaggctgaggcaggagaattgcttaagcccaggagacagaggtactgagtcgagactgcaccactgcactctagcctgggcaacagagcaagactccgtctcaatcaatcaatcaatcaataaaggcaagattagggaaagagtccctgtgagggaatgtgccctggaggacggtataatgacagattgctttttttttttttttttgagacgagtctcactctgtcacccaggctggagtacagtggtgcaatctcgactcactgcaacctccgcctcccaggttcaagtgattctcctgcctcaatttcctgagtagctgaggttacaggcacatgccatcacacccagctaatttttatatttttagtaaaaacggggtttcgccatgttggccaggctggtctcaaactcctgacctcaggtgatcctgaggccgacctcggcctcccaaagtgctgggattacaggcgtgcgccactgcacccggccccagattgcccattttaaagaggcctaatagtctctgaggcaatgacgcaaacacagatcttagagacccgggtaccagtgctggcagcaccattatcagtgatgtatttaccccgggtgggcctctcgcatttagcatatgttctgaaactcccgcaagcatttccgggcttcttcaagaaactgcttgtgcaacctgttttgctgtaagatctgctgctgctggtctcggatcatctgactgtgccggtcgtcgtcggcgaggctggtgcccgatggggaagtggtgctgagctcagatcctctctccctttcctgggctctcgtggaggaggacttcagatgggccagtcgagctcttctttgctccctcctctctttttctagctcagctttgtagtggatttccaagctcatatctgggtgttccatttgttcaagcgattccagttgtttttgtcttctctgctccatctctgctttctgcctttgcctggatgccgtcgagcccactctgtctgcctggtcttgaaggtggagctgaagggagccctctgccagcgtgcccagtttgggggtctcttgtccagattcagtgctatacaataatgagtcctctttgttgataaatatacctgcctcgggagacaatgtttgacttccatttctaaacgtgggcttgaccgtgccctgatatttttggttctgggccttgcccatgaacgttttcaagtcggtcttggacgctgcctgctgcgcctcctcctctgctgggctcctgggttccccggcaggcagcatctctgggtctgccattttcttccctcttggggtcccagcgccacactcttgcatctctgagaaggcatgcccttccccaggtctctggtccatcctgggcttcagtgccaggtacaagcacaggtgttttttcagctttctgtttatattaaacaactcttcaaaggccaactccagctctttctgccacttgttcttctcccggagcgtgcactgagatgctggggacacggcttcccttctgcagctggaatcagctggccacagctgcccgaggtctctcagcttcccctccagactctgtccctgagagcgactggtcagggctggaacaaagcaaactgccccctttcccagttgcctcctccccgcccgagctgttcctttctctttttcctccacaagcccgatttctcccacagcagccacgagtgggtttgacctttctaggtccgcccctttgctcctccgaggatggatggcacagcggccacccccagacttggtcgaaggttctggccttccctttctcttctcaggcggggccaggtgagaattcatccgacccgtggcttttgtagtctgtggtttctctggactcgctgctgtcttccggggcctggagtgcctggggtgttgctggcccaactctyccctgcaactcctctcttcactaagggctgctctatgcttctccttggccctcgggggcctggctgatcttcgctggatgggcccctgcgagtcaggctcattttccctggcccgtcctcctccccagcccaacagacgtgctgactgcagcctgtccaggccaccgacgtgcaggtgctgtgcctcctgataccctctcctcaactcctcagccaagcgctggagctggtagtttttccacagcttggcatccgctcttctctgcagagcgagatcgcctttgccccgggcttgtagcaatttgtgctttttcctccaaagcaggtcttcgttatcaggacagaggctcagccacatggctccatccatgtttctgttcctgtctgcgaacccagcagatacagcttcccagggaaggtgcttggagccaagagtggagggttcaaggggcgcccccgggcctgaggagccacagaagccacaacgttccacagcaaacctacgaggaagggagcacaagtgcagctttccagatcgctcccaggagagtgagcaaagccctggagacaagcacacgggattctcactgtgaggacaggctgcaaaatgtgcccctccaagctctcttgacccgtgcccaccagggcccactctcagcctcccaatttctgtcctgtacacttttgacaagagcctgtagggcagctgttttgaacagagtgtggtgttgtttcccaggggacattggcaatgtctggaaacattttctattgtcacaaatgcagggaggaggtgctccgggcctgcagctgggtggaggcgagggaggctgctgaataccccacactgcacaggagggctgcccaagacagtgaataacctggccagagatgtcagtagtgccgagactgacaatcccacccaaagggcaagggttaggattcaggtagggatkgaggggcacaaagggcagcccttggaaacaaatattgagaagagcaggtggaagtaaaagaggaagtctgggcctctggagggagaattgatcgtaaaggaaaggaggaagagacggggcagggaggagcctgccaagcatgtgtgtgtgcaggagtgtgtgcacgcgtgtgcaggggtgtgtgtgggtgtgtgcacatgcacatgtgtgtgcaggggtgtgtgtgcgtacatgtgtgtgcaggggtgtgtgtgcatacatgtgtgtgcaggggtgtgtgcaaggatgtgtgtgcatgtgtgtgcaggggtgtgtgtgcatgtgtgtgtaggagtgtgtgtgcaggggtgtgtgtgtaggggtgtgcgggcaagggtgtgtgtgcaggggtgtatgtgcaagggtgtgtgtgtctccatgcatgtgtgtgcaggggtgtgtgtgcakgkgtgtgtaggagtgtgtgtgcaggggtgtgtatgcaggggtgtgtgcgcgtagaggtatgtgtgcgtaggggtgtgtgtgcaggggtgtgtgtgcgtggggctgtgtgtgcaggggtgtgtgtgcatagcggtgtgtgtgcaggggtgtgtgcgcgcaggggtgtgtgcgtgtgcacatctgtttatgtttctgtgcacatgcctgcacatctgtgtgtacaggggggtgtacaggtgtgtgtatgtatgcatgtctgtgtgtgcctctgtgtgcatgtcggtgtgtgtatgtgtatgtgtccgtgtggggcatgcaggtatgtatgtgtgcatgcaagtctgatacttgaatccagtagaaaccagagaggaggagaagctggtgttagctctctcttcatgactcccagctctttccttttataatgatcagagaaggactcttccaggtctctttggcatcaggaagggacccatgctttggcaggccttcctaggaaaggaggggcatttacaccaaaacagtacgggattgtgtctgttgccacgggtagctgatgccagaaacagccagatctgtgagctgcaggaaaggctaagggacagccacagtcgatatggagtccccctccactgctccttcccttctttcatcttagtctatgtggaaccaggctaagcctttggagtcaaacgtagttgcagctgaagtcacatgtagttgcaggagtcagaaaatactgcatctrcattacagctaacattaaccgtgcaggctcccctctgagcactgggcatgtatccgttcatcttttttacagtaatcctttgagatacgaagctcctacccccccyggttcacagacagggaaactgaggcaggcagagatgaagatgcttaacccagatcacacagctggtaagtggcagagacaggccctctgctgcttggacgaaccccagcacctttgaccaacctcaggtggtcacactgcagctggctttgacttaagtcttctagtgggaggtccttgcacctcttggtaaatcagatcacacaattagaatagtggttaatattatatttagccagatctgccaaccaccatgatgatcaagagagaaagggagagagaaagctgggcccttcaatgcaatgattgagatttttgacaaaggtgccacggcaatttaatgtggggaaagaatagtttttttgtttttcaacaaatgatgctggcacagttggatatccacaggcaaaaaatgggaattcacagccttatctcaccctatatacaaaaattaactcacaatggatcatagaccttcatctacaactataaacgcttagaagaaaacgtaggtgtatattcatgaccttgagtcaggcaaagatttcttagatacaacaccaaaagcacaaccaataaacraagaaacggataagctgaacatcatcaaaattaaaagaaaaaaaaaacctttgtgcttcaaaaggtaccataagtaaagtgaaaatacaaggtacggactggaaggaaatatttgcaaatcatatatccaacagaagacttgaatccagaacatatgaacacctcttactacccagtaagatggcaaataatcccatttgaaaatcagcaaaagaaggacaggtgtggcagctcacacctgtaatcccagcacactgggaggctgaggcgggcggatcacttgaggtcaggagttcgaaagcagcctaaccaacatggtgaaaccccgtctctactaaaaatacaaaaattagccgggtgtggtggtacgcacctataatcccagctactcgggaagctaaggcaggagaattgcttgtatctgggaggcagaggttgcaatgagctgagattgcaccattgcactccagcctggatgacagagtgagattctgtctcaaaaataaataaataaaaataaaaatcagcaacagatttaaatagatatttcaccaaagaacatagatgtgtggctaatacagcacataaaaacatgttcaacggcagcggtctttagagaaatgcacactgaccctgcagtgtcctgccacctcacatccactccaacggctgtcgtcaaaaagacagacaatagcaactgtcagtgaggaaggagggggaggaattggaaccctgtgcacgctgctggtgggaatggaaaatggtgcagccactttggaaaacagtctggcagtttcttaaaaagggaaacacagacttaccctatgacccagagattccactcctaggtctataaccaagagaaggcctgagtccacaaaaagaaaccaaagctcagagaggttgaataactttcccagctcacatggaggagttggcctcagacaccaaagaccaccaggaacggccacagggatgtccaattaggtgtggtgaggtcggggctgctgtgaatgcccctctgtgtgtctcggaaggtgcctggaggccccaaggttcacagtctatttctgtgccaagagccgttggctcacaccccttgtcaaccaacaattagtaaaacctggacaagtcttccctgctctggaagtgcccccagcccgttcaatgacctcagtgcaccccgtgccagccccactggcgtgggcatcccaatgaagcagcgtcagttttcctggagacacgcaaacgggtaaaaacttaacacatttgggcagagatctttgggataagtctagaaaattgcagccagctccatccttcaggaatcgatccccgctctgacaccatcagatgcaacctcgtccccgctaccccagctctccttgctctcccctctgagaccctccccacttactaacttgaggcagagggcagggtctcacgtggacttgtgcaggcactggcagggaaagcaacagagccttagctgagcccaagatgaccaaggagaaacagccgttcacctgttgcacagcctgctgggatgcctgcctctgcctgtgatgcccaggctgatctccaggcagcccagtgtctctccagccctgccagacaggacgtcgggtgcccttggcaggacacttgccaatgaagacagccatggttccaatcagggccctcgctacagctcccctcccagargcacctgccctctctggttgcttagaatattctagaaggggcaggggtcctggcgctcctctgtcctccacatcctctgagtgttctgagcatcytgggctgctttggtgttttctactcccctgctgccctctggtcctgccmccccgmgctgacaagcctgccttctgctggctgccttcaaccactcagagaaaccacagctcccccctccgcagaagccgcgctcggagcagcagaaggaaggcgagtggacaccaatctggcctccggacggcaccagggcctcccacagagcggagtggacactgggcccattctcctctcttgctctctacagccccgtggccccagcgcaggagccagcccatggcagctccaccccagaccgatccgatcccagcacctgggcccaggaatgtgcttggccaccagattcccagcgattctcaccaaagtcaggcaacctctggcctacagcttgagaatgacgtccaagcagctcgcctttccctgggcggccgctcagacagcttttcagccaaggcagacctcacccagggaccytccacccaggcagcgtggaagtgccagggcccacagacagcacccccccgccccccgccggcctcctcaccccctccgaaggagactccaggcctgctgtgcactcctgtggcatcggggrgcggggggcaagcatcacagtcatagggagtgtgaggcgcccagaatgggggctccacagtcaggcctgcaccccggctgcaggataccagatcctgtggttcactgtgagacctccgcctctctcgtctgcctcacgctgccccctcgcacccccaaggtatgacggcatttgaacaatgcacgtgcccatctagagccttggggtgggcctgtgagagagtggccgcccaccccagtccccaccaggtgcatagtcctgcggctaagtcagggcggttgtracaaaggctcagaccctccaactaccaggctgtgttgtgacgaggctgctggagccccaggcaccatgacgggaatgggtgaatccacccacagtgggtgactctcaatgtgatactagcccggtacacttrgacacccaaaaatcaacgcggcagacgttgtatccccaggagaaggacccccccgaacagacacgtgggacaatggcaagcatggccatccctgaggacaatggcaggacccagagtgcctctctcctcctcaaggcatgaactggcccctccagatacagggacaaccttttcttcccacctcggcctgtaacagacacgacacaggccatacccttggctagagtcactgcaacatgatccagagggtgactgtgaaaggagccagcggggctgctgtgtcggttttcctggagacacggaaatgggtacaaacttaaaacatctgggcagaggtctttgggataaagtccagaaaatcacagctggctccatcattcaggaattgatttcccccatgacaccatcggatgcaaccttgtccctgccgcctccagctctccttgatttcccctctgagctcacaaaaagaaacaaaagctcagagaggctgaataactttcccagcttacacggaggagctgggtttgaatccagacatcacactgatcagcacgcagacccgcagggtttcatactcttccggcatttcasgtacacctctctccatctcaccgcctcaccataggaggtgaggcctattcctatccgcacaatctgacagggaaattgagactcagagaggttaagtaacttgcctaaggccacatagctcgtaatcagggcagcagggattccrggccragcaggcaggcccctgatccaggctcctagcctgctgcccagggaggtcagagctggaaaccacytccacagcacaaggagactctgcttggactgtgcttggcctcacgtgacctctgacctccctggccctcctgtgaccctgacaggtgtgctgagcttctgaagggtgggaaggcctgcaaggggcctgcgtgcattctgtgtgcatcgacccaggacaccacggttggtgcctctgagttcatcacgtcgatcatccccrtcttctttctgctcaagtacttgatttgtcaacatgcacagaagggtgagacctggccatggtgctgcttgaatcttgttaacagttaggctctgattcaatagtctgggtggggcccaagactctgcatttctttttcttttcttttttcttttttgagacggagkcttgctctgttgcccaggctggagtgcagtggtgcaatctcagctcactgcaacctccccctcctgggttcatgcaattctcttgcctcagcctcccaagtagctgggactataggcacgcgccaccatgcctggctaatttttgtatttttagtagagatagggtttcaccatgccggccaggctggtctcaaactcctgacctcaagtgatctgcccgccttggcctcccaaagtgctgggattccaggcatgagcccccgcacccgccagactctgcatctctaaagtgctgggattccgggtgtgagcccccacgcccgccagactctgcatctctaaagcgctcccagggatgctgatgctgccatctgggggaccacgcttggagtactgcggccctggcaaaccatctcttccaggaagctgcatcttgctctgccttcctcccctgccagcagctcagccctgatcatctctcacctgaggcccttaaaagcctcccaatcagcctctctgcccccgacccccaggcctgcacccsgtcctctcccgcactgcagcccagcgctgtctaactgagmgacctgggttacatttcagcatcccccatgtgattccctgctgtccacaccagcaagtctctgagtgcaacccgcagccacgtgcatcataatcagctgagctgctggtgaaggggtagattcctgggcctcacccctgacagatcctatcccagcccctgcgggaggggcccaggaatgcagccagttcaccagctgccctgccaaagcctggcaatctctgggcctagaggcttgagaacggtcaagcagctcgccctggctcccctgggagccaccctagcctggaacgctgcacaccagacaggggtggtagagctcctggccattcccaaatgccccacacccagcagcgcctggaatgtgctcatgcaggttcctcgtgacatggacacacccccttccccatcctacccrcatgtccccagcccaggcctcgttcccactcccccaggatgccccaaccctccaagggaacaaagagaatgctcttccctttctccagaagcccagcacccgggccacatagtcaagcgctttgtctttgaaacataaaaatagctatagaagggctccgttagctggcatcggccagagagagaacatttccatataattagagcttaccctttcatatggaaagttagacatttctctgtctaaggcgcctacgtagaatatgtaatttgaccttctttgggggaaattttggattgtctttgggatgataatataggaaatccctcgagggcttttaaaatgtaaagaacagaggtcccataaactaagtgaccccagaatgcaatttgggttttttaagtcgcctttttagagcttcctgtgtcctcccttccctggtcataactgtctgacagcagccacacaaacaagcttattaaaattgtggtttttttggccgggcgcggtggctcacgcctgtaatcccagcactttgggaggctgaggtggctggatcacctcacgacaggagttcgagaccagcctgaccaacgtggtgaaacctcgtctctactaaatacaaaaaattagccaggtgtggtggtatatgcctgtaatcccagctactcaggaggctgaggcaggagaatcacttgaacccaggaggcggaggttgcrgtgagccaagatcgcaccactgtactctagcctaggcaacagagcaagactccatttcaaaaaaaaaaaaaatgtgttttttaataaagtaagtagagtccgaggtggtggtgggctcttccacaggaccactgcctgagctttcacacctgaccttatcaattcaaagctgtgggcatccccggatacagataacccttgggggaggtggaaaattgttgctagactctagcctagaggtttttaacagcttgcacaactggccaaatcttacaagataaaaaaaggtaatgggaacacatctaaaacttatatgtgggtccctaaatccaactatgcaagtacagaggtgggtgtgtggagcagcacaggggacaaaagacgctgggccaccagaagggccaacgtgactgtcccctgagtgaacagaaacgcctctaacatgcgagcgaatggtgcagcccagccrgcccracctcacctggccatgytaggaggcagtgggcaagcggcaacgctgtggtgcccaggacgccggcaggcacagcgccacgtccacgggcaccgccygttcccaccctgcaggacgccacagcatcagacgagacggcccgtgtgaagcgccgagaacagagtctggcttccgggarggctcaggaaatgccgagagctcggcagagacacccacgtggtgctggattccacgcacgaggaaccgacgggcagacgtggagctaaatgatggtcaacagctacgaagtgcctgtgctctagaaayggccaatttgatcatgtcacgggataaagtttcaaaatcaataaaaccgtgatgaaatgatcaggaataaacctgtccagaactgttcaagacctaaaggagatgcacgggctgaagaacaaggagcraatctgaacgagggagaggtgtgtcttcctggacagttctcgggagaggaggagggcggtaaggacggggagaagaggccgcaggcttggagtccaggaggagaatgaactcctttggtcaggaggggcccactgaccaaaggtcctaggaagaaaagccaaaggaggtgaggtggggcaagggtgtttgcaaaggatagaaaagtctagaatggcagagtatggtgcttaagagtactatgtgacctaggccaagcyacttcactctgggtgcctcagtttgctctttaggatggggatgataacaacagcagcacccatctacagagatgccagtgcttgtcaccacgagaagcacctgaaatgcttggggaagaggggtggtacttactgtgtgtgtctccagatgactgagctagaccacccagaacacattacagggaggcagaagctgacaggagggcaggaagcactgtctccagggctgtcttgaaatcaytgggctgactttgtaggtagtgagacgcccatcactggaggcatccgaaccaagcccagataaaacaaacatcagaaacatttttaactccgtttctctgagttctagcctctaaaaataccctccatgacacgctgtgtgctgccagaggcttggttttcgccctcttctccccaactcttagccacgtcccagtggyggcgggggracgggggtcccaagccactgcactgggttttggtttcactatgttgcccaggctggagtgcagtggtgcgatctcagcttactgcaacctccaccttccgggttcaagcaattctcctgtctcagccttcccaagtagctgggactacaggcgcacgccaccacacccagctaatttttgtatttttagtagagacggggattcaccatattggtcagactggttacaaactcctgacctcaggtgatccacycgcctcggcctcccaaagtgctgggattccaggcatgagccaccatgcccagcctgcactgggktttggactggctgtgttagcatcacctggggcaggggtgggtcacgttagaatgagtcctggctaggcccacagcaggcttttccacccgaatactggggccacagctcatgaatctgtgtgtatccatatccygggctgggtcagctctccagggtggagatggttgggcaggcagcctctgggggcaagctcgggctcaggcctccccttgaccagcttcacagagacagacactgaggcagactgacctccaaactcccagctgagacgccagctccccacgtggggggcttacagctgatgcaaccggtggctcactaaacatacctcgacagcgtccattaccgcttccctgcaaacctcaagatcctaagcacccagcctaggtcaggggtccccaatcccagcaggtgttcctgcttcctgaagaccccccagcccaactcctccaayaaccatattcatctccaacccagtcccaccagcttccctcactctccttcccatcacactgcctgtggggagccccgtggtgcagggactttgccgctggccttgcgaacmcacggcttggagcccctccttggcccactctccggggccctcttgggagcctcgctaaacagctgggcatggaaagaaccccaccctcaccacagatgggaacagacacagagagcctcagccccgcagtggtctcaggggcccactgaccaaaggtggccggaatcgcttccccrcctccacctgcagcccggcctctgccctggctggctactcatagcaggctgttgccatgggaacagcagagctgttgagctgtgacatcatggcaggggtgaggtcagggacagctgtgagccagccagggggcaagcgtgtaggttaggggatcaatcataaagatttggctcaagcagccgggagccatgggggcacctgaaggcactgtttaaggaggtgtgggtgaacaaggacagtgcaatgtacaaatgctcgtggccataccaggcagaggacatctttttgtccccagctggctgcatggagacctcccagggtgtcattctctctgagctgtcaggccattaaggaggtacacttcaaggtcagggttcctgacaacgcytgccatcccttctcctgtagggacagcatctgttcacgcttctaaacagctccagaaagccatcgttaaactgaaacccactggaggcgggggaagaaagaatcccgtcaaccacctgcccacacaggaggagaagccacacgtacttggcctcgtttgagggctagttccccacagacagtttgatcagaaggatgggcgagggaagctggcagggcgaggctggggatgaacatgggacactgggggagtctggccggtgcagggggtttccaggaagcaggagtagctgctggaaatgggggcccctgacctagtctgggtggttggcatcttaaggtctgtggtaaagtgatgactggcattgtcaagatatgttttttgtttgttttttagacagtcttgctctgttgcccaggctggagtacggtggcgcaatctcggctcactgcaacctctgcctcccgggttcagggattctagtgcctcagctttctgagtagctgggactacaggtgcatgccaccatgcccagctaatttatgtgtgtgtgtgtgtgtgttttagcagagacggggttttaccatgttggctaggcgggtcttgaactcctgacctcaagcgattcccctgcctcgacctcccaaagtgctaggattataggcacgagccaccgcccccagcccaagatatgttttagtaagccgccagttggatcatctgtaagcaactcactagaagcttccagcatcctccacaaatttgacaactgagaaatgtggctgggaaatcatgatttgggtccgaagaagtgaaagcaacaatcctcaggktgttgtttcttgagagaagaaggtaaacagcaggaattcggctgaggtgtccaaatctcggggaggatgaattctcaggagagctgaacctgagacaaagccctttgtcctgggctggaaggaycctggaaaggttatctggtccctgactcagggaagggaggcattctccctgcaggaatgttctcgatcacagtmcaccaccacccccctacccccgcccacttttggagtccatcttcgcagcccttgatgattcattttatgtcagcttgacgggctaagggatgctcagatagctgggaaaacgtgatttctgggtggctctgggaagagactggcatctgaaccgggggactgagtaagaagatccctcctcgccaggtggggcaccatcactcaatctgttgaaagcccggacagaacaaagagacagaggcagaggcaggcaaaccctccctctgcaagagctgggacatccaggctgggcgcggtggctcacgcctgtaatcccagcactttgggaggccgaggcaggtggatcacctgagctcaagagtttgagaccaggccaacatggtgaaaccccatctctactaaaaatacaaaaatgacccgggcgtggtggygcacacctacagtcccagctactcaggaggctaaggcaggagaatcgcttgaaccagggaagtgaaggttgcagtgagccgaaatcgcaccactgaactccaacctgagcaacaaagtgagactccatctcaaaaaaaaaaagagagagagctgggacatccaccttctttctgccttggacctcagagctcctgggcctcaggcctttgggctccaggacttaccccagtggccaccccgcttctcaggctttgagactcaggctgcattactgcaccagtgaccctgctgctccagctcacagacagcagattccaggacctcccagccttcatacttgcatgagtcaattcccacataaatcccatcttacrcagctggatggagcctattggttctgtttctctgggaaaccctaatacggacccatagatacaaaatcttctatatgcttcttcctcggagaagatccctacatcttttatcctctcagcgtggccttgacgcccattctaaagcaaggggagaggttctagtgaggmggaaatagcatggggaccaacaggatggcacgctaggccttcgatggcccttgcagaatgtccagcacgactgccaagtgctcgtcaggtcttttctggactgaggacatctctctcaagcctgggctctcctgacgctgccttggcaagctctagaaggcagccccatcctctggattaatccgccctgctaaatgttctctctggcatgggattcactactggcctaaggccaactcagccttgagagtctgggtccatactattgttgactgcaattagaaccacatattagcaaatgctagcttttaaaaattacaggtacaggcagacctcagacatactgcgggttcagttcccacagaatcataataaggtgaatattgaaataaagtgagtcacatgactcttttggtttcccaaaccaatatatattcccaaatataaacgttatgtttacattgtacagtagcccagtaagtgtgcaataacattatgtcttatcaatgcacataccttaatttacaaatactttattggccggggcaagtgggctcacgcctgtcatcccagcactttaagaagccaaggcaggtagatggcttgannnnnnnnnnnnnnnnnnnnaccccaggagtttcagaccagccaggcaacacagtgagatcctacctctataaaaaactaaaaatagccaggcatagtggtgcgtacctgcagtcccagctactcaggaggctgaggcaggaggatggcttaagcccagaagttcgaggctgcagtgagctaagatcatgccactgcactccagcctgagtgacagagcaaggtcctgcctcaaaaaaaagaaaaacccaaaacttgaagaaataaaaataaaaataaaaatattttattgcttgaaaatgctaacaatcatctcgacctagtgagtccagtctttttgctggtggagggtcttgcctccatgttgatggctgctgactgatcagggtggtggttgctgaagattggggttggctgtggcaatttcttttttttccttttcttttttatttttattattttttttgagacagagtctcgctctgttgcccaggctggagtacagtggtgcgatctcggctcactgcaacctccatctcccgggttcacgcgattcttgtgcctcagcctcccgagtagctgggattacaggcctgcgccaccacacctggctaatttttgtatttttggtagagacggggttttaccatgttggccaggctggtcttgaactcctgacctcaggtgatccccccgcctcagcctcccaaagtgctgggattacaggcgtgagccaccgtgtctggccggcaggcccactttcttattatttgtgtgatcacctggagtagcattttttaatttccttcacattcacaacttggctgtttggcacaaaaggcctagctgtcagcctaccttggctttcaacacgccttcctcactaagcttaatcactcctagcttttgatttaaagtaagagacgtctcgctctgtctgtcaagcttgaatgcaatggtgtgatctcggctcactgcagcctagaactctcaggctcaagtgatcctcccgcctcagcctcctgagyagctaggactacaggcatgtgccaccacacccagctaagttctttaattttttgtggagatggggtcttgtcgtgttgcccaggctggtctcgaactcctggcctcaaggtgatcctcccgcctcagcctcccaaagtgctggaattacaggcatgagtccccacgcccagtcccattatagggtaattaattggcctaatttcaatattgttgtgtctcaggaaagagggaggcctaggcagagagagagagaccagaagccgccagtcggccagttggtggagtcgtctgaacacagacaacatggatcaattaactttgccatctcatgtgggcacagttcatggtgccccaaaacaattacaacagtaacgccaaagaccactgatcacagatcaccataacaggtatgataataatgaaaaagtttgaaatattgcaagaattattaaaatgggacacaaacacatgaagtgaacacgtgatgtgagaaaaaaatggcaccgatagactcagagttgagccagccgtgatattcaattcatgaaaacgcagtatctgcagagcacaatatagcgaagtccagtaaaacaggtgcacccatggaattcatgttcattctagagcaactggaaaatacacccttgccaaagaaagtctaatgtcccctcatgtgtccaaacgttctggccaggtgtggtggctcacgtctgtagtcccggcactctgggaggccgaggtgggaggatcacttgagctcaggagtttgagaccggcctgaacaacatggcgaaaccccatctgtactaaaaatacaaaaacttagctgggcatagtggtgtgtgtctgtggtcccagctacttgggaggctgaggtgggaggattgcttcagcccagggagcagaggttgcagygagtggagatcgcaccactgcactccagcctgggtgacaaagcgagacactgtctcaaaaacaaaaaagaaaagaaaaagctataccatgtgatgtctgcagagcatctgatgctgtgatttatttaaccacgcccctgctactgtatatataggtgtttctaacgtttccgtaagataagcaagacggagatgaatatccttcagctaaatacttccatgtgtcctaaattatttctctcagaaaaactccaagatatagggctgcctgatcaaagggaagacttatttttaaagtccttgatcactgctgccaaaatgcccttccatgcctctaaactactcaaattaaggcaaaatatacctgtcaccaaggccttctgaggacaacatgcctcttggccaaaaggagcaaagtgatgttaaatccaaagctgtgaaatctaatcttcttcccagagactcgagccaggatcattccccttggattcctggcactgccactctgtgggtgaccttgggcaagtcatcggctgctccccatccaaacacctgcctcacctcccccgcagagcctttgtaaataaggaagatgtgaagtcctttgtgctgaaaagccctcracagtatttttatgcatttgcctggttgttttatccctgctttccagaactagtgcacagaagggaagaccaccacagactgttcctttattccctgccctggrgccaactgggccaagtggacaagacctcacaagggagagtcaggccagcaatgctcatccmagctccaccctgaccccattcctcttggcatactcagtttctgcctgggctgggcaggctggtccttggcttctggggtcagctcaggattgaggatgaaatgagaggagcacccccagaagagaaagtgctgaaccagaagcccaggagagtcatgtgtgtgcgtgtccatctaagcctttgccccaaaacagtaggtagrtcaggtgcagtggctcatgcctgaaatcttagcactttgggaggctgagatgagaggatcacttraacccaggagttcgagaccagactgggcaacatagcragatctggtttctaaacacaaaagtaattttaaaaattagccaagcgtggtggcacacacctgcaatcccagctactcgggaggctgaagtgggaggactgcttgagcccmggtggttaaagctacagtgagctaggatcacgccactgcactccagcctgggcgacagagcaagaccctcatctctttaaaaaaaaaaaagataaatcaagragcccacstgtccccagagctctcctgccacagtgtcagcacatgccttctgagcataataatccccccggacctgaagcccacgaatgacccccccacccagtcctttctccctcatgtcacgtcaagtgctgtgtcactgaagcacccygtaccccatcacctggtgccagaggcctggccatggtgcagctggacccccagctgccgtgtgaccgtgggcaaacggattatgtcaccttcccagtgttagagagacccagtggtgacaaacgtcctctgtacctagggtcaccgtaaggctcgggtctcatcgggtttctgtacatgctctagacgtgcagcgtcatgctaccgacactccaagtagccggccttgctggcactcctggctttctcccttattccaccccccgccccccacaacattacgggacccaggccgggcactgtgacccaggcagtgtggattctcaactagctggagcaaacagggaactagggcacagaaaaggcagagtcacacaaccggaggcggagtgtccgtctagtactgggacccggtgtgatgctttaaggaacacacctgccgtccttatgtgagctgggctgggcctttmtttttaatggacacataattgtaatatttatggcatatatagtgatgtttagatacatacaatgtatagtgatcagatcagggtaattagcacagccatcatctcaagcatttctttctttgtggtaggaacattcaatgtcctccgagctatctgaaactatacaatatacttttgttaatttctttttcttttttttttttttgagacacggagtctcgctctgtagcccaggctagagtgtggtggcgtgatctcggctcgctgcaacctccacctccygggttcaagcgattctcctgcctcagcctcctgagtaactgggatcacaggtacacaccaccaggcctggctaatttttatatttttagtagagacaaggtttcaccattttggccaggctggtctcaaactcctggcctcaggtgatccgcccaccttggcctcccaaagtgttgggattaaaggtgtgggccaccgcctggcctattgttaattacattaatccaacagtgacayggaacaytataactcattcctcctatctagctgtaattttgtatcctttaacaaatctctccctctctcctcccccaacccttcccagactctagtattctctgttctacttttgacttcgatgagatcaacttttcttttttttagctttcccatatgagtgagaacatgccatgtttaactttctgttcctggcttatttcacttaacgtcttccagttccattcatgttgctgcaaatgacaagatttcattctgttttatggctgagtagtatttcattgtgtagatgtaccaacatccacaatgaaatactatttcattctttagccattcatctgttgttggacactgaggttgattccatatcttggctattgtgaacagtgctgccaggaccatgggggtgcaggtgtctctctgatgcactgattccctttcctttggataaatgcccagtcgtgggactgctggatcatatggccgttctatttgtagytttttgaggaacctccaccatagtgactgtactactttccattcccacccaccgcatatacgagttcccttttctccccttccttgcctgagctgggcctttctgatcatctgtccccgtcccttgaactcttgatctggactgagggaagaatggtggcagaggcgagctggggagcagggaggaaccaggctgtcgcaggagaaacagaatattgcgagccagccgtgtggaatggaaaggggaagcyggtcttcctgccccacactcctgcctttcttccttaagggctccttggacagagactgcaggtttctcagaagcactgtccaggatctcaacattctagaagggtctaggacaaactaactaactattgagcccctccagtgcttttgttgtttttgttttttgttttttgttttttgagacagagtctcactctgtcacccacgctggagtgcagtggcgtgatctcagctcactgcaacctccgcctgggttcaagtgattctcctgcctcagcctcccgagtagctgggattacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaggccaacatggtgaaaccctatctctactaaaaaccccccaaaaaaaaaaaaaaaaaaaattgaactgggcatggtggcacacgcctgaaatcccagctactggggaggctgaggcaggagaattgcttgaagccgggagacagaggatgcagtgagccaagattgtgccactgcactccagcctggacaacagagtgagactctgtctcaaaaaaaaaatatgaatctcccatggcaccacactgaagagtctgatcttgcttttacagaagaggaaaccraggctcagagaggcacacagtcgggattcagaaccagtcccacttgactccaaagcccaggctcttttctccaatacttttcatgtcgcctcttttctctgaaatgtccatttcctcattctgtccttggttaagcagcagctgttggcgggtgctctgtccaggcctccgctaccatgacgagccttggcaaagcctgccccactgccagtttgctttgccacgtctgtgtcaggaaagctcaatcaatctctcccgattacagatcagaaagggccaaataaactctcaacccaagccagattctgtccctgaagatgcagtaagggggtctcggtacccacagaacatcccaccacagaaagccaggctccagcctgaaagtccatcttccctgctctagcccacccgtgcgatgaagagcacagaagaggcgggtgaaggcattgcatcttcagcatcggcttggagaatgacaccctgcaggttccacttcttcccaggccacctgcttgcttctggaaagcagggaacaggcaatccggggagagaggagccagccacacaaggactgggaagcccagacctgtgccatcagcctgcgatgacttaggctggggatccgaaaaggtttctatgaacagccagctggtaagtaatttagactttgaggcccatacagtccttgatcaccgccattcaactctgttgttatagcacaaaagccacgtgggtttggccttaccagtgggcgtggctgtgttccaataaaactttatttgcactaggccaggcaccgtggcacaagcctgtaatcccagtactttgggaggccgaggcgggcagatcacctgaggttgggagttccagaccagcctggccaacatagtgaaaccctgtctctactaaaaatacaaaaattagccgggtgtggtggcaaaaagaaaaaaaaatatttacaacaacaggccatmagcccagcagtgggtctagtttgccaaccgctggaaaaagccarcaacattttgggaggccgactgccggctacaggacctcgccataccaacaagggctgagacccgcggctctgcagggctctaacaacagcgtttgacctgagtctatctggggaaacatcacgtgaacccacgttgaggccctactctggaagctgcaaaattagagatgatggctgtgcggctctgtgaatgtactcaaaccgctgaactgtgcactttagaggagtgacctcatggtatgtgaattacatctcaataaagcagctcaaaagcaggctgggtgcagtggttcacgcttgtaatcccagtgctttgggaggccgaggtgggaagacggcttgagcccaggcgttcaagaccagactgggcaacgtggcaaaacctcgtctcgacaaaaaatgtaaaaattagctgggtgtgctggtatggtcccatagttcmagctacttgagaagctgaggtaggaggactgcttaagcccaggaggctgaggctgcagtgagccatgatcatgccactttactccagcctgggtgacagagcaagaacctgtytcagaaaaacaacaacaaaaaaaaacaaaaaacataggccgggcacagtggctcacacctgtaatcccagctactytggaggctgaggcaggagaattgcttaaacccaggaggcggaggttgcagcgaaccaagattgcaccactgcactccagcctgggccacggagcgaaactctgtctcgggggraaaaaaaaaaaaaaaaaaaaattctaggcaatggatacaatcaggatgatttttcttgctttttgcttaagtgtcttttccatgattaacacatatagttgtgtaattattttaaagttagaaggcatttgggacgtgaatggagagacagagaagttttctttatgatggagagaggcggaagggacggcttcctctgcgagggtgcaagggctgacctgggagagcaggcagctgcgactaacgctggctggggcctgcctgacttccccttgagtcctyagaggcacaggttataacccaatgttttattgcttcttgagaacattattggcattcatctgccttcgaaattttggctattcatttatttatttatttatttayttatttatttatttgagatggagtctcgctctgtctcccaggctggatggagtacggtggcccgatctcggctcactgcaacctccacctcctgggttcaagtgattctcctgcctcagcctcttgaatagctgggattacaggcacccgccaccatgcccggctaatttttgtatttttagtagagatggggtttcatgatgttggccaggctggtctcgaactcctgacctcaggtgatccacccaccttggcctcccaaagcactgggattacagggatgagctactgcacccagccaagctgttttttttttctttatagacagagtcttgctctgtcccccaggctggtacaaccatagctcactgcagcctcaaactcctgggctccagtgatcctctcacttcagcctcccgagtaggtgggactacaggcacgtgccaccacccctggctaatttttaaaattttaatttattttatgtagagatgaggtcttgctatgttgcctaggctgatctggaactcctgggctcaagtgatcctcccgcctcagcctcccaaagtgctgggattacaggtgtaagccaccgcgcctggccagtctgggctttttcttttttttttttttgagacggagtcttgctctgttgcccaggctggcatgcagtggcacgatctcggctcactgcaacctccgcctcccgggttcaagtgattctcctgcctcagcctactgagtagctgggattacaggtgcccgccaccacgcccagctaatttttgtatttttagtagagatggggtttcatgatgttggccaggctggtctcaaactcctgacctcaggtgatccacccacctcagcctcccaaagtgctgggattacaggcgtgagtcactgcaaccggcccagtctgggcttttgaaagtactgtgctctgaacatttttctaggtcataaacacaaatctgtaatatcatttgaaatgtctgctcactctgttgcggcagggagaaagattaattgatttagcttatctccagcagacaggcaaacctcatgaacaaggccagcctcaggagctcctctccctcctcagtggctccatccgtcacctgtagagcttcagcccagctccacagcctagaccattcatccccaagccartatcagtctgaatcagcaccattctgttgatgtacctccttttaaaagccgtctctctctctttttttcttcttttttttttgagacagagtctcactctgtcacccaggcaggagtgcagtggtgcgatgtcggctcactgcaacctctgcttcccaggttcaagcgattctcatgcctcagcctcccgagtagctgggattacaggcgtgcaccaccacgcccagctaatttttttatttttagtagacatggagtttcaccatgttggcaaggctggtcttgaactcccgacctcaggcgatccacatgcctcggcctccccaagtgctgggattccaggcatgattccaccgtgcccggcctaaaaaccatctcttcttttactctgctatttcctagccagctaaccctgagcaggttccttagtgggcctgtgcctccgttggatcgtctgtacaatggggatgaggatagggaaggaaatgggttgacactagtgaagagcaagaacatacctccaagcccttggcacctctgccagctgttattgttgccatagtcattatcaccatgtcatgattcacctccctggctgctcccaggcctccctcagggcggggtggggaggaacaagaacacaaagacagggagagccagggtttgatgcagaaagagctggtgtcccccactagctccgagagcttcctgggaggcaggaaattcgcctctcctttttggaggtgtggaagtgggggcagagagaggccacctgtcccggatcgctctgctggactcaatctggggccagcatttgacccccgctcaccctgtttgctatgaatgtcagttcccctcgctactgctggctcccttccccctcaaygctccgtttcctgttccctccaaggccccgttacacaatttccactgtctgctgaagttctagctcaaatccctctcgccgagactttctggtcaccagattccagcagaactcaacagagacctctacccgcctgagctcctgaccaggttagagggcatctggctcccaggcactgggtcaagctccagaggcatctcctgtgtctgcccgcgacccatggccccgctcagggcctgccttccatctcctgggtcttccccagtgcaggtgggagctctgctcccctggtaactgcgagcctctcaacaccaccttcctcctcagtgtcatccccctcctgtctgccccctctcccccagtgcaggggccataaagccttccccggagtcccactgccaggtcccactgccgggcctccaggctttgctgctccacctgggctcaagcctggccatactttgttctaatgactctgtccccctgtggtacactctctaccacagccaccctgggctccccatacccaccccaggacctttcctcggggcttatcttagctctgataagatccacccctcagggcycacaatctcaacagtgtcctaacctcggtaagagtctctagcaagaggtgcagcctgcaagatgatcttcgcattcctgcgctcacttccttgaagatgggcaccatggctttggagtttgagaccagcctggccgacagggtgaaaccccgtctctactaaaaatacaaaaaattagccgggcgtagtggygggcgcctgtagtcccagctacttgggaggctgaggcaggagaatggcgtgaacccaggaggcggagcttgcagtgagccgagatcccgccactgcactccagcctgggcgacagagcgagactccgtctcaaaaaaaaaaaaaaaaaaaaatacaaaaattagctgggcatggcascacacacctgtaatcccagctactcgggaggctgaggcaggagaattgcttgaacccgggaggcggaggttgcagtgagccaagatcgcaccactgcattccagcctgggcgacagagcaaaactccgtctcagaaaactaaataattccttgacacacttgccatagtatttctgtgtacggtaggcacccaaattctattgtaaaacaaaatataaaaacacttaagtgaataaattctgtaagaagcaggtatctaagacatagacaccaggcccttcctaactggtgaggtctggagttccctcaggccatgtgtggtccagctgtgatcagagtttgagatcaaagagcagctgccgtctaccaaggacgtcttccccatggaagacaaccacagaacctcccaggtctttggagccatccctgagaccagctaggaggccaaaggacactgatggcaycctttccccagagctggttacaggtctgcctcggactcccctcgtggtggtagtgtctgagcggatcctggctgcccagggcggccgagtgcagaatgagggtggaagaggagagaaaggcaagatcgttaccatcgctcagctccgagactaggcagatactcacaagaaacagaagactcgaaacctataaaaagactccttttaaatggcagtgacttgacgtttggagggccacaggcacctttgagaagttggcggctgccactgtccacaaaaaaaacacgtacgcgtgcacacacacacacacacgcgcacacacacwctcacacacacacacacacacacacaacttcacttacagtttccgggcttgtgaccacccccaaacccgccaggcctatctctggctgggtgttcacacactctgggttaggacccctcttttataaagactgttcctcaatttgcttcttagcgtaaacacactctcaacctgacttgctggggctccggaagctttccctgggctccagtctgacctggctgactggggagtagctcagccctcagttgtaaggtgggaatcatcggggcggggtctctgtgcccttccctctgccgctgcacagccacgtcccagcaaatgcacgagggcaccagggcgtcagggcacaggctgcaggggtccaggcaggtgggccctgggaggtcctggggacaccagcttcatcctgcctgccactctgagacatccatgctcctgaccatctctccattgggaagtctgggtctgcccgccttccctcctcccagcaatctcagggcagctcatctgcctgcttactccaccccccgacactgaggtggtcagcctccacactttctgttcagacccacgggcaacaaaaacaaaaccttggccaagcactcacaatatcagatattcattaaaaaagtatatataggccgggcaccgtggctcacayctgtaatcccagcactttgggaggccaaggtgggcagatcacttgagctcaggagttcgagaccagcctgggcaacatggcgaaaccccatctctacaaaaaattaaaaaaattagctgggcgtggtggctgcttgggagactgaggtgggagaatcgcttgggccaggaaattgaagctgcagtgatctgtgattgcaccactgcactccagcctgggtgacacagcaagactccgtctcaaaamaaaaaaaaaattatatttggagtacaactctgaatccatatgctaactattcataacattcttagcaccgaggctgtactgggcacccctccggagacgactggtctatgccaactttggcgggcggcagcagcacctggagagtcctgaaactccagtgccacccccaggcccgctccagcacgcggagttaggcggctgccttctaccaggctccctgggcaacgcccgctgtcattccacagccagaacatctttggtggctgcgtgggtcccgggatggaatgcagatgtcacatgacaagccagagccgtgacatttggccccaatctccttgtgggtccccctgaatccccaggctcctctttggcctactctgtacccagaamtctcacctttcctggggcagttggtcccttggcttagaacacctgtgcacaccccaccctgctgccgctaaatgaccaggggttacggtccccagtgccgtcctccagatgcggcttcttcaccctcccttaccttgatttcttcactctgccctcccctcttgaaaaagaccatctgctgggtgcggtggctcaagcctgtaatctcaacactttgggaggccgaggtgggcggatcacgaggtcaggagmtcgagaccatcccggctaacacggtgaaaccccgtctctaataaaaattcaaaaaaattagccgggcatggtggcgggcrcctgtagtcccagctactcgggaggctgaggcaggagaatggcgtgaacccgggaggcggagcttgcagtgagccaagatagcgccactgcactccagcctggagacagagtgagactccrtctcgaaaaaaaagaaaaagaaaagaagaccatcctagccatgcagccacttgccctccgtccctggtttgtgagcctgtgcgtgcaccgggggacagagagagtgtccagggcatgcacccctcctgcccctgccactgccacgtctgcctgtctttgcttccttcttatctcctcctccctgctgttgcatccctcctcgcagctgcctgggaagcctcgrgcagacctctttgttgtttccgaacccaagacgttcacccctacacacgacccccactgcatcgagtcagtggttctgcatcaggactggagacggctgcccgcgcctctcagtctcccaggagtcatctatgccctgttctccatgtgctcagatgtcgccacagagtctgaacctctcagcccacaccagtggcatctacctagcaacctggctgcgacagcagggaggagggaggcagtacccaagcccacctgcagctcacaaacgacaggccaggactgcgtacgtggctctgcacccccagaagggtgcaaataggggaggcccgagaggctcygaggctggcactgtcctcagatcccagatagggagaaacgtgtgttgtccagagagctccttccagcacctgccatacctccaggctgtgcacagctctccctgctcttccagtccccctgccttgggagctgccagtaattcaggggtcagtgactcccctgacagatcctgtccctccaaggacgctgttcaaaaccaagccgaagagcctcagttctccccacagctccctcctcaacctaccatggggccttctatcctcacatcttgcaaatgcatttcacattgtcacatgattactcctgaattttggttatttcgaaagtttatctgttgttaattatttaccgaaaccacactgagtggactgactttataccacacctgggcagttgaggaggggaggcctgctcaccacgccgggcagcaggaacccccttccacaccgcctggtgccaagatgtaccaccccctgcatcccccaccacagggacaatgtcttgcttctcccttacatccccgggggcagaggcagccactccataattgcttgttgaaacacagacaagcccaatatgaaaatcaagatgaacaaaactgacaatacagatcgatcacatacttcgcacaacgagtygccaacagtttctttaaaaagcgccacgccgccccctcgcatggaaggcctgacccagctcacatgaatctgatgctgtgttgcttttcctgagcacgtgtcctgaagacagagccatttttgactgcgtgc

SEQ ID NO: 13513 - DNA, 40000 bp, Homo sapiens
  misc_feature (1)...(40000): n = A,T,C or G, or insertion/deletion polymorphism (see Tables 1-2)
cctcagcctcccaaagtgctgggattacaggcgtgagccactgcccccagcccaacacagatcttttttccctcccagagctcacagtggggcatggtaattataaataacatttcaagtacaaattcagtaagtgccctgagggggaagtacagctaggtatgtccgtgtaacaggaattcctgatccactggggaaacctgaaggctyccgggaaaaagaggaattcatggaatgaataaaaactcttactccaggcaasaaaagggggcaggggaaagggagacccaggtagagggaacagcatgtgccataaccccggagtcagagggatgcctgggtcttaatctccacttgwcctacctcctaccccacagcctgsagggacctccctcctacaagccaccraccccaaaagcgaagctggaggcacaggagatggtgagcactttccctggagcccaagctatccccacctccacacccaccccagggctgggaggggcctggcagggagaagctggctgggtggtgggggcagttcctgacctccccgcccctctcccactacagccctcccagctcttcactctgggggcctcggagcacagcccactcaagaccccctactttgatgctggcgcctcatgcactgagcaggtaggagctcatgggaagacaaaggtgggttgggggtctgggttgargggccaggggtcaggcctggcaaaagaggtcaaagactaaaggtcataactcaaggtcaagggtgtgtccccrgttggtgcttyatgcattgagatgtgttcaggattccatgggggaggtcaggggtgaaaaggcccaaggtcacaaggttagaatttaaagtcacttgggggctgggcacggtggctcacgcctataatcccagcactttgggaggccaaggcaggaggatcacttggggtcaggagttcgagaccagcctgtgcaacatggtgaaaccccgtctctactcaaaacacaaaaaattagttgggtgtggtggtgcsagcctgtaatcttagctacccggggcgctgaggaggaagaatcgcctgaacccaggaggccgaggttacagtgagctaagatcacaccactgcactccagcctgggcaacagagcaagattccgtctcaaaaaaataaataaaaccaaataaataaaatcacctgggccgggcatggtggctctggtctataatcccagtactttgggaggccaaggtagctggaccccttgagcctaggagctcgagaccagcgtgggcaacatgggctacccagcaacattttgcgtctacaaaaatactgaatttacctggatgtggtggcaaatgcctgtaggctgaggtgggcggattgcttaagcccaggtggttggggctgtgccactacactccagcctgggcatcagggtgagaccctatctcaaaaaaaaaaaaaaagaggaaaagtcattaggtcaatgaaaattgattatctggtcaggcrtggtggctcacacctgtaatcccagcactttgggaggctgagacgggcagatcacctgacgtcaggagttccagaccaccctggctaacaaggtgaaaccccttctctactaaaaacaaaaataagccaggcatgggtgacatgctcctgtaatcccagctattcaggaggctgaagcaggagaatcgcttggacccaggaggcagaagttgcaatgagctgagaccacgccactgcactccagcctaggcaacagagcaagactccgtctcaaaaaagaaaaaggccgggtgcggttgctcacgcctgtaatcccagcactttgggaggccaaggcaggtggatcacctgaggtcaggagttccaagaccagcctggccaacatggtgaaaccctgtctctactaaaaattacaaaaattagctgggcgtggtggcgggcgcctgtaatcccagctacttgggaggctgaggcaggagaatcgcttggacccgggaggcagaggttgcagtgagcccagattgcaccattgcacaacagcctgggagacaagagcaaaactccgtctcaacaacaaaaaaaaacagaatgaaagaaaattgattatctacatttgctggatactgtgcctgaagctgggacaagacaaatcaagtcactcccctckgtggtctactggaggtcaggggtcagacactgaggttgcgctcaaggttcaaaggactgtttagagcccaaggttaagtatttgaggtcaagactgaggtgaaaggttcatggggaaagatttgcagagatcgagtgtcaaaagtgagtcccaggattaacagggtgagttgcacgagctgggctttgggttaaggaagggctgaatgaatgtcccagtgcaatatggcctcaggggacaaggagtgaggtggcatcttgttggcatggggagagagcggtcaggattttggggtcaagagcagattggtaatctgtgtcgtgcgtaggaagtgatcttgagttcctgtmctctctctacctccaggaaatgcctcgataccatgagctgcccaccttggaagaacggtcaggacccttgcaccctggagccacaagcctggggtcccccatcccggtgcctccagggccacctgctgtggaagacgtttccctggatctagaggatgaggagggggaggaggaggaagagtatctggacaagatcaaccccatctatgatgctctgtcctatagcagcccctctgattcctaccagggcaaaggctttgtcatgtcccgggccatgtatgtgtgagctgccatgcgcctggcgtctcacatctcacctgttgatcccttagctttcttgccaaggatctagtgccccctgacctctggccaggccactgtcagttaacacatatgcattccatttgtgatgtctaccttggtggctccactatgacccctaacccatgagcccagagaaattcaccgtgataatggaatcctggcaaccttatctcatgaggcaggaggtggggaaggtgcttctgcacaacctctgatcccaaggactcctctcccagactgtgaccttagaccatacctctcaccccccaatgcctcgactcccccaaaatcacaaayaagaccctagacctataatttgtcttcaggtagtaaattcccaataggtctgctggagtgggcgctgagggctccctgctgctcagacctgagccctccaggcagcagggtcccacttaccccctccccaccctgttccccaaaggtgggaaagaggggattccccagcccaaggcagggttttcccagcaccctcctgtaagcagaagtctcagggtccagacccttccctgagcccccacccccaccccaattcctgcctaccaagcaagcagccccagcctagggtcagacagggtgagcctcatacagactgtgccttgatggccccagccttgggagaagaatttactgttaacctggaagactactgaatcattttacccttgcccagtggaataggacctaaacatcccccttccggggaaagtgggtcatytgaattgggggyagcaattgatactgttttgtaaactacatttcctacaaaatatgaatttatactttgaccaggtcttgccttttctgtgggatgtgaaggggatggggtgagacatgaaggggaatgaggaaggagtctaagggcttgagagaatcagtgaactggggtcaagagagttaaagacaaaaacaaagggaccaaagatacaaaataagaattgagagagtaatgagcaaaaatgtatcaatcaaaaacaaaattttttttttttttgaggcggagtctcgctctgtcgcccaggctggagtgcagtggcatgatctcggctcactgcaagctccaccttctgagttaacgccattcctctgcctcagcctcccgagtagctgggactacaggcgcccaccaccacgcccggcttattttttgtatttttagtagagacggggtttcaccgcgttagccaagatggtctcgatctcctgacctcgtgatccacccgtctcggcctcccaaagtgctgggattacaggcgtgagccactgcgcccagccctaaaaacagaatgttgagtaatggaatggggaggggtccagggcatgctgtttaatgaacattcataattgcaacagcagtatgatgaatgggacaaagayaaaaatagcaattggccagatgcagtggctcattcctgtaattccagcacttcgggaaactgaggcgggaagctcgactgagtccaggagttaagagaccagcctgggaaacacagtgagaccccgcctctacgaaagttagccgggcgtggtggcacgcacctgtagttcagctactctggaggctgaggtaggaggatcgattgaggccagaagttcaaggctgcagtaagctatgatggcgccactgcactccagcctgagtgacagagtccaaccttgtctttaaaaaaataaaaattaaaaaagcagtaacgaaagtataagaggctcaagtttaatgaataaacggcaagtaaaagtagactaaaggcaaaatcatgaataatgttgtaataggagcccaaggcatgacggataataaacctgaatgaatgggccagaggcagagtgatgaataatggaaaaatagggaccgggggcaagggaggtaacggacaggagttcatggatccaaaacatgatggctaartagagaagggccggaagaacgacgaaagtgagcaggcaggctggagctaaaagtagtctgggcaatgaagctcaaatgaatggggcagaggcatgatgggtaatgggagaggaatgaatgggccaaagatagaagccgcagtgacgcgaggaacaagaggcatgatgggtaacgaaaggggtgggtctaaggcaactgtttcgctaagaggtgatgagggcattgtgygtaacgaggagcagcgcagggttcgcagaacagattagaattctcccgaggcactctgggaagggccagcacttccggttttaggtcggctactccgaaccagaggtggggtgggggcccggctgccgcggtgcctggtggyacgcgaggcctgaccttgctgcctagccgcctctgccgcgcaacccacctttacctgtccttcgaccctggaacgttagccaatgagagtaccaagctgatacgccaccaaggtcgaccccgtacacgctggagccaatcaaaatgctgcaagggtcaaagccgaccaattatcacagcaacctcgccgcggggcggaatcaaaagagggcctcctccaggagagaggcggggcgatgcctcagcgggcgtggcaaaatgctcagcacagaccaatggcgggttagcaccggaacccgcggcsacgcgagccaataggcgcaggcgctgcgagccaatgggaaggytgggaggggcgccgtggctaccctgcgagtgagaaccaatacaaaaggacatttcagggaaagtgggcggractttatgcacaagtccaatgggaagaccgagtcttgacgctggtgggcgggcctcagggcacactaaaccaatgggctaggtggggcggggcgacggtggtggcggcggcggcagcgggttcggttgcgcgtggcgcacggggtgggagcggagcccaggccgggagcaggcgccgccgccagtgagaaccggggccggagccgggtgcggatttgctggggctgagtcgggggcgcgcgggccctgacctctgccctctgacctctcccctagcaggcgaccatggtgaacgtgttggctgccagctcgccgcccgcagggccgccaccsccgcctgcgccggccctcgtggggctgccgccacctccgcmctcgccgccgggcttcacgctgccgccgctgggaggcagcctgggcgccggcaccagtacgagtcgaagttcggaacggacccccggggctgcaaccgccagcgcctcaggggccgccgaggatggggcctgcggctgcctgcccaacccgggcacattcgaggagtgcsaccggaagtgcaagggtgaggggcgaggggcccccgckgggctgcgatggcctggatctcgggggaagggggaggacactggggactctgggatttggcgcgcaccattggaattatttaacagcactaggaggtgatgttgggatcgaatggtgkaacgttggacttggggcttagaatgatggaatcaaatgctggaaacgggatggaatgtcatagcagtagagaaaagcctttagggacctgaggagccccgggatcagccaagccagacttctcttgtgatcgggaaggcaactgaggcccaaggtcacggtgtcagcaaggtgtcagcraggttccttgggtatgggacccaaagcctccggatcccagcctggagcaattagagtagtagtrgtggtggagatttatggagttctgttctggtgttcattatacgttaactcattagatccttgggacaattctgtgtggtgagggtcccatctttcagatgatgagtttgacctaaagttgctcagcttggtggcagtgagatttgagcaagcaaaggccctggccctgtctaactaggctgtactgcctctttacaggtggaatcctttgtgagatgttctgctgtgggtctctggagagagctgggggtggtagggaaggaagagatgagagttggtgtggggttggrgtggagtgtgacagcgtttctcttctccagagctgttwcccattcagatggagggtgtcaagctcacagtcaacaaagggttgagtaaccatttycaggtgagccttcctggtgtccttacccaccagagatcgtccccgccgtccccctccctgcatstgcacactcggcccaattactcctccctcaagagctgggctccctgatacttgaaaagactcggaratatagtgccagactgactactcagtttggggacctagaatccagaggtactgtctccccatagsagctaggctggagtgaaggaacaggtctgtgggcctaccggcagcacctcctttctctgagtctcttagtcaggccgtgcctcccagtcttcatcccctgcccagcccagagaccttgtccttgccctcttcagtgggcaagcctatctgtccagtatcgtcacagctctcgctttccttccaggtcaaccacacagtagccctcagcacaatcggggagtccaactaccacttyggggtcacatatgtggggacaaagcagctgagtcccacagaggtgagcttcctttttcatccattcattgtatcyttctaataacaaatttgtagccaaatgtcargctaagacggcctcatcaggaaaagrtcacagctaccgagagcctggagatggggatygcatctctccgaggtgcactgggacacaaataattccttcatccagcaaacatccgccaaacccrtgctctctgcctggccccatgctgagcagtgctggggatgtggccacagccaccctgtcaccagacagcgatgacccagggtggaaagggctggactgtagatcatgcakaactttgaatgccagactaggctttggactttctctagggggttgtggagagtcatggcatggtttggtcaagggaaagacgtggtccacaggttcccgctgtagaaatctctggggcatctctggggtggccatgtgggggctagttattaggaagggcaaayrtggaggcccagacagggttgggggkactgaatgaggtctctgcttctgtcatttcccttcagcaaatgtgtttattctgcaaaccttcattgcacaacacattctgtgcccagccctgtgctggcacacatgactgaaacagcatgggactcacccgtggggcaggggacagactgttcccagagagtaacaagccaggatgggcaaggmtgacatgggggaacccaaaggtcggggagcctaactcagcytaggtggtcagagagcacttcgtggaggaggggacccccatccgaggctttctgaccctaggcttctcaccccggcccatctcacatacttgcacagtgcaccacctctgaccccttccgttctctctgcctcacaggcgttccctgtactggtgggtgacatggacaacagtggcagtctcaacgctcaggtcattcaccagctgggccccggtctcaggtccaagatggccatccaggtgagtggggcacggaggctgctgctcccctcggccaccgtgagcagggagccgccctcacaccccctcctctccacagacccagcagtcraagtttgtgaactggcaggtggacggggagtatcggggctctgacttcacagcagccgtcaccctggggaacccagacgtcctcgtgggtycaggtaagaggcggagggcttggagggtggtcacaaractgcagttctggctttgccagcaaatccaccccatttgtgaacctccttttctgccactggagaagtggctcagcaggagtgattttgkaacatcaggcaacatactacagtgggtgagacggtcacccactgaccatkagtgggtgagtcagmgcagtcttttttttttttttttttgagatggagtcttgctttatcacccaggttggagtgccgtggcacgatcttggctcactgcaacctccatctcctgggttcatgcaattctcctgcctcagcctcccgagtagctgggattacaggcatgcgctaccacgcctggctaatttttgtatttttagtagagacagsgtttcaccacattggtcaggctggtcttgaactcctgacctcaagggatccacccacctcagcctcccaaagtgctgggattacaggtgtgagccaccacgcccagccagtcagcgcaattttaactgagattttcttttgtattaaaaaatgttttaagatggggtcttgctgtattggccaggctggtcttggaactcctggcttcaagcartcctcccaccttgaccttccaaagtgctgggatgacaggcgtgagccacctcgcctggccagggaaacagcttttcagcckgcaagtagtgcagtcgggactcgtgaaaggaacttgagggaggatggtcccctggttgcataaggctttgcagagccttggccttcgctctgagtgagtctggggctttcggaaaccaaggcatagcttctcacaggaccctgcagctggcgtagagagcagactccaaagggggtaccactgggagggagtggacggygrgaggaggttggattctggatgttgtttgaaggcagagctgccaggatttgttgagacyggatggaggcgatgactctgtagtttttggctggaactggaaggatggagtttcrgattgccagctttgdgtctttgtgcagccatccactgtgtcgtggagagcaggctcttgagcgctgagtcctttgtgaatgactcgtgcaggcggggaggggagctagggttggccttggacccctgggagtgccsagggagagtcrccacttctcgctgcaggagcccagggagactcaaaagtgttgacttttgagctgccagaggaggagaaggggctaccccggctgggggacaggagcaagaagattccaggcagggagaagcaggaacaggggtgagggaagggaagggccatggcagaaaacccagsagacagggaagctggaggtgcagcaggtgcagagaggcctcctaggtgaggctgatctgtaggggccccatgaggaagaaacmtttcctgtccccaactcacctggtgacatcaccccatcttctcatacactacagttgaaccacatgagccttttttgttggtttgtttttgtttttgagayggagtcttgctctgttgcccaggctggagtgctgtggtgcaatctcggctcactgcaacctctgcctccctggttcaagcgattctcctgcctcaggctccctagtatccctagtagctgggactacaggcgcgcgccaccatgcctggctaatttttgtatttttagtagagacaggttttcgccatgtcggccaggctgatctcgaacttcttacctcaagtgatccacccgccccggcctcccaaagtgctgggattacaggtgtgagccaccgcgcccggccgaccatgcaagcttttctgacggttcctgaaaccaccgagttggttctaccccaggaccgacgcacactctgtccctgctgcatggaattcttccctctggtcttgacatgactgggaaggcttgcgtgcgcatgtcgccctctgtcgtccaccattgtccccatcttgcaaggccaagaggaggttctccactaagggcacatggccagtgggactccagtgtccctgctcttcacggcgccagcaaccccgttccctgtgccgcctcgctcgcctggtcctttcgtgctccccagcactggcctcctggagcccagggccaccagtgacgctttggtctctagtcctttccagtgcctcttccttcccccagacaccagtgagaayagggcctgccgtgtgccggtcagggctgagctctcgagtctcttgccaccaacagctrcgacttgacccagggtgtctctacctccaggcggctctgtgacctccggcaagtggttccagcccttctgggcttcagtctcctyatctgtcacttgggcacaatagaagcaactacctcccagtgaaggagtccatgagaggscccgacttctcggcctcagcactgggccacatgcacagtcaccacttgctccactctggcatctccatggggacaatgcccgcaggcacccccatttcacagataaggaaagcgaggcccaggggtgayatcagttgcccagggtgacacagccaggaagcagaggagctgggatttgaatggaagcttaattcaggagcccgtgagcctccccagcccctcccaatggtgacagctccttttctgcttcactctgagcacctcatgtgtgcccagccctgggctgggacacagcagtgaccgagacagcccattcctgcccmcatgggggtcccaggtcaggcacagtggctcacacctgtaatcccagcactttgggaggctgaggtgggcggatcgcttgagatcgggagttcaagatcagcctgggcaacatagcaataccctgtctctacaaaaaaaattagaaattaggcatatggtggtacatgcctgtagtcccaactactggggacgctgagctggcaggrcacatgcctatagtcccagctacttgggagcctgggaagggggagtggttctattctgaagctgaggccaagccatccaaggccttgcaggtgtgctgaggaacccatatcttctcagggcacgagggagccatggcaggttctgggcagggggtcaacagggtcaggtttgtgctttaacatgatccctctgtctgctgtctgtgaggtcacttgaagttggggcatgagactagagaggaggctgtgggtagagaaactgggggggtggcccaggagatgggaaggatggttagaaagatacttgagggtctcatggcctcagttccaacagtccctggaactcagaggccagagattctaagtcactcactctagatggctgcttttccctctggncttcagtctcccccttgattgaatgaggggataacactgaccagagtggtaatggtagtgattttttttttcttttcttcccctgccccacctcacatacctctgccctgagacgcagtctctgttgcccaggccagagtgcamtggcacagkgtcagctcacctcaacctccaccttctgggttcaagtgattctcctgtctcagcctcccaagtagctgggattacaggcacgcactgccacacccggctaatttttgtatttttgcgtcgtggcacatgcgtgtaatcccaggtactcgggaggctgaggcaggagagtcgcttgaacccgggaggcagaggttgcagtgagccgagatgacgcctttgcactccagcctgggcaacaagagcaaaacgccccatctcaaaaaaaaaaaaaaaagagagagagagggagagatgggggtctcgccatgttgccccagctggtctcagactcctgggctcaaacaaccctcctgcctcagcctcccaaagtgccaggattacaggcgtgagctactgtgccccgcccgtgtgatggtgattcaacaaccagtggggggttcggggattcatttgcttcatctcctctgggaaggagagtcacacagtcgcttgcccgagcccatgggyaccagctgcagcctacttctgatctcagcctccccagaagatgccaccagggcactggccatgaactcacggcctctctcacacccaccaggctcatcttgggggttgccgcctaacactcagcccctctgagagctccacccagccatgcctgcaggtatgaaaggcccctattcctgcagctccagagagctggctccaggrtggctccatgctagcaggccagcctgctcccactgtggggcccctagtctgcccctctggtcatcttggtctgggaagcatcttcgcacctgctttgctctgtgctgtctcagcttctctgtgtgccctcagtctcgtggcccccaacctcccttcccttctccacgtgtcttcctctccrgggctgcaccctaggagattgctcgatcgtggtggatttctcaactgtgaatcttcagtccctcttcccccttcatttctgtctctgcagatgtgttgtttctttttttttttttcttttttttttttttttgkctttttgagatgaagtcttgcactgtctcccaggctggagtgcagtggcacaatcacaatctcagcttactgcaacttccgcctcccgggttcaagcgatyctcctgcctcagcctcctgagtagctgggactacaggtgtgcaccaccacactcagctaatgtttgtatttttagtagagacagggtttcaccatgttggccaggctggtctcgaacctccgacctcagacgatccacccacctcagcctcccaaagtgctggaattacaggtgtgagccaccgtgcccagcctctttttttctttaaaaattttttaggccgggcgcggtggctcatgcttgtaatcccagcactttgggaggccgaggcaggcggatcacgaggtcaggagatcgagaccacggtgaaaccccttctctactaaaaatacaaaaaattagccaggcatggtggcgggctcctgtagtcccagctactcggagaggctgaggcaggagaatggcgtgaacccgggaggtggagcttgcagtgagccgagatagtgccactgcactccagcctgggygacagagcgagactccatctcaaaaaaaaaaaaaaaaaattaaatttcttattttttgaaacaggatctctgttgcccacgttggagtgcagtggcgtgatyatagctyagtgtaaccttgaccttctgagctcaagtgatcctcctgcctcagcctcccaagtagctgggactataagcatgtgcmatcatgcctggctacgtttttaaatttatttatytgttgtttgtttgcttattgggacagattctcactctgtcactcaggctggagtgcagtggcactatcatggctcactgcagcctccacctcctgggcttaagcaatcctcccacgtccacccccttastacctgggactacaggtgtgcaccacctcacccarctaatttttgtattcgctatgtttcccaagctggtttcgaattcctgggctcaaatgaacccactttggcctcccaaactgctgggattacaacaagcatgagccactgtgcctggccttgattttttttttttmttatgataatctgtagttagatgaagtttttaaattttttgtagagatggggtctcactatgtcacctaggcttgtctccaactgctgacctcaagctgtcctcttgccccagccctccaaagcattgggattactggcatgagccatwgcatctggctttttttttttttttgagatggggtctcaccatgttgcccgggctggcttygaatgcctaggctcaagcaatcctcccttctcagcctcccaaatagctgggattacaggcacgtgccaccacgccaggcdtgttttctttccctgtccctccctctctatttcccactctcttcctccccaattcttctggccctataaaatcacatttgtggcctgtaccctgctagyctcgaaagacaccaaagtgaatccatctccatcctgaggcttgaaaaggcagcccaaaggtggcagttctcttgttcagcaagcactccctacggtggagggacacaggaacgyagacttggacctcagtgcagcaagtcccrgccacagctgagcactcgattcctcacaaccccaagaggcagttaggttcacagagagatgatgccagcgtccatggtcaccagccagcctgtggcagggctgggattcgaacccaggctgtgcatatttacccactctacccaatggcctctcagcagcagagtggctcagagcctgggtttgggaggtgtggaggcttggattctgcccttgacacattttgtgagcatgagtgagtgacttaccctgtaagcttctataagtggtggtgaccccctctgtaagtyggggtggataaatgctgaccacatgggcttgtgtcgaccagatgaggtccttcaggtaatgcagtcatagcagggcctgggacgctgacctcagcggtagggaacccctgggcgatgggttaggagaarggagcccttgagggaggcctgagagcaagcccaagcctccagccggggtgagcctagagggcttcytggaggtggagtctagcctggcactcagggtgggtggaaactgatcgtcattttgcccacaggaatcctcgtagcccactacctccagagratcacgccttgcctggccctgggtrgagagctggtctaccaccggcggcctggagaggagggcactgtcatgtctctagctgggaaatacacatgtgagcctggcgcctgggtccgagggtggaggggctgggcccctggactcctkctgggtctgagggaggacgggctagggccctggacactcaggtctgagggaggaggcctgggttcccagatgcccaaatccccttggtaatgagaccccgcctccaccccactctctgacagtgaacaactggttggcaacggtaacgttgggccaggcgggcatgcacgcaacatactaccacaaagccagtgaccaggtgagtgggtgcagggactagctggtgctgccaggggctgctgggcctggaagtccaggtggggccactngctaattctcatgtgttgctccggcccctccagctgcaggtgggtgtggagtttgaggccagcacaaggatgcaggacaccagcgtctccttcgggtaccagctggacctgcccaaggccaacctcctcttcaaaggtaaaggtctckgttcccctacgcgggaaacaggcaggaggtgactcaactctgagtggatgtgtgggccaccacaggtgctggaggacagtgtgctgccaccctgtgggcctccacattaccrgggaacacttgttaaaaggtaggtggggccgggtgcggtggctcacgcctgtaatcccagcactttgggaggccaaggcgggccgaggtaaggagattgagaccatcctggctaacacggtgaaactccgtctctactaaaaatacaaaaacaaaattagccgggtgtggttgcgggtgcctatagtcccaactactgaggctgaggcgggaaaatggtatgaacccaggaggcggagcttgcggtgagccgagatcgtgccaccgcactccagcctgggygacagagcaagactccatctcaaaaaaaaaaaagtaggtggacaaccctctactatgttttatgcttggaaaaaaaaagtaggtagagcrgccaggcgtggtgactcacgcctgtaatcccagcattttgggaggccaagccaggtagaatacttgaggccaggagttggagaccagcctggccaacgtggtgaaatcccctctctactaaaagtacaaaaattagccaggtgtggtagcgtgctgcaactgtagtccccgctacttaggaggctgaggcacaagaatcacttgaacctgggaggcggaggttgcagggagttgagactgcaccactgcactccagcctgggtgacagagtgagactccatctccaaaaaaaataaaatgaaataaataaataaatgttaaaaaaaatctggtggagcatctgatggmtgtttgggccaagctggagctttgtccatcccctcttatttttctgcacttgactctcttatttttctgagactggtctccctctgtcgcccaggctagagtgcagcagtscaactgcggctcactgcagcctccacctcccgggctcaagcagccttcccacctcagcctcctgagtagctaggaccacaggtgtatgccaccaggcccagctaatttttttgatagttttgggagacatgggggtttcaccatgttgcccaggctggtctcgaactcctggactcaagccttggcctcccaaagtgctgggattataggtgtgagccaccacacccagccagggtagaaggcactttggaagcctcgagcctgccccattcatcttacgttagtggaaactgaggcttccagaggtttcaaggtcacaactaaatccagaacctcatctcaggcacactggtcgtagtcccaatgtccagtcttaagtcttcttggatatctgtggctcacagatyttrggtgtttgagcctcctgctgagcactgctggrgccacagcggtgaccagccctgtcttcacgggactcagtgagaggaacagattcatccgcagagtgggcaggactaggttgggggaacccaggggtctagagggcttttcagagggcaggggtcactgagcggagagcagaggaggagtgagccatttgctccagcgtgaagttgttggtgtgatggggtttcagggtggcaggmgcwgtgtggttaaaggyctggaagctgtcggcatgtggctggtatccaaggtggccaggaactctgcatggatatggtgggaagctggcacgcctctcacctcagctcttccctgcaggctctgtggatagcaactggatcgtgggtgccacgctggagaagaagctcccacccctgcccctgacactggcccttggggccttcctgaatcaccgckagaacaagtttcagtgtggctttggcctcaccatcggctgagccctcctggcccccgccttccacgcccttccgattccacctccrcctccacctccccctgccacagaggggagacctgagcccccctcccttccctccccccttgggggtcgggggggacattggaaaggagggaccccgccaccccagcagctgaggaggggattctggaactgaatggcgcttcgggattctgagtagcaggggcagcatgcccagtgggcctggggtcccgggagggattccrgaattgaggggcacrcaggattytgaycaccaggggcagaggcggccagacracctcagggaggagtgtcctggcgtccccatcctccaaagggcctgggcccgccccgagggggcagcgagagsagcttmcccatccckrgtcagtccaccctgccccgtccactttccyktctcctcggtataaatcatgtttataagttatggaagaaccgggacattttacagaaaaaaaacaaaaaacaacaaaaaatatacgtgggaaaaaaaacgatgggaggcctccgttttctcaagtgtgtctggcctgttttgagcatttcatccggagtctggccgccctgaccttcccccagccgcctgcagggggcgccagagggccggagcacggaaagcagcggatccttgatgctgccttaagtccggctcagaggggcgcagcgtgrcctggggtcgcyatcttcccatccggaacatctgccctgctgggggacactacgggccttcccttgcctgagggtagggtctcaaggtcacttgcccccagcttgacctggccggagtggctatagaggartttgtccctgcagactgcagcagcagagatgacactgtctctgagtgcagagatgggggcagggagctgggagagggttcaagctactggaacagcttcayaacaactagggtactaggaactgctgtgtcagggagaaggggctcaaggactcgcaggcctgggassaggggcctaggccagccatkggagttgggtcacctgtgtctgargacttggtgctgtctggattttgccaacctagggctggggtyagctgatgcccaccacgactcccgagcctccaggaactgaaaccctgtctgcccccagggtctggggaaggaggctgctgagtagaaccaaccccaggttaccaaccccacctcagccaccccttgcragccaaagcaaacaggcccggccyggcactgggggttccttctcgaaccaggagttcagcctcccctgacccgcagaatcttctgatcscacccgctccaggagcckggaatgagtcccagtctctcccagttktcactgtgtggttttgccattcrtcttgctgctgaaccacgggtttctcctctgaaacatctgggatttataacagggcttaggaaagtgacagcgtctgagcgttcactrtggcctgtccattgctagccctaacataggaccgctgtgtgccagggctgtcctccatgctcaatacacgttagcttgtcaccaaacatacccgtgccgctgctttcccagtctgatgagcaaaggaacttgatgctcagagaggacaagtcatttgcccaaggtcacacagctggcaactggcagagccaggattcacgycctggcaatttgactccagaatcctaaccttaacccagaagcacggcttcaagcccctggaaaccacaatacctgtggcagccagggggaggtgctggaatctcatttcacatgtggggagggggctcccctgtgctcaaggtcacaaccaaagaggaagctgtgattaaaacccaggtcccatttgcaaagcctcgacttttagcaggtgcatcatactgttcccacccctccyatcscactwrtgtccagccgcctagccccacttkcttttttttctttttttgagacagtctccctcttgctgaggctggagtgcagtggcgagatctcggctcactgtaacctccgcctcccgggttcaagcgattctcctgcctcagcctcccaagtagctrggattacaggcgcccgccaccacgcctggctaacttttgtatttttagtagagatggggtttcaccatgttggccaggctggtctcaawctcctgaccttaagtgattcgcccactgtggcctyccaaagtgctgggattacaggcgtgagcyaccgcccccagcccctcccatcccacttctgtccagccccctagccctactttctttctgggatccaggagtccagatccccagccccctctccagattacattcatccaggcacaggaaaggacagggtcaggaaaggaggactctyggcggcagcctccacattccccttccacgcttggcccccagaatggaggagggtgtctgkrttactgggcgaggtgtcctcccttcctggggactgtggggggtggtcaaaagacctctatgccccacctccttcctccctctgccctgctgtgcctggggcagggggagaacagcccacctcgtgactgggggctggcccagcccgccctatccctgggggagggggcgggacagggggagccctataattggacaagtctgggatccttgagtcctactragccccagcggaggtgaaggacgtccttccccaggagccggtgagaagcgcagtygggggcacggggaygagctcaggggcctctagaaagagctgggaccctgggaasccctggcctccaggtagtctcaggagagctactcggggtcgggcttggggagaggaggagcgggggtgaggcaagcagcaggggactggacctgggaagggctgggcagcagagamgacccgacccgctagyaggtggggtggggagkgcagctggactgggatgtaagccatagcaggactccacgagttgtcactatcatttatcgagcacctactgggtgtccccagtgtcctcagatctccataactggggagccaggggcagcgacacggtagctagccgtcgattggagaactttaaaatsaggactgaattagctcataaatggaacacggcgcttaactgtgaggttggarcttagaatgtgaagggagaatgaggaatgcgagactgggacwgagatggaacyggcggtggggagggggtggggggatggaatttgaaccccgggagaggaagatggaattttctatggaggccgacctggggatggggagataagagaagaccaggagggagttaaatagggaatgggttgggggcggcttggtaaatgtgctgggattaggctgttgcagataatgcaacaaggcttggaaggctaacctggggtgaggccgggttggggccgggctgggggtgggaggagtcctcactggcggttgattgacagtttctccttccccagactggccaatcacaggcaggaagatgaaggttctgtgggctgcyttgctggtcacattcctggcaggtatgggggcggggcttgctcggttccccccgctcctccccctctcatcctcacctcaacctcctggccccattcagrcagaccctgggccccctcttctgaggcttctgtgctgcttcctggctctgaacagcgatttgacgctctctgggcctcggtttcccccatccttgagataggagttagaagttgttttgwtgktgttgtttgttgttgttgttttgtttttttgagatgaagtctcgctctgtcgcccaggctggagtgcagtggcgggatctcggctcactgcyagctccgcctcccaggtccacgccattctcctgcctcagcctcccaagtagctgggactacaggcacatgccarcacacccgactaacttttttgtattttcagtagagacggggtttcaccatgttggccaggctggtctggaactcctgacctcaggtgatctgcccgtttcgatctcccayagtgctgggattacaggcgtgagccaccgcacctggctgggarttagaggtttctaatgcattgcaggcagatagtgaataccagacacggggcagctgtgatctttattctccatcacccccacacagccctgcctggggcacacaaggacactcaatacatgcttttccgctgggcgcggtggctcacccctgtaatcccagcactttgggaggccaaggtgggaggatcacttgagcccaggagttcaacaccagcctgggcaacatagtgagaccctgtctctactaaaaatacaaaaattagccaggcatggtgccacacacctgtgctctcagctactcaggaggctgaggcaggaggatcgcttgagcccagaaggtcaaggttgcartgaaccatgttcaggccgctgcactccagcctgggtgacagagcaagaccctgtttataaatacataatgctttccaagtgattaaaccgactcccccctcaccctgcccaccakggctccaaagaagcatttgtggagcaccttctgtgtgcccctaggtactagatgcctggacggggtcagaaggaccctgacccaccttgaacttyttccacacaggatgccaggccaaggtggagcaagcggtggagacagagccggagcccragctgcgccagcagaccgagtgrcagagcggccagygctgggaacyggcactgggtcgcttttgggattacctgcgctgggtgcagacactgtctgagcaggtgcaggaggagctgctcagctcccaggtcacccaggaactgaggtgagtgtccccatcctggcccttgaccctcctggtgggcggctataccyccccaggtccaggtttcattctgcccctgtcgctaagtcttggggggcctgggtctctgctggttctagcttcctcttcccatttctgactcctggctttagctctctggaattctctctctcagctttgtctctctctcttcccttctgactcagtctctcacactcgtcctggctctgtctctgtccttccctagctcttttatatagagacagagagatggggtctcactgtgttgcccaggctggtcttgaacttctgggctcaagcgatcctcccgcctcggcctcccaaagtgctgggattagaggcatgagccaccttgcccggcctcctagctccttcttcgtctctgcctctgccctctgcatctgctctctgcatctgtctctgtctccttctctcggcctctgcccsgttccttctctccctcttgggtctctctggctcatccccatctcgcccgccccatcccagcccttctccccgcctcccactgtgcgacaccctcccgccctctcggccgcagggcgctgatggacgagaccatgaaggagttgaaggcctacaaatcggaactggaggaacaactgaccccggtggcggaggagacgcgggcacggctgtccaaggagctgcaggcggcgcaggcccggctgggcgcggacatggaggacgtgygcggccgcctggtgcagtaccgcggcgaggtgcaggccatgctcgrccagagcaccgaggagctgcgggtghrcctcgcctcccacctgykcaagctgystvagcggctcctccgcgatgccgatgacctgcagaagygcctggcagtgtaccaggccggggcccgcgagggcgccgagcgcggcctcagcgccatccgcgagygcctggggcccctggtggaasagggccgcgtgcgggccgccactgtgggctccctggcyggccagccgctacaggagcgggcccaggcctrgggcgagcggctgcgcgcgcggatggaggagatgggcagccggacccgcgacygcctggacgaggtgaaggagcaggtggcgmaggtgcgcgccaagctgraggagcaggcccagcagatacgcctgcaggccgaggccttccaggcccgcctcaagagctggttcgagcccctggtggaagacatgcagcgccagtgggccgggctggtggagaaggtgcaggctgccgtgggcaccagcgccgcccctgtgcccagcgacaatcactgaacgccgaagcctgcagccatgcgaccccacgccaccccgtgcctcctgcctccgcgcagcctgcagcgggagaccctgtccccgccccagccgtcctcctggggtggaccctagtttaataaagattcaccaagtttcacgcatctgctggcctccccctgtgatttcctctaagccccagcctcagtttctctttctgcccacatactggccacacaattctcagccccctcctctccatctgtgtctgtgtgtatctttctctctgcccttttttttttttttagacggagtctggctctgtcacccaggctagagtgcagtggcacgatcttggctcactgcaacctctgcctcttgggttcaagcgattctgctgcctcagtagctgggattacaggctcacaccaccacacccggctaatttttgtatttttagtagagacgagctttcaccatgttggccaggcaggtctcaaactcctgaccaagtgatccacccgccggcctcccaaagtgctgagattacaggcctgagccaccwtgcccggcctctgcccctctttcttttttagggggcagggaaaggtctcaccctgtcacccgccatcacagctcactgcagcctccacctcctggactcaagtgataagtgatcctcccgcctcagcctttccagtagctgagactacaggcgcataccactaggattaatttggggggggkgtggtgtgtgtggagatggggtctggctttgttggccaggctgatgtggaattcctgggctcaagcgatactcccaccttggcctcctgagtagctgagactactggctagcaccaccacacccagcttttyattattatttgtagagacaaggtctcaatatgttgcccaggctagtctcaaacccctgggctcaagagatcctccgccatcggcctcccaaagtgctgggattccaggcatggggctccgagcccggcctgcccaacttaataatacrtgttcctcagagttgcaactccaaatgacctgagattggtgcctttattctaagctattttcattttttttctgctgtcattattctcccccttctctcctccagtcttatctgatatctgcctccttcccacccaccctgcaccccatcccacccctctgtctctccctgttctcctcaggagactctggcttcctgttttcctccacttctatcttttatctctccctcctacggtttcttttctttctccccggcctgcttgtttctcccccaacccccttcatctggatttcttcttctgccattcagtttggtttgrgctctctgcttctccggttccctctgagctagctgtcycttcacccactgtgaactgggtttccctgcccaaccctcattctctttctttctttctttttttttttttttttttttttttttgagacagagtcttgctctgttgcccagcctggagtgcagtggtgcaatcttggttcactgcaacctccacttcccagattcaagcaattctcctgcctcagcctccagagtagctgggattacaggcgtgtcccaccacacccgactaatttttgtatttttggtagagacaaggcttcggcattgttggccaggcaggtctcgaactcctgacctcaagtaatctgrctgcctcaccctcccaaagtgctgggattacaggcatgagccacctcacccggaccatccctcattctccatcctttcctccagttgtgatgtctacccctcatgtttcccaacaagcctactgggtgctgaatccaggctgggaagagaagggagcggctcttctgtcggagtctgcaccaggcccatgctgagacgagagctggcgctcagagaggggaagcttggatggaagcccaggagccgccggcactctcttcycctcccaccccctcagttctcagagacggggaggagggttcccaccaacgggggacaggctgagacttgagcttgtatctcctgggccagctgcaacatctgcttgtccctctgcccatcttggctcctgcacaccctgaacttggtgctttccctggcactgctctgatcacccacgtggaggcagcacccctcccctggagatgactcaccagggctgagtgaggaggggaagggtcagtgtgctcacaggcagggggcctggtctgctgggcctgctgctgattcaccgtatgtccaggagctggagcagcaccctctcagagcctcagtttccccagatgtcaatgagagaatcagcatcagcckcatctcccacctgaagaatcgaaccttgagttctcacctttaagaatttttttttttttttgagacagtgccttgctcagtcgaccacgctggagtgcagtagcacgatcatcaatcactgcagcctccaactcaagcaaccctcctgcctcaacctcctgagtagctggggccacaggcacccaccaccatgcctggctaattctttcttttttgagatggagtctcactctgtcgcccaggctggagtgcagtggcaccatcttggctcaccgcaacctctgccccccgggttcaagcaattctcctgcctcagcctcctgagtagctagaattacaggcgcacaccaccacaccaggctaatttttgtatttttagtagaaacgaggtttcaccacggtggtcaggttggtctcaaactcctgacatcaggtgatccacccgcctcggcctcccaaagcactgggattacaggagtgagccaccatgcctggccatattttaaacttttttgtagagatggggtcttactatgttgcccaggctgatctcaaactcttgggctcaagcagatcctcctgccaaagcttcccaaagtagttggattacaggtgtgagccaccacgccccaccaacctatgaagatgtctaagcagacagggtgccctatctcaccacatccccagtcagatccagaggtgggacaaggatgggaaggaggttccagaacaaaggctggcagggagtcgtatgggacaggagctgacccagcaaccatccacagagacatcctggagcctgggaaggagaaggacaaaragcccccttttttaaattttttttatgtttttgagacggagtctcactctgtcacccaagctggagtgcagtrgcacaatcttggctcactgcaacctccacctcatgggttcaaacgactctcctgcctcagcctcctgagtagctgggaccacaggtgcacaccaccatgcctggataatttttgaatttttggtagagacggagtttcaccatgttggccaggcaggtctcgaactcctgacctcaagtgctccgcccaccttggcctcccaaagttctgggaatacaggcktgagccactgcaaccagccagtagcccccatctttgcccctcgctgagccctactggatgttcttggttatgcgacagtttccccatctattaaagagaaacccctatagcagaggggaggatgaggttggaaaagcaggagcattgttatgctattcttgtggggtctgggaagcagacatctgggtggatgtttggggggtgctgggcttagttggggaagtaggggggcccctggggctkacagggactggaagctctgagctggccagagggatgttgcaatcctgccagggtcttgtctatgctgtccttttcacaaccatccccctactgccaggctgacacgtggttgcgggggcacaaggccagccaacctagagtctgaggctaggcggaggacaccctccccaccagctgccagggtcactggcggtcaaaggcagctggtggggaaggcattggactccagccttgggggacggatgtagtgatggtgggaagcaggcttggtgccaggaggggcgtcagagggtgaataaragcagatagagtgtttgggggaggtagccagccaaagggggtgaggcccggtggaagggaagaagggacatacacgcagagctttgcagctgagggttttaattttttgagatggggtctctgtcccaccaggctggagtgcagtggcacaatcacagctcactgcagcctcgaactcctgggctcaagcaatcttcctacctcagcctcttgagtagctgggactacaggcatgcgccaccacgctcggctaatttttgaayttttttgtagagatgaggtctccctatattgcccaggctggtctcgaactcccaggctcaagtgatcctccctcttcagcttcccaaagkgctgggattacaggcatgagccaccatgcctggctaatgcaggtgaggtttttgcagtgtcatccagctaaggcgacccgttcccctcccaaaaaagggagactgagaaccatgaagttaagagcccagagaatatcacggtggtctggggtgcttcaagggctggtctggaataaattggaggtggcacgcagggtaggagcgccgggccaactgggagacccagcaacataaaggaaaagttgttggggctgaggaggcttgctgagagaggggaagtgagggaaagaggtgatctagggacacggtgtgaatgagggggggatgagatcacagggttattactgggagacccctgagggaagatggccacagggacaggacaaggctgtcttcttaagggaggagaccacccctcatattgtcttatgcccaatttctgcctccaaagaaagaaaaagtaaaaactaaaaggcagaaatgaaatccacaagcagacagcccgcgccacaccctgggcctggtggttaaagattgacccctgacctaatccgttaggttatctatagattacagacattgtatagaaaagcactgtgaaaatccctattctgttttgttccgatctaattaccggtgcatgcagcccccagtcacgcatcccctgcttgttcaatcgatcacgaccctctcacgtgcacccacttagagttgtgagcccttaaaaggaacagggattgctcactcggggagctcggctcttgagacaggaatcttgcccattccccraacgaataaaccccttccbtaactcagygtctgaggaattttgtctgcggctcctcctgctacattctgagtggggaaagggactaaggtggtctgaggacccsacagagtcaggaagattgagaggtgagagtgctgaacggggaggggctttggggctaagggaagtgcccgggaccccacctgaccccaacgctcacgggacaggggcagaggagaaaaacgtgggtggacagagggaggcaggcggtcaggggaaggctcaggaggagggagatcaacatcaacctgccccgccccctccccagcctgataaaggtcctycgggcaggacaggacctcccaaccaagccctccagcaaggattcaggttggtgctgagtgcctgggagygacacccgcctmcactctgcaagaaactcaaaaagggagatgaggggatcgtgggagggaggtagggagggaggagggtgccactgatcccctgaacccctgcctctgcctccagrgtgcccctccggcctcgccatgaggctcttcctgtcrctcccggtcctggtggtggttctgtcgatcgtcttggaaggtaaaagtgggatgggagaattgcggagttggagatttggaagartgaaggtggctacaggcctggggtcccggcttagaggacctctgagagctccggggccccttctgggtcgtggttgcctcatcgtggtcgggtgggtctccaggttctcccaggctcagtcccgcaggcgccaaatctgcgcaggagagcactagcaaccgatgacgtattgaggcccacacctctgggattggytgtcctgcttcgacagccttgaaagtgggtaagctgggtrgggggctctgggagaggtcagtgctgagtaaggcaattcccagcagcttgagccccaccaggtcactccagtattccyccccattctttttttttttttttttttttctcttgagacrgagtctcgctctgtcgccgaggctggagtgcagtggcgcgatctcggctcactgcaagctccgcctccctggttcacgccattctcctgcctcagcaggactacaggcgcccgccaccgcgcccggctaattttttgtattttcagtagagacagggtttcaccgtggtctcgatctcctgacttygtgatccgcctgcctcgacctcccaaagtgctgggattacaggcgtgagccacygcgtccggccattcctccccattctaaccacatgatccccaaggatctctatccatcccggtatcccaacctaagggggttccaataacaaatttttggccgggcagggtggctcaygcctgtaatcccagcactttgggaggccgaggcgggcagatcacttgaggtcaggagttcgaaaccagcctggccaacatggtgaaacttcgtctctactaaaaatacaaaaaaattagccaggtgtggaggcacgcgcctgtagkcccagctactcgggaggctgaggcaggagaatcacttgaacccgggaggcggaggttgcagtgagccgagatcataccactgcactccagcctggctgacacagcaagactccgtctcaaaacaaaacaaaacaaaaatagctgggtgtggtggtgcacacctgtaatcccagctacttgggaggctgaggcaggagaactgcttgaacccgggaggtggtggttgcagtaggccgagatcatgccactgcactccagcttgggctacagagcaagactccatctccaaaaraaaaaaaaaaaaaacaaattttgaacccctgcccatcttcctggcaggcccagccccagcccaggggaccccagacgtctccagtgccttggataagctgaaggagtttggraacacactwgaggacaaggctcgggaactcatcagccgcatcaaacagagtgaactttctgccaagatgcggttagaacccttcccagggcacgggagagctggggtgtgtttttgggtggagccctggcagatggtccaagatgaacagattgaaaaaaaaacaagtcctggagaggctgacaacatccctctggtcacacagctagatctcaaggtgctcagacttcaaggacagtttccctgactcccatccaggccatattttaaaagatggtcttgggctgggcacggtggctcatgcttgcaatcccagcacrtagggaggccgaggtgggctgattgcctgaggtcaggagttcgagaccagtctgaccaacatggtgaaaccttgtctctactaaaaatacaaaaaaattaggcaggcatggtggcgtgcacctgtaatcccagctagtcgggaggctgaggcagyggaattgcttgaaccaggaaggtgggagttacagtgagccaacattgtgccagcctgggtgacagaaggagactctgtctcaaaaaaaaaaaaaaaaaamaaaaaamcaagatggtcttgcccaggtatggtggctcacacctgtaattccagcactatgggaggctgagatgggaggattgcttgagcccaggagttcgagaccagcctgaccaacatggcgagatcctgtctccatttaaaaaaaaaaaaaaaaagatggttttgtgaggtaatgaaaatgaaggccccaagcttggccagacctgggtccccaggctggagtagcaccccttcctgtgtgatcttgacagagggrcattactgtgagcctcagtttcctctcctataaactggtggttctacagggaagtaaaggagcaggcctacagggtgtctggtacatgtagatgctcagtatatcatgaaacccacccttgccccctttggcaagttagagagtcattcrttctttcaaaaatatttactgagcatctgctaagtgctggaaactgtttcaatgtggggaataaaacagtgaagaacgtgccgagcacggtggctcacacctgtaaccccaccactttggaaggccgaggtgggtggatcacttgaggtcaggagtgcgagaaccccgtccctaatagaaatgcaaaaaaaattagctgggcatggtggcccatgcctgtagtcccagctccttgggaggctgaggcgagaggattgcttgagcccaggagatctaggctgcagtgcgccatgtttgtgccactgcattccagcctgggtaacagaatgagaccctgtctcaacaaaaaaagaaaagaaaagagaagaaaagagaaaagaaagacagggagggagggaggaaggaagggagggagggagggaaaatagagccaggcataaacttagaaagatcgtttggaggccaggcacaatggctcacacctgtaatcccagcactttgggaggccaaggcaagcagatcaactgaggtcaggagttcgagaccagcctaacatggagaaaacccctgtctctactaaaaaaaaatacaaaaaaattagccggggcgtggtgcattccmgtagtcctagctactcgggagcctgaggcaggagaatcacttgaacccgggaggcggaggttgcagtgagccgagatcatgccactgcactccagcctgggcgacaaggcgagactccatgccaaaaaagaaaaaaaactcctygcrcggtggctcacgccagtaatcccagcactgtgggaggctgagcaggcggatcacgaggtcaggagttcgagactagcctgctcaacataatgaaaccctctctgtactaaaaatacaaaaattagctgggtgtggtggcaggcacctgtagtcccagctactcgggaggctgaggcaggagaatggcttgaacctgggaggcagaggttgcagtgagccgagacagtgccattgcactccagtccaggtgacagagcgaaactccatctcaaaaaaaaaaggaaggcattggtagcaagagatggcaggccttgaaagccaggccagggtgaagtgtttctttttttttttttttttttttctttttaaatttttttttttgagacggagtctcgctctgtcaccmaggctggattgcagtggcctgatctcggctcactgcaagttccgcctcccgggttcatgccattctcctgcctcaccctccckagtygctgggactacaygcacctgccaccacgccagctaattttttgtattcttagtagaatgtagaatttacttagtagaattttttgtattcttagccagcatggtctcgatctcctgacctggtgatccrcccgcctcggcctcccaaagtgctgggattacaggcgtgagccacggcgcccggccttattttttctttttgagatgtacccagactggagtacagtggtgcgatctcggcttactggaacctccacctcccgggttcaggcaattctcctgcctcagcctcatgagtacttggaactacaggtgtgtgacaccacacatggtattttttgtatttttagtgaagatgacatttcaccatgttgcccaggttggtctcraactcctgacctcaagtgatcagsctacctcggcctcccaaagtgttgggattacaggcgtgagccaaatgcccagccaagggtaaagtgtttagacttcaacgtgctttggtccatctgggaaactgaggcacagaagttggcccacccagcccagcggtcctcctaatcccacagacagtggggatggagattctgcaaggggaagaggtgggagtcaggtagcaggcagaatttggacagcctgggaggtagctgcacacagtgacccccttccttattcctccccacagggagtggttttcagagacatttcagaaagtgaaggagaaactcaagattgactcatgaggacctgaagggtgacatcccaggaggggcctctgaaatttcccacaccccagcgcctgtgctgaggactccckccatgtggccccaggtgccaccaatraakatcctacagaaaattctctcctgagtgcttctttactctggggaakgggctgcgggagagggtaggggcttccagagagggcagggtctgcaggagagggcaggggctaaaccttaggtactcctcacaagccctccaatgccctatctacttgccctgtgctgaggatgttttaactccatggtctcaaaagagtcttcctaagaaccctgcaaactgggccttattaatcccataagggcattgaggcccaragaggtgaagttacttgtataaggtcacacagccaggaagtagagaactggaactagattgaaccctcagcctagcaatgtcactatgctacacttttcctrgtgtggtctacccgagatgaggggctgaggtttttttttgtttttgtttctgttttgaggcagactcactctctcccccaggatggagtacagtggtgcgatctcagctcactgcaacctccacctcccaggttcaagagattatcctgcctcagcctcccaagtagctgggatttacaggtgtgcgccaccacacccagctaatttttgtatttttagtagagacagggtttcatcatgttggccaggctggtctccaactcctgggcttaagcaatcctcctgccttggcctcccaaagtattagaattacaggcgtgagccactgtgcctggctcttatgtaaaattaaaccacatacacatgagaaacaaccctatgtaattaagatttctttctttttttttttttttttaagagatggagtcacccaggctggagtgcagttgcacaatctccattcactgcagccttgcaacctccaccacctgagttcaagggattctcctgcctcagcctcctgagtagctgggattataggcatgtgccaccacgcccagctaatttttttgtatttttagtagagacggaatttccccatgttggccaggctggtctcaaacrcctggccttaaatgatccacccgtcctggcctcccaaagtgctgggattacaggtgtgagccaccgcacccagcttaagatttcataagaaaaatatttgtaagccacatatctaataaccggttaatattcaggctgggtgaagtggctcatgcctgtaatcccagcactttgggargacaaggcgggcggattacctgaagtcaaaagtttgagacctgcctggccaacatggtgaaaccctgtctctactaaaaatacaaaaaaattagccgggtggggtggcacatgcctgtaatcccagctgcttgggaggctgaggcaagagaatcccttgaacccaggagtcgaaggttgcagtgarccaagatggcgccactgccctccagcctgggagacagagtgggactccatctcaaaaaaaaaaaaaattcaaaatgtataatatacaatcctagttgggacatcaaacactgcagccactgtggaaaacagtatggggtttcctcaaaacattaaagatagaactctcaaatgatccttcaatcccacttctgggtatttattcaaaagaattgaaatcaggaccttgaagagatacctgccctcccatgttcactgcaggtctgctcaatacccaagatatggaaacaacctaaatgtttatcaacagatgaatgggtcaaggaaatgtggtctctacatgtaatggaatgtaacgcatccttaaaaaggaaaccctaaggccgggctctgtggctcacacatgtttttttttttwaattttatttatttatttatttatttatttattttttattgatcattcttgggtgtttctcacagagggggatttggcagggtcataggacaatagtggagggaaggtcagcagataaacaagtgaacaaaggtctctggttttcctaggcagaggaccctgmggccttccgcagtgtttgtgtccctgggtacttgagattagggagtggtgacgactcttaacgagcatgctgccttcaagcatctgtttaacaaagcacatcttgcaccrcccttaatccatttaaccctgagtggacacagcacatgtttcagagagcacagggttgggggtaagatcacagatcaacaggatcccaaggcagaagaatttttcttygtatagaacaaaatgaaaagtctcccatgtctacttctttctacacagacmcggcaaccatccgatttctcaatcttttccccaacytttcccccctttctattccacaaagccgcgattgtcatcctggccggttctcaatgagctgttgggcacacctcccagacagggtggtggccgggcagaggggctcctcacttcccagtaggggcggccgggcagaggcgcccctcacctcccggacggggtggctgccgggcggagaggctcctcacttcycagacagggcggttgccaggcagagggtctcctcacttctcagacggggtggccgggcagagacgctcctcacctcccagacggggtcgcggccgggcagaggcgctcctcacatcccagacggggcggyggggcagaggcgctccccacatctcagacgatgkgcggccgggaagaggcgctcctcacttcctagatgggatggcggccggacggagacgctcctcacttcccagactgggcagccaggcagaggggctcctcacatcccagacgatgtggctcacgcatgttatcccagcactttcggaggtcaaggcaggaggatcacttgaggccaggagttggagaccatcttggccaacatggtgaaaccccgtctctactaaaaatacaaaaaattagccaggcgtgcgcctgtaatcccagctactcagtaggctgaggcrtgagaatcgcttgaacccagtccgtggaggctgcagtgagccgagatcatgccactgcactccagccggggcatcagaycaagactyaatctcayaacataaaaggaaatcctgaaactgggcacagtggcttatgcgtgtaatcccagcactttggaaggctgaggtgggaggatcacttgaggtcaggagttcgagaccagcctgggtaacatggtgagacaccatctctaccaaaaaaagaagaaagagaataaataaatgtataaatattactccctggggttaatgcatccccttctcccccaaatcaaccctccaaactcctatactctcctgtcttctcactcagcagcctgttagaactcaagtcagattttttgttttttgttttttgagacggagtctcactctattgcccagcctgtgcagtggcaccatctcagctcactgcaacctctgcctcccaggttgaaccgattttcctgctcagtctcccaagtagctgggactacaggcgtgtgtgtgccaccacacccagctaatttttgtatttgtagtagagacggggtttcaccatgttgcccaggttggtctcgaactcctgagctctagcaattagccctccttggcctcccaaagtgytggggttacaggcatgagccaccatggccggcctcaagtcagattatgctcttcctctgctcagaactctcctgattctctcagagtaaacccagaagcacttaccaaggcctacaaacgggacactatgccgtccacgatcgcctcctccctgtctctctctccatcactcacaagcaactctttgctattcctccaatgtactgggcaggttcccatctcagggcccttgcagttactgttcctcttgcctggaatgttcttccccaggggtccagatatctgcctggctccctcctcacttcctccagttctcttccaaaatcatcccctgccagacgtggtggcacacgcctgtaatcctaactctttgagatgccaaggtgggaggattgcttcagctcaggagttcaagatcagcctgggcaatagcaagaccccatccgttctaaaaataaaaataaataaaaaataaaaaataaaaattagctgagcatggtagtggacaccttggggttccagccacgtggcmggctgaggtaggaggatggctttgaatcagggaggttgaggctgcagtgagccatgttctgaattagatactggtgatgatcgtgcaaccttcccaatytaggaaaaaccactgaacagtacattttcaaagggtaaatttagccggacacggtggctcatgtctgtaatcccagyacttttggagtccgaggcgggcagatcacctgaggctgggagttcaagaccagcctgaccaacatggagaaaccccgtctctactaaaaatacaaaaaattagccaggtatggtggcgcatgcctgtaatcccagctactccagaggttgaggcaggagaattgcttgaacccgggaggcagaggttgtggtgagccgacatcacaccatcgtactccagcctgggcaacaagagcgaaactccgtctcaaaaaaaaaaaaaataattaagaaattagccaggcgtggtggtgggtgcctgtagtctcagctacttgggaggctgaggcatgagaatcgcttaaacccggcgggtggaggctacagtgagcctagattccaccaccgcactccagcctgggcaactgagtgagactccacctcaaaaaaataaataaaagggtaaattttatggaatgtgaatcataattcaatttttcaacatgcgttaggagggacatttcaaactcttttttaccctagactttcctaccatcaccsagagtatccagccaggaggggaggggctagagacaccygaagtttagcagggaggagggcgtagggattcggggaatgaagggatgggattcagactagggccaggacccagggatggagagaaagagatgagagtggtttgggggcttggtgacttagagaacagagctgcaggctcagaggcacacaggagtttctgggctcaccctgcccccttccaacccctcagttcccatcctccagcagctgtttgtgtgctgcctctgaagtccacactgaacaaacttcagcctastcatgtccctaaaatgggcaaacattgcaagcagcaaacagcaaacacacagccctccctgcctgctgaccttggagctggggcagaggtcagagacctctctgggcccatgccacctccaacatccactcgaccccttrgaatttcggtggagaggagcagargttgtcctrgcgtggkttaggtagtgtgagagggtccgggttcaaaaccacttgctgggtggggagtcgtcagtaagtggctatgccccgaccccgaagcctgtttccccatctgtacratggaaatgataaagacgcccatctgatagggtttttgtggcaaataaacatttggtttttttgttttgttttgttttgttttttgagatggaggtttgctctgtcgcccaggctggagtgcagtgacacaatctcatctcaccacaacctkcccctgcctcagcctcccaagtagctgggattacaagcatgtgccaccacacctggctaattttctatttttagtagagacgggtttctccatgttggtcagcctcagcctcccaagtaactgggattacaggcctgtgccaccacacccggctaattttttctatttttgacagggacggggtttcaccatgttggtcaggctggtctagaactcctgacctcaaatgatccacccacctaggcctcccaaagtgcacagattacaggcgtgggccaccgcacctggccaaatttttaatttttttctagagatagggtcttactgtgttgcccaggctggtgtcaaactcctyggctcaagcagatcctcctgyctcagcttcccaaagtggtgggattataggtgtgagccactgcgcccagtcagtagccccctctttgcccctcactgagccctactggatgttcttggttgtgtgacagtttccccatctattaaacagaaacccctatagcagaggggaggatgaggttggaaaatcaggagcattgttattctattcttgtgggatcggggaagcagacatctgggtggatgtttggggaatgctgggctcagttgaggaagtaggggggcccctggggcttacagggactggaagctctgagctggccagagggatgttgcaatcctgccagggtcttgtctatgctgtccctttcacaaccatccccctaccgccaggctgac

SEQ ID NO: 13514 - DNA, 40000 bp, Homo sapiens
  misc_feature (1)...(40000): n = A,T,C or G, or insertion/deletion polymorphism (see Tables 1-2)
gatgactcattcacaggaaaggtgggcaccttccttctggccctgagaaacaaaagggctggctgggtctctccagggtccctctggctccaaactccactcagatgtttccaaaggccctcaccatcccttgaacatccttaaatagcacaatcactggagaaggccttagacctttgccccagcgctaacaccaaactcaaagtgaggtgctccactccacccaagataagtggttcccaggatctcatcaactgtatttagaaagccttagcccaaactgtttacactcttccatggcctattaccataaggctgagattaaaaagaatctcaaagtcgcagcatttatcatctcatcagctmattggaccatagacctattcctcccctaacacaggcacctgcacacttaaggatacttggaggaagcaccagggggtcaaaggaaaggagaacaacagaaaaatacctctggtttttgttatgtggtgcaggattttcaagacttatggctaaaaaaaaaattagagaaacaaactcctccaaaacttggggaattaagcygtctatggaatcctacagattagcagtttccctccatctggtacaaccaaaatgcatcaaacgagttaggctagagtttctctccccagcccccagtgacccttcrgaattccaggccgaatgtaggcatgagaaatccatggctgcctggcccagcctcattataactttatgcaaagctgcagacagacagggctcaaaatagttcccagcagtggaaagagaagagggaaaacagggagcaagtattttcataaggatggggttatgtgcaaagggatwaaaaaaaatgccgacwccytgawacatgctttgaataatytaaagaaagcaagagaagacactcttgctaatttrcaggagataccaggttaaggatggaaaagatcttcatgagcaagacttatgcttaccatcacaaygaccgtaaagatacgctcatcttccacctaacctaattgtctgtgtccttgtgtaatgcccttttggtagctctgtcagaggtgttcgaaccagagcaactctatcttgaataggggctgggtagaatgaggctgcattgccagaaggtgaggcattcttactcattggatgagacgggaggtccacacaagacattgctcacaaagactcccacwaataaaacaggacgtggaaaaaaaaaaaaaacatggccaaaatccaccaaaaccaagatggcaacccaagtgaccttctgttgtcctcactgctcattatatgctaattataatgcattasccactraaagacactcccaccagygccatgacagtttacaaatgccatggcaacatcagraagtcaccctatatggtctaggaagrgggaacctcagttccaggaattcatgaataacccaccccttgtttagcataggatcgaaaaataactgtaagtatactcaatcaagcagcccataccactgctctwtggagcagccattcttttgtttctttacttctctaatacatttgctttcgctttactctatggacttgccttgaattctttcttgctcgaggtgcaagaaccctctcttggggtctggatcgggacccctttccagtaatagctccaatagatttatcacttacctcaaactactgagtctctattagagacacargctttatcctcaagcaagatgccagggctgggattarggtgaggcaggtgargtaagtggagcaagctcagggctggatcctgcctttactaaaaacaatatttygtcgattatgaatttttttttgcactcattttggctttctgaaaatagtgcrttacattttacttgttttttcctactttctggtgcctcctgaaagtttgtacatgagggagtgcctcactcaccccagtctattctcagccctgcaagagacccatggaaatcagattcctaaaaatccagaaaagttacatggacctctgctgtctcaygtagttgcttctgactctcgrcaaagcaattttgcgctccccaagttgtggggcgaaacygtccaccagcgggccagtcatgtttttggttgcgtctgtcrgtacttttgtcatcaatgcatatgaaatgaagctgtttctggtttttcaattactgggccagggaccaggcctccctgactgttctgttcctgagttactgtttattaagagctcccaccaagtctgccctgaggaggccacaaaagaagaagaggccagtgcttccaagcctytgaatgtccccaaggtctcccaaagctcttggccctcctaagactctgaggtggggcagatgagaaagagagctgatgcctcatcctgtctgtctattcttgggaggtttggtgggtgagccaggattccgaagcccccaaaactatgcggacaaacarttcattcacatgtggctgtctgtactcagccatgctctgcaatttattttccgagtgcaattaatttctattccaaagtgggcaaaagtctgtgtgtatgtgtgtgtgcatttccaattttsaggaactctgtttcaactgaaacrtgacaaggaaggagaccaggtcactttctcatgcaaaacagagaccatccacttccaatacactggaacgcggggtggtgccgtagacagggtcaccctttacagctccccctctgaggtttggaactggaattataaagcagaagcattgtttgcctcccagcttcctttgttttaaattcttgcaggaacaaacatgaccakacacatcagagcctttcatgtgccttcagattgaaggccaagttcctcactgtaatggccctttcatctagcacaaatccaaattctccctcggggtcacacagggtcacaacctctttgtaccaagttttcttgctacaaatcaaactgccttccagcctcaagtcyctctgtctcccaagtggagattagttgcattccaccaagtctgtttttgttcctggaccactcacacttcctgctgactctggggcagaaaacgggctttctacctgtgcatccccaacagaaaagtcctcgtaggactgrcctttccaacaaactgcgaaacttagccctaagtctccccaattttaaagaagtatcttgccrtccagtgttctaagaaatatgccactccaactcaaaactggtacaaagaagtgtgctaatttctaaggaagagatagaaatggttatgtgaggggaaaaaccycctgaaaccatgatcagtcagaacctcaagctcagggtcccttttaatctggccaacaccctcttctttcacatgcccgtctcaaaagcacatcatgaaatgatgttttctaaatagatgtctgtgggatttcctcgattgcttcctggtgactcccrgttggtgacacccacttcargtcctgggcaatgctgggtgaagtcagaagtgaggctactggtgccccatggggtcctcagctgatgaatacaaggcattatatctactctgctggacgtaccaaggamatgagagccacagatgcctcacagagctctcagcataggtgtttaacaaagaggtaaacagatcattcctgttctcctgaactgagaccctaatcaccccaatcaccacccctacctcctrtttcacagacacagccccagacgggtgcccgcaaagagcgccatgccccattactgaaaactttcagtgatttaccaaggggagagggaagcaatagaaagcagaaaggaggggctggaagggcgggactgaatctcagcccagcccagcaacctttgaccacagagtctttatcaggctgcttatcagcaacagcagacagccaggcacaccttttcccagartctgtaagctttctgctaattgaggctaacagaccgtcctkcaggggacagggtggacaggtttgctccggggcactccaggagctaagatcagagtcagaaggtccaaagaggtggaccccagcagaacttgagcaaggactttctactcaccagccagcatcctccyatcacaggattggatatggcaggaggactrgttttggcccagraagggcttctgcagggctggaggttgtgttgttatcattgtggccaccatcttcaagacgttgagtgtttactagattgtaggcgctgmgctaaccacgccctgtgtactttcttgtgtcatcctgaaaacatctttcctcatagagtgctatctattcccccactctctagatggggacactgaaggtctcagaggtgacatctcctaagtggcagatccagatttcagcccaggcattcdagcccacagtttgagctcttaacccctacaaarggatctgttcctcctccacgtgacaatttggatgagtrggccccaggccccattcctctctaaaccccaggagtctctaaaccaaagtgtgaagctggatctgcaagaagagatggatttgagcagtcccacctcctatgtctgccctgctcccgtaaccacaccaagaagcaagaagacagaacaaggcacagagcagcagccargaaaagaaaaatcctgcaccaggaatgagactcatggactgggggtccctcgccctctcgcctagactcagccccctctgtcccagcatctctgacatcaggrcaaaccttctggtttgcttggagtgcacactcaaccagcccctcttacccacagagaaaccaccaagggctctggtaggctaaaggaaaatcacatgcttctatgcaagccaaggctacatttccagaataaaatttaggacttgtgatggaccaaggatttgggttttgcccatgtgttaacayaygttaataaaaataatcttgcaaaagggtaaatatatgattacatagaattatatatatgaatcatcactatcaaaaagaacaaaaccccagccctaacaaygtaacaagacccratctctacaaaaaaaaaaaaaaattactaaattagctaggcatggtgacacgcacctgtggttccagctactcgggaggctgaggtgggagattcgattgagcccaggagttcaaagttgcagtgacctatgattgcatcactgcacttcagcctgggcgacagaatgagacactgtctcaaaaagaacaaaaccacccttaatcagtcacggatggggaamcatgtcttttattcattcttgggtcccagagccccattcaatactgacccaggtgaggcactctgggaaaacatattaaatgaacgaaagcaggagtcatctaagatggcatattagtcacctaagaagcccatgttgggaacatgcacacaggaggaggcttacagggcaggcttcagggccaaacttctgggctggcagcccagtccctactcacaagctctgcaaccttggccaactgactccrcctcctgggctcagcttcttcctgtaaactacagggacaatagcatccaactaatggggctgtcaagctgatcccatgagatgacatgaggtcacagtcatggtcagccatcctcaccatccatgattagtagcagactattcatgacccctttccaaaaccatgatggcagaaagactggccctctgcctcatatggccacatgtccaacaatgatactgccaggtgtggctcacaggtcagggtgacttttgtttttttgagatggaatcttgstctgtcacccaggctggagtgcagtggcgtgatctctgctcactgcaacctccacctcctgggttcaagtgattctcctgcttcagcctctccagtagctgggactacaggcacatgccaccatgcctggctattttttgtatttttagtacagacggggtttcaccatgttggccaggctcatctcaaactcctgacttcaagtgatctgcccacctcagcctcccaaagtgttgggtttataggtgtgagccaccgcgcctggcccagggtgacttttatcrggatcccaaaatcacattctggtgctcagctggctcctcatgtgcaggaagttggggttccagatccaaccgttctattgggatgttctaaaatttggaatatctcttcttgagaccatgccaagatgcctttcttgaagaacacagaaggcaaagccagaatctgtgatgctgcccttttgtggtagaatacattaaaatacaagtttaaatgttttgttaatgctttttttttttttktttttttttyactctttatgcatttaggggagaaaaaaactcaaaaraaatggcattcctgctggattaagtttagtgtggcttgatccagggcagcctgggaagccggcctggycatcttgataggagctgakcagactgttgggattaggagagacttggcagctcactgtmctggagcggctgatgtctgcaccttccagagggtcacagagaggcaacagcacctcctggctcaaggccacacagatagtcatggccaggactcaagggcagcacttctgggttctggagtcttctccacaagtcgggactgcaaatcccaaattttccaccatgatcatgattcccaacatcctgccctgttcttttcataactacattcctatctgccagcccatgtgtgtcagattttggtttggaaaacacagtcaccatccagcatcacaatgcctccctcagatgtccttagagggatgaacagatggcaggatccctcagctcatggggcggggaggagcacagtggggctctttgctgggtgcttcacagctcagtcagccattggataaacaggttttcagtcttcagccaggctctgaggggctggtcygccatgaaatgtggttcgrgctgacatccccrttatgggtcactttargtgtcaacttggctaggmtactgtgcccagttgtttagtcaaacagcagcctagatgttgccctgaaggtatttttgatatgtgattaacatttaaatcagtagactttgagcaaagcagctgaccctccaaaatgtagtgggcctcatccaatctgttgagggccttcacagaaaagacaggttcccgaacagaaaagaattctgcttccagacctccttgacatcaactccctcrggaattttcagcctgrtggcaygcagatttctggcctgccagcccccacaatcatgtaagccaaattctgaaaattgctctttgtctctctccatatatatatctctggagggacattgcccataacttctgtttatcctccatraaagtccatggcccccaagagcaaccaaatatttcctttggcaaccgcacttctgatatatgcataatctgcagacatgcacacaccctgttggytctgtctctctagagaaccctgactcctacaggccccagctacctsrtatctgtttcttcagtctgctcatagaggacagccgcagtgtayaaggacatcagcacacggaccccttgttcaccacctgtccccttactatcttaytcttggcaacttatccatgacaataggatgggatatgtttttctctgattsgggactttgattttgttggcagtggtgggatggcttggggactgtgggggacagccaaggaaaggctaatggaaatcatgctatcccattgatgaactgtgatcccagcagccttgacagggtaagtataaatttggttcctctttggggcgatggacttttgggaagatatcacagaagttatgggcaacatccccaagaaaaactctcttkcccacccctgtctacarggatgtgcaggcccctgaagagcagccaggcacctggagaaagaggcctcctgtgtgggagaaggcactggagatttaggggctcagcaacagcaaagatgagccagagtacccaggtggcaggacttagccaaaagtcaaccagcatttcctgagcatccatgccatgctgggtgctaacagaaagggccgaccaagctcgggtctggaaggactaaggaggggaaaaaagcaggagggctaaagggacagccgaggaatctcagaccttctttcyaaaagagacttaagagaccaactagtctcttgagcctgaactagacagttaacttcccttgaggagatgcaaagcgggtctcggtagtractcccaatatgactcctgcagcatctcakatcctcgaagggagcaaaaatgaccgtactcagagcaatttccatcaaagatcaactaggagtgttgattctgtcttcacgcagctggatgcgccatgggaggaaaggctctgaaaggtgaaaagcacccaaagttcaagacccctgactgaggcacaagaatcaaggctccttctcgtgcccagaacagctgccgctgggwcagsgagaaatcacacctggtggagaartttggagagggagaccagtccatgaatgaagagggcgtgacagcaggagaggggaacatgtgacaggtggggttgtgatctaatggggagacagaaccactagaaaagactgtgtccctcacttccagtgcctcttttgctcaattcagtgattttttagattcctccccatcactcctgttccctgtcaccacagcccatttyctcaaattgcagtcttgcctgagatattttaaagatgacaacagacctatctacacatctacagagtttcaggaaggaagggaaggagggagggaaaagaarggaaaggaaagagggaaagaagggagggggagagggagggagggcaggaggaagtttggagggtaagaaagaaaggagggaggcaggaagggagggaaggaggccatttgggyagttctgcctcataaaaattattttacctgtctaatttcaaaatgctcaagtctggctattgtcrtttttgtttcccaagtagctcaggggatgcccaaacaccagatttaatcyttctttcatcatgtttaaattgaaccagtgtcgggaaggaagggaagaggtaaatcacacttcagggggaaagttatcaagttggctgtcctggaaaaagtcagagagccacagcttcatttcaggacaaactcgaaatcargagacaggacttcaaacagatcgcaggatgcatgagacagaattttaaacagatcacagggtgttggttgagactctcagacatgtctcaagtcatcacttcctcyccagccagtgctccgggrwttggtaaacaggcaacgaatgaaagagatggtttccaaatcctctcccacctgcccaccaccccaggttcctgtctgtmattccattagctttcttctttctccttctagattcacagctggggattctggccaagacaagaactcggttcctggtgactgcccagtgccctccattctatgaagtgaatttgatcagagcacaatgatgcaggataagaatcagaaagggcagtgccaaggtrcaggggctacarggaaaggtgactcccctcrctatctgaggataagaggcaattgatgatggcccaacactcacagcttctatcttccccacaaagggaaagaaacagggaggcacctcccatcctctaggtggacacagcccagccagcaaatcagggtatcacgaccagctacagaatttatgggacccaggmgaaaatgcaaatgtgcagctctttgttcagaaagtattaaggatttcaagacagtgacagcaggactttaagccgagccagagtctttctgagtgcaggactttgtgcacgtgtyctgctggctcaatgtgaagcccctgcctgcccttcnagcatggtggggtgatgttccagatctrtcatggatgtgattagaggtcttgtcccctggtctgaaagacattccacccctcaggtttactaccctcgtctgcacttcatttttgaggtgccgatgacacaaggtaggtaastgagccccatgaaagctgctaccaagggctcagaggttatggggcttggggatraaggtgaccgtgaggaacytgaatcaagacggctccgggacacggtggcaaaggtgcctttccaggcttccaggggcttgcattcacaaccatctctgagttcrcagctaagaatccctaatagggtacaagcaagagtcccaagagatcccatgaacacccagggaacagaacttagaggtgtctgatccaagtcccagatcttagagatggggaagccaatgccagagagttggtgacccaggcaaggtcaagccctctgyatggcctgcaagatgatgtgcctgcaggaggggttccctgaacactgggagtcatcaaagcctccccctgtcagagccacactctctccacatggccccaggagaaggctgacttccccactggacgaaccccaagacaaattcaggatggtgctgtctaggccctagggtaagagagtttctaagractgcaggagagaagggaaggccctctgtgaccatggcagtgggtgactggagccagcctgtggaaggcccaaggacgagctgatgtgaattcaccctgccttggcatccaggggsgcccacaggaaggaagggagcccatcccaggggaattctaccccgagtggactgtgcaggttctgtcaggctcagctaaacccayccttagactccctggagaccaggatgctttcaaggaattttaaaccccttggatcctggtggggtcaacagtgagtatgaryccccttggcrcctgggraatgagataaactttcggggctttctctatctcagaaaagaggctcagagagacatctcaggtatctaatccccctggtcagttcacttcattcagagggagggctcctccttccacaggatcaaactcaggattgagtttctcttgggccaggccctcaggggggatgtgggtcacacccctgacctgcagaagagacctgggctggcaagaggccccagcaagagctaaaggctgtgccagggcaggctctgggctaactgagcggggctggggtggagtgaggtcctcctgggaatgagcagatgtgggcctggtccgggagccacgttcytcaccacaaaaggctgacttactcgggagtgttgatccaaatgatgtccaggtggcaatagtagacacactccttgtccttgtaggtgaagcacgtgcagcgcctggatcggtggtgctcaggggccccctcggccgcctgctcctgcccagggcttccagggcttggaccctgcagtgctgtcggggccacagtcycctcgccagggccagccacagtctcctmgccagggccagccacagtstcttcacagtccccctcagatctggctgctgtgggggcctgggacacgccgcgcctgrcagcatccccagactgggagcaaggcacgaatcctgcagaaggcagattgaggggctcctaagctgagtgtgcagacccctcaacacccgccacccccaaacacctgaggaggggggtggagcaagcaaaatgtctgmaaagtttccaaagctctgcgcagtttctgaaaagtttscaagctatctgcacactctgtgaaaagytwgcragctrtctgcacccgttgaaaacttgcatgcattttgcatactttctgmaaactttgccagggtttggcacagcctctgaatagttcgcaaactttctgaaaagtccccagtttcatgaaaaattgaccaagtyggccraggcagcargtctccagccrgtgcgcgggctgcaactcccggagcccgtgcgggtagtcgttgcgcgccgcttctrctccccagccctcccccaggygtyttcacragtgcagagcccaggcaagagtttgctccccgcgacgcacatyttctccgcgcctcgggtccccmgccctgggtccttttgtgtgcgctcgcgccaggagaggcgcgccgccccgtgcgcttacytgyggcggaggtcactgtgagcccgaaaaggagccacagccccggctccatgaacykagatcaggcgccggagcaccggaccaggaggycggccgcttgtggccgcgaaagggcactggggccgggtwyagctggcctcgccctccagctgtgggggttcgaggcrggccgatcgctcgctgcgtctccagctccggccaggagttggctgcggcggycataaactttcagagcgcgctgcccatccctgcgcggagctggccrgctgtggctcgggcttttctggcttctgcaccaccccygtcgcctccccgccccccagaggggctggaactgcctcgccgggcctttgaacccgggcgcaytgggggtcgcctcccaggcgctggggggagctggccaggagcgcagcggcccgaggcgcacccaggacagcgaggggcgggggcggcgtggcgtggcgcggctgggtggggtggggtagggtggggtgggggccgggacagctgccagctgccggaaggccacgagagcgcgcgcacacacgcacacgcgcgctmacactcacaggcgcacccccgcccgccagttcgccgctccggagtagcagccccccatccaagagcaagaacagatgagaaaaggctgtgctcaaggggtgttatcttttctatcaggggctgagggaaagacacatttctcattgttccccgagtgacaccttccccttgaagagcctgcttgccaaggaactcrgtgtactttacactcttgactcacgcctcgggctggctccctacctctcccaggagttcagagcctgcgtgtggggcagtggcctgggagcaaagtcaacaaagatcctgggttagcggtcctgtggtgtccagggcttcctcagccatctgcacaggttgggtggcttcaggtgagagtcgggctcctctccctaaaggccaagttcattcacacaaccgtccctaccaagggaaatgacctcccaagagagccccctawttccttcatagccttccaagtcctgtgtgtgggaggctgtccccatctccagctcagataaaaatgtctgagactgggaagtcctcctgacttctcagggcacttgtggtcaaaggaccctcctttcataacakatggggttgggggagggrcagtgcttcacatctgtaattccagctctttgagaggccaaggyggatggattgcttgagcctgggagttcaagaccagcctgggcaacatagcgagacctcatctctaaaaaatggggttgaattgggtcctgccctctactagccttaacgaccagcttctgaaaactagaaagcagctgaagtgaccagagcagtttctgaggacagtccaaaagagtgctacaacatccccctggcttgayagctcargacacctgtcctctgaacacagctgctgtaccaggaggaagccctaacaagcccacctggagagatcacctggagaaacmtacgtggagagaaaccgaggcctcccagccgaccaccagtgtcagccactgacctgagtgaatgtgccttcygatgatttgagctcccagccctcaagacttccaactgaggaatagctgtcccgctgtaccctgtccgaacttcccaccracacaatccatgagcataataaatggttgttttacagcactaaactctgggtaaattggtacagagctgcagtaactagagtagcactcaagcttccagcactgaagctgatgctgaagttctccatccccccactcccatcccatcctgcctagcccttgaatccaagtgtttatytgtttgttttygcacttgatgctttgaaaataagaaaaacccaagactcacaatatcttctgttcctgctgggctagaatttggatcattttagtattatctttgtttgttggggctactataacaaaacgrcataagctgggtggctgatmaaccgcagagttttatttttcacatttttggggtctggaaaaccaagatcaaggtgctggtagattcggtgtttaataagggctcratttctgatcatggatggtgacttctcactgcatcctcagttgtggaagsgtcaaggcasctctctgggggtctsttttctaaggacaccaaccccattcatgagggctgcaaccctcatgacttaatcacccctcaagggccccacctcctgacrtcatcaccttcatggataggatttcaacagataaatctggagaggacaaatattcagaccataataattactatctctttggaattaaaatttccatcttcaacaaaataaaaagtycttggattgggggatggctggaggaatagaaaatatactaatcagctaaaaggagaaaaggagtaggaggaggtttccgggtaccatgttcagacacaggaggtatcatggctgcttagaccactctctgggtctayggccttcagtagcttgaagccgacaccaccacttgtcttcactgggactaaaaatcaacaaaccctggatgagcctctcargcaccaggaggtgctagccaaataccaggatggagctggccctgccctctgggtcttctactctagttgaggtaaggaagttcagaaatagatcgccaaggatccaggatgctgagaacataaaacgccgcacagagctaagagaagaagacagtgtgttcagctggatgatcagaggaggcagcattgtccttggtccctaaagcaagcygggcrccatgatttgaggcagcagcctgcagtgacactcgccaacaccagcyctcaagcgaaagagctccctttcctactgttcttctggcttctgacgatggccagggcaatgactcgatgtgtctttaacagctctcgaacagagagagagctgtacaaagggatttttgaacaaagggatacaaaaggaatgtagcaggccataggcttgtacaaagggatagcaggccataggcttggagcctttgtcaggctgtggaatcgrgcttactgtgcatggtagtgattgacataaaattcctttctaaattaatacacttaagtcaagtaaaggtaacctcaattacaatatgaagtaattcattgtaaagccggcttggagacttggcaagatcacaaagccttctgggttccaggctaagaaatgtgcaaaggaaatatacaattcatgtaactcaatggcaagctggtggtttccatcattgttttgcccttgtgacaactcaacaaaatttatgctaacattatccccatctcacagattaaaaaactaaggctcgaaaaggtcaaagtaaccagcctacaaccatgcatctattaagtggcagtctatcaggattcaaatttgactccacatgattccagggacagagttcataatgcttaagcagcgctgcctctggaactcatacccaaggttttaatggttcccrttttcttctgtgtatcattgacaactcactgcctctccatctgtctagtttccattccataatctctgatggaargtcatgtaaaggaatgatgacctctacagaggacacgaatgaataggcattcttctccgcagacgtctgccaatattccttgatcctccttcactgcctcagcatccaatgtgcccctargagaagtcatgtatcaggacactgctggggctcggccaagtgcacggcttggtcattgtgtttatttttcctcaactttttccaagtcagcagatgtgcgaytgatactttgagtccttaccacttacattttgattcayaacccagccattaagaatgttgcaatttatctcagataagcatcccctcaagttgtctctttatgtgctttatgattctttgaagattgtttttcctttaatttaarggatttaagggagagtaacataatacattatgtagttttccatcatgctggaatttcttctccccacccacccacagcagcaggaactctggacttactcaaaaaccaagtaattaagtgcttttccatgttgtccaactcttagctgtgtcttccctcactggcacgtggttcattctaagatgcactggaggaagtgccaggctccaaatcccttkctatacaaatgaggtacactgtgtataatattctccgtgaaataaaatgatcacaargcattctgaactttagtgctatcaataaaatgtgttcaaagcctaagagaaatcgggtgatcccaaaagcaacaaaacttgttcaaaagagtcctgaagttttttcctgtgttttctgctgtggacatttgctgttgttgccctgccagcayccccatccctccaggtctggtaatggaccacatcttcccctggggaaccacccctcccctrctctgtccaagtggtttcaggggacgctccagggccaggcttgtgactatggattaactaatcagaccatacatcatctttgagataggaagaataatggtatccccaaagatgtccatgtcctaatcctcagaacctgtgaatatgtcaactaacatggcaaaagggattttaagggtgtgattaaagacattgagatgggagatgaccctggattatcgggggtggggggcggtgggcaatgtaatttttaaaaatgttcttttaagagggagggggagggtcagcgtcagaraagctgtgacaatggaaacagaagttgggctggtacaaggctatgagcagaggaacacaggcaatgtctagaaaatggaaaaggcaagggaatgaattctttccttcagcctccagaaggcacatagcccttccaacctatttttagactgctgacctccagaactataagataatcaattggtattgttttaaaccattaagttcatgatgatttgttgcagcagcaataagaaattaatacaactttaaatatagtgatttgtccagagataggcccatgagccaagcctggctgctcaggacccaggagattcagttctgggactttgaaaagaggctcttctgtttttctggggagcygctgagaaaatcagatgaaagcttgctggtgccagcagtacttgtcatcatgaggtgaaaagtctctccgggaatggtgccaacacagagtaatcggtagaaagtagaaagtagaagtagggaatcaaggctaagtcataagccctggacccaacatggctccttggacctttcacctacatcagccaagacatctccatctttgctgacaccagttcaagttaggtttcttccactcgcagtcaaaagcatcccgatgtgttttgtctcaacttactgtgagagtggagtaggctgtaaagaacatggatgctgctratggtaattgtctccagaaccagcagcagaatggctatgttggttcattggtcagggaatgagaagagctactgaaataaatgcttagtttttttctagaaagtctgaaatttcacagttctagcaggcaagacataagtgctcgttcaaaaccatctctggtgggagtagaaacyatgcagggaagagagaaagagtggccatttggaccccgaagcagcacattatacaaccatccaatgcaatgctaacctggagcctcatacccatagwcagacsacttcytgatggaagggcacagattccatctctcaacagcacccagcccttgggggaaaaaggtaaaggaagtcgatytgtttttggaatctcttgcattttggtatttgttttatttcagcaatgcctctaactcatacctttcccatccctcccaggagccctgacccagaccgcatgcacgmacacacacacacacacacacacacacacacacagtctcaacttatctcaaacaacatgtgtgtactttaactggagsyttcaatgcytcagmcaaagttgggaatttcaagcatctcagcagatacatgggagagatgcttttgaataagttaagtcaacatgccacaaacacacctgtgtgttttaattacyttgaagtagcyttgacttttatcagaggaatttttcacaagctgtatccctttaaagttcatatagtgatgagtccctgtgtcyaccaaatgcagccaatcacrggatgtggaaaactmtccagcagctgccaaataccttgatctgtttgcagaataaaaatattcacataagcactccttcattctcacctcattgcatgaaatcctgaccaaagccactttaagtcycagatcaaatgctgccccttctagcaacctgatttgcctgtttaaaaaaataatatgttgagatcctcctgtagctgctcaaacatttagacttgcaggmaagcataatggcctcyctcatgggctttgaagtcaaacagacctggatcaaaatactgacatcccccttgcctagctgtgtgaccttgygcaagtcactgcacctctttgagactcaatttcctcatctgtgaactgaggataagcgttgtcgcacagattaaatgacagtgaagcattgaatataggacctggagcaaaataaataagcattggataaatgttacccagcagtgatagtagttttagtaattatggttatgtgcaaacttttgcctctcaccagattggaagtcctttgaggatggtgtatgagttatccattgccacgtaatgtgcattacaagtgttcctcaaactgcaatgarggtcagcaaagcatccsgtggctaggcagctctgtggactgcctagaccccctgctggactcagtcgtttgtctggggatagctgctggaggatccgggttgackttgactgagacaatgagaattactcacctctactccccaagtctcttttcctccagcaggccagccaggtatgtccttctcatagcaggagaaggggctccagagatgaaagcttaacacacgggccccatgcaagcctctgttgrctccatgaacatcccaatggccaaaccaagtcycatggccaagctgttgtgactcaggagggcacaccatggcaaagggtgtagtaamagaggtgtgaagaattggggctatttgcaatctaccacaagcaggaaatgaagtcctacaacagcctaaagtgctgtcgtggtcctgagaaatccatttgtagatgctggctgagctgaacatgaagttgggctccaaacctaagttgccactcttaaacatcaaaagcagtggttaaaaatasaggaatttatagagtgcargtgattcatygttgttgaggcttgtgggtccacccccccacaaaaaaaaacagctagctttttttccttacatsaaactatttaaacttctgtccccagcrctagagaaaaaaaagatattgaaggttctgcattcctagtatgtcacctacttttcctcctccctcacacctgggaacagttcaaacttgaaagagaagtaaggaaatgaacggtgagagggcagcaaaaaccaatgggacggaggagaagccactgcgggtgggggaaggaagaacagaaatctaagctggctgycggattctggaactttcaaaacctaaaataaggaatggacttcacagaacttctcaagctagggcacagacgcattttcttctgaaagaaatttcacaattgtgtttttaatgagctcaaaccactttagcaggacacagttaaacaaaagagtaacacaatcaagcccggaagtcataattcagrttcagaaatgcagggggggcaggatttgacctggtaccttctcagagaygtaggactccgagagagcaaaatctcctrccggaacgtgctgatggattggggaggaaatgggaatcttttggctttaaaaaaaaaaaaaaagaaanaaaaaaccttagaattaaactcttagttactgagatgtcgcaactcacatcactrtgaaagtcatgtaaaagsgttctgtgtttgtccctttattcattcaactacttattaagcacctactgggagtcagacactttttctaagtactaagattacccctgggaacaagatggtgcctccatgagatgcctccaagaactaagacaaaacaaagaattaactaatatgacattgggcttgatgaaagagacagtaatgggaagggcagagaaagatgtgtagcgtgaagaaactggcaccattttgactggagtgaagaggaaatttgagcagagactcaaagaggcgaacccacgcagtcatgggaagtgttccacacaggtggaagtacacggtaggaatggacttcctgggttctgggaggagcratacggcgaccctatgagggatgctccgctgcaccatcaactctcttttcagattkcaggtcaaggacagcttcttggggaaaactctgacctctcaggytaggttgagtcacccattgctgatgctccggagaagacccaggacttctccttagagcatacttcagcatttctgaagataccactttctctgatcctgtttctgggctgatgtggagagtgtctgtcacccctgcgacattgctagaagctgcaggtcaccatctccttgtccaccgctgtggtcccagtacctaggctggggcctgacaggtggtagatgctccacagaggtgctcgctgccctccccgcattmtcttgtttcatcttcacagctccactgtgtgagtgctgccgttatccccactttccgaatgcagaaaccgagactcagaaggggagytggcttgccagagccaggcaggtaggcaaggggtggggagaatggtgggaatcacgattttaacccaggtctttttgactccaaagtccgaacagcatgcctcaccctctggacaggtgtttaaacaggcatgtgcatgtcacccagtcagagccagtgactcatcagcaacgttggttggagcttccaggaaagagatgccatctgccccactggagagcctcrggttgaaggcgaagccgtggaaracggaccagagcctggaggggatcaggcctgcagtggcatcgtcrgaggcactgcatcacgcctcacctgaacgagacatgcatccgggcaccccaatccctatgttctaagcccatttccatctatctttcacttggaacaacaatactttctaattgataaaacatgttagtgttggttattgtcatcaccactggggtggttgtttttatggaaattaaacacataaagtaggttaaaatatggccgtactgcatatatgttaccagagctggttatatatcaagtgttctagagaggttacccttggtttcctcttctgccctagttctccagtcttctccatatgtagcttagctaccctgctagaccagctgtccccactccctgctgtggccatcaggaccaaatcagcccagaaggaatgagatgcctggtgaggctcataataggaaaattctaagcccatatctgccttttcctcaatagcatgaataagggattaattcatgccagacgctaaagtcaggcatatgatggcagttaagcccacaaaagatgagtgactgccgctccagcctgagcaatagagtgagaacmtgyctcacaaaaataaaaatacatataatgaaagcacagaactccatcattaacattctaacaagatatgactgtgggctgtggagttcctggctggccttctctttctgtgttggggaggtgttaaaaatatgctttcatcaaagggaggctgtcctggggcagtmgggattggaacagaaggaggcagcagccttgtcattatgcgatttagtatcagtgtcatgtccatgcaccttataacattatctcaggctccactcttgagcttgcctgcagggtagctggtggcaagggcctgtgcatcacagcttgggttcagatgccactcaaagtattcgctgtgagcatattgcttagtttcctccttggaaaaataatcaccataatgatactagctagctcgctaagatcctgattgggaggaccttaagtgagatacatgtgtatgataatatgcacatcctaataactgtacaaaaataagctgttattatttttgttacaatgaccacagtgataaaaatatytggggacccaccctccccaaccccgctccacmtgactggttgagtggctggccctagttctgttccatgtttatgcatccagcaaacacttgaatacckcctcggtatcaggcacaatgctgacaggccttgcccctaccctctaggagtttatattttagcagggaggcaacatttgtctggccaaagtaaaatgacaaatgtgacagtggctggaaggacaagtccaaggtgttagaacagggcaatgcaaccttggtccctgaggaaytgctccagtgctgagaggtgaagaagagaacaggtaagagggaacatcccgttacataggagggcaggtctgggcagccagtgggagagcagctgccagcatctggctggctggtggggctgcrtctgaggcaggactcagcttcaggcctgaggatttccagccagtgtccctccactctggcaaaggccaggcaggtctcaccaggacctgggtgatcacagttgagggtgyggcccacgttccaaagggctacctgagtgctgcctggctgctgccccagtgaagtggtgaagcgctgccaccacccctctgttcccatcgcccaaygaagcctccttcccccaacaagagctccttgttcactacagagcaacagaagctgtcaggcactactagaggttgactctaaagcaaccctagtttgcaaaaaatcactccttttgcaaagtagaggaattatttgtaaagtgaaaaactttgtatcatgtctgctgcaaggagaccgagagacagtctggaggcagctctagcaacagtccrtctctcagctgagaattctactttggctcttgaaggacatcttaggaggagctttccacgcagtgattcctgagtgtgacgcaagcacaggcaggatgcagtttaccttccacatggccagatayaaaacaccggaggtgggtttctgcaaatctgtagatgaaccataacccattattgtgtttaaaagccacaatttcttgagtctccactatgtgccaggcaccacactaagctcttccatatctgatctcartttatcttcatgtcaaccattggataggtactcttacaatcccttgtcgccatctggggaactgaggtctggacaaattaagtacctggactcgggtcataaagctacgtaaatgggggtgtgagggccataatrgaggtctatctgatgccaatgccaggcatttcatcgctgtcttgcactcccttctctgtggtagcatgtccttgccctggcacatcccgctgacgacaggggagcccctcgatttcaggtacatgccatcaacaccttcatgtcctcagcttcttgcagtatctggcaggtgttggcacccaactgaagctcatcaaatgagtttgctgaactgagcaaacatctgcaagcatgtgaacaaggagtggttggtgtcaagatgtcctctaacagatggggtttctttcaaatagaaatgaaccctgccccttctctagaggagaaagcaggaatcccctgccttggggatctgtgtgcctgtcaccacctgaagccaacttaacaagggcaccaccttgggagcagagrctgggagcatgcaggtgggatcaaaggaccytatggcaatgctgcctcatgttatgaggctttctccggccacccctcccctccattgcctctgggtctttgttcagaagcaaggcacaccacctgtaaggcagctacaagccygtggagctactggggccagccgaaatgtctctggtttctgtagaggcctgagggctccccaacctcctggctagacttggggattccccaggaggtggaaggtcaatgggtcataactttacatgacttccaagcatcacacatgctttgtgaatagctgagctattsgcaggtttggtcctgttgacycattcattcatttacctgtgggttccacacaggggcctggcaatggcccacccaacacagagctacacagacctggagagaacacaggcccttgataccatgactttgtgaagctgacaaaggtgatctggaccctgagggagcctgcccctggagaggaggaaagaaggaagaacaagactgaggccagaattgggggaggggcaaataacacctgcaggacctcattggaccctacagtcaagagtccagggcagtggtgggtgacaggggcacaggagagccagggacaaagcaagatgggaccctgggtccctagayaaaagtccacagccggaaaaggaaagaatagagcccagtgacggagcagaggccctgcaagaacccaggggcccccagggtggtggaggggagagtgtgagctttgtcccagtcttgctgatggttttcagcccatttcttcctctgtacacaaaggkaaggcaagatgygctctgcaaagaaggaggtcttccctgctttcattccatcagcaaatttactaaagaccatctgtgagccaggtactgtttttggcaccagggaacaagatcccagcccttgtgatgcttatggttctggttggggaatagaggcaataaacaggtaaataacatggtagaacaaaactacagactctgaaagtttccataaagggattggacagggtgaggccacatcgagtaactagsgggggccgtttacaatgggtggtctgtgaaggcctcaaaggtggttgaggtttgagcaggtcccaaggatgggagggagccaggcatttacatccctgaggaaaaggtattccaggcaaaggagactgcaagtgcgaagccccaggcagggctggaatcaagcttgacatttgacaacccttcctaggctgacagggagtgtgttagcatggctgctataacatactgtcacaaaattgctgcatttaaacagaaatgtattctctcacagtcaatatgaaatcagggtgtcggcagggctgcacttgctctagagactccaggggagaagcctrcctggcctctttcaggttctagtggttccaggttgagggcagcataactctaatttctgccaccatcctcacgtggcctgctcctccccatcctttctctttctcttttcttstaagaacatttttcattggatttaggtcccactcctatccagaatgatctcattgcttagtgtaattacatccacaaagatcctttctttcaaataagctcacattcacagattccaggtggaacctgtggatatcttgtgggagaccacacttcagtccactagagtctgctctctggctcccaaaaatgcatatttgtcccatgtgcaaaacatcccatccccaccwsctcaactcattacagcatcaactctatgtccaaaatctcatctaaatatcatcaggtcaaaagtgccaaatstcttcatctaaatcagtatgggtgagacattttgtacggtccatcctcagacaaaattcctcttcatctgtgcctctgtgaacctagaaagcaagctacctgcttccaaaatactgtggcaggacaggcaaaatacaatgataggatagggtagacatttccaayccacaagggagaaattgtactaagtaaaggggtcacttaccccaaccaaattagagatgcagcaggacaaatttcaagaagttgcaaggacttgggaacagcactctgtggttttccactcccttgtctaggctaggttctgcctctttggttcttagctccatcctccaggcccaggccccacctgctgtgactctcagctctgccctctgggccctctagctgcatatagagaatgggttgtactgatctaggataaaagccaggaaactgggtgggatgcttgtttaggccaataggagatggcttaacctggggttatagtgatagggaaaaaagcattgtggtcagctgagattcagaaaatattttgggggcagaaccaactggattttgcacaaattgaagtttagaggcaggagaatactgatgaaaaggaatcaaaytgccttctaggattttggtgggcaacttggtaagagggaaagatgtggaagttctttaaaatgtaggaagttctgtgtgagtgaagggaattcttcataccccatagtccttgcagctagagagtaggcagcccctacatgcaagataaggtcatatctcaaaagcctttcctttagtgctcaactagtttctattccaascttcatctctacttcaaactcaaagcgccatttcccatagaagagttctggggataaaaagaggaaaagagttattcttggaggccttccccataacccagcatgctgagagggccttcccccagctgctgggccctctgccccatcccaccttcattctttagacacacttttcttggctggaccaccccaacccactaccaccagcccagcaaatggactccgggcgttggttacataacccactcatttttcactgaggtaggagatgggactccactgtggaggtggggcttggacaccagaccaaattgagaactaactaaaacagggacagggtagaagctgctttccgtaagayatgcccagcaatgtgccatgtcagtttaccattkccttggcagcacctgaaagttatcgccctttccgtgacagcaacccagtgatctagaagttgccaccctttcctagaaatttctacataatctaccccttaatttgcatataattaaaagtgagtataactatgaccacagaactctgagctgttgctctaagctcactgcctatgggggagccctgctctacaaggtgcagtccctctgccactgctgtgcacggccccttcaatcaaagctgttgttgaacaccactggctcacccttaaagtctttcctgggctaagccaagaaccctccagggctaagccccaattttggggctctcctgctctgcagcatcaccaggcctatagctcaacaccacagtcattttcagtttgaaatcactctggcctctgttgatatggctgctctcaactggttgaagacaaaaggaatcgacaaactaaaaccctttgggaggaccgggcacagtggctgacacctgtagtcccggcagtttgggaggctgaggcaggcggatcacctgagrtcaggagttcaagaccagcctgacccacatggagaaaccccatatctactaaaaayacaaaaattagccatgcatggtggtgcatgcctgtaatcccaggtactcgggaggctgaggcaggagaatcacttgaacccgggaggtggaggttgtggtgagccaagatcgtgccattgcactccagcctgggcaacaagagtgaaactctgcctcaaaacaaaaraaaacaaaccctttgggaaaacagamtaacatggaaaagtacaaacagtatacaccctccacactttgaggagtctagggtggctttcagctgcctgccatgcatgcagatttccacattttaactcttgttttaattttttccaaatgttctttattgtggaatatctgataatataagtagtctttaggggcttcctacagctgactcttaataagataaactgaaataatgctgaccacttctaggtgcccggcattggcacacagtatctataatacacagcagcaaggaagatcatagtatcccttgtttgcagatgaggacactggctcagaagggctcagtggcttcactagtcttacgagagagggtgggtctggagatttggactcagcagttgtcagcaaatggattgcatttaaagcttcaggataagcttagcctggaaataaatgtggatggagaagagatctgaggctgagacctgaggtgatccaaagtttagatccagaaagagaaagaagatccagaaaaggggactgaaaaggagaatccacctgtgattcaacccctctgggccacgctcccccgatgagtgtagcagactccagtggctactccacattctcaacagctatttatccacgggcttatctgtttgctcaaaacacttattaagaagtgagcaatgggccaggcactgccaagatgctcactggctagagaaggaggctggtagagcaaaatcattagaatactcataatcgtcctacaacgtgctcaggatgggcaagcttcaaatggggatcaatgcaaacccacttgccaggtcatttatgctaatatagccagcctgactacattgatcagattagccccagtaaataaataaygccactaggcaatggcaacacacaaactagtgaaaacaatctagaaaccattctcaagaagtttgtaatctggtggaacagtgagacaggcacagagaacatggataacacaaaaatatggcaaattcaaagaaagaatgcatgaatacagtaaaagttcctgagggcatgcccaagaataaaccatcaaatatatgtgayattgattttcaacaaggatgccaacccattcaatagaggaaaagacaatcttttcaacaaatggtcctggaaaaacaggatatccacrttcaaaagaataaaagtggacccttagctaacaccacatacaaaaattagctcaaaattgaccaaagacctaaatgtaggagctacaattctgaractcttagaagacaacatatggagaaagctttttccatgctaaatccatgacaaaggrtttagcaatgatttartgacaccaaaggcacagacaacaaaagaaaaaataggcaaattggacttcatcaaaattaaaaacttgtgcatcagaggacccatcaacagagtaataaggcagcccacagactggaagaaagtatttgcaaattgcttatctcttaagggrttaacatccagaatargtaaaaaaccaaaatgcaacaacaaaaaagcaaactcaattaaaatatggcaaaggatttgaagacttttctccaaagagtatgtactaatggccaataagcacaggaccagacgctcaacatcactccttattagggaaaaacagatcaaaaccacaatgagaraccacttcacacccattaggatggctattatcaaaataacagaaagtaaccagtgttggtgaggatatggagaaatcggtacacttgagcaccactggwgaaaatgcaaatggtacagctgctgtgaaaaacagtatggcagctcctcagaagactaaaaatagaataatgacagccgggcagggtggctcatgcctgtaatcccagcactttgggaggccaagaygggcagatcacgaggtcagragttcagatcagtctggccaacatagtgaaaccctgtctttactaaaaatataaaayaatagctgagtgtggtggtscgtccctgtaatcccagctactcaggaygctggcttcccgcctggcttccacaatttaaaaaatacttttctttaaaaaaagggtagtggggaagcttcctgtcttccccaagaaaagttaccaagggcaatatagccaagcaagttgatctttcagagcactttagttcaaagccagaaaggcatccagggaaatcctgagtctttgaaaaagtcattaaggcaaagcatttcttccttctctttgctctcctacagagcatacctgtcttcggtgaccctgctcaaaatctttctcccaccagctcttgaaaggkgaagtgcggccaagcatgtgaccctggatagggcctcctgacattcgatctttgttcattttgccacttgatgcccacgacacagcgaggcacttggaatgtgacaggtagatgctgtgtgagtcatgtgctgggatcagctgcagcttttctgaaggcagtcttagggagaatggaggcaggagttttaaaggtcataaaaatttcaagcgaaagagatgctccaaatctcttagraaaaattgtcaacagaaaagaarggaaataaaggtcacatgattatgaaatggaagggcacaaaccccaaggtggcattcattttgcatttaagtcctgtatcagattgccagcatcctctctgcgcaaatgcgaagccgaggtgccgcagtggggctatgaccccaaggatcaaactacgccactttgttacagactgaactctttctttctctgggaggaacatcgcaaacttgggtcgtgttggttcaaragatgcatagaggctgatgtcctgggaggaatggtctctgcacaaaggtaagcagatactaccattccgtttcacacctgcagcagaagaaaaaacatctgtgccaacttctgactgagagtcctctagcaggtcctctcctttcctttggggtcacctgaattataatgtttaaacttgtctttggacagaaccaaccrcttttgaccagctcttttctcttgagggaatcctaaccttaattaaccaataggtatatgtgtgagggtttccattccagcttgggttttgtttggaagaaatatgttatttaatgactttttggaaaatatttcaagttaagggattcttttgatgttcagatacattaaatagtaaactgttccagagagctgtgagtgacaggaaacaaaattatttactatttacacagtttggggtttaacttaaatatttattgtgtatcagccccttagatttccttgaaaaatctgttttgtaatgtatgtttacatggyttygtctaagcaggacctcagatcaaccactgatttgatcaaatcagtttaaaaacagggcatattgagcaattgatcttgctggggattttgttgttgttgctgttttcctgcattggctaattaatttraaatcagtctttgtatgtggcactgagggatagatgatcacctcctcttgttgcctgacattttctcttgatacagccctccttcccttatccccaaagtttgtgtgttcggggtaggaaggagggaggagagatgattggaaacttacctcaagagattaaaaaaattctgggcaaagcagggttaataaaatttaagacaaaatagaacgagtgcagtcagttatgcgatttttagatttgttttttgctataggtacatttcccyaatggagtcaagaatgccgacacttctggcaaacagaaaagccttgtgggaaaggctgggtaaggatagagttgctttttacctctggtgaggttatgtagactgggtgcctttgttctgtctcacaatagagttatgaataagatctcatggttagcagtagccttagacatgtggggaagcaagctatgggctgcatgaggaaataattacataayccaaaaaggaggccagaggttgtctaagtaagcttggagaaacaataattccaaaataagctgagaccaactytgtagcgtaatgaacattcaaagctgtgcagmttcaacagaggagatggctgtgtcattaagaaattatgtccaacatcaaaagccaattaaaaaatgaaggtgatgaaggrctggtcccctctggctaacgtggctggaagctacaaccttgcaaggccatttctgarattttcacacctgcaaagcaaagggaaaaaagcatgcattctagtgacaaaatkcaattaattacaggatctgttataaacagtcagctgwataactttggcagaaagcaaattcgtcatctcgagaggattttgctgttctaaataaataagtgcsattagggtgatgagcaaacttctacctacttcyacctccttcattttgaagagagagaaggacagagacagggtgcaaatttgagcaagatgggaagcattcaagaagaamytaaataactccaaacagaaaagtgggtgaatggtgactgatgyctttggatgagtgaaaccaatttatctrccagaagcccctggaatgcacatggcttggctccacttcascatttgaggatggcaaatctcttctaaatcataagtagttcgrgcagcaaaatcttgactttcatttcatcttatttyatgytwtggagttctcatccaatccaatcttttttatagaagatggtcaataaatcattcaaaattagaattgtagatttatgtacatcagtggtactcagctggggatgatttgacccccagggaacrcttaccaatgtctgcaaacatttttgatggtcacaactaatatggagggagtgttgctggctgctgcgatctaaagggtagagcccagggacccggctcaccatcctgcaacacacaggacagcccctataaagaaagatctggccctgatgtcaatatgccaaggttggaaaacccttrtccagtggactgtgcattttagagcattcagcgggccagacaacaaaccttcctgagcaaccctttctacgccaagcactgtgtataatactcagaggagaccgtggcttacaaaggacaaaacccaactcataagctcagacagaacggggaatccattggccctagtaactaatacgcatggcaggaacctttaatgagttaagtatacctggttccacacatggattctgttcagatgcaccaacatgtctacaaatgaaagctcaggtttgcaccttttcatgtgtgttatccttttgaggccatctgccttctccaagcagaacttgtgtttctcatcaatggaggaggaggaaaaaagagygtagagccctctgattttctattatcttgtagatttgctgtaagactgtttaatgttcctctggggtttgaacttttccatggaaaacagtggctaacataaatgcaatttgtaaacagcataaatttaaaayttctgyagcttgagcacatgcactgtgcaatatggtgccacttggagatgttgcatacagccctgctgggcagcacagtgctgagaggctctttggtaagatttggagcarctataagtcctaagagatcaggccaagcgtagtgctaagctagcatcttccacttttcctcaaaagtaaaaaaaacaaaactggttttccctgtctccgtggttcacctacagccctaaatgtgctgtgggctctytactgattagaagggtgtgactaaatatgttccaatcattgaaaagagcawaaggcaatgtgcacacatacacatcactgcttcttcctcagccacagaaaccattggacttcaaccagaagttcattggagcaaaagaacccaacaaaacaagcatcaggaattctttagatgccttctttgaaagtatgaaatttgcagaattgaagcaaattgckgagctgtttcctaagagatttcaatggaaaagcatgaggacatgattcataggagttctgaggagacacgctgaccatgttgttggcttggttggaggcttgtcctttwaaaagcacctatttcttgtaaaaaatgaaggaggtttttcctcgttctgcacagccagccactcagtggccgcgggacttccatggccatacgttgggcctttggagccttgcaacattctgagactgtgagcttcttgagggctggggctttggctttgcacctgtgtgtacccaaaggtcttggacatcaacttaggttgrgtagaactttctgagkaaagccagtcaaatgtcacygkcctcattgtccatacaagaaaaccaagaattygcgtttggtgggatcctgccacattacataggaaggtcttaraagatccacagcagatgtctgtttgggccacattgctcccctgagaatctcytcccttcttgtggttcactttccccgctgcrtgctgagccatcactctctgaaagactctgtccctttgtttactgggcttttcatccccagccagaaattyccacagttcttcgctttctggttttctacacacyccagttgccaacagctatagccctaactccaagcaggaagtgaccgctggaaagcagctgaacaaagcaaaggtgatcaaggtcactggatgggagatgaaggatgcatcgacacctcaggccgaagggtccttgargacaggaytcaggtctgattcttctttgtctgaaatcgacacattacctgacaaagtcaaaatcctcaataaccactcactcaacccatttgtctaaccatgggtttgctgtgtgccctaagcaccktactmgggtgatgtcactgaattctcaatataatcctatatgatcaaggccaacattaccattgacagsctggacctctgataggctaatgagaagcacacttcccttctgacatcttcctccccaaaatcaataagctcagtctaatacgaggaaaacatcttgcsaaaacccaaattgagggacattccacaaaacacctsactataccttttaaractgtcaatgtaggccgggcacagtggctcacatctgaatcrcagcactttgggaggccaaggcaggtagatgacttgaggtcaggagtttgagaccagcytggccaccatggagaaaccctgtctctactaaaaatacaaaaattagccaggcgtggtggcaggtgtccgtaatrccagttactcgggaggctragccaggagaatagcttgagcccgggaggcagaagttgcagtgagccaagatcacaccactgcactccagcccaggcaacagagcaacactccacctcaaaaacaaacaaacaaacaaacaaacaaacaaacaactgtcaacgtcatcaagaccaagacaagtctgagaaaattgtcacagatcaaaaaggyctaagaagaaaactaaatgtaaggtggtgtcctggatgggaccctggaccagagagggacattaggaaraaatgagtgcagtttgaattagccatggagttcagttaatagtaatgtgccgatgttagctttgcagctgtggcagacrcactacagaaatgtaagatgacatatatacaacaagagaagaacctgtgtgagaggcttacaggaactccctgtactttctttgcaacttttctgtaactctaaagtgactttaaaattaaaaatgtatttaagtaaaaacatttgttaaaaaaaagaaaaaataaccttctaaggcagctactattgtttttcccaattgacaggtaaggaaacggtccaggtgagttcagaatcattgtctcctaagctgatgatyattctagtatcttctgggacccygctttaaggctcctgtttacaccagggcccctgagaattagatcatgaaagatttccaagggatagtttctctgctcagaatcatgagtgacccaaatcgctgggaggggagagagggaaggagcttgtgaggtctggctatgaaagttscacaccataattgaatcgtttgaacactcccagggagaaaacgtctggagattgatttagaggggcattcggggacttctttagaaccctgtaagtcttggatgtctgagtgggatgaaaaatggttccaattcagtggggcccagaaggcaggaaatcttcgggcataacctctaacaccataaagacaccaaactttctgtccctctcaaaagtcaaaggcccacagctgcttccaatcaaggaaagcaaactatccagggcaccacatgctcayacattcccactgctggcccttcaagcacagttccttcrcacacccagtgcagggaaaaaaccacatcctttcaagatccctggcccatcttcctccctttcttctccyctctttgataatgctgttgcatttctcatagtgggcggsgrggagggttccccaagtcctcagatgcctccggcatcacacacagmgacttcacgaaaggtcccctttgtcccagtgctcacctctaccagctagatttccccataacattcagccttatacattcgcatgctatccagatacacagtggactgcaaggcagacgtctctgtgtttgaccttcccaacatctgttctccctgcctcccacagcaacttggtcaacactgcatcccccatgagctggctctcatctctgaggttctcataaaaaaggtcccacctcccctgtccagtcccagcttattcacagtcccagtgaatgctggactcakggaaagggaatatgaaccaagcatatttgacttggatttgccactaacaaacaagagtcctgagtgctctgcgaacaaagggtaagtcctccrtgatgtctcccagattgcctgcgyggctgcaggtcagtacccatcgcacagctttagcgaagtgcctgcctctttcatttcccaaagtaccccatgtggaccaattacatgaccatgttacttaggataccaccttcttcccagaaaatcaccaccagctgcttgataaacattcttctcactatgttcttctatactcaacttaaacacagtattgtttcttccttatttytacaaaaatgcaaatatctgggccgggcacagtggctcacacctgtaatcccaacaatttgggaggatgaggtggaaggatcacttgagcctaggagttygagaccagcctgggcaacatagcaagactccawccctacaaaaaaaaawtttttttaattagctgggcatggtggtgcacacctgtggtcccagccactcargaggctgaggtgggaggatcacttgagcctaggaggtcgaggctgcagtgagctgtgatggcgccactgcactccagcctctgggcaatagagcaagactttktctcaaaaaaaaaaatgcagacatctyattaatacttgtatacacttttmtttttggacccagtcacccttccgtgccatacttatgggtttacttgttcttttggacactgcagagtrtccattgaatgaacacacaatggcttayctaacaytgacttttggatggacgtttargttattcccactcagtcactgttacaaacagtgctgcatcctcctacaaaagtctccgcgtgcytgtttctgtaggacaagtgtctagaagtggatggccatattacctgaaagggaaaatgtgcagtacctccctggggacagacctcaagtggctccagcatcactcaccttgacccagggtttccgtggtcactccgcactgggactttgtagcttgrcctgtgaacacagagctcacattcagtgggcacctcagcgtgtcaggctctctgatgcctctttgcttctagaatttcatgagtgtttaactctgtgaaggacctgcaattataaccccattttacagatgtagaattgaaggtctgggaaggtaggtaattttcccaaaatcacgtagatgatacatggaaaaatacagactcggctcccttcctgcctaactctggagcccgggcccatcacccccactgtccctcctggcagctgtgmgccttggagctggttgcactgtcacagtcccctccatccccatgaactctgtaaatgccacctccacagaaattgattagaaatcagaggaattggccaggcgcggtggctcgcacctgtaatcccagcactttgggaggctgacatgggtggatcactrgaggtcaggagctagagaccagcctggccaacatggcgaaaccctgtctctactaaacatacaaaaattagctgggcatggtggcaggtgcctgtaatcccagctacttgggaggctgaagcaggagaattcttgaactcgggaagcggaggttgcagtgagccgagacacaccactgcyctccagcctgggagacagagtgwgactctgtctcaagaaaccaaaaaaaaagaaagaaatcagaggaattggtatggggttgggtgtgaagtttttttttcatctggtttgagttatgaaatcagggtcatgttgatatttttcatgctgtactcagatgacagtgattattttctttcattcatttattttctttttgtatcagcttcagctmtgaaatcctcctcagtacagccttcctgatcttcctaaaattgcacaggatgagaaggattttctgtttcctaagcaagtcggctccattggggtgggtcagacacttccacggtctttgtcttttggtctattttgtccacaaacttttggctccacagagaaaacacatttctgcaatgctcccataaactttcacaaactggatgcctctgaagccaaataaaagcaagttgtgccctcctgggctgtgagaaccatgttcccagccagaagacacataatgagaaaacatgaaagattttacacgcaaacttggctttactctccctcacttttgtttcctctytgcggctttctttacttttcttaggatttctakgctgctttgtgtcaggaaggatgagcagcccctcacaggaaggaccagtgaacacacttgaccttcttgtggctcactagtgtcatyctgcagcacgyctaagaggaagtggcaggcgccatgcatcagatagaaggctgggaggagcattctatatccagaatgtggccacaccacccttgtctgggaggtactgaagattcagcaaacacatcaaggacgtaatacaaaaaaaaggctcacccattaatctccctcccccacatctcccaggtttaaaacttgaccttctggagtgtcggcaaactgagaaatccagcagactcccacgcatgaggactccggagatgaccacaacgccatgaccagccgtggaggcagcttgggggatggacgaggctaagcaggtgaagcttgcctgctgagtagtacacatgagttagaagtcaggagttgccaaggtgaaaacctagcaacacatcgggttttaacaacayaaggcttgaaaaatatgaagaaacaggcaagatatataacaagaccatgtatgtacataaaaaatacatgcccataatttattratggtgatagacgtcagaaagtggttacttctggatgggggagatagtaatgtactgatggggcatgagagacctttctgggtactggatgtcttctgtatcctgatcttgttggtggctgtgagtatagacatatgtgaggtccatcaagagatacacttaatatttgtatatctatgtgyatatgcatacaaagcaataatacacattttgcaaaaatgaaaacaaatgattaacgcatctgtatggtggtcagtggggcagagggaaaagggactggagkaggatattaatagggatagaargatggatgactggttggatggatagatgggtggatagataaattgatagataaaactagttggtggagacggataatattaccattcttgacccagcatagctggcarggttctaagytgcagccatcagaactgactccgarttgcttargcattgaaggaatggatcagcaggacatcaatgagctcacagaactgacaaaaatgttcgtgcatyggactcagaaagcaagccagttccagggaygctgagtcgccacagagaccacgaatctgggccccgcagccggctcttctgctgtacactcagaactccaccttcatgtcacgagcaggctccagtggtcccaaagtctttacctgtcactcccaagattccaagtcctcactgacagtataagattggccaagcaaagacaggcggttgagccattgccacagggaggcagaggaggaacaagagcctctactgccccttggctctggtagggactgacacactaaggggatatcccccaaagaggatgagtgtgccccactgctct

SEQ ID NO: 13515 - DNA, 201 bp, Homo sapiens
gtgctgaaagctctgaagaagctaaggattgaggctgatgaggtaagtgaggggaggagggtggccccagagatcccagaatcgccccctctgtgcccagkgtccagggcccaactcagccagggagagctggaccgaaggatatgaacttctatgggatagaaatagaaggatatgaacttctatgggacaggcattgcc

SEQ ID NO: 13516 - DNA, 201 bp, Homo sapiens
agagacgaagacttcatgtgctgaaagctctgaagaagctaaggattgaggctgatgaggtaagtgaggggaggagggtggccccagagatcccagaatcrccccctctgtgcccagtgtccagggcccaactcagccagggagagctggaccgaaggatatgaacttctatgggatagaaatagaaggatatgaacttct

SEQ ID NO: 13517 - DNA, 201 bp, Homo sapiens
cttttccctgtgaattttctggacttctttgtgttttctcctgggaagctctgaagtttccataattcctgggctccagaaagaagaaaaggcggccgtgragagacgaagacttcatgtgctgaaagctctgaagaagctaaggattgaggctgatgaggtaagtgaggggaggagggtggccccagagatcccagaatc

SEQ ID NO: 13518 - DNA, 201 bp, Homo sapiens
atattttcctcaccccaaaaggaaaccatgtacccgtgggctggtggctacctgcttggacagcccagttctaggtcaaattctgtgttttatcccttttycctgtgaattttctggacttctttgtgttttctcctgggaagctctgaagtttccataattcctgggctccagaaagaagaaaaggcggccgtggagaga

SEQ ID NO: 13519 - DNA, 201 bp, Homo sapiens
ggaaagaaggagggaaggaaggaaggaggaaggaaggaaggatggaaggaagggagggagggagggaggggagggaaggggagggagggagggagggaggkaggtatgtcaccatgttggccaggctggtcttgaactcctgggctcaagtgatccacccacctcaccctcccaaagtgctgggattacaggtgtgagcca

SEQ ID NO: 13520 - DNA, 201 bp, Homo sapiens
aagagaaagaaagaaagaaaagaaagaaagaaagacagaaagaaagaaagaaagaaagaagggagggagggagggagggagggagggagggagggaaagarggagggaaggaaggaaggaggaaggaaggaaggatggaaggaagggagggagggagggaggggagggaaggggagggagggagggagggagggaggtatg

SEQ ID NO: 13521 - DNA, 201 bp, Homo sapiens
gttgaaccggggaggtggaggttgcagtgaactgagattgcgccactgcactccagcctgggcaacagagcgagactctgtctcaaaaaagagagagagaragagaaagaaagaaagaaaagaaagaaagaaagacagaaagaaagaaagaaagaaagaagggagggagggagggagggagggagggagggagggaaagaa

SEQ ID NO: 13522 - DNA, 201 bp, Homo sapiens
ctgtcttattgttgaaccggggaggtggaggttgcagtgaactgagattgcgccactgcactccagcctgggcaacagagcgagactctgtctcaaaaaaragagagagaaagagaaagaaagaaagaaaagaaagaaagaaagacagaaagaaagaaagaaagaaagaagggagggagggagggagggagggagggaggg

SEQ ID NO: 13523 - DNA, 201 bp, Homo sapiens
tttttaaaaattagccaagcatagtggtacacacctgtagtccaagctacttaggaggctgagacatgaggatcacttgagtcccggtgttcaaggctgcrgtaagctatgattgcaccaccgcactggtggtgggcaacagagcaagaccctgtcttattgttgaaccggggaggtggaggttgcagtgaactgagattg

SEQ ID NO: 13524 - DNA, 201 bp, Homo sapiens
gagggctgtgacagttcctctcgcttggtggagatagatggaaagagctgaaggttgggcatggtggcccatgcctgtaaccccagcacttttggtggccraggcaagaagatctcttgagccccagagttcgagactagcctgggcaacatggtgaaaccctatctctacaataaaagaaaatatttttaaaaattagcc

SEQ ID NO: 13525 - DNA, 201 bp, Homo sapiens
aaggcatatctgaggctcggtaatttataaaggaaagaggtttatttggctcatggttctgtaggctgtgcaagaagcatggcgcctgtatctacttctgrtgaaggcttcagagagcatccaatcctggtggaaggggaaggggggctggcgtgttacatggtgagagagagcaagagagagagaagggaggaaagcacc

SEQ ID NO: 13526 - DNA, 201 bp, Homo sapiens
gaaaagtaaatgcaaagtgtctggagtgggaaagaccttgatctgtgtcttacctatgtctataacattctgtactaatataaaggcatatctgaggctcrgtaatttataaaggaaagaggtttatttggctcatggttctgtaggctgtgcaagaagcatggcgcctgtatctacttctggtgaaggcttcagagagca

SEQ ID NO: 13527 - DNA, 201 bp, Homo sapiens
tgggtctccaggccccaggggtcttctggaggggtcttctggagaggtcttgcaaccatttcttattgcctccttctcagaccatccgggctaccactgaytactgccgccgccacaagatcccctttccccaagtagaagaggctgagctggatttgtggtccaaggcccccgccagctgctacatcctgaaaggagaaa

SEQ ID NO: 13528 - DNA, 201 bp, Homo sapiens
ccaggttcacgccattctcctggcccagcctcctgagtagctgggactacaggcacccaccactgcgcccagctaatttttttttttttttttttttttgkatttttagtagagaccggtgttagccaggatagtctcgatctcctgacctcatgatccacccgcctcagcctcccaaagtgctgggattacaggcatgag

SEQ ID NO: 13529 - DNA, 201 bp, Homo sapiens
cctcccgagtagctgagattacaggcatgcgccaccacacccagctaatttttgtatttttagtagagacggggtttcaccatgttggccaggctggtctygaactcctgaccttgtgatctgcccgcctcggcctcccaaagtgcagggattacaggcgtgagccaccacgcccggccaataaacagaaatttaagcaag

SEQ ID NO: 13530 - DNA, 201 bp, Homo sapiens
acatttcctggatgcctgctagatccagtccgcccaggtcctgcagccgtggctgcatacaggtcagatgaggctcttgctcttgtagaatgtacctcctyccgggggggcaacatgacataaacaggtaaacaaagaagtcaacaggatggccatggagagtaagtgccatggagacgaccgaacgtgcggtgtgctgag

SEQ ID NO: 13531 - DNA, 201 bp, Homo sapiens
ctctctcggtcttgcatgtttatgcatgttgctgcctctctctgcagccttcttgtcctacctgaatatccaaccccttccacctgggcatcccacattcytcatccagtctcaggtgagcagctgcttggaaggcctagcatccaggatgggtggtcctccggggcctgattgtgccacttcccacagtgggctcctttt

SEQ ID NO: 13532 - DNA, 201 bp, Homo sapiens
gtaaaaagttataacatgtacaatattttaattataaggatcaacactgctactattaggtaataatatttttaaatattaagatttttttgtttttttttgaatttttacttcaatagcttttggggtacaagtggtttctgttacacgatgaattatgtagtagtaaattctgagactgtagtccacccatcagtgtat

SEQ ID NO: 13533 - DNA, 201 bp, Homo sapiens
gtgtgcagcagtgtggggtcaggaaccacatcactttgctcaccatggtgttcattctttcattcattgattccacaaacatttcctggatgcctgctagrtccagtccgcccaggtcctgcagccgtggctgcatacaggtcagatgaggctcttgctcttgtagaatgtacctcctcccgggggggcaacatgacataa

SEQ ID NO: 13534 - DNA, 201 bp, Homo sapiens
gccacttcccacagtgggctccttttagcttgtcaatcgtgtctcctgcgatgagactcccattagggataaattgtgtctgttttcttccttcatttaaygaacatttattggttacctatgctgcatcagccatggttccaggagaggcaggctagagtagtaaagaagacaggaagcagggggccaggcgcggtggct

SEQ ID NO: 13535 - DNA, 201 bp, Homo sapiens
actctctctcctcataataaggtgtgcagcagtgtggggtcaggaaccacatcactttgctcaccatggtgttcattctttcattcattgattccacaaayatttcctggatgcctgctagatccagtccgcccaggtcctgcagccgtggctgcatacaggtcagatgaggctcttgctcttgtagaatgtacctcctcc

SEQ ID NO: 13536 - DNA, 201 bp, Homo sapiens
ttcatttaatgaacatttattggttacctatgctgcatcagccatggttccaggagaggcaggctagagtagtaaagaagacaggaagcagggggccaggygcggtggctcacgcctgtaatcccagcactttgggatgccaagccggggcagatcacctgagatcaggagtttaaggccagcttggccaacagggtgaaa

SEQ ID NO: 13537 - DNA, 201 bp, Homo sapiens
cacaccattgcactccagcctgggcaacaagagtgaaacacagtctcaaaaaaaaaaaaagaaaaaagaaaaagaaaaagaaaaaaaagaaatgaaacaamcaaaaaaaaaaaaaaaaagaaaagaaaatcaacaacaacaacaaaattctctgtgacccaatttctcctttgtaaaatggatacaatagtgcatagcccc

SEQ ID NO: 13538 - DNA, 201 bp, Homo sapiens
ttatttatgcttatttgttgactctctctcctcataataaggtgtgcagcagtgtggggtcaggaaccacatcactttgctcaccatggtgttcattcttycattcattgattccacaaacatttcctggatgcctgctagatccagtccgcccaggtcctgcagccgtggctgcatacaggtcagatgaggctcttgctc

SEQ ID NO: 13539 - DNA, 201 bp, Homo sapiens
gatggtgcctccctgtgtctacacatgattttcctctgtgcctgtccactccccaccttctcacctgtagaactcagggcttatttatgcttatttgttgrctctctctcctcataataaggtgtgcagcagtgtggggtcaggaaccacatcactttgctcaccatggtgttcattctttcattcattgattccacaaac

SEQ ID NO: 13540 - DNA, 201 bp, Homo sapiens
atgccaagccggggcagatcacctgagatcaggagtttaaggccagcttggccaacagggtgaaaccccgtctctattaaaaaatacaaaaaattagccargcgtggtgatgcacgcctgtaatcctagctacttgggaggctgaggcaggagaatcgcttgaatctaggaggtggaggttacagtcacccaagattgtgc

SEQ ID NO: 13541 - DNA, 201 bp, Homo sapiens
atcgaggcaatcacacttttgacatattgcatgagatgaaactttttcctacaaattgggtggttacaaagtaataaacagaattttttttttttttttttgagacagagtctcgctctatcacataggctggagtgcagtggcacaatctcggctcactgcaacctccacctcctgggttcaagcaattctcctgcctca

SEQ ID NO: 13542 - DNA, 201 bp, Homo sapiens
ggtgtgaacaggggtggtttctcctgagacctctctccttggcttgcagatggtgcctccctgtgtctacacatgattttcctctgtgcctgtccactccycaccttctcacctgtagaactcagggcttatttatgcttatttgttgactctctctcctcataataaggtgtgcagcagtgtggggtcaggaaccacatc

SEQ ID NO: 13543 - DNA, 201 bp, Homo sapiens
gcctgtaatcctagctacttgggaggctgaggcaggagaatcgcttgaatctaggaggtggaggttacagtcacccaagattgtgccattggactccagcstgggagacaagagcgagcctctgtctcaaaaaaaaaaaaaaaaaaaaaagaaaaaaggaccggaaggggcatggatcataaaaatatagataaatccata

SEQ ID NO: 13544 - DNA, 201 bp, Homo sapiens
ccacagatcaggtggcttaaacaaccgacacttattgtctcacagttctggaggctggaagtccaagatcaaggtgtgaacaggggtggtttctcctgagrcctctctccttggcttgcagatggtgcctccctgtgtctacacatgattttcctctgtgcctgtccactccccaccttctcacctgtagaactcagggct

SEQ ID NO: 13545 - DNA, 201 bp, Homo sapiens
gagtctctgcaccatgcctggtccatagctggtgttctggattaacaacaatgcttatctggtgatgatgagaatagcaagagtaataggaagaaaaccggcagcatttgttaaacttcaatcaaagacgacttcagagacctaagctgtccactacagtggttgccggccacatgtggcacttgagcacttgaaatgtgc

SEQ ID NO: 13546 - DNA, 201 bp, Homo sapiens
aattttattgctcttttcttggcaggtttatggggaagtgctcttggtaacactgaagtcattagggaatacatttttggtgagtatttggggaacagaamggtcaaaccctagagatattttatgcaaggagattcacagtacttttcctactcatggcagaagagagacctgtgtgtaattgttctagcaactgctttt

SEQ ID NO: 13547 - DNA, 201 bp, Homo sapiens
ctgccaccagcagcgtagactcaggtctgaggatgagatccccagtggtttctgataccacacagtccatctctaacattctcctgtcatggttgtaattyctcattaatagatttctttttcctgcatacccgctacattcctggttctgtgctgggactcacttgccgttgtatttcctctgcagagacctggttcgag

SEQ ID NO: 13548 - DNA, 201 bp, Homo sapiens
gacccctctaaaaaaaaaatgtggcctacgtgcagaggttccaccctgtgggacccacatgcctccctcacactgtcttggcacattctcccaaagctgcyggagtctcatttgtccaatatgaagaagcccgtggaagaagggacactaccctacccgatatttgcagccattgacaatgacctgcaaccttcctggcag

SEQ ID NO: 13549 - DNA, 201 bp, Homo sapiens
tgactctgatgaggcctttctcccatcgtgctctcattttcctgcctgtgaaatggaaggattgtcccagatgattttgagtcctccttcgaacttgatcrttctgcagttgtatttatttaatggaaattttccgtttcctctgtgtgtcgccctctccatgaggcaggtgttcctgtgaaggacctccttgcacacatc

SEQ ID NO: 13550 - DNA, 201 bp, Homo sapiens
gtgagccaaatcatgccactgcactccagcctggtgacagagtgaagactctgtctcaaaaaaaaaaaaaaaaaaaaaaaaaaaaggaaagaaaaggggggatttaggggagggagagcattatgacaaatacctaatgcatgcagggcttaatacctaggtgacgggttgattggtgcagcaaaccagcatggcacatgt

SEQ ID NO: 13551 - DNA, 201 bp, Homo sapiens
aattggtgatactcctgccttggcctcccaaagtgctaggattatggcctcatatctatttttaaaaaataagaattcaagctgggtgcggtggctcgcgmctgtaatcccagcactttgggaagccgaggcaggtggatcacttgagttcagcagttcgagccagcctggccaacatggtgaaaccctgtctctactaaa

SEQ ID NO: 13552 - DNA, 201 bp, Homo sapiens
agagagacgcgcttgaaatatttctcccattctcctcgcttggccgcccctgagattattaaactctctctctttgctgcaacacctgctgttcgcattgrttttgtctgggcagtggacaaggagaacccatgagcccgtgacagtcccagccctcccccactgtctttgctaagcccaacagtgggcacaggactaaga

SEQ ID NO: 13553 - DNA, 201 bp, Homo sapiens
gaggtggagcttgcagtgagccaaatcatgccactgcactccagcctggtgacagagtgaagactctgtctcaaaaaaaaaaaaaaaaaaaaaaaaaaaargaaagaaaaggggggatttaggggagggagagcattatgacaaatacctaatgcatgcagggcttaatacctaggtgacgggttgattggtgcagcaaac

SEQ ID NO: 13554 - DNA, 201 bp, Homo sapiens
aattttcagagagacgcgcttgaaatatttctcccattctcctcgcttggccgcccctgagattattaaactctctctctttgctgcaacacctgctgttygcattggttttgtctgggcagtggacaaggagaacccatgagcccgtgacagtcccagccctcccccactgtctttgctaagcccaacagtgggcacagg

SEQ ID NO: 13555 - DNA, 201 bp, Homo sapiens
tcaagtgaagatgaggtcactcgtgtggaccctaatccacaatgactagtgtccttatgaaaaggagagatttcgccgggcgcagtggctcacgcctgtamtcccagcactttgggaggccgaggcaggtggatcacaaagtcaagagattgataccatcctgaccaacatggtgaaacctcatctctactaaaaatacaa

SEQ ID NO: 13556 - DNA, 201 bp, Homo sapiens
agacagaggcagagaaagagaaagagcgaggaaaaaccctagcctccaaattttcagagagacgcgcttgaaatatttctcccattctcctcgcttggccrcccctgagattattaaactctctctctttgctgcaacacctgctgttcgcattggttttgtctgggcagtggacaaggagaacccatgagcccgtgacag

SEQ ID NO: 13557 - DNA, 201 bp, Homo sapiens
ttgggaggccaaggcgggtggatcacctgaggtcgggagttcaagcccagcctggccaacatggagaaaccccatctctactaaaaatacaaaaattagcygggcatggtggtgcatgcctgtaatcccagatactcaggaggctgaggcaggagaatcgcttgaacccgggaggcggaggatgcagtgagccgagatcat

SEQ ID NO: 13558 - DNA, 201 bp, Homo sapiens
gaccttgcatggaaataaggtctttaccaatgtcatcaagtgaagatgaggtcactcgtgtggaccctaatccacaatgactagtgtccttatgaaaaggrgagatttcgccgggcgcagtggctcacgcctgtaatcccagcactttgggaggccgaggcaggtggatcacaaagtcaagagattgataccatcctgacc

SEQ ID NO: 13559 - DNA, 201 bp, Homo sapiens
agttttggacacacctgtgatttcatccatagccgatcaattgttccctcagccccttgcccaccaaagtttccttaaaaaaccctagtctcaggtcggaygcggtggctcgtgcctgtaatcccagcactttgggaggccaaggcgggtggatcacctgaggtcgggagttcaagcccagcctggccaacatggagaaac

SEQ ID NO: 13560 - DNA, 201 bp, Homo sapiens
cccaccaaaagatgtggccattgtaacccccagtgcctgtgaatgtgaccttgcatggaaataaggtctttaccaatgtcatcaagtgaagatgaggtcaytcgtgtggaccctaatccacaatgactagtgtccttatgaaaaggagagatttcgccgggcgcagtggctcacgcctgtaatcccagcactttgggaggc

SEQ ID NO: 13561 - DNA, 201 bp, Homo sapiens
aagatagttttggacacacctgtgatttcatccatagccgatcaattgttccctcagccccttgcccaccaaagtttccttaaaaaaccctagtctcaggycggacgcggtggctcgtgcctgtaatcccagcactttgggaggccaaggcgggtggatcacctgaggtcgggagttcaagcccagcctggccaacatgga

SEQ ID NO: 13562 - DNA, 201 bp, Homo sapiens
ggcagaccaagagctaccacctggtcctgagacccgctcccaggaactgactcagctatacaaagatagttttggacacacctgtgatttcatccatagcygatcaattgttccctcagccccttgcccaccaaagtttccttaaaaaaccctagtctcaggtcggacgcggtggctcgtgcctgtaatcccagcactttg

SEQ ID NO: 13563 - DNA, 201 bp, Homo sapiens
tggaaggaatgttgctgtggtacatgtgagctttgtgacctctgaaaagttacctaacctctctgtgcctcagtttctgcctctgtgccatgtgggtgatrataatagtagttatgaggattaaatgagttaattcatcaaaagcacataggacagtgtctggtagataaaggcactcagtaaacattagcaatctggctg

SEQ ID NO: 13564 - DNA, 201 bp, Homo sapiens
agcgagactccatctcaaaaaaaaataaaataaaataaaccaatcaaaccaaattccaggccaccctcaggaccccactttaacttagtcacccctttaaragcctatgtctggccgagtgcgatgactcatgcctataatcccagcgttttgggaagccaaggtggaaagctctcttgagcctaggagttcaagaccagc

SEQ ID NO: 13565 - DNA, 201 bp, Homo sapiens
ttcctgcatgtggcagaaaagaggcctgtgtataatggttctaacaaccacatttcctgacatttattctcatacactgaacattgattatgggcagccasgaagaccacagagtggatgagagtacagacacccttggaaggaatgttgctgtggtacatgtgagctttgtgacctctgaaaagttacctaacctctctg

SEQ ID NO: 13566 - DNA, 201 bp, Homo sapiens
cgcctgtagtcccagctactccggaggctgaggcgggagaatggcgtgagcccggaaggcggagcttgcagtgagccgagactgcgccactgcactccagmctagggcacaaagcgagactccatctcaaaaaaaaataaaataaaataaaccaatcaaaccaaattccaggccaccctcaggaccccactttaacttagt

SEQ ID NO: 13567 - DNA, 201 bp, Homo sapiens
agctgcagtagtagcagtgggatattcacttgccctatgttgcccagggtggctactcttgtttctcaggcaatgggcagagccacagagttcccaaaagyttccgtcctttgtattaaagccaccagggcgggtggcagggcaaagccaggtgtgggctgggtcaggcagttttgtgctctaactctccctgtgcagggc

SEQ ID NO: 13568 - DNA, 201 bp, Homo sapiens
aaattagctgggcgtggtggcgggcgcctgtagtcccagctactccggaggctgaggcgggagaatggcgtgagcccggaaggcggagcttgcagtgagcsgagactgcgccactgcactccagcctagggcacaaagcgagactccatctcaaaaaaaaataaaataaaataaaccaatcaaaccaaattccaggccacc

SEQ ID NO: 13569 - DNA, 201 bp, Homo sapiens
agccttgacagaggtggctggaggagctctcagtgagttgcatcgagattttttttttttttttttgagacagagtttggctcttgttgcccaggctggartacaatggcatgatctcagctcaccccacaacctccgcctcccaggttcaaggaattctcctgccgcagcctcctgagtagctgggattgcaggcacttg

SEQ ID NO: 13570 - DNA, 201 bp, Homo sapiens
tgcactccagcctgctgacagagggagattccgtctcaaagaaaaaagtaccacagatcaggtggcttaaacaaccgacacttattgtctcacagttctgraggctggaagtccaagatcaaggtgtgaacaggggtggtttctcctgagacctctctccttggcttgcagatggtgcctccctgtgtctacacatgattt

SEQ ID NO: 13571 - DNA, 201 bp, Homo sapiens
cttgggaggctgaggcaggagaatcgcttgaacccagaaggtggaggttgcagtgagcccagatcatgccactgcactccagcctgctgacagagggagaytccgtctcaaagaaaaaagtaccacagatcaggtggcttaaacaaccgacacttattgtctcacagttctggaggctggaagtccaagatcaaggtgtga

SEQ ID NO: 13572 - DNA, 201 bp, Homo sapiens
tcatattaccaaagttacttttctgattccttctcatttgagtagactatttcttttaattattcttgaatttatgttggatttgactgtgttttttttttcttttttccgcttaaggatgtgactttaatgtccctagctaattatagcctaatttggtccttggtgctttcaggggtgaagattgtaagagttccttgg

SEQ ID NO: 13573 - DNA, 201 bp, Homo sapiens
ctgccattaaaaagtaccacagaggccgggcatggtggttcacacctgtaatcccagcactttgggaggccgaggtgggcagatcatgaggtcaggagttygagaccaacctggccaacatggtgaagccccatttctactaaaaatacaaaacttagatgggcatggtagtgcacacctgtagtcccagttacttgggag

SEQ ID NO: 13574 - DNA, 201 bp, Homo sapiens
ggaccgcaggagtctccatcccgcttccgcaggtggatagtgacaagggcatctcccttcgcttccctcggtttattcgagtccgtgaagacaagcagccrgagcaggccaccaccagtgctcaggtgaggtcctgggaagcaggggtgggccgcccagctgcttggccctaccagctttttagcgtggtggcctctctgg

SEQ ID NO: 13575 - DNA, 201 bp, Homo sapiens
ctgaggtgggaggattgccggagcccaggagtttgaggctgcagtgagctatgatggtaccaccccactccaggctgggcgacagagcaagaccttgcctytaaaaaaaaaaaaaaaaaaaaaaaaattaagctgaaagcttaattaagctgagtcatgcaagaaactgtctttccttttgttcctaagccacagataaaa

SEQ ID NO: 13576 - DNA, 201 bp, Homo sapiens
gtttgctggggctgccattaaaaagtaccacagaggccgggcatggtggttcacacctgtaatcccagcactttgggaggccgaggtgggcagatcatgasgtcaggagttcgagaccaacctggccaacatggtgaagccccatttctactaaaaatacaaaacttagatgggcatggtagtgcacacctgtagtcccag

SEQ ID NO: 13577 - DNA, 201 bp, Homo sapiens
ctcctccatccttagcatattaagtcaccctcatgctgaactcctccacaccacgggatggcggctgcatccaatgaagctgcaacttttttttttttttttgaagtcagggtctctctctgtcactcaagctgccgtgcaaaagcacagtcatagcccaatacaggtcttgaactcctggcctcaagtgatcttcctgcc

SEQ ID NO: 13578 - DNA, 201 bp, Homo sapiens
gtttcctgggcaaatagtggccctcaataaatgtttgctgagtgagaacatatgcaagtatatttgtcttagtacatattgcaccttcccagtggccactrggatccgttctccctgccttcatatcccagctctgccacttaccagctgtgtggcctgatccaatgtgcgtaacttctgtgcatgtcggtttcctcagct

SEQ ID NO: 13579 - DNA, 201 bp, Homo sapiens
atggggcagggcggttatttgctgctcatctgtcttctaatgaggggttgtatattagtttgctggggctgccattaaaaagtaccacagaggccgggcayggtggttcacacctgtaatcccagcactttgggaggccgaggtgggcagatcatgaggtcaggagttcgagaccaacctggccaacatggtgaagcccca

SEQ ID NO: 13580 - DNA, 201 bp, Homo sapiens
ctataggtgcataccaccaggcctggctaatttttgtattttttagtagagatagggtttcaccatgttagccaggctgactttaaactcctgacttcaawtgatccgcccacctcagtctcccaaagtgttagcattacaggcgtgagccaccgtgcctggctgattattcattttttatgtctccctgtatcatataca

SEQ ID NO: 13581 - DNA, 201 bp, Homo sapiens
catggggcagggcggttatttgctgctcatctgtcttctaatgaggggttgtatattagtttgctggggctgccattaaaaagtaccacagaggccgggcmtggtggttcacacctgtaatcccagcactttgggaggccgaggtgggcagatcatgaggtcaggagttcgagaccaacctggccaacatggtgaagcccc

SEQ ID NO: 13582 - DNA, 201 bp, Homo sapiens
agcaccctgaggagcagtttgggtcaatgacctcagggtcgcaaggtagagggaagagaaagccattctgggcctctggaccagtctatgttccccagagmgtttccccaaaagccctgcctggcatggggcagggcggttatttgctgctcatctgtcttctaatgaggggttgtatattagtttgctggggctgccatt

SEQ ID NO: 13583 - DNA, 201 bp, Homo sapiens
tgtcgtgaaacacagaactcagctttttagtggggtgtggtagctaacacctgtaatccccacttcttgggaggctgaggcaggaggattgcatgagcccrggagaatgagaccagcctgggcaacatagtgagacctcaatctctacaaaaaaattaaaactttgccagacgtggtggtgcatgcctgtagtcccagcaa

SEQ ID NO: 13584 - DNA, 201 bp, Homo sapiens; identical to SEQ ID NO: 1042

SEQ ID NO: 13585 - DNA, 201 bp, Homo sapiens; identical to SEQ ID NO: 1048

SEQ ID NO: 13586 - DNA, 201 bp, Homo sapiens; identical to SEQ ID NO: 1051

SEQ ID NO: 13587 - DNA, 201 bp, Homo sapiens
ttgccccattgcactccagcctgggcaacagagcaatactctgtctcaaataaataaataaataaataaataaataaataaataaataaataaatgggagmctttgcctccaaccctgaagaaaataagcgtgcaaaagatgagtagaggtggaggcagagatgaaggagctagaaaaaagaggccagaaagtcagagaga

SEQ ID NO: 13588 - DNA, 201 bp, Homo sapiens
actttcctttctccccaggctctactacccgaaggatagtgcccgaagttgctgcttggcatagatgagcctcagcttccagggcactgtgggcctgttgrtctactagggccctgaagtccacctggccttcctgttcttcactcccttcagccacacgcttcatggccttgagttcaccttggctgtcctaacagggcc

SEQ ID NO: 13589 - DNA, 201 bp, Homo sapiens
tatcagtctattcgaggaacagaaggaaagctgttattgctggatcagggtaggggaagcacggaatgaaatgtgattggagagatggacagagatcagawcttgtgaattctggcaggtatcatgacattcgatgtaggccaaagagttacctcctagcccagctcctgatacatgcttaataagcgtagtgttggataa

SEQ ID NO: 13590 - DNA, 201 bp, Homo sapiens
gctgaggcaggagaatctcttgatctcgagaggcggaagctgcagtgagcggagatcgcgccattgcgctccagcctgggctatctcaaaaaaaaaaaaaattttttttttgaggaacgaccataccattttccacagtggctgtaccattttatattctgcccaatggtgtcccaggtttccaatttctccacgtcctca

SEQ ID NO: 13591 - DNA, 201 bp, Homo sapiens
ccagagagccaaatcaactcacccatcgctcccgaagcacccgcagtcggccacatccaacgaacttctgatccaaagccatcccagaccttcccgggccsctcttcctggcagatgactctccccgcttctgcgtcctgcctgcccattcataccagtttgaactgcaacagcctagctcctcacctgtgcacctccttc

SEQ ID NO: 13592 - DNA, 201 bp, Homo sapiens
agtgaaaccccgtctctactaaaaatacaaaaaattagctgggcgtggcggcgggcgcctgtagtcccagctgctcgggaggctgaggcaggagaatggcrtgaacccgggaggcggaggttgcagtgagctgagatcgcgccacagcactccagcctgggcgacagagcaagactccgtctcaaaaaaaaaaaaaaaaaa

SEQ ID NO: 13593 - DNA, 201 bp, Homo sapiens
ccggaagcacctccacctggtggatgctggtttagccatcaacactcccttcccactcgtgctgcccccgacgcgggaggttcacctcatcctctccttcracttcagtgccggagatcctttcgaggtaatcgagaagggctttggggccggtcctgggtgggaggtgggctgcggcgaagctgactttgcggaggaact

SEQ ID NO: 13594 - DNA, 201 bp, Homo sapiens
tgattgcaccattgtactacagcctgagtgacaaagtgagaccctgtccccccaaaaagaagaaagaaaaaagaaaacagaggagaggagggacaaaagamaaaaaggggccgggcgcagtggctcacgcctgtaatcccaggactttgggaggccgaggcgggtggatcacgaggtcaggagatcaagaccatcctgact

SEQ ID NO: 13595 - DNA, 201 bp, Homo sapiens
ggcttcaacatatgaatctgggaagagagagaagtcagctcctagttggcaacctcacaactgctgtctacactgacaacgatcattttcccatccccctytctgccttccatttccaagtcttgctttcagtccccagaagcagctgatcctctttcttcctgggcaccacaggtggcatccgggacaagataatgagca

SEQ ID NO: 13596 - DNA, 201 bp, Homo sapiens
ccagcctgggcaacatagcaagagcctgtctctatcaaaaaataaattagccgggcatggtgacatgcatctgtagtcccagctacttgggaggttgaggygggtggattgcttgagcccaggaggttgaggctgtagtggcccattattgtaccactgcactccagcctgggtgacagactgagacccctctaaaaaaaa

SEQ ID NO: 13597 - DNA, 201 bp, Homo sapiens
tggagtgcagtggtgcaatcacagctcactgcagccttgacctcctgggctcaagcaatcctcccagctcagcctcccaagtagctgggactacaggcacrcaccactgggcctgacaaatttttttttttttttttttttttttagagatagggtttcgcttttttgctcggggtggtctccaaatcctgggctcaagtg

SEQ ID NO: 13598 - DNA, 201 bp, Homo sapiens
cacttcttatctacctgtgacctggaagccccctccctgctttgagttgtcccacctttccagaccgaaccagtgttcatcttacatatattgacatctcrggtcttcctaaaatgtctaaaccaagctgtgccccaaccgccttgggcacatgtcatcatgacctcctgaggctgtgtcacggttgtgcatccttaacct

SEQ ID NO: 13599 - DNA, 201 bp, Homo sapiens
ggcgttttatactgagcgcattccaagttggatgcagaagtctcattagatgttaaaggaggcccggggcagtggctcacacctgtaatcccagcacttcragaggccgaggcaggtggatcacctgaggtcaggagtttgagaccagcctggccaacatggtgaaaccctgtctctactaaaaatacaaaaattagctgg

SEQ ID NO: 13600 - DNA, 201 bp, Homo sapiens
gaatttaattcatagttaaactttgagacaaagaaaactgacccccagtccttgttgagagattgaagccacattcatttactttttatttatttatttakttttgagacagagtttcactcttgttgcccagactggagtgcaatggcatgatctctgctcactggcacctccacctcctgagttcaagtgattctcctc

SEQ ID NO: 13601 - DNA, 201 bp, Homo sapiens
gggcgtggtggcgggcgcctgtagtcccagctactccggaggctgaggcgggagaatggcgtgagcccggaaggcggagcttgcagtgagccgagactgcrccactgcactccagcctagggcacaaagcgagactccatctcaaaaaaaaataaaataaaataaaccaatcaaaccaaattccaggccaccctcaggacc

SEQ ID NO: 13602 - DNA, 201 bp, Homo sapiens
ctggctaacacagtgaaaccccgtctcaactaaaaatacaaaaaattagctgggcgtggtggcgggcgcctgtagtcccagctactccggaggctgaggcrggagaatggcgtgagcccggaaggcggagcttgcagtgagccgagactgcgccactgcactccagcctagggcacaaagcgagactccatctcaaaaaaa

SEQ ID NO: 13603 - DNA, 201 bp, Homo sapiens
ttttttattttattttattttatttatttatttattttttttgagacagcatctcgctctgtcgcctaggctggagtgcagtgacgcgatctcggctcackgcaagctccgcctccggggttcaagcgattctcctgcctcaacctcccgagtagctgggattacaggcgcacaccaccacacccggctaatttttgtatt

SEQ ID NO: 13604 - DNA, 201 bp, Homo sapiens
ccttaagcttacacagttagtaagtggcagggtcggccaagtatagtggctcatgcctgaatcgcagcatcttgggaggcagaggcgggaggatcacttawgtccaggagtttgagaccagcctgggaaacacaagaccccatctctactaaaaatacaaaaaaatagctcagcatggtggcatgcatctgcagtcccagc

SEQ ID NO: 13605 - DNA, 201 bp, Homo sapiens
gtttcctctgtgtgtcgccctctccatgaggcaggtgttcctgtgaaggacctccttgcacacatctttccccagtcttcatcgtccacacttaaaatgcycaactcactctcttcctctgtcctccagggcaatatcttctctctacaccaatgatggtgacatggaagctctcgaggctgacctgaaacatcgatttac

SEQ ID NO: 13606 - DNA, 201 bp, Homo sapiens
aatgatggtgacatggaagctctcgaggctgacctgaaacatcgatttacccgacaggagtgggacttggctaagagcctacagaaaaccatccaagcagygaggtctgagaattactctctgaccgacttctgggcctacatggttatctctaagcaaaccagagaagtaagtcattcccagctggggacctggggtggg

SEQ ID NO: 13607 - DNA, 201 bp, Homo sapiens
atttacccgacaggagtgggacttggctaagagcctacagaaaaccatccaagcagcgaggtctgagaattactctctgaccgacttctgggcctacatgkttatctctaagcaaaccagagaagtaagtcattcccagctggggacctggggtgggggtaggagcaaggggtctcagggtgtggggttaccaaagatgct

SEQ ID NO: 13608 - DNA, 201 bp, Homo sapiens
ctctgctcactgagataaatgcgtatctgattgcctccagttggaaaggctaatggaaactctaaagaatgttggccggcccgtggctcacgcctgtaatsccagcactttgggaggcagaagcgggtagatcacgaggtcaggagttcaagaccagcctggccaagatggggaaaccctgtctctactagaaatacaaaa

SEQ ID NO: 13609 - DNA, 201 bp, Homo sapiens
agtgagcccagatcacaccactgcactccagcttcgatgacagagcgagaccctgtctcaaaaaaaaaaaaaaaaaaaaaagtcacatactcacaggctcyagggattaggatagggacatcattaggagacattattcaacctgccacaaagacacagacacaaccagatgacagaagccaggggaagagttggaatatt

SEQ ID NO: 13610 - DNA, 201 bp, Homo sapiens
cgaaggatatgaacttctatgggatagaaatagaaggatatgaacttctatgggacaggcattgcccctgcctaagggagatcctaggtctcctccttctyctcctcctcctttctttttcttttcttttctttcttttttttttttttttttttttgagacaacgtctcgctctgtcacccaggctggaatgcagtggca

SEQ ID NO: 13611 - DNA, 201 bp, Homo sapiens
agaaaactgttagactcaaatattcaactcaatataaaataagaagaagccgggtgcggtggctcacacctgtaatcccagcactttgggaggtagaggcrggtggatcacctgaggtcaggtgtttgagaccagcctggccaacatggcgaaaccctgtctctactaaaaatacaaaaattagccaggcatggtggcacg

SEQ ID NO: 13612 - DNA, 201 bp, Homo sapiens
gggtgatggcagaggcttactctttcccttacagaagatgttgtccctgtccaagctgacccttgctctgttgtgtgtctgggctgttagctgaggtcccrttgggtctccaggccccaggggtcttctggaggggtcttctggagaggtcttgcaaccatttcttattgcctccttctcagaccatccgggctaccactg

SEQ ID NO: 13613 - DNA, 201 bp, Homo sapiens
aggaagaaaaccggcagcatttgttaaacttcaatcaaagacgacttcagagacctaagctgtccactacagtggttgccggccacatgtggcacttgagsacttgaaatgtgcctggcccaagttgaagtgtgctatgaagataaaatacacctcggattttaatgaccgagtatggaaaacgcatgtcaaagaccttat

SEQ ID NO: 13614 - DNA, 201 bp, Homo sapiens
caccaacccattcatgaaggatccactcccatgatccaaacatctccctctgggccccacctccaacactggggatcacatttcaacatgagatttggagrggacgaatttccaaactatatcagtctattcgaggaacagaaggaaagctgttattgctggatcagggtaggggaagcacggaatgaaatgtgattggag

SEQ ID NO: 13615 - DNA, 201 bp, Homo sapiens
cacatttgttgacttgcatatgttaagccatccctgcattcctagtatgaaacccacttgatcacatcatggcaaatttcaagctaccaacatgaggtcascgagcacagagttggaagacgggtacaaaattagctctccagaacccgtatcaacagactccaacccatggctgccatttctattaaagagacgtcgctg

SEQ ID NO: 13616 - DNA, 201 bp, Homo sapiens
ggtggaaggggaaggggggctggcgtgttacatggtgagagagagcaagagagagagaagggaggaaagcaccagtttccttttaacaaccagatctcaartgaactaatagagcaagaactcactcattaccgcagggaaggcaccaacccattcatgaaggatccactcccatgatccaaacatctccctctgggcccc

SEQ ID NO: 13617 - DNA, 201 bp, Homo sapiens
tcccatggtcccagctactcaggaggctgaggcaggaggatcacttgagcccaagaggtcgaggctgtagtgaactatgattgtgccactgcattccagcstgggtgacagagcaagaccctgtctcgaaaaaataataaataagtaaattatatggagagacaaggagaggcgagagcaggtatccggtgaaaaattctg

SEQ ID NO: 13618 - DNA, 201 bp, Homo sapiens
ggccctaaggatctggctcactgcaacctccacctcccaggatgaagcacctgcctcagcctcccgagtagtagctgggattacaggcacatgccaccatrccgagctaatttttgtatttttagtagagaaggtgtttcaccatgttggccaggctggtctcgaactcctgacttcacatgatccgcctgcctcagcctc

SEQ ID NO: 13619 - DNA, 201 bp, Homo sapiens
cctttgctttcttaacagacttgctttcgctttgcactgtggactcaccctgaattctttcttgtatgagatccaagaaccctttcttggggtctggatcrggacccctttccagtaactgatgaaggctccaggtagcaagcttcagagagaatagattgtaaatgattcttgtcagacttaagctctgggtggatatta

SEQ ID NO: 13620 - DNA, 201 bp, Homo sapiens
accagagttggccctaaggatctggctcactgcaacctccacctcccaggatgaagcacctgcctcagcctcccgagtagtagctgggattacaggcacaygccaccatgccgagctaatttttgtatttttagtagagaaggtgtttcaccatgttggccaggctggtctcgaactcctgacttcacatgatccgcctgc

SEQ ID NO: 13621 - DNA, 201 bp, Homo sapiens
aacccaggagacggaggttgcagtgagccgagattgcaccactgcacaccagcctgggcgacaaagagtaagactccatctcaaaaaaaaaaaaaaaaaaattcaaaacccatcgagttgggatgacgcttagtgctgggcttcaggaagagtaggcaggagggtagtatgggaggtttctaggagccactcttggaagcg

SEQ ID NO: 13622 - DNA, 201 bp, Homo sapiens
gcagtgtcttaaaataacacagatgtattccctaaacagtttcggaggtcagaagttcaaaatcagttttactgggctaacatcaaagtggtggcagggccggttccttctgggagctccaggagagaaactgtgtcctttttccagcttccagaggccacctggttcctaggctcatggcttcttcctccgtcctcaaag

SEQ ID NO: 13623 - DNA, 201 bp, Homo sapiens
ctgtgcagtgtgaccgccactggccacctgcaatgcccgagcccttgacaggtggccagcatgacagaggatgcgaatttgttttgttttgttttgttttgattttgttttgagacagagtctcgctctgttgcccaggctggagtgcgatgatgagatctcagctcactgcaacctccaccttccgggttcaagtgattc

SEQ ID NO: 13624 - DNA, 201 bp, Homo sapiens
tctgtgcagtgtgaccgccactggccacctgcaatgcccgagcccttgacaggtggccagcatgacagaggatgcgaatttgttttgttttgttttgttttgattttgttttgagacagagtctcgctctgttgcccaggctggagtgcgatgatgagatctcagctcactgcaacctccaccttccgggttcaagtgatt

SEQ ID NO: 13625 - DNA, 201 bp, Homo sapiens
ctctgtgcagtgtgaccgccactggccacctgcaatgcccgagcccttgacaggtggccagcatgacagaggatgcgaatttgttttgttttgttttgttttgattttgttttgagacagagtctcgctctgttgcccaggctggagtgcgatgatgagatctcagctcactgcaacctccaccttccgggttcaagtgat

SEQ ID NO: 13626 - DNA, 201 bp, Homo sapiens
gctctgtgcagtgtgaccgccactggccacctgcaatgcccgagcccttgacaggtggccagcatgacagaggatgcgaatttgttttgttttgttttgttttgattttgttttgagacagagtctcgctctgttgcccaggctggagtgcgatgatgagatctcagctcactgcaacctccaccttccgggttcaagtga

SEQ ID NO: 13627 - DNA, 201 bp, Homo sapiens
tgctctgtgcagtgtgaccgccactggccacctgcaatgcccgagcccttgacaggtggccagcatgacagaggatgcgaatttgttttgttttgttttgttttgattttgttttgagacagagtctcgctctgttgcccaggctggagtgcgatgatgagatctcagctcactgcaacctccaccttccgggttcaagtg

SEQ ID NO: 13628 - DNA, 201 bp, Homo sapiens
gatttggtccacaactgtagtttgccaagccctgatgtaaatagacaaaaatctgcagaattaattgtccaaactcatgatgccttttctttgttggtttsgttatgcttcaggtgatattgaggcatggagtgacacatacgacacattcaagcttgctgacacctacactctagatgtggtggtgctactcttggcatt

SEQ ID NO: 13629 - DNA, 201 bp, Homo sapiens
taacctcatgtgtcaataaaactttatttataaagccaaagtagtgggccgactggatttggtccacaactgtagtttgccaagccctgatgtaaatagayaaaaatctgcagaattaattgtccaaactcatgatgccttttctttgttggtttggttatgcttcaggtgatattgaggcatggagtgacacatacgaca

SEQ ID NO: 13630 - DNA, 201 bp, Homo sapiens
ccgacagggagcagggaggaggggccatcttgagactggtgccctgcgagctccaccccacccctccatgcagttccccatgggccccgcctgcatcttcytgaggaaaggcattgctgagaaacagcgggtgaggtggggagtgagggggaagggcggtgggcggggcaaagggagcaggggtgtgggacaaagaagggg

SEQ ID NO: 13631 - DNA, 201 bp, Homo sapiens
catggtgaagccccatttctactaaaaatacaaaacttagatgggcatggtagtgcacacctgtagtcccagttacttgggaggctgaggcaggagaatcrcttgaacccagaaggtggaggttgcagtgagcccagatcatgccactgcactccagcctgctgacagagggagattccgtctcaaagaaaaaagtaccac

SEQ ID NO: 13632 - DNA, 201 bp, Homo sapiens
gtggcctctctggaaccttgtggaggtgggagcagccagggagcttctgaccaccccgtcccaccctctctccgcaggtggcctgtttgtaccggaagcaragtcagattcagaaccaacaaggcgaggactcaggctctgaccctgaagatacctactaagccctcgccctcctagggcctgggtacagggcatgagttg

SEQ ID NO: 13633 - DNA, 201 bp, Homo sapiens
ctacttgggaggctgaggcaggagaatcgcttgaatctaggaggtggaggttacagtcacccaagattgtgccattggactccagcgtgggagacaagagygagcctctgtctcaaaaaaaaaaaaaaaaaaaaaagaaaaaaggaccggaaggggcatggatcataaaaatatagataaatccataacctcatgtgtcaa

SEQ ID NO: 13634 - DNA, 201 bp, Homo sapiens
gcagatcatgaggtcaggagttcgagaccaacctggccaacatggtgaagccccatttctactaaaaatacaaaacttagatgggcatggtagtgcacacytgtagtcccagttacttgggaggctgaggcaggagaatcgcttgaacccagaaggtggaggttgcagtgagcccagatcatgccactgcactccagcctg

SEQ ID NO: 13635 - DNA, 201 bp, Homo sapiens
ctggaccgaaggatatgaacttctatgggatagaaatagaaggatatgaacttctatgggacaggcattgcccctgcctaagggagatcctaggtctcctycttctcctcctcctcctttctttttcttttcttttctttcttttttttttttttttttttttgagacaacgtctcgctctgtcacccaggctggaatgca

SEQ ID NO: 13636 - DNA, 201 bp, Homo sapiens
cagcactttgggaggctgaggcgggcggatcacaaggtcaggagattgagaccatcctggctaacacagtgaaaccccatctctactaaaaatacaaaaamaaaaaaaaataaattgctgggcttggtggtgcgtgcctgtaatcccagctactcaggaggctgaggcaggagaatcgcttgaacctgggaggcggaggtt

SEQ ID NO: 13637 - DNA, 201 bp, Homo sapiens
ggccaggctggtctccaactcctgacctcaagtgatcctcccacctcggcctcttaaggtgctgggattacagccatgagccactgtgcctggcctgaagycacattcataagacaaggttagaatcatgaaggtgctggaactttgctaaagaacagtcgtgggttgaagaatgacctgccatcccttagcttccttttc

SEQ ID NO: 13638 - DNA, 201 bp, Homo sapiens
tcccagcactttgggaggctgaggcgggcggatcacaaggtcaggagattgagaccatcctggctaacacagtgaaaccccatctctactaaaaatacaamaaaaaaaaaaaataaattgctgggcttggtggtgcgtgcctgtaatcccagctactcaggaggctgaggcaggagaatcgcttgaacctgggaggcggag

SEQ ID NO: 13639 - DNA, 201 bp, Homo sapiens
acctgaggtcgggagttcaagaccagcctgaccaacatggagaaaccccgtctccactaaaaatacaaaattagccgggcgtagtggcacatgcctgttaytcccagctactcaggaggttgaggcaggagaatcgcttgaacccgggaggaggaggttgcagtgagccgagatcgagccattgcactccagcctgggcaa

SEQ ID NO: 13640 - DNA, 201 bp, Homo sapiens
accacgcctggctaatttttgtatttttagtagagatggggtttcgccatgttggccaggctgatcttgaactcttggcctcaagcgatccaccctcctcrgcccccctaagtgctgggattacaggcgtgagccaccacacccagccataccaaatattttatttaattgtattggacagcagtagtctaaaatctttac

SEQ ID NO: 13641 - DNA, 201 bp, Homo sapiens; identical to SEQ ID NO: 1041

SEQ ID NO: 13642 - DNA, 201 bp, Homo sapiens
gagaggcaagaattttccttctgagggtctagtttgcccagctcttaaatttcttgggggaaagaaaaggacttggtaggcttccagaaagaggaatggtrtattccttctgctgagtcttcagtgtctctcaaaggtctccttaatgcggcagatacctgatatcctatcaaacaatccaggagagggagcttaatagag

SEQ ID NO: 13643 - DNA, 201 bp, Homo sapiens
ggagctccaggtcttctcaatgaatgaaagaatggatgaatgtctttctcctaagtcatgtatgacctgtagaggcttccaggtcttctaatcttatccartgtgcaacactgcctacaaagcacagtggtaacttctaactttcctttctccccaggctctactacccgaaggatagtgcccgaagttgctgcttggcat

SEQ ID NO: 13644 - DNA, 201 bp, Homo sapiens
gctgaggtcccgttgggtctccaggccccaggggtcttctggaggggtcttctggagaggtcttgcaaccatttcttattgcctccttctcagaccatccrggctaccactgactactgccgccgccacaagatcccctttccccaagtagaagaggctgagctggatttgtggtccaaggcccccgccagctgctacatc

SEQ ID NO: 13645 - DNA, 201 bp, Homo sapiens
tgggtaatttgtagacaaaggaggtttaattgactcacagtttcacatggctggggaggcctcaggaaacttacaatcatggcagaaggtgaaagggaagmaagaaccttcttcaagtggtagcaggagagagaagagcaagccaaagaagagctgcccaacacttatcaaaccatcagatctcgtgagaactcactcgct

SEQ ID NO: 13646 - DNA, 201 bp, Homo sapiens
agtgggagctgaatgatgagaacacatggacgcagggaggggaacaacacacactggggcctgttgggggcgggtggggagaagaagagcaccaggaaaaytagctaatgcatgtggggcttaatacctatgtgatgggttgataggtgcagcaaaccgccatggcacatgtttacctgtgtaacaaatctacacgtcctg

SEQ ID NO: 13647 - DNA, 201 bp, Homo sapiens
tacaggcacatgtatgttcactgcagcactattcacaatatcaaagacatggaatcaacccaaatgcccatcagtgatagactggataaagaaaatgtggyacatatacaccatggaatactatgcagccagaaaaaggaacaagatcatgtcctctgcagggatatgggtggagctggaagtcattatcctcagcaaact

SEQ ID NO: 13648 - DNA, 201 bp, Homo sapiens
caacaacaacaacaacaaaaaagaaatggcaaccccaaggtgatggtattaagagatggggcctttgggaggtgttgagaccatgagggtggagccctctwgatttggattaatcccttataaaagaagcctcagagagctcactccaaggaatgcggtgaaggttgaagggtagaatttatgcaaaatgccaagatgagc

SEQ ID NO: 13649 - DNA, 201 bp, Homo sapiens
gctgtggattttgagagtcaggggaggggtgtgtgtgtgagggggtggcttactccggagtctgggattcatcccgtcatttctttcaataaataattatyggatagctactttgtgacagggtctgtgctgggctctgggggcaaagctgtcatgggtgtcacctgcatagcatgtagccatgtagccatggcctaggaa

SEQ ID NO: 13650 - DNA, 201 bp, Homo sapiens
tatgttagaggaaaaccatcgggaaatggtcagacaaggcaagcaggatgcctggaacacccacccagccctgggcaccacggggctggcttggggaaaayggctgcacgcggagcggggcccaggctcgggtcttccagagcaggaggcctctaaccccggggcccagcgtggaacaggagcttccgggcatgagagtgt

SEQ ID NO: 13651 - DNA, 201 bp, Homo sapiens
ggatgcctagtttgcaaatatttgctcgcattcagtgggttgtgtgtttactctgataattacttcctttgctgtacagaagctttttaatttactcaggkcccatatatttgtttatttttgagacggagtctcactccatcacccaggcttcagtgcagcagcacgatctcggctcactgcaatctccgcctcccagac

SEQ ID NO: 13652 - DNA, 201 bp, Homo sapiens
aagttaccttccctaggtccactatctaggaagtggtgggccagggtttggtccatgctgtcagctccttgaccctgcatctataactactaactatactrtggagagcctcatgagctcctgcgaggtgtagaaccttatcccgcaggcggggcagtggcatggtcaggtctaggagtgaaaagatcctgcgatggttgg

SEQ ID NO: 13653 - DNA, 201 bp, Homo sapiens
caatctcagctcactgcaagctccccacctcccggattcacgccattctcctgcctcagcttcctgagtagctgggactacaggcgcccgccaccacaccyggctaatttctttttgtatttttagtagaggcggggtttcaccgtgttagccaggatagtctccatctcctgacctcgtgatccacccgcctcggcctcc

SEQ ID NO: 13654 - DNA, 201 bp, Homo sapiens
gtgcaatggcgcgatctcagctcaccgcaacctcggcctcctgggtttaagcgattctcctgcctcccgagtagctgggattacaggcatgcgccaccackcccggctaattttgtatttttagtagagacagggtttctccatgttggtcaggctggtctcaaactcctgacctcgtgatctacccaccttggcctccca

SEQ ID NO: 13655 - DNA, 201 bp, Homo sapiens
gcccaggctggagtgcaatggcgcgatctcagctcaccgcaacctcggcctcctgggtttaagcgattctcctgcctcccgagtagctgggattacaggcrtgcgccaccacgcccggctaattttgtatttttagtagagacagggtttctccatgttggtcaggctggtctcaaactcctgacctcgtgatctacccac

SEQ ID NO: 13656 - DNA, 201 bp, Homo sapiens
tcatgtcaacacaaatttttttttttttttttgagatggagttttgctctttttgcccaggctggagtgcaatggcgcgatctcagctcaccgcaacctcsgcctcctgggtttaagcgattctcctgcctcccgagtagctgggattacaggcatgcgccaccacgcccggctaattttgtatttttagtagagacaggg

SEQ ID NO: 13657 - DNA, 201 bp, Homo sapiens
gaattcaggaaaagctgactagcagtcatgtcaacacaaatttttttttttttttttgagatggagttttgctctttttgcccaggctggagtgcaatggygcgatctcagctcaccgcaacctcggcctcctgggtttaagcgattctcctgcctcccgagtagctgggattacaggcatgcgccaccacgcccggctaa

SEQ ID NO: 13658 - DNA, 201 bp, Homo sapiens
tgttttcttccttcatttaatgaacatttattggttacctatgctgcatcagccatggttccaggagaggcaggctagagtagtaaagaagacaggaagcrgggggccaggcgcggtggctcacgcctgtaatcccagcactttgggatgccaagccggggcagatcacctgagatcaggagtttaaggccagcttggcca

SEQ ID NO: 13659 - DNA, 201 bp, Homo sapiens
aatcgtgtctcctgcgatgagactcccattagggataaattgtgtctgttttcttccttcatttaatgaacatttattggttacctatgctgcatcagccrtggttccaggagaggcaggctagagtagtaaagaagacaggaagcagggggccaggcgcggtggctcacgcctgtaatcccagcactttgggatgccaag

SEQ ID NO: 13660 - DNA, 201 bp, Homo sapiens
cctagcatccaggatgggtggtcctccggggcctgattgtgccacttcccacagtgggctccttttagcttgtcaatcgtgtctcctgcgatgagactccyattagggataaattgtgtctgttttcttccttcatttaatgaacatttattggttacctatgctgcatcagccatggttccaggagaggcaggctagagt

SEQ ID NO: 13661 - DNA, 201 bp, Homo sapiens
actatgttgcccagactgatcttgaacccctgggctcaagcgatcctcccacctcagcctcccaaagtgctgggattacaggtgtgagccaccccacaccwggccttccccactcttttgttacaagactatcgtgaacatctttatgtttgtggtcctgttgcccttgtgcaaatcgagaaaaggtgcatcttccagggg

SEQ ID NO: 13662 - DNA, 201 bp, Homo sapiens
taaataaataaatacataccatcaggtctcgcgagaactcaactcactgtcacgagaacagcatgagggtaaccacttccatgcttcaattacctcccacracacttggggattatgggaactacaattcaagatgagatttgggtggggacacagccaaaccatatcaccaccaggccaggccgaatggagctgtgctgt

SEQ ID NO: 13663 - DNA, 201 bp, Homo sapiens
caggtgggaatgcagtggtgcaatcatggctcactgcagcctcagcctccccagctcaagcaatcctcccatttcagcctcccgaatagctgggaacacargcacacagcaccatgcctggctaatttttctttttctttttcatagagatggggtctcactatgttgcccagactgatcttgaacccctgggctcaagcg

SEQ ID NO: 13664 - DNA, 201 bp, Homo sapiens
aaataaataaataaatacataccatcaggtctcgcgagaactcaactcactgtcacgagaacagcatgagggtaaccacttccatgcttcaattacctccyacgacacttggggattatgggaactacaattcaagatgagatttgggtggggacacagccaaaccatatcaccaccaggccaggccgaatggagctgtgc

SEQ ID NO: 13665 - DNA, 201 bp, Homo sapiens
gtgtcttgctctgttgcccaggtgggaatgcagtggtgcaatcatggctcactgcagcctcagcctccccagctcaagcaatcctcccatttcagcctccmgaatagctgggaacacaggcacacagcaccatgcctggctaatttttctttttctttttcatagagatggggtctcactatgttgcccagactgatcttg

SEQ ID NO: 13666 - DNA, 201 bp, Homo sapiens
ctgggcttggtggtgcgtgcctgtaatcccagctactcaggaggctgaggcaggagaatcgcttgaacctgggaggcggaggttgcagtgagctgagatcrcgctcctgcactccagcctggggacagagcaagactccttctcaaataaataaataaatacataccatcaggtctcgcgagaactcaactcactgtcacg

SEQ ID NO: 13667 - DNA, 201 bp, Homo sapiens
cttgttcagcaactgtgtcctggtaagttctcacgatacatcaggcaatgttaccagttacctgtggttgggcgtctcctggcatctcaaggctcagaagyccccagtgtgaatggtgtttgtctgtttgtttgtttgagacagagttttgctcttgttgcccaggctggagtgtaatggcacgatctcggctcactgcaa

SEQ ID NO: 13668 - DNA, 201 bp, Homo sapiens
actgtgttggccaggctgatcttgaactcctgacctcaagtgatccgcctgcctcagcccccaaagtgctgggatttcaggcgtgaggcaccgcacccagycagggcttcaacatatgaatctgggaagagagagaagtcagctcctagttggcaacctcacaactgctgtctacactgacaacgatcattttcccatccc

SEQ ID NO: 13669 - DNA, 201 bp, Homo sapiens
agtgagtgccagcagggcaattgccagatgcttataaaatcatcagatcagccgggcgcggtggctcatgcctgtaatcccagcactttgggaggctgagrcgggcggatcacaaggtcaggagattgagaccatcctggctaacacagtgaaaccccatctctactaaaaatacaaaaaaaaaaaaaaataaattgctgg

SEQ ID NO: 13670 - DNA, 201 bp, Homo sapiens
gcccgtggctcacgcctgtaatcccagcactttgggaggcagaagcgggtagatcacgaggtcaggagttcaagaccagcctggccaagatggggaaaccytgtctctactagaaatacaaaaattagctcagcatggtggcgggtgcctgtaatcccagctacttgggaggctgaggcagagaatcacttgaagccagga

SEQ ID NO: 13671 - DNA, 201 bp, Homo sapiens
  misc_feature (1)...(201): n = A,T,C or G, or insertion/deletion polymorphism (see Tables 1-2)
ttactttcttcaagtgcagcaagtagacaattgaaaagtacctttacggccgggcgcggtggctcatgcctgtaatcccagcactttgggagactgagacnagcggatcacctgaggatcaccaacctgaccaacatggagaaaccctgtctctactaaatatatgaaattagccgggcgtggtggagcatgtctgtaatc

SEQ ID NO: 13672 - DNA, 201 bp, Homo sapiens
tctaaagaatgttggccggcccgtggctcacgcctgtaatcccagcactttgggaggcagaagcgggtagatcacgaggtcaggagttcaagaccagcctkgccaagatggggaaaccctgtctctactagaaatacaaaaattagctcagcatggtggcgggtgcctgtaatcccagctacttgggaggctgaggcagag

SEQ ID NO: 13673 - DNA, 201 bp, Homo sapiens
ttttttgtatttttagtagagacggggtttctccacgttggttaggctggtctcgaactcctgacctcaggtgatctgcccacctcagcctcccaaattgytgggattacaggtgtgagccatcgcgcccagcctcggccatgtcttcttagtctcctccaatctcgaacggttcctcaatctttccttgattttcatgac

SEQ ID NO: 13674 - DNA, 201 bp, Homo sapiens
tctttcttttcttttctttttttcttctggagacacagtcttgctcttgtcgcccaggctggagtgcagtggcgcgatcttggctcattgcaacctctacytcccaggttcaagtgattctcctgcctcagcctcccagttagctgggattacagacgcgtgccaccatgcccagctaatttttgtatttttagtagagac

SEQ ID NO: 13675 - DNA, 201 bp, Homo sapiens
tggcatgatcttggctcactgcaacctccacctcccaggttcaagctattcccctgcatcagcctgctgagcagctgggattacaggtgtgtgccaccacrcccagctaatttttgtatttttagtagagatggggttttaccacattgaccaggttggtcttgaactcctgacctcaagtgatccacctgcctcggcctc

SEQ ID NO: 13676 - DNA, 201 bp, Homo sapiens
tggtcgctgaagccactgccttcctgagatgacccaggtacagccagtctcacccccagacatccaacctctcacctctgtgatgacccggtgtccaggcrcagacacacccagagtcctcctgaccagctcatcagcagctcaccaaggaaaggaaatcaaggtgtactctcttcagactctagatttcccttcctcctc

SEQ ID NO: 13677 - DNA, 201 bp, Homo sapiens
ctgggtttaagcgattctgctgcctcagcctcccgagtagcagggattacaggcatgtgccaccatgccgggctaatttttttgtatttttagtagagacrgggtttctccacgttggttaggctggtctcgaactcctgacctcaggtgatctgcccacctcagcctcccaaattgctgggattacaggtgtgagccatc

SEQ ID NO: 13678 - DNA, 201 bp, Homo sapiens
ttggtagggtacttggacagtgtctgagaccacctggatttcttgacgtagatgaaggcggtgagcctgaacacacctggctgactgagatgctcgagaaytggaccaggacctccctggaaaagcaggagcagccccatgaggaccccgaaaggaaaggtaccatgtgtagtgtgataagtgtcatcaacagtaagtgcc

SEQ ID NO: 13679 - DNA, 201 bp, Homo sapiens
ctctagacatggaatcagccaaatttcctaggcactctggttccatttggtggagaatggtatatagaagtcaagatttggatgctagtggtgctcattcrtatgggccatcattgtttctatgttctcttagtggagagagctagagaatatgtgtacaaatgttcctatacacactgaaactatgtgtttatttttatc

SEQ ID NO: 13680 - DNA, 201 bp, Homo sapiens
tcccaggttcacgccattctcctggcccagcctcctgagtagctgggactacaggcacccaccactgcgcccagctaatttttttttttttttttttttttgtatttttagtagagaccggtgttagccaggatagtctcgatctcctgacctcatgatccacccgcctcagcctcccaaagtgctgggattacaggcatg

SEQ ID NO: 13681 - DNA, 201 bp, Homo sapiens
acattcataagacaaggttagaatcatgaaggtgctggaactttgctaaagaacagtcgtgggttgaagaatgacctgccatcccttagcttccttttctrtatgtgctccagagtcacgtaaccaggggtcgcatgatttataacttccccagctacttctataaataatatcactgtcgtgaaacacagaactcagctt

SEQ ID NO: 13682 - DNA, 201 bp, Homo sapiens
gcttcctacaaggcacacaggacttcagctgtgtctgcgcaccatgccatgcagctgccgggtcttatggcctcggaatacaccatcaagcatcaagtcastggatcatggcgatgagtgttttagcatcaaatttctccctgaaggggttggatgaagtcgctttctcagtagcaatatatgagagtgtaaaccaaaaat

SEQ ID NO: 13683 - DNA, 201 bp, Homo sapiens
tcactgcaacctccggctcatgggttcaagtgatcctcctgcctcagcctcccaagtagctgtgattacaggcacccgccaccacgcctggctaattttgrtatttttagtagagacagggtttcactgtgttggccaggctgatcttgaactcctgacctcaagtgatccgcctgcctcagcccccaaagtgctgggatt

SEQ ID NO: 13684 - DNA, 201 bp, Homo sapiens
cactcttgacctcaagtgatctgactgcctcggcctcccaaagtgctgggattacaggcatgagccactgctcctggcaataatgtttcgttttgtttttrttttaaaaaaaagaaattgtctttgagatagttttcagagtgagcattttggcagaccaagagctaccacctggtcctgagacccgctcccaggaactga

SEQ ID NO: 13685 - DNA, 201 bp, Homo sapiens
ttagtagagacagggtttcactgtgttggccaggctgatcttgaactcctgacctcaagtgatccgcctgcctcagcccccaaagtgctgggatttcaggygtgaggcaccgcacccagccagggcttcaacatatgaatctgggaagagagagaagtcagctcctagttggcaacctcacaactgctgtctacactgaca

SEQ ID NO: 13686 - DNA, 201 bp, Homo sapiens
attgctggtgtattacaaaagatgggccaggtgtggtggctcacgcctgtaatcccagaactttgggaggctgaggcaggaagatcgcttgagtctaggartttgagacccaggcggggcaacatagcaagaccccatctctacaaaaagtgaaaaaattagccaggcgtggtggtgcatgcctatggtcccagctactca

SEQ ID NO: 13687 - DNA, 201 bp, Homo sapiens
tgtgtgtgtgtgtgtgtgtgtgtgtcttgctctgttgcccaggtgggaatgcagtggtgcaatcatggctcactgcagcctcagcctccccagctcaagcwatcctcccatttcagcctcccgaatagctgggaacacaggcacacagcaccatgcctggctaatttttctttttctttttcatagagatggggtctcact

SEQ ID NO: 13688 - DNA, 201 bp, Homo sapiens
gtgtgtgtgtgtgtgtgtgtgtgtgtcttgctctgttgcccaggtgggaatgcagtggtgcaatcatggctcactgcagcctcagcctccccagctcaagmaatcctcccatttcagcctcccgaatagctgggaacacaggcacacagcaccatgcctggctaatttttctttttctttttcatagagatggggtctcac

SEQ ID NO: 13689 - DNA, 201 bp, Homo sapiens
tgtatgtgtgtgtgtgtgtgtgtgtgtgtgtgtgtcttgctctgttgcccaggtgggaatgcagtggtgcaatcatggctcactgcagcctcagcctcccsagctcaagcaatcctcccatttcagcctcccgaatagctgggaacacaggcacacagcaccatgcctggctaatttttctttttctttttcatagagatg

SEQ ID NO: 13690 - DNA, 201 bp, Homo sapiens
gtgtatgtgtgtgtgtgtgtgtgtgtgtgtgtgtgtcttgctctgttgcccaggtgggaatgcagtggtgcaatcatggctcactgcagcctcagcctccmcagctcaagcaatcctcccatttcagcctcccgaatagctgggaacacaggcacacagcaccatgcctggctaatttttctttttctttttcatagagat

SEQ ID NO: 13691 - DNA, 201 bp, Homo sapiens
ctcaggaaacttacagtcatggtggaaagcgaaggccaagcaagtcaccttcttcacaaggcggcaggaaggagaagtgagtgccagcagggcaattgccmgatgcttataaaatcatcagatcagccgggcgcggtggctcatgcctgtaatcccagcactttgggaggctgaggcgggcggatcacaaggtcaggagat

SEQ ID NO: 13692 - DNA, 201 bp, Homo sapiens
tgacatcctgtcaggtggtgtgaaattccaacttgtcacattactgatgatgtccactttcattgactaagatggtgtttgccacgtttctccactataamgtaactcctttgaaattggtattttgtagggaggtattttgagctctgtaaatatcaaacttctcacttagctttttatttatctgagtatggactcctg

SEQ ID NO: 13693 - DNA, 201 bp, Homo sapiens
actcatgtatgtgtatgtgtgtgtgtgtgtgtgtgtgtgtgtgtgtcttgctctgttgcccaggtgggaatgcagtggtgcaatcatggctcactgcagcmtcagcctccccagctcaagcaatcctcccatttcagcctcccgaatagctgggaacacaggcacacagcaccatgcctggctaatttttctttttctttt

SEQ ID NO: 13694 - DNA, 201 bp, Homo sapiens
caatccctgcaccactcatgtatgtgtatgtgtgtgtgtgtgtgtgtgtgtgtgtgtgtcttgctctgttgcccaggtgggaatgcagtggtgcaatcatrgctcactgcagcctcagcctccccagctcaagcaatcctcccatttcagcctcccgaatagctgggaacacaggcacacagcaccatgcctggctaattt

SEQ ID NO: 13695 - DNA, 201 bp, Homo sapiens
actctttcccttacagaagatgttgtccctgtccaagctgacccttgctctgttgtgtgtctgggctgttagctgaggtcccgttgggtctccaggccccrggggtcttctggaggggtcttctggagaggtcttgcaaccatttcttattgcctccttctcagaccatccgggctaccactgactactgccgccgccaca

SEQ ID NO: 13696 - DNA, 201 bp, Homo sapiens
gctacaggtgcacgcccccatgcctggctaattgaaatatatatatatatatatatactgtagagatgaggtctccaacatctttctgtggcagagctggrattcaaagcctcatctaggcaccattttccttgccctctgagtcccgcagcccccagccccaaaggttactctctaacctcgcgaatgttgtctctaggt

SEQ ID NO: 13697 - DNA, 201 bp, Homo sapiens
ctgcccaatggtgtcccaggtttccaatttctccacgtcctcatcaacacttattgttttctggggttttttggataccagccatcctaatgggtgtgtcwttttttttttttttttttttttttttgagatggagtctcactctgtctcccaggctggagtgcagttgtgtgatctctgctcactgcaacctcccaggtt

SEQ ID NO: 13698 - DNA, 201 bp, Homo sapiens
tggctattacagagatcctttgcagaggtgatgagatgcacccataccacatatctcgttgggctcctgggctcaaatgatcttcccatctcagcttcctsagtagctagggctacaggtgcacgcccccatgcctggctaattgaaatatatatatatatatatatactgtagagatgaggtctccaacatctttctgtg

SEQ ID NO: 13699 - DNA, 201 bp, Homo sapiens
tccccaagtagaagaggctgagctggatttgtggtccaaggcccccgccagctgctacatcctgaaaggagaaactggaccagtggtgatgcattttcccytgttcaacatagatgcctgtggaggtaggtgcaggggaggagcaggtgagaagccacctgtattagtccatgctcacactgctaataaaaacatacctga

SEQ ID NO: 13700 - DNA, 201 bp, Homo sapiens
ggattacaggcatgcaccaccatgcctggctaattttgtatttttttagtacagacagggtttctccatgttgctcagactggtctcgaactcctgaccgmaggtgatccacctgcctcggcctcccaaagtgccgggattacaggcatgacccaccactcctggccccaatgtgtagttttttatccccacctccctacc

SEQ ID NO: 13701 - DNA, 201 bp, Homo sapiens
tgtgtgtgaggaggtccttcacaggaacgcctgcctcatggagagggcgacacacagaggaaatggaaaatttacatgaaataaatataactgcagaacgrtcaagttcaaaggagcactcaaaatcatctgggacagtccttccatttcacaggcaggaaaatgagagcacgatgggagaaaggcctcatcagagtcaaa

SEQ ID NO: 13702 - DNA, 201 bp, Homo sapiens
ttccgcaggtggatagtgacaagggcatctcccttcgcttccctcggtttattcgagtccgtgaagacaagcagccggagcaggccaccaccagtgctcakgtgaggtcctgggaagcaggggtgggccgcccagctgcttggccctaccagctttttagcgtggtggcctctctggaaccttgtggaggtgggagcagcc

SEQ ID NO: 13703 - DNA, 201 bp, Homo sapiens
aaattggtgatactcctgccttggcctcccaaagtgctaggattatggcctcatatctatttttaaaaaataagaattcaagctgggtgcggtggctcgcrcctgtaatcccagcactttgggaagccgaggcaggtggatcacttgagttcagcagttcgagccagcctggccaacatggtgaaaccctgtctctactaa

SEQ ID NO: 13704 - DNA, 201 bp, Homo sapiens
ccacccgccctctctccccttccttctctatctgcgaggctttgctctctgccgtgcaagtctgtgccaggcttactttgctgtctgtcactgtgactcakcctccctgtctctcttcctgtgtctccatcatggtctcttgtgcacacaatctcttgggcattctgtttctatttgttgtagcccaagaagacaacattg

SEQ ID NO: 13705 - DNA, 201 bp, Homo sapiens
attggtgcagcaaaccagcatggcacatgtatacctatgtaataaacctgcatgttcagcacatgtatcccagatttgaaataaaattcttttaaaaaagbgggggggatttaaagacagagacaggcatgtatacagagaggaaaccatgtgaacatggaagcagggattggggtgaggctctactgaccaagggctgcc

SEQ ID NO: 13706 - DNA, 201 bp, Homo sapiens
agctgggcgtggtggcgggcgcctgtagtcccagctactccggaggctgaggcgggagaatggcgtgagcccggaaggcggagcttgcagtgagccgagaytgcgccactgcactccagcctagggcacaaagcgagactccatctcaaaaaaaaataaaataaaataaaccaatcaaaccaaattccaggccaccctcag

SEQ ID NO: 13707 - DNA, 201 bp, Homo sapiens
caaaaaataaattagccgggcatggtgacatgcatctgtagtcccagctacttgggaggttgaggtgggtggattgcttgagcccaggaggttgaggctgyagtggcccattattgtaccactgcactccagcctgggtgacagactgagacccctctaaaaaaaaaatgtggcctacgtgcagaggttccaccctgtggg

SEQ ID NO: 13708 - DNA, 201 bp, Homo sapiens
atgttacctgagcctcgtttttctcatagggaaagtacttacctcaaaatgtgggtgtgagagttaggtatgatccacaaataaaacactcagcccagtgyccagcacatggtaggaaattaaggatggttgactctccatgattttagcatacacttttgagacacactaggagcctgatactattttaaatgcagggga

SEQ ID NO: 13709 - DNA, 201 bp, Homo sapiens
gctgtagtggcccattattgtaccactgcactccagcctgggtgacagactgagacccctctaaaaaaaaaatgtggcctacgtgcagaggttccaccctstgggacccacatgcctccctcacactgtcttggcacattctcccaaagctgccggagtctcatttgtccaatatgaagaagcccgtggaagaagggacac

SEQ ID NO: 13710 - DNA, 201 bp, Homo sapiens
gcaacatagcaagaccccatctctacaaaattttttgtaaaaaattagctggacatggtagtgcgttcccatggtcccagctactcaggaggctgaggcasgaggatcacttgagcccaagaggtcgaggctgtagtgaactatgattgtgccactgcattccagcctgggtgacagagcaagaccctgtctcgaaaaaat

SEQ ID NO: 13711 - DNA, 201 bp, Homo sapiens
tgagctaagttccaggcagcctgtgctcagaacttgcaaatgcccccaagtcataagctttccctgcagagatagcaaccactgctctcaggccatgcccmtccccatctatcccacctagccatgtgccagggtcctgcacacgtgtctgcagcttgcttttcattcaccccatgtgggtggagaagttcacctccaccc

SEQ ID NO: 13712 - DNA, 201 bp, Homo sapiens
cagtggtgtggtccatactgaaaaatgtgtggcctcgctgcgagtcccagtcatcgtgaaaagcctcactgatggctttctctggttttgcaaaaatgcaraaaaccctaatttcttgtcagctagtcctaggacctggtcttcaaaaacacttgtatgggctgggcgcagtggctcatgcctgtaatcccagcactttgg

SEQ ID NO: 13713 - DNA, 201 bp, Homo sapiens
aaaatcagaacttgattaaatgtccttgactgtagcttacacactggtatcacttttagttgtggcttcataatcttctcagcattcagggtctgaaggcrttaccctgctgggcagacagctcccctacataggaccaaccatgccagcttgagaaagtcattaatgttacctgagcctcgtttttctcatagggaaagt

SEQ ID NO: 13714 - DNA, 201 bp, Homo sapiens
caaatctttagaaggtacttatgacagtaaattcctctgtaatacaggtatgaagcaccttcatgatatttctgttttatgtgtagaaaagtggctgggtrcggtggctcactcctgtaatctcagtgctttgggaggccaaggtgggaggatcacttgagatcagcaatttgagaccagcctgggcaacatagcaagacc

SEQ ID NO: 13715 - DNA, 201 bp, Homo sapiens
ggaagggggtgggcctgaaacaatcccaggctggtccttccccagagctttggaggggggtggtgtcaaagggcccagggatctgattaggggaactttcrctcagtggtgtggtccatactgaaaaatgtgtggcctcgctgcgagtcccagtcatcgtgaaaagcctcactgatggctttctctggttttgcaaaaatg

SEQ ID NO: 13716 - DNA, 201 bp, Homo sapiens
agtgtttgattaaataactggttactgtggcccagcctagttgacatgttaaaccatcctcccaacatcctaagtgctataggcaggctcttacttattcytcataaatctataagggataggtgttactctcttcctggttttacagatgagaacagagatgttaagtaacttgctcaggggcccggtgcagtggctcat

SEQ ID NO: 13717 - DNA, 201 bp, Homo sapiens
acaactgagaaactacttctcattaagtttccccatggtgtcacctttatttaatatttatttttaaaattaatttctcctacttctttttactttcttcragtgcagcaagtagacaattgaaaagtacctttacggccgggcgcggtggctcatgcctgtaatcccagcactttgggagactgagacgagcggatcacc

SEQ ID NO: 13718 - DNA, 201 bp, Homo sapiens
caaacacggtgagaagaccctcttcccaccgccctggtctgtccttgcgtgtgaatgggctggagtaggggaagggggtgggcctgaaacaatcccaggcyggtccttccccagagctttggaggggggtggtgtcaaagggcccagggatctgattaggggaactttcgctcagtggtgtggtccatactgaaaaatgtg

SEQ ID NO: 13719 - DNA, 201 bp, Homo sapiens
ccctgaatgacctctttaaaagtcctgtctccagatacaaccccatgggggatgagggcttccacatatgactttggtgggggcagaaaccactcagtctyctgaactcaccttggctgtctcggcttctttccctaggctcactcagtaacttgatggattttgtgaagaaaacaggcatttgcgcttcaaagtgggaat

SEQ ID NO: 13720 - DNA, 201 bp, Homo sapiens
tctcagctcactgcaagctccccacctcccggattcacgccattctcctgcctcagcttcctgagtagctgggactacaggcgcccgccaccacacccggstaatttctttttgtatttttagtagaggcggggtttcaccgtgttagccaggatagtctccatctcctgacctcgtgatccacccgcctcggcctcccaa

SEQ ID NO: 13721 - DNA, 201 bp, Homo sapiens
tgggaggcggaggttgcaatgagccaagatcccgccactgcactccagcctgggcaacagagcgagactctgtcaaaaaaaaaaaaaaaaaaaaaaaaaaraagaagaagaagaagaagaagaagaaacacttgttgagactgcatctccttttgctaatgagtggtttctagttgtaatatcactcctctgaataaagaa

SEQ ID NO: 13722 - DNA, 201 bp, Homo sapiens
gtgcctgtaatcccagctgctagtggggctgaggcaggagaatcgcttgaatctgggaggcggaggttgcaatgagccaagatcccgccactgcactccarcctgggcaacagagcgagactctgtcaaaaaaaaaaaaaaaaaaaaaaaaaagaagaagaagaagaagaagaagaagaaacacttgttgagactgcatct

SEQ ID NO: 13723 - DNA, 201 bp, Homo sapiens
ccctgtctctactaaaaatacaaaaattagccaggcatggtggcacgtgcctgtaatcccagctgctagtggggctgaggcaggagaatcgcttgaatctsggaggcggaggttgcaatgagccaagatcccgccactgcactccagcctgggcaacagagcgagactctgtcaaaaaaaaaaaaaaaaaaaaaaaaaaga

SEQ ID NO: 13724 - DNA, 201 bp, Homo sapiens
cagggttattattgcctttgctttttagcaaatctgctgtggcaggctgtggattttgagagtcaggggaggggtgtgtgtgtgagggggtggcttactcyggagtctgggattcatcccgtcatttctttcaataaataattatcggatagctactttgtgacagggtctgtgctgggctctgggggcaaagctgtcatg

SEQ ID NO: 13725 - DNA, 201 bp, Homo sapiens
caatggcgcgatctcagctcaccgcaacctcggcctcctgggtttaagcgattctcctgcctcccgagtagctgggattacaggcatgcgccaccacgccyggctaattttgtatttttagtagagacagggtttctccatgttggtcaggctggtctcaaactcctgacctcgtgatctacccaccttggcctcccaaag

SEQ ID NO: 13726 - DNA, 201 bp, Homo sapiens
gcgtagagagagaggatagcttatgtcattatttcttttatgttcttttcagaaagatcaaagactttaatattttaatactttcactaattctgctactsctatctagagggtgcagccaggtatacagagtggaacaggaaagtgaaacaggagtgtgaccactgaagcacagcatcacagggagatggtcaggcctct

SEQ ID NO: 13727 - DNA, 201 bp, Homo sapiens
gactgagaattttctgaccgcagtgcaccatgggaaggtaagtcctcttagagctgaccactatggggaagcagagcatttgtgtaatggaatgcatagtragtgtcaagaggtgagggctgtgacagttcctctcgcttggtggagatagatggaaagagctgaaggttgggcatggtggcccatgcctgtaaccccagc

SEQ ID NO: 13728 - DNA, 201 bp, Homo sapiens
agcaatttgagaccagcctgggcaacatagcaagaccccatctccacacaaattttttttttttttgagacggagtttcgctcttgttgcccgggctggartgcaatggcacgatatcggcttgccacaacctccaccttccaggttcaagcgattctcctgcctcagcctcacaagtagctaggattacaggcatgcgcc

SEQ ID NO: 13729 - DNA, 201 bp, Homo sapiens
atgagatccccagtggtttctgataccacacagtccatctctaacattctcctgtcatggttgtaattcctcattaatagatttctttttcctgcataccygctacattcctggttctgtgctgggactcacttgccgttgtatttcctctgcagagacctggttcgagttcacccctcaccacgctggcttctctgcact

SEQ ID NO: 13730 - DNA, 201 bp, Homo sapiens
tcttgggcatcagagattttgaaattgtcactcccaggtactccctataacattattatttccttagatgtatgtatcacctactgaagggattctgtacrtgtattttatccctcccctcacacaccagggtgctttttatttattattataaaataaacataacataaaatttgccattttaaccattttaaagtgtca

SEQ ID NO: 13731 - DNA, 201 bp, Homo sapiens
cctgtatcatatacaaatgtgtttggctaaaagtcactaaccaaccacagtgccccgaggacatgtgggattaattttcttacaaaagaaaaagacagacygagcaccgtgactcacagctgaaatcccagcactgtgggaggccgaggcgggcagatcacttgaggtcaagagttcaagaccagacgggccaacatggtg

SEQ ID NO: 13732 - DNA, 201 bp, Homo sapiens
tgtatcatatacaaatgtgtttggctaaaagtcactaaccaaccacagtgccccgaggacatgtgggattaattttcttacaaaagaaaaagacagactgrgcaccgtgactcacagctgaaatcccagcactgtgggaggccgaggcgggcagatcacttgaggtcaagagttcaagaccagacgggccaacatggtgaa

SEQ ID NO: 13733 - DNA, 201 bp, Homo sapiens
gggaggctgggaaatatttgcccttcctgcctgtgggctgagaaacgttggcatggaagggagcttgaaatggccttggggtagccagtctacagtgcccrgctggctccacccatagaaggttcctgaggacaaatctgtcttgtttactgctctattccaacagtcagaagagtgccgggtgcccactgattgcttcat

SEQ ID NO: 13734 - DNA, 201 bp, Homo sapiens
tagagttgcatgccaccatacctggcctgctccttctgagaaggagaacaagcactttgcagaagtccccccagcagtgtgcatggaccagagcttgaccktcccctagctgcaagggaggctgggaaatatttgcccttcctgcctgtgtgctgagaagggttggcatggacaggagcttgaaatggccttggggtagcc

SEQ ID NO: 13735 - DNA, 201 bp, Homo sapiens
cactgcagggtgccctgtgaggaacaataaggaatggcttccctgggtccatactgggatctgggagtgcatgcagggttcttcccacagctcctacttayattccacgaacctccccaagtcatatcctgcactgaatagggttaaggccttaccccagagactggactttcaggctccctggtgtggtgggggcgtgtg

SEQ ID NO: 13736 - DNA, 201 bp, Homo sapiens
gcagtgtgcatggaccagagcttgaccgtcccctagctgcaagggaggctgggaaatatttgcccttcctgcctgtgtgctgagaagggttggcatggacrggagcttgaaatggccttggggtagccagtctacagtgcccggctggctccacccatagaaggttcgtgaggacaaggaccttatctgtcttgtttactg

SEQ ID NO: 13737 - DNA, 201 bp, Homo sapiens
agccatgtgccagggtcctgcacacgtgtctgcagcttgcttttcattcaccccatgtgggtggagaagttcacctccacccacagttatctcatgaaacmcagctgggggcttctttcaacctgcgaccacccacctgaactttttggctgaccactgcagggtgccctgtgaggaacaataaggaatggcttccctggg

SEQ ID NO: 13738 - DNA, 201 bp, Homo sapiens
gagaagggttggcatggacaggagcttgaaatggccttggggtagccagtctacagtgcccggctggctccacccatagaaggttcgtgaggacaaggacyttatctgtcttgtttactgctctattccaacagccagaagagtgccgggtgcccactaattgcttcataaatatttatggaatggaagaaagatctttct

SEQ ID NO: 13739 - DNA, 201 bp, Homo sapiens
gacaaggaccttatctgtcttgtttactgctctattccaacagccagaagagtgccgggtgcccactaattgcttcataaatatttatggaatggaagaawgatctttcttcctgctgcagatccctgcagtgctttatgccagtctgctggtgctttgaatatcaaacatgacagtcacgtgatggagaatgtttgaatt

SEQ ID NO: 13740 - DNA, 201 bp, Homo sapiens
tttctgcctctgctgcacagaagagtttgtgtagggagtggggagtggcaggtggcagtaagccccacgcggatcccacacacttggcgaggcagatcccytcccaccctgttccactggcagtggtgagctaagttccaggcagcctgtgctcagaacttgcaaatgcccccaagtcataagctttccctgcagagatag

SEQ ID NO: 13741 - DNA, 201 bp, Homo sapiens
aattgcttcataaatatttatggaatggaagaaagatctttcttcctgctgcagatccctgcagtgctttatgccagtctgctggtgctttgaatatcaarcatgacagtcacgtgatggagaatgtttgaattttattgctcttttcttggcaggtttatggggaagtgctcttggtaacactgaagtcattagggaata

SEQ ID NO: 13742 - DNA, 201 bp, Homo sapiens
tcacagaacctgactctgcatttccccacccatatcattcaagccagatggggaggcagggacagctctggtccctccccaacccgggtagagatttccarcccagctgtcacagctctaagacaccgggaccgaaggagaagccaagagaggcaggaagaggtggcaaaggagtgctggagaagataaggaggctgagct

SEQ ID NO: 13743 - DNA, 201 bp, Homo sapiens
gataatccagagaggaatgtttctgcctctgctgcacagaagagtttgtgtagggagtggggagtggcaggtggcagtaagccccacgcggatcccacacmcttggcgaggcagatcccctcccaccctgttccactggcagtggtgagctaagttccaggcagcctgtgctcagaacttgcaaatgcccccaagtcataa

SEQ ID NO: 13744 - DNA, 201 bp, Homo sapiens
acccatgtgctgataatccagagaggaatgtttctgcctctgctgcacagaagagtttgtgtagggagtggggagtggcaggtggcagtaagccccacgcrgatcccacacacttggcgaggcagatcccctcccaccctgttccactggcagtggtgagctaagttccaggcagcctgtgctcagaacttgcaaatgccc

SEQ ID NO: 13745 - DNA, 201 bp, Homo sapiens
gaactgatcatgtggacagactcaggacctcctggttagccagagtggtgcatgcagtggtgatagctgaggacatagagccattttctccttcctgggcycagtgttatcctaccaggagatgctgtcatggactgtgttggttggcctccacccagcaggtggagcaccagctgcagtagtagcagtgggatattcact

SEQ ID NO: 13746 - DNA, 201 bp, Homo sapiens
ccccatttataaaatgcactttccaattccactctggggataaaggcgtcacagaacctgactctgcatttccccacccatatcattcaagccagatggggaggcagggacagctctggtccctccccaacccgggtagagatttccagcccagctgtcacagctctaagacaccgggaccgaaggagaagccaagagagg

SEQ ID NO: 13747 - DNA, 201 bp, Homo sapiens
tgctagttatagtagtaatgaactgatcatgtggacagactcaggacctcctggttagccagagtggtgcatgcagtggtgatagctgaggacatagagcyattttctccttcctgggcccagtgttatcctaccaggagatgctgtcatggactgtgttggttggcctccacccagcaggtggagcaccagctgcagtag

SEQ ID NO: 13748 - DNA, 201 bp, Homo sapiens
tggcaccttccccctcgctctcttgctcctgctctcggcaagtgatgtgcctgctccccattcactttccatcatgattggaagcttcctgaggccccacyagaagcagatgccagcaccacgcttcctgtacagcatccagaactgtgagacaattaaacctcttttctttataaattatccaacctcaggtacttcttt

SEQ ID NO: 13749 - DNA, 201 bp, Homo sapiens
aagtgatcctcctgcctcagccttctgaatagctgggaccacaggcatgcattaatatgcccagctaatttgtttattttattttatttttgtaaagatgyggtctcgctctcttgcccaagctggtctcaaacttctgggctcaagcaatcctcccacctcggcttccctaagtcctgggattactctggtgcctggcac

SEQ ID NO: 13750 - DNA, 201 bp, Homo sapiens
cagcaaaccagcatggcacatgtatacctatgtaataaacctgcatgttcagcacatgtatcccagatttgaaataaaattcttttaaaaaagggggggggatttaaagacagagacaggcatgtatacagagaggaaaccatgtgaacatggaagcagggattggggtgaggctctactgaccaagggctgccaaactat

SEQ ID NO: 13751 - DNA, 201 bp, Homo sapiens
gacagccttagtaggttggcttccttgaatgctagttatagtagtaatgaactgatcatgtggacagactcaggacctcctggttagccagagtggtgcaygcagtggtgatagctgaggacatagagccattttctccttcctgggcccagtgttatcctaccaggagatgctgtcatggactgtgttggttggcctcca

SEQ ID NO: 13752 - DNA, 201 bp, Homo sapiens
tcctcttggtgattagtaagtgcttgctctgagttcatgtgagatacggttgtttagaagtgtgtggcaccttccccctcgctctcttgctcctgctctcrgcaagtgatgtgcctgctccccattcactttccatcatgattggaagcttcctgaggccccaccagaagcagatgccagcaccacgcttcctgtacagca

SEQ ID NO: 13753 - DNA, 201 bp, Homo sapiens
aatgtcccctgtcctcgagactcccagcaatgggaagcagcaccagctctaatgggggtggcaggagagagacacaggctctgtgagattccttgctgatrgacagccttagtaggttggcttccttgaatgctagttatagtagtaatgaactgatcatgtggacagactcaggacctcctggttagccagagtggtgca

SEQ ID NO: 13754 - DNA, 201 bp, Homo sapiens
aaaccctgtctctactaaaaatacaaaaattagccaggcatggtggcacgtgcctgtaatcccagctgctagtggggctgaggcaggagaatcgcttgaayctgggaggcggaggttgcaatgagccaagatcccgccactgcactccagcctgggcaacagagcgagactctgtcaaaaaaaaaaaaaaaaaaaaaaaaa

SEQ ID NO: 13755 - DNA, 201 bp, Homo sapiens
tcaaccattgtaggagacagtgtggaattcctcaaggatctagatccagaaatactatttggcccagcaatcccattactgggtatatgcccaaaggaatrtaaatcattctgttagaaagatacaggcacatgtatgttcactgcagcactattcacaatatcaaagacatggaatcaacccaaatgcccatcagtgata

SEQ ID NO: 13756 - DNA, 201 bp, Homo sapiens
tgcatgaggcagaatttgacgctccagtctggaggtagaatttcttcttctctagaaactgttttgccctcaaagccttcaactgagtagatgagacccasccacattactgagaataatcttcttgaagtcaactgattttagctgtcaaccacatctacaaaataccttcacagccacatctaggctagtgtttgatta

SEQ ID NO: 13757 - DNA, 201 bp, Homo sapiens
tacccgacaggagtgggacttggctaagagcctacagaaaaccatccaagcagcgaggtctgagaattactctctgaccgacttctgggcctacatggttrtctctaagcaaaccagagaagtaagtcattcccagctggggacctggggtgggggtaggagcaaggggtctcagggtgtggggttaccaaagatgctgac

SEQ ID NO: 13758 - DNA, 201 bp, Homo sapiens
gtaagtgccaccaaccttctcccccctcttgctcttccccacccctgtgggccagtcctgcaggggacatgaccagatgtcccactggtacagtttggatrtttgttcccttccacatctcatgttggaatgtaatcccccaatgtaaattagttcaaccattgtaggagacagtgtggaattcctcaaggatctagatcc

SEQ ID NO: 13759 - DNA, 201 bp, Homo sapiens
ctcacacctgtaatcccagcactttgggaggtagaggcgggtggatcacctgaggtcaggtgtttgagaccagcctggccaacatggcgaaaccctgtctytactaaaaatacaaaaattagccaggcatggtggcacgtgcctgtaatcccagctgctagtggggctgaggcaggagaatcgcttgaatctgggaggcgg

SEQ ID NO: 13760 - DNA, 201 bp, Homo sapiens
ggttgattccatgtctttgctattgtgaatagtgctgcaatgagcatacgcatgcatgaggcagaatttgacgctccagtctggaggtagaatttcttctkctctagaaactgttttgccctcaaagccttcaactgagtagatgagacccacccacattactgagaataatcttcttgaagtcaactgattttagctgtc

SEQ ID NO: 13761 - DNA, 201 bp, Homo sapiens
ggacttggctaagagcctacagaaaaccatccaagcagcgaggtctgagaattactctctgaccgacttctgggcctacatggttatctctaagcaaaccrgagaagtaagtcattcccagctggggacctggggtgggggtaggagcaaggggtctcagggtgtggggttaccaaagatgctgaccagcaccacctttta

SEQ ID NO: 13762 - DNA, 201 bp, Homo sapiens
ggctcacacctgtaatcccagcactttgggaggtagaggcgggtggatcacctgaggtcaggtgtttgagaccagcctggccaacatggcgaaaccctgtytctactaaaaatacaaaaattagccaggcatggtggcacgtgcctgtaatcccagctgctagtggggctgaggcaggagaatcgcttgaatctgggaggc

SEQ ID NO: 13763 - DNA, 201 bp, Homo sapiens
gcaatcctccaactactgggttcaagtgatcctcctatctcagcctcccgaagtgctgggattacgtgtatgagccactgcatccagcctatcctaacacwtcgggtttttgttgttttttgtttgttttgtttattcttgagacagggtttcactctgtcgcccaggctggagtgcagtggtgcaatcacagctcactgc

SEQ ID NO: 13764 - DNA, 201 bp, Homo sapiens
ctgggtgacagactgagacccctctaaaaaaaaaatgtggcctacgtgcagaggttccaccctgtgggacccacatgcctccctcacactgtcttggcacmttctcccaaagctgccggagtctcatttgtccaatatgaagaagcccgtggaagaagggacactaccctacccgatatttgcagccattgacaatgacct

SEQ ID NO: 13765 - DNA, 201 bp, Homo sapiens
atgcctccctcacactgtcttggcacattctcccaaagctgccggagtctcatttgtccaatatgaagaagcccgtggaagaagggacactaccctacccratatttgcagccattgacaatgacctgcaaccttcctggcaggaggcaagagcaccaggtaagcaaacatttagagggagggagaggtagtaagggatgg

SEQ ID NO: 13766 - DNA, 201 bp, Homo sapiens
aggatatgaacttctatgggacaggcattgcccctgcctaagggagatcctaggtctcctccttctcctcctcctcctttctttttcttttcttttctttsttttttttttttttttttttttgagacaacgtctcgctctgtcacccaggctggaatgcagtggcatgatcttggctcactgcaacctccacctcccagg

SEQ ID NO: 13767 - DNA, 201 bp, Homo sapiens
taccctacccgatatttgcagccattgacaatgacctgcaaccttcctggcaggaggcaagagcaccaggtaagcaaacatttagagggagggagaggtartaagggatggaacagcacggagtggaatggaagaatgtttccctgccctccccttggggagcccaggaagagggaagggctcaggattgcagaaaacagg

SEQ ID NO: 13768 - DNA, 201 bp, Homo sapiens
cgggcgtggtggcaggtgcctgtaatcccagctactcgggaggctgaggcaggagaatcacttgaacccaggaggcggaggttgcagtgaaccaagattgygccattgcactccagcctggtgaacaagagcaaaattccatctcaaaaaaaaaaaaaaaaaaaaagtagggaagcccacagtgcagccttcagtctgtag

SEQ ID NO: 13769 - DNA, 201 bp, Homo sapiens
tttgcagccattgacaatgacctgcaaccttcctggcaggaggcaagagcaccaggtaagcaaacatttagagggagggagaggtagtaagggatggaacrgcacggagtggaatggaagaatgtttccctgccctccccttggggagcccaggaagagggaagggctcaggattgcagaaaacagggtgctcagcttaga

SEQ ID NO: 13770 - DNA, 201 bp, Homo sapiens
ttgggaggccgaggcgggtggatcagaagatcaggagttcgagaccagcctggtcaacctggtgaaatcccgtctctactaaaaatacaaaaaaattagcygggcgtggtggcaggtgcctgtaatcccagctactcgggaggctgaggcaggagaatcacttgaacccaggaggcggaggttgcagtgaaccaagattgc

SEQ ID NO: 13771 - DNA, 201 bp, Homo sapiens
agccattgacaatgacctgcaaccttcctggcaggaggcaagagcaccaggtaagcaaacatttagagggagggagaggtagtaagggatggaacagcacrgagtggaatggaagaatgtttccctgccctccccttggggagcccaggaagagggaagggctcaggattgcagaaaacagggtgctcagcttagacgaga

SEQ ID NO: 13772 - DNA, 201 bp, Homo sapiens
caagaaaacctttaagaggccaacatggtggctcacgcttgtaatcccagtggtttgggaggctgaggtgggaggatcgcctgaaaccagaagttggagaycaccctgggcaacatagtgagatcccatctcaaaacaacaacattaaaaaacaaaacaaaacaaaaaaacacaataaattagccaagcatggtggcagga

SEQ ID NO: 13773 - DNA, 201 bp, Homo sapiens
gcctccagatttgttctttttgcttagtctttgctttggctatgagggctcttttttggttcatatggattttgggattgtggctgggcatggtagctcaygtctgtaatcccagcactttgggaggccaaggcgggtggatcacctgaggtcaggagtttgagaccagcctggccaacatggcgaaaccccatctctact

SEQ ID NO: 13774 - DNA, 201 bp, Homo sapiens
gtcttgctcttgtcgcccaggctggagtgcagtggcgcgatcttggctcattgcaacctctacttcccaggttcaagtgattctcctgcctcagcctcccrgttagctgggattacagacgcgtgccaccatgcccagctaatttttgtatttttagtagagacggagtttccccgtgttggccaggctggtctcaaactt

SEQ ID NO: 13775 - DNA, 201 bp, Homo sapiens
acagagtggatgagagtacagactcccttggaaggaatgttgctctggtacatgtaagctttgtgacctccgaaaagttacttaacctctctgtgcctcgktttctgcctctgtgccatgcgggtgataataacagtagttatgaatatttgatgagttaattcattgaaagcttgtaggacagtgcctggtagataacgg

SEQ ID NO: 13776 - DNA, 201 bp, Homo sapiens
ttacctggtccctcatttaacatttaacccctttaataccctaagaggcagacgcttttgtcccttccattttgctgagatccaccaagtcgtgggaaggrtgcgtgactcacccacactgctggtcagtgagtgcagacgcggggatctataggagaactgggtggtggatctctaggggaatagtgtggtggttctgat

SEQ ID NO: 13777 - DNA, 201 bp, Homo sapiens
gcacccgccaccacgcctggctaattttggtatttttagtagagacagggtttcactgtgttggccaggctgatcttgaactcctgacctcaagtgatccrcctgcctcagcccccaaagtgctgggatttcaggcgtgaggcaccgcacccagccagggcttcaacatatgaatctgggaagagagagaagtcagctcct

SEQ ID NO: 13778 - DNA, 201 bp, Homo sapiens
tcagcctcccagtgtgctaggattacaggcataaaccaccacgcccgggctgatgttgttctttgacattggtgttcaccatagcttggttaaaaacaaamctaaaaagggaatctatctatatccaacctccaaatggctaactaaaggtgtgagatgggtctgagtgttacttctccagtgggtctgctaagctttctc

SEQ ID NO: 13779 - DNA, 201 bp, Homo sapiens
cgcccgggctgatgttgttctttgacattggtgttcaccatagcttggttaaaaacaaaactaaaaagggaatctatctatatccaacctccaaatggctractaaaggtgtgagatgggtctgagtgttacttctccagtgggtctgctaagctttctctctaaaaaacaaaaacaaaattcctgatatgtagtgtttgc

SEQ ID NO: 13780 - DNA, 201 bp, Homo sapiens
ggttaaaaacaaaactaaaaagggaatctatctatatccaacctccaaatggctaactaaaggtgtgagatgggtctgagtgttacttctccagtgggtckgctaagctttctctctaaaaaacaaaaacaaaattcctgatatgtagtgtttgccaattcctgtggtgtaaatgttcccaccgtggccaacttcaggcta

SEQ ID NO: 13781 - DNA, 201 bp, Homo sapiens
ctacagtgagtgttattgttcctctgggtctagccacccagtgaagctgccacacttcaggctggttcttgggaatgtctccaaggaatccggtaatgtcmcctgtcctcgagactcccagcaatgggaagcagcaccagctctaatgggggtggcaggagagagacacaggctctgtgagattccttgctgatggacagc

SEQ ID NO: 13782 - DNA, 201 bp, Homo sapiens
aattcctgtggtgtaaatgttcccaccgtggccaacttcaggctaccaacatgaggtcactgagcacagagttggaagagaggtgcaaaattggctctcgrgagccattggctgccattggagcccatggctgccatttctattaatgaaatatccctgcaggtcatctgtattttttatattataactagggactttgtt

SEQ ID NO: 13783 - DNA, 201 bp, Homo sapiens
agcaccagactacagtgagtgttattgttcctctgggtctagccacccagtgaagctgccacacttcaggctggttcttgggaatgtctccaaggaatccrgtaatgtcccctgtcctcgagactcccagcaatgggaagcagcaccagctctaatgggggtggcaggagagagacacaggctctgtgagattccttgctg

SEQ ID NO: 13784 - DNA, 201 bp, Homo sapiens
accctgaaaggtaagcatcctacttcatcatgaatccctgatgataatggggaccgcacacttgcttgaggccagccattgtcctaggaacattacatgtrtgattcatttggtgcccatttgaattctttatctggtatttcaaagatttcatcttgatttggatctgttgctggagaggtagtgtgatcttttgggggt

SEQ ID NO: 13785 - DNA, 201 bp, Homo sapiens
gagtcttcgtgtgatggctttctcatatgctggttgtagaagcgatgtgctcactgtgtgagcaagttcactgttgcctacagggctggaatggtagaagwctcttgaagcttaactcattccccacaaggcatgcaattttttccccagtattttattgactggtttgatggttcaggcttcaggtctgtaggggagtgc

SEQ ID NO: 13786 - DNA, 201 bp, Homo sapiens
ttcccctaggataggagtcactgagcaccagactacagtgagtgttattgttcctctgggtctagccacccagtgaagctgccacacttcaggctggttcytgggaatgtctccaaggaatccggtaatgtcccctgtcctcgagactcccagcaatgggaagcagcaccagctctaatgggggtggcaggagagagacac

SEQ ID NO: 13787 - DNA, 201 bp, Homo sapiens
gagcaatactctgtctcaaataaataaataaataaataaataaataaataaataaataaataaatgggagactttgcctccaaccctgaagaaaataagcrtgcaaaagatgagtagaggtggaggcagagatgaaggagctagaaaaaagaggccagaaagtcagagagagtgaggtaacatgggggtcagcagaaggca

SEQ ID NO: 13788 - DNA, 201 bp, Homo sapiens
ggttgggttagagctgtgggctttccgtgctgagcccagcactgaaactgtgtccctgctgaaagaaacttcccaccagcagaaagatctgattttcaagkcctgctgtccagattcttttgtcccatggggtgttcccttgatgtggtgcactccccattcccctaggataggagtcactgagcaccagactacagtgag

SEQ ID NO: 13789 - DNA, 201 bp, Homo sapiens
ctatagttgtacccatgctgagctcccatgggagaaaccccaactgtgcctgtggcagtggaagagaggggaaagacatccccttatccaagacccttcaygcacaccagggctgtctgatggttgggttagagctgtgggctttccgtgctgagcccagcactgaaactgtgtccctgctgaaagaaacttcccaccagc

SEQ ID NO: 13790 - DNA, 201 bp, Homo sapiens
cctgtggggatgcagtcgccctgatatgttccagaaaggctgtctatagttgtacccatgctgagctcccatgggagaaaccccaactgtgcctgtggcartggaagagaggggaaagacatccccttatccaagacccttcatgcacaccagggctgtctgatggttgggttagagctgtgggctttccgtgctgagccc

SEQ ID NO: 13791 - DNA, 201 bp, Homo sapiens
aggaatgttggtgttctgagtagagaggaactgtgaatctgtctcttatgcaagcctaaacctagaggggctcctcctgtggggatgcagtcgccctgatrtgttccagaaaggctgtctatagttgtacccatgctgagctcccatgggagaaaccccaactgtgcctgtggcagtggaagagaggggaaagacatcccc

SEQ ID NO: 13792 - DNA, 201 bp, Homo sapiens
gatgctgcataaggtactggcagatgagattgggaggagcagagacactgaagaggaggtggaattggcaggtcttggtgatagtccagggtgagggtgargaagaggcaggcgtctgggataatgacctggtttatccctgactgacttggcagcctcttgggctggggaagggagcacgggaaagtgtgctgggcattt

SEQ ID NO: 13793 - DNA, 201 bp, Homo sapiens
tcatctgtaggaatgttggtgttctgagtagagaggaactgtgaatctgtctcttatgcaagcctaaacctagaggggctcctcctgtggggatgcagtcrccctgatatgttccagaaaggctgtctatagttgtacccatgctgagctcccatgggagaaaccccaactgtgcctgtggcagtggaagagaggggaaag

SEQ ID NO: 13794 - DNA, 201 bp, Homo sapiens
cgggcacctcttttcatctgtaggaatgttggtgttctgagtagagaggaactgtgaatctgtctcttatgcaagcctaaacctagaggggctcctcctgyggggatgcagtcgccctgatatgttccagaaaggctgtctatagttgtacccatgctgagctcccatgggagaaaccccaactgtgcctgtggcagtgga

SEQ ID NO: 13795 - DNA, 201 bp, Homo sapiens
aaaaataagaggggatgccaggcatgatagctcaatgcctgtaatcccagcactttgggaggctgaggggggtggatcacttgaggtcaggagttcgagamcagcctggccaacatggtaaaaccccatcagtactaaaaatacaaaaattagccgggcctggtggtggtgcgtgcctgtagtcccagatactccagaggc

SEQ ID NO: 13796 - DNA, 201 bp, Homo sapiens
cgtctctactacaaatacaaaaaaatatttagccgggcgtagtggtgggtgcctgtggtcctagctatttgggaggctgaggcaggagaatcacttgagcscaggaggcggaggttgcagtgagccgagattgcaccactgcactacagcctgggtgacagagcaagactgtctcaagaaaaaataaataaataaaagtaa

SEQ ID NO: 13797 - DNA, 201 bp, Homo sapiens
taattcatgagtgtggataaaaataagaggggatgccaggcatgatagctcaatgcctgtaatcccagcactttgggaggctgaggggggtggatcacttkaggtcaggagttcgagaccagcctggccaacatggtaaaaccccatcagtactaaaaatacaaaaattagccgggcctggtggtggtgcgtgcctgtagt

SEQ ID NO: 13798 - DNA, 201 bp, Homo sapiens
cacctgaggtcaggagttcgagaccagcctgaccaacatagcgaaaccccgtctctactacaaatacaaaaaaatatttagccgggcgtagtggtgggtgyctgtggtcctagctatttgggaggctgaggcaggagaatcacttgagcgcaggaggcggaggttgcagtgagccgagattgcaccactgcactacagcct

SEQ ID NO: 13799 - DNA, 201 bp, Homo sapiens
tttgggaggctgaggtgggaggatcgcctgaaaccagaagttggagaccaccctgggcaacatagtgagatcccatctcaaaacaacaacattaaaaaacmaaacaaaacaaaaaaacacaataaattagccaagcatggtggcaggaacctgaagaatctacccaggagactggggcaggaggatcactggagcccagga

SEQ ID NO: 13800 - DNA, 201 bp, Homo sapiens
tgagcagagctattatcagtgtgtgtgtgtgagagagagagagttgaacatcatctaattcatgagtgtggataaaaataagaggggatgccaggcatgayagctcaatgcctgtaatcccagcactttgggaggctgaggggggtggatcacttgaggtcaggagttcgagaccagcctggccaacatggtaaaacccca

SEQ ID NO: 13801 - DNA, 201 bp, Homo sapiens
gttttacagatgagaacagagatgttaagtaacttgctcaggggcccggtgcagtggctcatgtttgtaatcctagcactttgggaggccgaggtgggagratcacctgaggtcaggagttcgagaccagcctgaccaacatagcgaaaccccgtctctactacaaatacaaaaaaatatttagccgggcgtagtggtggg

SEQ ID NO: 13802 - DNA, 201 bp, Homo sapiens
ataaattagccaagcatggtggcaggaacctgaagaatctacccaggagactggggcaggaggatcactggagcccaggaattcaaggcttcggtgagctstgattgcaccattgtactacagcctgagtgacaaagtgagaccctgtccccccaaaaagaagaaagaaaaaagaaaacagaggagaggagggacaaaaga

SEQ ID NO: 13803 - DNA, 201 bp, Homo sapiens
tggttttacagatgagaacagagatgttaagtaacttgctcaggggcccggtgcagtggctcatgtttgtaatcctagcactttgggaggccgaggtgggwggatcacctgaggtcaggagttcgagaccagcctgaccaacatagcgaaaccccgtctctactacaaatacaaaaaaatatttagccgggcgtagtggtg

SEQ ID NO: 13804 - DNA, 201 bp, Homo sapiens
ctggaagtcattatcctcagcaaactattgcaggaacagaaaaccaaacaccacatgttctcacttataagtgggagctgaatgatgagaacacatggacrcagggaggggaacaacacacactggggcctgttgggggcgggtggggagaagaagagcaccaggaaaattagctaatgcatgtggggcttaatacctatg

SEQ ID NO: 13805 - DNA, 201 bp, Homo sapiens
atggtggcaggaacctgaagaatctacccaggagactggggcaggaggatcactggagcccaggaattcaaggcttcggtgagctgtgattgcaccattgyactacagcctgagtgacaaagtgagaccctgtccccccaaaaagaagaaagaaaaaagaaaacagaggagaggagggacaaaagacaaaaaggggccggg

SEQ ID NO: 13806 - DNA, 201 bp, Homo sapiens
gacaaaaaggggccgggcgcagtggctcacgcctgtaatcccaggactttgggaggccgaggcgggtggatcacgaggtcaggagatcaagaccatcctgrctaacacagtgaaaccccgtctctactaaaaatacaaaaaattagctgggcgtggcggcgggcgcctgtagtcccagctgctcgggaggctgaggcagga

SEQ ID NO: 13807 - DNA, 201 bp, Homo sapiens
atccacccgcctcggcctcccaaagtgctgggattacaggcatgagccaccgcacccggccatctctcactttttagatgtcttccttctccataggtccrattatcacccaaatgctggcagctctccagacattccagtttctcttttgagctcatctctctcctgagatccagacctccttaccctatttcctaagca

SEQ ID NO: 13808 - DNA, 201 bp, Homo sapiens
gagtgtaatggcacgatctcggctcactgcaacctctgcctcccaggttcaagtgattctcctgcctcagcctcccaagtagctgggattataggcatgcrccaccacgcctggctaatttttgtatttttagtagggatggggtgtcaccatgttaatcaggctggtctcgaactcctgaccttaggtgatccactcacc

SEQ ID NO: 13809 - DNA, 201 bp, Homo sapiens
cagctgactccgtcctttccataagccccacaaattcagtcattcccagacctagaaatcaccccctcctcattttcatcctttgtgctcttctacatcayccccagaccaggtctcccagtctcctgggagactcttgtaattagttcctcactggcccgcccatcccaagctgtccacctccttccctggctacctgat

SEQ ID NO: 13810 - DNA, 201 bp, Homo sapiens
gcatacccgctacattcctggttctgtgctgggactcacttgccgttgtatttcctctgcagagacctggttcgagttcacccctcaccacgctggcttcyctgcactgggggcctttgtttccataacccacttcggaagcaaattcaagaagggaagactggtcagaactcaccctgagagagacctgactttcctgag

SEQ ID NO: 13811 - DNA, 201 bp, Homo sapiens
ctcctgggctcaagcaatcctcttgcctcagccttttgagtaagctggggcaacaggcatgcaccatcgtgcctggctaatttttaattatttttttttttgtagagacagggatcttgctatattgcccaggctggtctcaaactcctgagctcaagcaatcctccaactactgggttcaagtgatcctcctatctcagc

SEQ ID NO: 13812 - DNA, 201 bp, Homo sapiens
cgtgatccagtgctccagctattcagatcagacgggcacctcttttcatctgtaggaatgttggtgttctgagtagagaggaactgtgaatctgtctcttrtgcaagcctaaacctagaggggctcctcctgtggggatgcagtcgccctgatatgttccagaaaggctgtctatagttgtacccatgctgagctcccatg

SEQ ID NO: 13813 - DNA, 201 bp, Homo sapiens
aaagccatccatctctcagacacactcgtgatccagtgctccagctattcagatcagacgggcacctcttttcatctgtaggaatgttggtgttctgagtrgagaggaactgtgaatctgtctcttatgcaagcctaaacctagaggggctcctcctgtggggatgcagtcgccctgatatgttccagaaaggctgtctat

SEQ ID NO: 13814 - DNA, 201 bp, Homo sapiens
tctgcttggccatttgatgtcttgaattcactattttattttatttcattttatttttgagacagggtcttgctctgtcacccaggctggagtgcagtggygagatcatggctcactgcagcttcgacctcctgggctcaagcaatcctcttgcctcagccttttgagtaagctggggcaacaggcatgcaccatcgtgcc

SEQ ID NO: 13815 - DNA, 201 bp, Homo sapiens
ccagaaagccatccatctctcagacacactcgtgatccagtgctccagctattcagatcagacgggcacctcttttcatctgtaggaatgttggtgttctragtagagaggaactgtgaatctgtctcttatgcaagcctaaacctagaggggctcctcctgtggggatgcagtcgccctgatatgttccagaaaggctgt

SEQ ID NO: 13816 - DNA, 201 bp, Homo sapiens
gccagaaagccatccatctctcagacacactcgtgatccagtgctccagctattcagatcagacgggcacctcttttcatctgtaggaatgttggtgttcygagtagagaggaactgtgaatctgtctcttatgcaagcctaaacctagaggggctcctcctgtggggatgcagtcgccctgatatgttccagaaaggctg

SEQ ID NO: 13817 - DNA, 201 bp, Homo sapiens
aagggttggagccacctcagctcccctgccaggtcagccagaaagccatccatctctcagacacactcgtgatccagtgctccagctattcagatcagacrggcacctcttttcatctgtaggaatgttggtgttctgagtagagaggaactgtgaatctgtctcttatgcaagcctaaacctagaggggctcctcctgtg

SEQ ID NO: 13818 - DNA, 201 bp, Homo sapiens
ctaattttgtatttttagtagagatggggtttctccgtgttggtcaggctggtctcgatctcccaacctcaggtgatccgcccacctcggcctcccaaagygctgggattacagccgtgagccaccatgcctggctgtgcaccgtggtcttatcaggcagaagggttggagccacctcagctcccctgccaggtcagccag

SEQ ID NO: 13819 - DNA, 201 bp, Homo sapiens
ccaggctggaatacaatggcatgatctcagctcaccccacaacctccgcctcccaggttcaaggaattctcctgccgcagcctcctgagtagctgggattrcaggcacttgccaccatgcccagctaattttgtatttttagtagagatggggtttctccgtgttggtcaggctggtctcgatctcccaacctcaggtgat

SEQ ID NO: 13820 - DNA, 201 bp, Homo sapiens
ttttttttttttttttgagacagagtttggctcttgttgcccaggctggaatacaatggcatgatctcagctcaccccacaacctccgcctcccaggttcmaggaattctcctgccgcagcctcctgagtagctgggattgcaggcacttgccaccatgcccagctaattttgtatttttagtagagatggggtttctccg

SEQ ID NO: 13821 - DNA, 201 bp, Homo sapiens
actatagttgaatgtcaaatcttttttttttttttgagatggagtcttctgtgtcgcccaggctggtgtgctgtggtgcgatcttggctcactgcaacctycgcctcccgggttcaagtgattctcttgcctcagcctcctgagtagctgggattacaggcgcccgccaccatgcccggctaatttctgtatttttagtag

SEQ ID NO: 13822 - DNA, 201 bp, Homo sapiens
taactcattccccacaaggcatgcaattttttccccagtattttattgactggtttgatggttcaggcttcaggtctgtaggggagtgcataggaagtgaytgtggccaaaacatgtgagtaaatgcaacacccaatggtgagcaaaggtcccagccttgacagaggtggctggaggagctctcagtgagttgcatcgaga

SEQ ID NO: 13823 - DNA, 201 bp, Homo sapiens
aaagttacttttctgattccttctcatttgagtagactatttcttttaattattcttgaatttatgttggatttgactgtgttttttttttcttttttccrcttaaggatgtgactttaatgtccctagctaattatagcctaatttggtccttggtgctttcaggggtgaagattgtaagagttccttggatatagggag

SEQ ID NO: 13824 - DNA, 201 bp, Homo sapiens
aacaggccggaaaccgagacaggattttttaaaatttaatttaatttaaagtttgaggatacatgtgcaggacatgcaggtttgttacccaggtaaacgtrtgccatggtggtttgctgcacttatcaacccatcacctagatattaagccccacatgcattagctgtttaccctgatgttttccctcccaccgccccctc

SEQ ID NO: 13825 - DNA, 201 bp, Homo sapiens
tcttcctggttttacagatgagaacagagatgttaagtaacttgctcaggggcccggtgcagtggctcatgtttgtaatcctagcactttgggaggccgargtgggaggatcacctgaggtcaggagttcgagaccagcctgaccaacatagcgaaaccccgtctctactacaaatacaaaaaaatatttagccgggcgta

SEQ ID NO: 13826 - DNA, 201 bp, Homo sapiens
acctaggagctttttggatgagtctaaccataggatccatgtacatagtcgtcagatataccctaggtatgcctaggatccaagtgtcagaggcagaaaaygggaacagcctgaggcaattagcaaattgagaggaaaaatacttcccaaaactacataggttgggagtcatgaaggaatcagacttgacccatggtggga

SEQ ID NO: 13827 - DNA, 201 bp, Homo sapiens
atctaactagagatatttattttaacaaattggctcatgggattgtgaagatgacaagtccaaaatccatggggcaggccaacaggccggaaaccgagacmggattttttaaaatttaatttaatttaaagtttgaggatacatgtgcaggacatgcaggtttgttacccaggtaaacgtatgccatggtggtttgctgca

SEQ ID NO: 13828 - DNA, 201 bp, Homo sapiens
gtagatagcacccgataagcagcattaagaacatcaaaaatttttattgagcccgggcacggtggctcacacctataatcccagcattttgggaagctgakgtgggaggattgcttcaggccacaagtttgagaccagcgtgggcaacatagtgagactccatctctacagaaaataaatttaaaaatgagcagggcatgg

SEQ ID NO: 13829 - DNA, 201 bp, Homo sapiens
gtggtgcatgcctgtaatcccagctagtcgggaggctgaagcaggagaatcacttgaatctgggaggcagaggttgcagtgagccgagatcacaccactgmactccagcctgggcaacagagcgagatcccatctcaaaataaataaataatacaaagttaggtggctggtgacattggtttagctgtgcaacattaagca

SEQ ID NO: 13830 - DNA, 201 bp, Homo sapiens
ttcaccatgttggccaggctggtcttgaactcctgacctcaagtgattcactgcctcagcctcccagtgtgctaggattacaggcataaaccaccacgccygggctgatgttgttctttgacattggtgttcaccatagcttggttaaaaacaaaactaaaaagggaatctatctatatccaacctccaaatggctaacta

SEQ ID NO: 13831 - DNA, 201 bp, Homo sapiens
aaatgaaataaatattttaaatcatgctagccacacttcaggggctcaagagctatgatgtatgtttaatacattggatggtgtgagggtagatagcaccygataagcagcattaagaacatcaaaaatttttattgagcccgggcacggtggctcacacctataatcccagcattttgggaagctgaggtgggaggattg

SEQ ID NO: 13832 - DNA, 201 bp, Homo sapiens
caggtttattctagattttctgctcctccatccttagcatattaagtcaccctcatgctgaactcctccacaccacgggatggcggctgcatccaatgaarctgcaacttttttttttttttttgaagtcagggtctctctctgtcactcaagctgccgtgcaaaagcacagtcatagcccaatacaggtcttgaactcct

SEQ ID NO: 13833 - DNA, 201 bp, Homo sapiens
attctacccatccatgagcatgggatgtgtttccatttgtttgtgtcatctatgatttctttcagcagtgttttgtagttttccttgtagcagtctttcayctccttggttaggtatattcctgagtattttattttatttttttgcagctgttgtaaaaggggttgagttcttgatttgaatctcagcttggtcattgtt

SEQ ID NO: 13834 - DNA, 201 bp, Homo sapiens
gaatcgcttgaacccgggaggcggaggttgcagtgagctgagatcacgccattgcactccagcctgggcaacaagagtgaaactctgtctcaaaaaaaaaraagaagtatggagtcctcaggccacatttagttttctttaacatgttaaatattaaagggctatcaaagcaatgtaggtgtgatttgcttttctgctgct

SEQ ID NO: 13835 - DNA, 201 bp, Homo sapiens
tcctccatccttagcatattaagtcaccctcatgctgaactcctccacaccacgggatggcggctgcatccaatgaagctgcaactttttttttttttttkgaagtcagggtctctctctgtcactcaagctgccgtgcaaaagcacagtcatagcccaatacaggtcttgaactcctggcctcaagtgatcttcctgcct

SEQ ID NO: 13836 - DNA, 201 bp, Homo sapiens
tgctcttttcttggcaggtttatggggaagtgctcttggtaacactgaagtcattagggaatacatttttggtgagtatttggggaacagaaaggtcaaascctagagatattttatgcaaggagattcacagtacttttcctactcatggcagaagagagacctgtgtgtaattgttctagcaactgcttttcctgacat

SEQ ID NO: 13837 - DNA, 201 bp, Homo sapiens
atgtgctcactgtgtgagcaagttcactgttgcctacagggctggaatggtagaagactcttgaagcttaactcattccccacaaggcatgcaattttttycccagtattttattgactggtttgatggttcaggcttcaggtctgtaggggagtgcataggaagtgattgtggccaaaacatgtgagtaaatgcaacacc

SEQ ID NO: 13838 - DNA, 201 bp, Homo sapiens
ttgggaggcccaggcggacagatcacttgaggtcaggggttcgagtgcaagctgggtaacatggtgaaaatgcgtctctactaaaaatacaaaaattagcyaagtatggtggtgcacgcctgtgatcccagctactcaggaggttgaggcacaagaatcgcttgaaaccaggaggcaaaggctgcagtgagctaagatcac

SEQ ID NO: 13839 - DNA, 201 bp, Homo sapiens
atgaacgtggccgggtaggtgggagaccatagtcgctctgatgcctatgctcgttcagtaagtatctgttggagaactttctctgcaacaggcaggagggytgcatgggtgaaaaaagataggcagtgtctcccctacttgagcttgcgtctcagcaggggacagaccatgaacagggtcaggagtgaatggttttctgaa

SEQ ID NO: 13840 - DNA, 201 bp, Homo sapiens
aaaaaaattaaaaaataaagaaatgaggggccgggcgcagtggctcacacctgtaatctcagcactttgggaggctgaggtgggcagatcacctgaggtcrggagtttgagaccagcctgaccaacgtggagaaaccccatctctactaaaaatacaaaattagccgggcgtggtggtacatgcctgtaatcccagctaca

SEQ ID NO: 13841 - DNA, 201 bp, Homo sapiens
attgcaccactgcacaccagcctgggcgacaaagagtaagactccatctcaaaaaaaaaaaaaaaaaaattcaaaacccatcgagttgggatgacgcttartgctgggcttcaggaagagtaggcaggagggtagtatgggaggtttctaggagccactcttggaagcggtgctccccacagatgcccgattgcactgact

SEQ ID NO: 13842 - DNA, 201 bp, Homo sapiens
ttcctggcagatgactctccccgcttctgcgtcctgcctgcccattcataccagtttgaactgcaacagcctagctcctcacctgtgcacctccttccccrggtgtgcacgtctccagccccgagcgcgtgtcttcctgctcatctgggtttcctgggcaaatagtggccctcaataaatgtttgctgagtgagaacatat

SEQ ID NO: 13843 - DNA, 201 bp, Homo sapiens
tgaagtttccataattcctgggctccagaaagaagaaaaggcggccgtggagagacgaagacttcatgtgctgaaagctctgaagaagctaaggattgagsctgatgaggtaagtgaggggaggagggtggccccagagatcccagaatcgccccctctgtgcccagtgtccagggcccaactcagccagggagagctgga

SEQ ID NO: 13844 - DNA, 201 bp, Homo sapiens
ccggtaatgtcccctgtcctcgagactcccagcaatgggaagcagcaccagctctaatgggggtggcaggagagagacacaggctctgtgagattccttgstgatggacagccttagtaggttggcttccttgaatgctagttatagtagtaatgaactgatcatgtggacagactcaggacctcctggttagccagagtg

SEQ ID NO: 13845 - DNA, 201 bp, Homo sapiens
ggcttttattacattgaagtatgtctcttgtataccgattttgttgagggctttaatcataaagggatgtgggattttgtgaaatgcttctgcatctcctrtgatttttgtttttaattctgtttctgtgatatatcacatttgttgacttgcatatgttaagccatccctgcattcctagtatgaaacccacttgatcac

SEQ ID NO: 13846 - DNA, 201 bp, Homo sapiens
atcttgagactggtgccctgcgagctccaccccacccctccatgcagttccccatgggccccgcctgcatcttcttgaggaaaggcattgctgagaaacascgggtgaggtggggagtgagggggaagggcggtgggcggggcaaagggagcaggggtgtgggacaaagaaggggacatgatggtgccacagaaccagggg

SEQ ID NO: 13847 - DNA, 201 bp, Homo sapiens
cgtctcaactaaaaatacaaaaaattagctgggcgtggtggcgggcgcctgtagtcccagctactccggaggctgaggcgggagaatggcgtgagcccggraggcggagcttgcagtgagccgagactgcgccactgcactccagcctagggcacaaagcgagactccatctcaaaaaaaaataaaataaaataaaccaat

SEQ ID NO: 13848 - DNA, 201 bp, Homo sapiens
aaaccccgtctcaactaaaaatacaaaaaattagctgggcgtggtggcgggcgcctgtagtcccagctactccggaggctgaggcgggagaatggcgtgarcccggaaggcggagcttgcagtgagccgagactgcgccactgcactccagcctagggcacaaagcgagactccatctcaaaaaaaaataaaataaaataa

SEQ ID NO: 13849 - DNA, 201 bp, Homo sapiens
gagatcatcctggctaacacagtgaaaccccgtctcaactaaaaatacaaaaaattagctgggcgtggtggcgggcgcctgtagtcccagctactccggargctgaggcgggagaatggcgtgagcccggaaggcggagcttgcagtgagccgagactgcgccactgcactccagcctagggcacaaagcgagactccatc

SEQ ID NO: 13850 - DNA, 201 bp, Homo sapiens
tttctcctgaagcctcttgcagaggccctaatctctccttataaaaccaatcaggctgggcgcggtggctcacgcctgtaatcccagccctttgggaagaygaggcgggcggatcctgaggtcaggagatcgagatcatcctggctaacacagtgaaaccccgtctcaactaaaaatacaaaaaattagctgggcgtggtg

SEQ ID NO: 13851 - DNA, 201 bp, Homo sapiens
attctttatctggtatttcaaagatttcatcttgatttggatctgttgctggagaggtagtgtgatcttttgggggtgctgtagaaccatgttttgtcatrttaccaaagttacttttctgattccttctcatttgagtagactatttcttttaattattcttgaatttatgttggatttgactgtgttttttttttcttt

SEQ ID NO: 13852 - DNA, 201 bp, Homo sapiens
tgtgcctggcctgaagtcacattcataagacaaggttagaatcatgaaggtgctggaactttgctaaagaacagtcgtgggttgaagaatgacctgccatyccttagcttccttttctatatgtgctccagagtcacgtaaccaggggtcgcatgatttataacttccccagctacttctataaataatatcactgtcgtg

SEQ ID NO: 13853 - DNA, 201 bp, Homo sapiens
tacaggcgtgagccaccgcgcccggctaggaatttattttctaacacttctggaagctagaagtccaagatcaaggtgttggcagggttggtttctcctgragcctcttgcagaggccctaatctctccttataaaaccaatcaggctgggcgcggtggctcacgcctgtaatcccagccctttgggaagacgaggcgggc

SEQ ID NO: 13854 - DNA, 201 bp, Homo sapiens
acattcctcctgcttctactcttttgcagaccagttaaggaatctgaccctgaaaggtaagcatcctacttcatcatgaatccctgatgataatggggacygcacacttgcttgaggccagccattgtcctaggaacattacatgtatgattcatttggtgcccatttgaattctttatctggtatttcaaagatttcatc

SEQ ID NO: 13855 - DNA, 201 bp, Homo sapiens
tggagtgcagtgacgcgatctcggctcactgcaagctccgcctccggggttcaagcgattctcctgcctcaacctcccgagtagctgggattacaggcgcmcaccaccacacccggctaatttttgtatttttagtagagatggggtttcaccatgttggccaggctggtctcaaactcctgaactcgtgatccaccccac

SEQ ID NO: 13856 - DNA, 201 bp, Homo sapiens
aaacattcctcctgcttctactcttttgcagaccagttaaggaatctgaccctgaaaggtaagcatcctacttcatcatgaatccctgatgataatggggmccgcacacttgcttgaggccagccattgtcctaggaacattacatgtatgattcatttggtgcccatttgaattctttatctggtatttcaaagatttca

SEQ ID NO: 13857 - DNA, 201 bp, Homo sapiens
gctggggcggccataaccaagtaccagggattgggtgcaattaaataacaggatttctttttcttttttattttattttattttatttatttatttatttwttttgagacagcatctcgctctgtcgcctaggctggagtgcagtgacgcgatctcggctcactgcaagctccgcctccggggttcaagcgattctcctgc

SEQ ID NO: 13858 - DNA, 201 bp, Homo sapiens
agttggaagagaggtgcaaaattggctctcgagagccattggctgccattggagcccatggctgccatttctattaatgaaatatccctgcaggtcatctrtattttttatattataactagggactttgttgtacagataaacattcctcctgcttctactcttttgcagaccagttaaggaatctgaccctgaaaggta

SEQ ID NO: 13859 - DNA, 201 bp, Homo sapiens
cggattccggagcacaagctccaccgcgcatgcgcacacgccccagacccaggctcaggcaagccgtgggggcagggagggctgtttcatcccgctggggyggccataaccaagtaccagggattgggtgcaattaaataacaggatttctttttcttttttattttattttattttatttatttatttattttttttgag

SEQ ID NO: 13860 - DNA, 201 bp, Homo sapiens
tgttcccaccgtggccaacttcaggctaccaacatgaggtcactgagcacagagttggaagagaggtgcaaaattggctctcgagagccattggctgccaktggagcccatggctgccatttctattaatgaaatatccctgcaggtcatctgtattttttatattataactagggactttgttgtacagataaacattcc

SEQ ID NO: 13861 - DNA, 201 bp, Homo sapiens
aaactttacgtgtctgattcatgtggtgctcctttgggaatggagaggagcatggactctcccaggtgcctgaggccacgcagccaggaggggcaggatcrgagttcaaactgacactctgtgaaaaatgatagtattttgataggaattacactggacttgtagattgcttttggcagtatggtcattttcacaatattg

SEQ ID NO: 13862 - DNA, 201 bp, Homo sapiens
ccacagaagctttggcaccgaggatccccgcagtcttcacccgcggagattccggctgaaggagctgtccagcgactacaccgctaagcgcagggagcccragcctccgcaccggattccggagcacaagctccaccgcgcatgcgcacacgccccagacccaggctcaggcaagccgtgggggcagggagggctgtttca

SEQ ID NO: 13863 - DNA, 201 bp, Homo sapiens
acatttgttgacttgcatatgttaagccatccctgcattcctagtatgaaacccacttgatcacatcatggcaaatttcaagctaccaacatgaggtcacygagcacagagttggaagacgggtacaaaattagctctccagaacccgtatcaacagactccaacccatggctgccatttctattaaagagacgtcgctgc

SEQ ID NO: 13864 - DNA, 201 bp, Homo sapiens
agtagctgggattacaggcacatgccaccatgccgagctaatttttgtatttttagtagagaaggtgtttcaccatgttggccaggctggtctcgaactcstgacttcacatgatccgcctgcctcagcctcccaaagtgctaggattacaggcgtaagccaccacgcctggcctcaatatttctttttctgggtatttga

SEQ ID NO: 13865 - DNA, 201 bp, Homo sapiens
ttacttctccagtgggtctgctaagctttctctctaaaaaacaaaaacaaaattcctgatatgtagtgtttgccaattcctgtggtgtaaatgttcccacygtggccaacttcaggctaccaacatgaggtcactgagcacagagttggaagagaggtgcaaaattggctctcgagagccattggctgccattggagccca

SEQ ID NO: 13866 - DNA, 201 bp, Homo sapiens
ctgtgatatatcacatttgttgacttgcatatgttaagccatccctgcattcctagtatgaaacccacttgatcacatcatggcaaatttcaagctaccarcatgaggtcaccgagcacagagttggaagacgggtacaaaattagctctccagaacccgtatcaacagactccaacccatggctgccatttctattaaag

SEQ ID NO: 13867 - DNA, 201 bp, Homo sapiens
ctttaataccctaagaggcagacgcttttgtcccttccattttgctgagatccaccaagtcgtgggaaggatgcgtgactcacccacactgctggtcagtragtgcagacgcggggatctataggagaactgggtggtggatctctaggggaatagtgtggtggttctgatccaaagcctgtctgcctggatccacatccc

SEQ ID NO: 13868 - DNA, 201 bp, Homo sapiens
ttggatacccttcatttctttctcttgtctgatggctgtggctaggacttccagtactatgttgaatacaagtgataagagtgggcattcttgtcttattscagttctcagggggaatgctttaaacttttccctgttcagtgtaatgttggctgtgggtttgtcatagatggcttttattacattgaagtatgtctcttg

SEQ ID NO: 13869 - DNA, 201 bp, Homo sapiens
agtagttatgaatatttgatgagttaattcattgaaagcttgtaggacagtgcctggtagataacggcactcagtaaacattagcaatcattacctggtcyctcatttaacatttaacccctttaataccctaagaggcagacgcttttgtcccttccattttgctgagatccaccaagtcgtgggaaggatgcgtgactc

SEQ ID NO: 13870 - DNA, 201 bp, Homo sapiens
gacctaggagctttttggatgagtctttagggttttctaggtgtacaatcatatcatcagtgaacactaacagtttgacttcctctttactggtttggatrcccttcatttctttctcttgtctgatggctgtggctaggacttccagtactatgttgaatacaagtgataagagtgggcattcttgtcttattgcagttc

SEQ ID NO: 13871 - DNA, 201 bp, Homo sapiens
tttctgctcctccatccttagcatattaagtcaccctcatgctgaactcctccacaccacgggatggcggctgcatccaatgaagctgcaacttttttttwtttttttgaagtcagggtctctctctgtcactcaagctgccgtgcaaaagcacagtcatagcccaatacaggtcttgaactcctggcctcaagtgatctt

SEQ ID NO: 13872 - DNA, 201 bp, Homo sapiens; identical to SEQ ID NO: 1049

SEQ ID NO: 13873 - DNA, 201 bp, Homo sapiens
tgaaaaatgatagtattttgatgggaattacactggacttgtagattgcttttggcagtatggtcattttcacaatattgattctacccatccatgagcaygggatgtgtttccatttgtttgtgtcatctatgatttctttcagcagtgttttgtagttttccttgtagcagtctttcacctccttggttaggtatattc

SEQ ID NO: 13874 - DNA, 201 bp, Homo sapiens
aagcatggtggttccacagctgggtttggatcttacttctgttatctgcttaccatgagaacatgggcaagagccttcgcctccatgccccagttccatcrtctgtagaatagaccatcacggagcctgtatcctagaaaggcttaaatgagttcatgagtctcaagaccttagaatagttagtctggcaccgacggagtt

SEQ ID NO: 13875 - DNA, 201 bp, Homo sapiens
gggcaacagagcgagactaagtctcaaaaaaaaaaaaaaaaaggattttaggattttttgttctgtgaaaaatgatagtattttgatgggaattacactgracttgtagattgcttttggcagtatggtcattttcacaatattgattctacccatccatgagcatgggatgtgtttccatttgtttgtgtcatctatgat

SEQ ID NO: 13876 - DNA, 201 bp, Homo sapiens
gggtttggatcttacttctgttatctgcttaccatgagaacatgggcaagagccttcgcctccatgccccagttccatcgtctgtagaatagaccatcacrgagcctgtatcctagaaaggcttaaatgagttcatgagtctcaagaccttagaatagttagtctggcaccgacggagttccagagcaattattattcata

SEQ ID NO: 13877 - DNA, 201 bp, Homo sapiens
cctgggcaacagagcgagactaagtctcaaaaaaaaaaaaaaaaaggattttaggattttttgttctgtgaaaaatgatagtattttgatgggaattacaytggacttgtagattgcttttggcagtatggtcattttcacaatattgattctacccatccatgagcatgggatgtgtttccatttgtttgtgtcatctat

SEQ ID NO: 13878 - DNA, 201 bp, Homo sapiens
gggggcaacatgacataaacaggtaaacaaagaagtcaacaggatggccatggagagtaagtgccatggagacgaccgaacgtgcggtgtgctgaggagtraagtgaaagctttttaggaaagggtctgggggtctgggaaggcatcctgagggagagacctttcacctggggctgaatactgagaaggggtggccatgag

SEQ ID NO: 13879 - DNA, 201 bp, Homo sapiens
atttttttgtttttttttgaatttttacttcaatagcttttggggtacaagtggtttctgttacacgatgaattatgtagtagtaaattctgagactgtartccacccatcagtgtatgttttagagtatgttgcattcaatatgtagttttttggttttgttttttgtgacagtctcactctgttgcccaggctggagtg

SEQ ID NO: 13880 - DNA, 201 bp, Homo sapiens
cctctatgtggacttctcctcaccccactaccccactggaatgctggctctccacgccagatggcccccagccccctcctcccctaaccctacctagtgtrgagtcgcaaaacccctttgggctttgacaccaccataacttcacaccctccctgacacccccaccttgctttttccctctaaatcattcaggaaagacag

SEQ ID NO: 13881 - DNA, 201 bp, Homo sapiens
atataccaacttgtccagatatgtgggcatacttttcattgttaggctttaagatcaccaaaaaaagagaataaaaaaggccaggcagtggctcacgcctrtgatcccagccctttgggaggccaaagcaggtggatcacgaggtcaggaggtcaagaccagcctggccaagatggtgaaaccctgtctctattagaaata

SEQ ID NO: 13882 - DNA, 201 bp, Homo sapiens
ttgagaccagcctgaccaacgtggagaaaccccatctctactaaaaatacaaaattagccgggcgtggtggtacatgcctgtaatcccagctacacgggargctgaggcaggagaatcgcttgaacccaggaggtggaggttgcagtgagctgagatcacaccattgcactccagcctgggcaacaagagtgaaacacagt

SEQ ID NO: 13883 - DNA, 201 bp, Homo sapiens
ttattcttgagacagggtttcactctgtcgcccaggctggagtgcagtggtgcaatcacagctcactgcagccttgacctcctgggctcaagcaatcctcycagctcagcctcccaagtagctgggactacaggcacacaccactgggcctgacaaatttttttttttttttttttttttttagagatagggtttcgcttt

SEQ ID NO: 13884 - DNA, 201 bp, Homo sapiens
tacgtgtatgagccactgcatccagcctatcctaacacttcgggtttttgttgttttttgtttgttttgtttattcttgagacagggtttcactctgtcgyccaggctggagtgcagtggtgcaatcacagctcactgcagccttgacctcctgggctcaagcaatcctcccagctcagcctcccaagtagctgggactac

SEQ ID NO: 13885 - DNA, 201 bp, Homo sapiens
tgggaggccacttctgggcttcaaaccttcactgtgaatggagctcacaggttttctaaaaatggacattaaatgaaccagagttggccctaaggatctgrctcactgcaacctccacctcccaggatgaagcacctgcctcagcctcccgagtagtagctgggattacaggcacatgccaccatgccgagctaatttttg

SEQ ID NO: 13886 - DNA, 201 bp, Homo sapiens
gtggcgagatcatggctcactgcagcttcgacctcctgggctcaagcaatcctcttgcctcagccttttgagtaagctggggcaacaggcatgcaccatcrtgcctggctaatttttaattatttttttttttgtagagacagggatcttgctatattgcccaggctggtctcaaactcctgagctcaagcaatcctccaa

SEQ ID NO: 13887 - DNA, 201 bp, Homo sapiens
gagcagccccatgaggaccccgaaaggaaaggtaccatgtgtagtgtgataagtgtcatcaacagtaagtgccaccaaccttctcccccctcttgctcttycccacccctgtgggccagtcctgcaggggacatgaccagatgtcccactggtacagtttggatatttgttcccttccacatctcatgttggaatgtaatc

SEQ ID NO: 13888 - DNA, 201 bp, Homo sapiens
agggtagtatgggaggtttctaggagccactcttggaagcggtgctccccacagatgcccgattgcactgactggaactcggtcacatgaccacataactsgctcacatgaccacacctagctgcaaaggtgctgggaaatgtggtaccctgttgggaggccacttctgggcttcaaaccttcactgtgaatggagctcac

SEQ ID NO: 13889 - DNA, 201 bp, Homo sapiens
aagactccatctcaaaaaaaaaaaaaaaaaaattcaaaacccatcgagttgggatgacgcttagtgctgggcttcaggaagagtaggcaggagggtagtaygggaggtttctaggagccactcttggaagcggtgctccccacagatgcccgattgcactgactggaactcggtcacatgaccacataactcgctcacatg

SEQ ID NO: 13890 - DNA, 201 bp, Homo sapiens
catttgagcctgggggtttgagactgcagtgagccaagatcatgccactgcactctagtctgggcaacagagcaagacctgtctcaaaaaaaaaaaaaaawatatatatatatatatatatagactctatgtgacacaccagctcccttgccttctgccatgagtagaagctttttgcaccatgcttcttgtacagcctgc

SEQ ID NO: 13891 - DNA, 201 bp, Homo sapiens
cgggcagatcacttgaggtcaagagttcaagaccagacgggccaacatggtgaaaccccgtctctacttaaaaaatacaaaaattagcagggcgtggtggygcatgcctgtaatcccagctagtcgggaggctgaagcaggagaatcacttgaatctgggaggcagaggttgcagtgagccgagatcacaccactgcactc

SEQ ID NO: 13892 - DNA, 201 bp, Homo sapiens
tcccaggttcaagttattcccctgcctcagcctcccaagtagctgggactataggtgcataccaccaggcctggctaatttttgtattttttagtagagawagggtttcaccatgttagccaggctgactttaaactcctgacttcaattgatccgcccacctcagtctcccaaagtgttagcattacaggcgtgagccac

SEQ ID NO: 13893 - DNA, 201 bp, Homo sapiens
gcaacctcccaggttcaagttattcccctgcctcagcctcccaagtagctgggactataggtgcataccaccaggcctggctaatttttgtattttttagkagagatagggtttcaccatgttagccaggctgactttaaactcctgacttcaattgatccgcccacctcagtctcccaaagtgttagcattacaggcgtg

SEQ ID NO: 13894 - DNA, 201 bp, Homo sapiens
cacgatgggagaaaggcctcatcagagtcaaatgttttttgcagccagcatttattaaaggtttacatgtgacagcaacaaactgtgctgatctcacaggrctgtttgagaattaaatgatgaaacacatgcaaatcgtcccaacctgagctatcaagtagagctatgtaacatgagccacatctattctatcattttaaa

SEQ ID NO: 13895 - DNA, 201 bp, Homo sapiens
ctgctcactgcaacctcccaggttcaagttattcccctgcctcagcctcccaagtagctgggactataggtgcataccaccaggcctggctaatttttgtwttttttagtagagatagggtttcaccatgttagccaggctgactttaaactcctgacttcaattgatccgcccacctcagtctcccaaagtgttagcatt

SEQ ID NO: 13896 - DNA, 201 bp, Homo sapiens
ggccattgcactccagcctgggcaacagagcgagactaagtctcaaaaaaaaaaaaaaaaaggattttaggattttttgttctgtgaaaaatgatagtatyttgatgggaattacactggacttgtagattgcttttggcagtatggtcattttcacaatattgattctacccatccatgagcatgggatgtgtttccatt

SEQ ID NO: 13897 - DNA, 201 bp, Homo sapiens
agagcttgggagtgggaaaggtcctgcagagtcacaccggacccctctattcctccaaggctcatctaacatgttgagtgacatggcgtgggggtttagcygtactgcacattgcagaactccagggggcgctattgagataggaaccccatgatttcttctggaatctttccgagactgctgtggttaaaaaggcaggcc

SEQ ID NO: 13898 - DNA, 201 bp, Homo sapiens
tgggcaacaagagtgaaacacagtctcaaaaaaaaaaaaagaaaaaagaaaaagaaaaagaaaaaaaagaaatgaaacaaacaaaaaaaaaaaaaaaaagraaagaaaatcaacaacaacaacaaaattctctgtgacccaatttctcctttgtaaaatggatacaatagtgcatagccccaatcttgtatatttatatca

SEQ ID NO: 13899 - DNA, 201 bp, Homo sapiens
ttgagatggagtctcactctgtctcccaggctggagtgcagttgtgtgatctctgctcactgcaacctcccaggttcaagttattcccctgcctcagcctsccaagtagctgggactataggtgcataccaccaggcctggctaatttttgtattttttagtagagatagggtttcaccatgttagccaggctgactttaa

SEQ ID NO: 13900 - DNA, 201 bp, Homo sapiens
tttttttttgagatggagtctcactctgtctcccaggctggagtgcagttgtgtgatctctgctcactgcaacctcccaggttcaagttattcccctgcckcagcctcccaagtagctgggactataggtgcataccaccaggcctggctaatttttgtattttttagtagagatagggtttcaccatgttagccaggctg

SEQ ID NO: 13901 - DNA, 201 bp, Homo sapiens
tacatgtggcttgccagttatcccagcaccatttgttgaataaggtgtcctttcccccactttatgtttttgtttgctttgtcgaagatcacttggctatragtatttggctttatttctgggctctctattctgttccattgttctacatgcctaattttataccagtaccgtgctgttttggtaactataggcttgtag

SEQ ID NO: 13902 - DNA, 201 bp, Homo sapiens
gtgacttaaacgacagacatttattttctcacagttctcaaggctggaagtccaaaatcaagttgtctgtggggtgagttctttctgaggactctctctgygatttgcagacagccaccttctcatatcctcgtatggtctttgctccatgtgtgtctctgttctaatcccctcttcttagaagagcactagtcattctat

SEQ ID NO: 13903 - DNA, 201 bp, Homo sapiens
tttttttttttttttttgagatggagtctcactctgtctcccaggctggagtgcagttgtgtgatctctgctcactgcaacctcccaggttcaagttattsccctgcctcagcctcccaagtagctgggactataggtgcataccaccaggcctggctaatttttgtattttttagtagagatagggtttcaccatgttag

SEQ ID NO: 13904 - DNA, 201 bp, Homo sapiens
atgcccagctaatttttgtatttttagtagagacggagtttccccgtgttggccaggctggtctcaaacttctgacctcaggtgatctgcctgccctggcytcccaaagtgctggaattacaggtgtaagccaccatgtccggcccattttaaattttctagtagcctcttcaagaaggtaaaaagaaacagtgaaatgat

SEQ ID NO: 13905 - DNA, 201 bp, Homo sapiens
atgggtgtgtctttttttttttttttttttttttttttgagatggagtctcactctgtctcccaggctggagtgcagttgtgtgatctctgctcactgcarcctcccaggttcaagttattcccctgcctcagcctcccaagtagctgggactataggtgcataccaccaggcctggctaatttttgtattttttagtaga

SEQ ID NO: 13906 - DNA, 201 bp, Homo sapiens
ctggatcagggtaggggaagcacggaatgaaatgtgattggagagatggacagagatcagaacttgtgaattctggcaggtatcatgacattcgatgtagrccaaagagttacctcctagcccagctcctgatacatgcttaataagcgtagtgttggataaataaacgtttacgtggtaaaagtagatcacaagagctcc

SEQ ID NO: 13907 - DNA, 201 bp, Homo sapiens
tggggttttttggataccagccatcctaatgggtgtgtctttttttttttttttttttttttttttgagatggagtctcactctgtctcccaggctggagygcagttgtgtgatctctgctcactgcaacctcccaggttcaagttattcccctgcctcagcctcccaagtagctgggactataggtgcataccaccaggc

SEQ ID NO: 13908 - DNA, 201 bp, Homo sapiens
ctttcaccttttggctgttgtgaaggaacctgccatgcacatgggtctatgaatatctctttgagaccctgctttcaattcttttgggtatatactcagargtagaattgctggatcatgtatgtggtaattctacttttaaaattttgaggccaggtgtggtggctaatgcctgtaatcccagcactttgggaggccgag

SEQ ID NO: 13909 - DNA, 201 bp, Homo sapiens
gttggaagacgggtacaaaattagctctccagaacccgtatcaacagactccaacccatggctgccatttctattaaagagacgtcgctgcaggtaatctrtattttctataactagtgactttacagttaaacattccccctgcctctgctcttttgcagcccgattactgaggctgcaagaaagttcacaaggggaaca

SEQ ID NO: 13910 - DNA, 201 bp, Homo sapiens
tggcgcgatcttggctcattgcaacctctacttcccaggttcaagtgattctcctgcctcagcctcccagttagctgggattacagacgcgtgccaccatrcccagctaatttttgtatttttagtagagacggagtttccccgtgttggccaggctggtctcaaacttctgacctcaggtgatctgcctgccctggcttc

SEQ ID NO: 13911 - DNA, 201 bp, Homo sapiens
attacactggacttgtagattgcttttggcagtatggtcattttcacaatattgattctacccatccatgagcatgggatgtgtttccatttgtttgtgtyatctatgatttctttcagcagtgttttgtagttttccttgtagcagtctttcacctccttggttaggtatattcctgagtattttattttatttttttgc

SEQ ID NO: 13912 - DNA, 201 bp, Homo sapiens
gggattacaggcatgcaccaccatgcctggctaattttgtatttttttagtacagacagggtttctccatgttgctcagactggtctcgaactcctgacckaaggtgatccacctgcctcggcctcccaaagtgccgggattacaggcatgacccaccactcctggccccaatgtgtagttttttatccccacctccctac

SEQ ID NO: 13913 - DNA, 201 bp, Homo sapiens
ccctggggagcagaggttgcagtgagcccagatcacaccactgcactccagcttcgatgacagagcgagaccctgtctcaaaaaaaaaaaaaaaaaaaaargtcacatactcacaggctccagggattaggatagggacatcattaggagacattattcaacctgccacaaagacacagacacaaccagatgacagaagcc

SEQ ID NO: 13914 - DNA, 201 bp, Homo sapiens
gatcagagtaccagtagggttggattctggggaaccctcttctgggttgcagagagccaacttcttgccacatggcgggctttaatgttgttttttgacaycagcattcaccatatgctggttatagacaagtctggaaggagaatctatctccaacctgcaaatggctaactaatgttgtgggatggtaggctggtgatt

SEQ ID NO: 13915 - DNA, 201 bp, Homo sapiens
caaaagatgggccaggtgtggtggctcacgcctgtaatcccagaactttgggaggctgaggcaggaagatcgcttgagtctaggagtttgagacccaggckgggcaacatagcaagaccccatctctacaaaaagtgaaaaaattagccaggcgtggtggtgcatgcctatggtcccagctactcaggaagttgaggcagg

SEQ ID NO: 13916 - DNA, 201 bp, Homo sapiens
accttggctgtctcggcttctttccctaggctcactcagtaacttgatggattttgtgaagaaaacaggcatttgcgcttcaaagtgggaatgggggaccmctcacaacttcctgtacaaacacggtgagaagaccctcttcccaccgccctggtctgtccttgcgtgtgaatgggctggagtaggggaagggggtgggcc

SEQ ID NO: 13917 - DNA, 201 bp, Homo sapiens
ggagtgcaatggtacaatcatagctcactgcagccttgaactcctgggctcaagcaatcctcccatctctgcctttggagcagctgggactacaggtgtgygccaccatgcacggctaatttttttattttttgtaaagacagcctctccgtatgttgctcagctggtctcaaactcctgggctcaagcaatcctcccacc

SEQ ID NO: 13918 - DNA, 201 bp, Homo sapiens
tcggtgggattattcgttttcttcttgctgatttctttgagttccttataggttctgtataatcgtcttttgtggatgcctagtttgcaaatatttgctcrcattcagtgggttgtgtgtttactctgataattacttcctttgctgtacagaagctttttaatttactcaggtcccatatatttgtttatttttgagacg

SEQ ID NO: 13919 - DNA, 201 bp, Homo sapiens
aaaagaaaaagaaatgtaatccccagtgttggaggtggggcctggtgggaggtgattggatcatgggggcggatccctcatgaatggcttagcgtcatccycttggtgattagtaagtgcttgctctgagttcatgtgagatacggttgtttagaagtgtgtggcaccttccccctcgctctcttgctcctgctctcggca

SEQ ID NO: 13920 - DNA, 201 bp, Homo sapiens
ggatcatgggggcggatccctcatgaatggcttagcgtcatcctcttggtgattagtaagtgcttgctctgagttcatgtgagatacggttgtttagaagygtgtggcaccttccccctcgctctcttgctcctgctctcggcaagtgatgtgcctgctccccattcactttccatcatgattggaagcttcctgaggccc

SEQ ID NO: 13921 - DNA, 201 bp, Homo sapiens
tcatgaatggcttagcgtcatcctcttggtgattagtaagtgcttgctctgagttcatgtgagatacggttgtttagaagtgtgtggcaccttccccctcrctctcttgctcctgctctcggcaagtgatgtgcctgctccccattcactttccatcatgattggaagcttcctgaggccccaccagaagcagatgccagc

SEQ ID NO: 13922 - DNA, 201 bp, Homo sapiens
gtcatcaggctggagttcagtggcacgatctcggctcacttcagcctctgcctcccaggttcaagcgattctcctgcctcagcctccccagtagctgggaytacaggcatgcgccaccaccacgcccagctaatttttgtatttttagtagagacagggtttcaccatgttggccaggatggtctcgatctcttgatatgg

SEQ ID NO: 13923 - DNA, 201 bp, Homo sapiens
gtggcgcgatcttggctcattgcaacctctacttcccaggttcaagtgattctcctgcctcagcctcccagttagctgggattacagacgcgtgccaccaygcccagctaatttttgtatttttagtagagacggagtttccccgtgttggccaggctggtctcaaacttctgacctcaggtgatctgcctgccctggctt

SEQ ID NO: 13924 - DNA, 201 bp, Homo sapiens
cagagcaggaggtaaggctaggcagagcagcagaggctcgagtgtgagataggcagggcagaggcatgaatgttgagcctggctggcctgatttgttttcmtttctgtgctcaaagtttgatctggagctgggttctgagctggatgtggaggatgaggttcctggaggcgacagcatgaagagcagagctgcagagcttg

SEQ ID NO: 13925 - DNA, 201 bp, Homo sapiens
ggcatgaatgttgagcctggctggcctgatttgttttcatttctgtgctcaaagtttgatctggagctgggttctgagctggatgtggaggatgaggttcmtggaggcgacagcatgaagagcagagctgcagagcttgggagtgggaaaggtcctgcagagtcacaccggacccctctattcctccaaggctcatctaac

SEQ ID NO: 13926 - DNA, 201 bp, Homo sapiens
tcagattgctttctgacacataaatgggattatttttttcctcctgacaccaaatgtgtgtggttttttccaacgctgcttctcgagctctctggtactarctgggtgtcctacaattctgagcaattctgacgctggctacctggagttcacatcagattccacaggtgaaaggggctcagtcccaaaaaactgctccca

SEQ ID NO: 13927 - DNA, 201 bp, Homo sapiens
ggtggccccagagatcccagaatcgccccctctgtgcccagtgtccagggcccaactcagccagggagagctggaccgaaggatatgaacttctatgggayagaaatagaaggatatgaacttctatgggacaggcattgcccctgcctaagggagatcctaggtctcctccttctcctcctcctcctttctttttctttt

SEQ ID NO: 13928 - DNA, 201 bp, Homo sapiens
gtgatctcccctcctcagcctcccaaagtgttgggattacaggcgtgagccactgcacccagcccacaagtgtctttttcatataatggctgcctttcctytgggtagatacccagtagtgggattgctggatcgaacggtagatctacttttagttctctgaggactctccatactgttttccatagaggttgtactaat

SEQ ID NO: 13929 - DNA, 201 bp, Homo sapiens
gctttcaccttttggctgttgtgaaggaacctgccatgcacatgggtctatgaatatctctttgagaccctgctttcaattcttttgggtatatactcagwggtagaattgctggatcatgtatgtggtaattctacttttaaaattttgaggccaggtgtggtggctaatgcctgtaatcccagcactttgggaggccga

SEQ ID NO: 13930 - DNA, 201 bp, Homo sapiens
acccacctcaccctcccaaagtgctgggattacaggtgtgagccaccgcgtctggccccaaaattaaccattttgaaaagtgaataattgactggcattcratgcattcacagtgttgtacaaccatcacctctatctagtttcagaatattttcctcaccccaaaaggaaaccatgtacccgtgggctggtggctacctg

SEQ ID NO: 13931 - DNA, 201 bp, Homo sapiens
tctgattacctcccaccaggtctctccctcaacatctggggattacaactcgagagatttgggtggggacataaagcttaaccatatcagaccctaagccrggaccaagtttgtcttactctagaaccaatgagaagaccagtgaggctggagcctcctgaatgaggctgagagagagggctagagaggtaggcagggtcc

SEQ ID NO: 13932 - DNA, 201 bp, Homo sapiens
cccaacacttatcaaaccatcagatctcgtgagaactcactcgctatcacgagtacagcatggggggatctgcccccatgatctgattacctcccaccagstctctccctcaacatctggggattacaactcgagagatttgggtggggacataaagcttaaccatatcagaccctaagccaggaccaagtttgtcttact

SEQ ID NO: 13933 - DNA, 201 bp, Homo sapiens
aagaaagaaccttcttcaagtggtagcaggagagagaagagcaagccaaagaagagctgcccaacacttatcaaaccatcagatctcgtgagaactcactygctatcacgagtacagcatggggggatctgcccccatgatctgattacctcccaccaggtctctccctcaacatctggggattacaactcgagagatttg

SEQ ID NO: 13934 - DNA, 201 bp, Homo sapiens
agatcccctttccccaagtagaagaggctgagctggatttgtggtccaaggcccccgccagctgctacatcctgaaaggagaaactggaccagtggtgatrcattttcccctgttcaacatagatgcctgtggaggtaggtgcaggggaggagcaggtgagaagccacctgtattagtccatgctcacactgctaataaaa

SEQ ID NO: 13935 - DNA, 201 bp, Homo sapiens
catggcagaaggtgaaagggaagaaagaaccttcttcaagtggtagcaggagagagaagagcaagccaaagaagagctgcccaacacttatcaaaccatcrgatctcgtgagaactcactcgctatcacgagtacagcatggggggatctgcccccatgatctgattacctcccaccaggtctctccctcaacatctgggg

SEQ ID NO: 13936 - DNA, 201 bp, Homo sapiens
aagggggggggatttaaagacagagacaggcatgtatacagagaggaaaccatgtgaacatggaagcagggattggggtgaggctctactgaccaagggcygccaaactattgccagcaaaccaccagtcatccgaaagaagaccttgatagcagaaggatcctgttcagaattctgtgttgcattcagtcgtagcttttt

SEQ ID NO: 13937 - DNA, 201 bp, Homo sapiens
ggtttaattgactcacagtttcacatggctggggaggcctcaggaaacttacaatcatggcagaaggtgaaagggaagaaagaaccttcttcaagtggtakcaggagagagaagagcaagccaaagaagagctgcccaacacttatcaaaccatcagatctcgtgagaactcactcgctatcacgagtacagcatgggggg

SEQ ID NO: 13938 - DNA, 201 bp, Homo sapiens
agcaaaccagcatggcacatgtatacctatgtaataaacctgcatgttcagcacatgtatcccagatttgaaataaaattcttttaaaaaagggggggggwtttaaagacagagacaggcatgtatacagagaggaaaccatgtgaacatggaagcagggattggggtgaggctctactgaccaagggctgccaaactatt

SEQ ID NO: 13939 - DNA, 201 bp, Homo sapiens
ttgttctgtggattaaattaatacttgttaatacatgtgaagtgcttagcacagtatctgccacttactgtggggtttataaacattttcctcccctcccytcccctcccctcatggcctcctttcgagactgggtcttatggtgtgatcatagctcactgcagcctcaacctcctgggctcaagcgatcctcccacctca

SEQ ID NO: 13940 - DNA, 201 bp, Homo sapiens
catgcagatatcttagaggaaaagcatcatggacagagggaagagcaaatgcagagaccctgtattagtccgttttcatactactataaagatactacccragactgggtaatttgtagacaaaggaggtttaattgactcacagtttcacatggctggggaggcctcaggaaacttacaatcatggcagaaggtgaaagg

SEQ ID NO: 13941 - DNA, 201 bp, Homo sapiens
tgacctcctgaggctgtgtcacggttgtgcatccttaaccttggcaaaataaactttctacactgaccgagacctgtctcagaaacattgggttaacaacrctctcacatattgctgctgagaaggcagcttcatttggaacttcacgccaaaaaccccattttaccttaattacctctttaaagaccctgtctccaaata

SEQ ID NO: 13942 - DNA, 201 bp, Homo sapiens
attttaaatgcaggggattcagtcatgagcaggacagtgaaggctcattccctaatgaagtttgcactccagggaaggagatgatgaatgaacacacacamaaataagtatgtattataatgtcagatcatagtaaatgctatcttgaaaaataattcatggtaagggactggagagtgactacagtattatttttaattg

SEQ ID NO: 13943 - DNA, 201 bp, Homo sapiens
ctgagtcttcagtgtctctcaaaggtctccttaatgcggcagatacctgatatcctatcaaacaatccaggagagggagcttaatagaggggctcaagtcyagggctgtggcttccaataagcagattcagaatgtgtttgggattacatggtgctttgggaggctgacctgggaggatcccttgagactgggagtttgag

SEQ ID NO: 13944 - DNA, 201 bp, Homo sapiens
gttcgagttcacccctcaccacgctggcttctctgcactgggggcctttgtttccataacccacttcggaagcaaattcaagaagggaagactggtcagawctcaccctgagagagacctgactttcctgagaggtcagcgctggggtcagaggggattaaaagggggtgggaagtggaggagaggcaagaattttccttc

SEQ ID NO: 13945 - DNA, 201 bp, Homo sapiens
tgctctgagttcatgtgagatacggttgtttagaagtgtgtggcaccttccccctcgctctcttgctcctgctctcggcaagtgatgtgcctgctccccaytcactttccatcatgattggaagcttcctgaggccccaccagaagcagatgccagcaccacgcttcctgtacagcatccagaactgtgagacaattaaac

SEQ ID NO: 13946 - DNA, 201 bp, Homo sapiens
tttgtatttttagtagagatggggtttcaccatgttggccaggctggtcttgaacgcctgacctcgagtgatctcccctcctcagcctcccaaagtgttgrgattacaggcgtgagccactgcacccagcccacaagtgtctttttcatataatggctgcctttcctttgggtagatacccagtagtgggattgctggatc

SEQ ID NO: 13947 - DNA, 201 bp, Homo sapiens
gataatggcttccagctccatccctgtccctgcaaaggacatgatcttgttcctttttctggctgcatagtattccatggtgtatatgtgccacattttcyttatccagtctaccattgatgggtatatttggttgattccatgtctttgctattgtgaatagtgctgcaatgagcatacgcatgcatgaggcagaatttg

SEQ ID NO: 13948 - DNA, 201 bp, Homo sapiens
tgggtaatggagagagatggaatgtgccacacgaagcctcactatgactttctataatgcctggctcctgtgctgaaatgagaacatgcatcctagccggscatggtggtgcgtgcacctgtagtcccagctattcggggaggctgaggtgggaggattccttaagcccaggagttggaggctgcagtgagctatgaatgc

SEQ ID NO: 13949 - DNA, 201 bp, Homo sapiens
gaggttgcagtgagctgagatcgcgctcctgcactccagcctggggacagagcaagactccttctcaaataaataaataaatacataccatcaggtctcgygagaactcaactcactgtcacgagaacagcatgagggtaaccacttccatgcttcaattacctcccacgacacttggggattatgggaactacaattcaa

SEQ ID NO: 13950 - DNA, 201 bp, Homo sapiens
gaggattccttaagcccaggagttggaggctgcagtgagctatgaatgcaccactgcactcagagtgagacccccatcccttaaaaagttttcttttaaaraacgtacttttttttgttttgttttttgtttttgtttgtttgtttgagatggagtctcgctctgtcacccaagctggagtgcggtggtgcaatcttggct

SEQ ID NO: 13951 - DNA, 201 bp, Homo sapiens
acttactataagatatacttgagcccaggtattcaagactagcctggaaaacactgtgagacctcatcttttttaaacaaaattaataaatagataaaacrtttaaaaaagccaggtgtgatggctcacgcctgtagtcccagctactcaggaggctgaggcgggagggtcgcttgaggccaggagttcaagaccagcaag

SEQ ID NO: 13952 - DNA, 201 bp, Homo sapiens
gttcaagaccagcaagcctgggcaacgtagtgagacctcctctctaaaataaataaataaaaatataagatagaatggccgggtgtggtggctcatggctktaatcccagcactttgagaggccaaggtgggcggatcgcttgaggtcaggagcttgagaccagcctggccaacatggcaaactctgtctctactaaaaat

SEQ ID NO: 13953 - DNA, 201 bp, Homo sapiens
acgtagtgagacctcctctctaaaataaataaataaaaatataagatagaatggccgggtgtggtggctcatggctttaatcccagcactttgagaggccraggtgggcggatcgcttgaggtcaggagcttgagaccagcctggccaacatggcaaactctgtctctactaaaaatgcaaaaatacaaaattcgccgggc

SEQ ID NO: 13954 - DNA, 201 bp, Homo sapiens
taattgccttacagtgcaaacctccaccccagacaatgcctgcatataaatgcccccgccccactcagctcatgttccaacactgcacaccaagctgcccrtctgtggatttatccccaccatctccagccccaacaccctgggtcatgctgcccctctatgtggacttctcctcaccccactaccccactggaatgctgg

SEQ ID NO: 13955 - DNA, 201 bp, Homo sapiens
acctgtattagtccatgctcacactgctaataaaaacatacctgagactgggtaatttacaaaggaagaaggtttaattgactcacagttcagcatggatkgagaggcctcaggaaacttacagtcatggtggaaagcgaaggccaagcaagtcaccttcttcacaaggcggcaggaaggagaagtgagtgccagcagggc

SEQ ID NO: 13956 - DNA, 201 bp, Homo sapiens
gtccaagctgacccttgctctgttgtgtgtctgggctgttagctgaggtcccgttgggtctccaggccccaggggtcttctggaggggtcttctggagaggtcttgcaaccatttcttattgcctccttctcagaccatccgggctaccactgactactgccgccgccacaagatcccctttccccaagtagaagaggctg

SEQ ID NO: 13957 - DNA, 201 bp, Homo sapiens
tgatccgcccacctcagtctcccaaagtgttagcattacaggcgtgagccaccgtgcctggctgattattcattttttatgtctccctgtatcatatacaratgtgtttggctaaaagtcactaaccaaccacagtgccccgaggacatgtgggattaattttcttacaaaagaaaaagacagactgagcaccgtgactca

SEQ ID NO: 13958 - DNA, 201 bp, Homo sapiens
agaagaaaaggcggccgtggagagacgaagacttcatgtgctgaaagctctgaagaagctaaggattgaggctgatgaggtaagtgaggggaggagggtgsccccagagatcccagaatcgccccctctgtgcccagtgtccagggcccaactcagccagggagagctggaccgaaggatatgaacttctatgggatagaa

SEQ ID NO: 13959 - DNA, 201 bp, Homo sapiens
gtattttttagtagagatagggtttcaccatgttagccaggctgactttaaactcctgacttcaattgatccgcccacctcagtctcccaaagtgttagcrttacaggcgtgagccaccgtgcctggctgattattcattttttatgtctccctgtatcatatacaaatgtgtttggctaaaagtcactaaccaaccacag

SEQ ID NO: 13960 - DNA, 201 bp, Homo sapiens
agcctcccaagtagctgggactataggtgcataccaccaggcctggctaatttttgtattttttagtagagatagggtttcaccatgttagccaggctgaytttaaactcctgacttcaattgatccgcccacctcagtctcccaaagtgttagcattacaggcgtgagccaccgtgcctggctgattattcattttttat

SEQ ID NO: 13961 - DNA, 201 bp, Homo sapiens
acttattgttttctggggttttttggataccagccatcctaatgggtgtgtctttttttttttttttttttttttttttgagatggagtctcactctgtckcccaggctggagtgcagttgtgtgatctctgctcactgcaacctcccaggttcaagttattcccctgcctcagcctcccaagtagctgggactataggtg

SEQ ID NO: 13962 - DNA, 201 bp, Homo sapiens
ccccgcagtcttcacccgcggagattccggctgaaggagctgtccagcgactacaccgctaagcgcagggagcccaagcctccgcaccggattccggagcmcaagctccaccgcgcatgcgcacacgccccagacccaggctcaggcaagccgtgggggcagggagggctgtttcatcccgctggggcggccataaccaag

SEQ ID NO: 13963 - DNA, 201 bp, Homo sapiens
ggctatctcaaaaaaaaaaaaaattttttttttgaggaacgaccataccattttccacagtggctgtaccattttatattctgcccaatggtgtcccaggkttccaatttctccacgtcctcatcaacacttattgttttctggggttttttggataccagccatcctaatgggtgtgtcttttttttttttttttttttt

SEQ ID NO: 13964 - DNA, 201 bp, Homo sapiens
ggaagttatgagctgccaccagcagcgtagactcaggtctgaggatgagatccccagtggtttctgataccacacagtccatctctaacattctcctgtcrtggttgtaattcctcattaatagatttctttttcctgcatacccgctacattcctggttctgtgctgggactcacttgccgttgtatttcctctgcagag

SEQ ID NO: 13965 - DNA, 201 bp, Homo sapiens
tttttttttttttttgagatggagttttgctctttttgcccaggctggagtgcaatggcgcgatctcagctcaccgcaacctcggcctcctgggtttaagygattctcctgcctcccgagtagctgggattacaggcatgcgccaccacgcccggctaattttgtatttttagtagagacagggtttctccatgttggtca

SEQ ID NO: 13966 - DNA, 201 bp, Homo sapiens
cacttcggttgatgcctcaaaactaaagtatatcaggattactgtggttgcaagtgacagaaattgactctgattcgtttatgcaacaaataaagtgataygatttactagaaagatacacagacatccagggcaagaagaacaatgaggacttatgatggaataaggcagaaatagggaaagtgtcagacccaagacaac

SEQ ID NO: 13967 - DNA, 201 bp, Homo sapiens
gagcaaggggtctcagggtgtggggttaccaaagatgctgaccagcaccaccttttaagtccttcaggattttcaagtcatcaaaatctgggcacttcggytgatgcctcaaaactaaagtatatcaggattactgtggttgcaagtgacagaaattgactctgattcgtttatgcaacaaataaagtgatatgatttact

SEQ ID NO: 13968 - DNA, 201 bp, Homo sapiens
ctctcgaggctgacctgaaacatcgatttacccgacaggagtgggacttggctaagagcctacagaaaaccatccaagcagcgaggtctgagaattactcyctgaccgacttctgggcctacatggttatctctaagcaaaccagagaagtaagtcattcccagctggggacctggggtgggggtaggagcaaggggtctc

SEQ ID NO: 13969 - DNA, 201 bp, Homo sapiens
ttcctctgtgtgtcgccctctccatgaggcaggtgttcctgtgaaggacctccttgcacacatctttccccagtcttcatcgtccacacttaaaatgcccmactcactctcttcctctgtcctccagggcaatatcttctctctacaccaatgatggtgacatggaagctctcgaggctgacctgaaacatcgatttaccc

SEQ ID NO: 13970 - DNA, 201 bp, Homo sapiens
acccgggaggcggaggttgcagtgagctgagatcacgccattgcactccagcctgggcaacaagagtgaaactctgtctcaaaaaaaaagaagaagtatgkagtcctcaggccacatttagttttctttaacatgttaaatattaaagggctatcaaagcaatgtaggtgtgatttgcttttctgctgctaaactcttgta

SEQ ID NO: 13971 - DNA, 201 bp, Homo sapiens
aggcctttctcccatcgtgctctcattttcctgcctgtgaaatggaaggattgtcccagatgattttgagtcctccttcgaacttgatcgttctgcagttktatttatttaatggaaattttccgtttcctctgtgtgtcgccctctccatgaggcaggtgttcctgtgaaggacctccttgcacacatctttccccagtc

SEQ ID NO: 13972 - DNA, 201 bp, Homo sapiens
ggcgtgtgccaccatgcctggctaatttttgtgtttttagtagagacagggtttcctgagtatccggcactagaggtacccaccaccacgcatgccatcaygcctggctaatttttctgtatttttagtggagacggggtttcaccatgttggccaggctggtctcgaactcctgacctcaggcaatcctcccgcctcgtc

SEQ ID NO: 13973 - DNA, 201 bp, Homo sapiens
acaggcgtgtgccaccatgcctggctaatttttgtgtttttagtagagacagggtttcctgagtatccggcactagaggtacccaccaccacgcatgccaycatgcctggctaatttttctgtatttttagtggagacggggtttcaccatgttggccaggctggtctcgaactcctgacctcaggcaatcctcccgcctc

SEQ ID NO: 13974 - DNA, 201 bp, Homo sapiens
gagtcatgctctgtcgcccaggctggagtgcagtggcacaatctcagctcactgcaacctccgcctcccgggttcaagcgattcctctgcttcagcctccygagcagctgggaccacaggcgtgtgccaccatgcctggctaatttttgtgtttttagtagagacagggtttcctgagtatccggcactagaggtacccac

SEQ ID NO: 13975 - DNA, 201 bp, Homo sapiens
atttcactcttgttgcccaggctggagtgcaatggagcgatctctgctcaccgcaacctccacctcctgggttcaagccattctcctgcctcaacctcccragtagctgggattacaggcatgcaccaccatgcctggctaattttgtatttttttagtacagacagggtttctccatgttgctcagactggtctcgaact

SEQ ID NO: 13976 - DNA, 201 bp, Homo sapiens
gctcaagcaatcctcccacctcagcctcccaaagcgctgggactacagacatgagcaccacatccagcctctaatccccatttataaaatgcactttccarttccactctggggataaaggcgtcacagaacctgactctgcatttccccacccatatcattcaagccagatggggaggcagggacagctctggtccctcc

SEQ ID NO: 13977 - DNA, 201 bp, Homo sapiens
gccttctgccatgagtagaagctttttgcaccatgcttcttgtacagcctgcagaactgtgagctaaataaacctcttttctttataaattaatatatatratatatatttattgagtgaacaaatgaatataaagtcttttttttctttttttttttctttttgagatagagtcttgctctgttgcccaggctggagtgc

SEQ ID NO: 13978 - DNA, 201 bp, Homo sapiens
aatttcactcttgttgcccaggctggagtgcaatggagcgatctctgctcaccgcaacctccacctcctgggttcaagccattctcctgcctcaacctccygagtagctgggattacaggcatgcaccaccatgcctggctaattttgtatttttttagtacagacagggtttctccatgttgctcagactggtctcgaac

SEQ ID NO: 13979 - DNA, 201 bp, Homo sapiens
gtttccatttgtttgtgtcatctatgatttctttcagcagtgttttgtagttttccttgtagcagtctttcacctccttggttaggtatattcctgagtaytttattttatttttttgcagctgttgtaaaaggggttgagttcttgatttgaatctcagcttggtcattgttggtgtatagcagtgctactgatttgtgt

SEQ ID NO: 13980 - DNA, 201 bp, Homo sapiens
acgatcttgggctcactgcaacctccgcctcctgggtttaagcgattctgctgcctcagcctcccgagtagcagggattacaggcatgtgccaccatgccbggctaatttttttgtatttttagtagagacggggtttctccacgttggttaggctggtctcgaactcctgacctcaggtgatctgcccacctcagcctcc

SEQ ID NO: 13981 - DNA, 201 bp, Homo sapiens
gttttgctcttgttgcccaggctggagtgcaatggcacgatcttgggctcactgcaacctccgcctcctgggtttaagcgattctgctgcctcagcctccygagtagcagggattacaggcatgtgccaccatgccgggctaatttttttgtatttttagtagagacggggtttctccacgttggttaggctggtctcgaa

SEQ ID NO: 13982 - DNA, 201 bp, Homo sapiens
ttattttcttacaattctgcaggcaggaagtccaagatcaaggtgccagtggggtcagtttctcctgaggcctctctccatggcttgcagagggatggccrccttctcaccgcatcctctcagcccagcctttcctcagtgcacacgcattcttggtattcttggtgtcttcctttttttcttttttttttttttttagat

SEQ ID NO: 13983 - DNA, 201 bp, Homo sapiens
cgggcgcctgtagtcccagctactcgggaggctgaggcaggagaatggcgtgaacctgggaggcagagtttgcggtgagccaagatcgagccactgcactscagcctgggcgacagagcgagactccgtctcaaaaaaaaaaaaaaaagaaagaaagaaaaagcaagccgggcacagtggctcacgcctgtaatcccagca

SEQ ID NO: 13984 - DNA, 201 bp, Homo sapiens
aatacctaatgcatgcagggcttaatacctaggtgacgggttgattggtgcagcaaaccagcatggcacatgtatacctatgtaataaacctgcatgttcrgcacatgtatcccagatttgaaataaaattcttttaaaaaagggggggggatttaaagacagagacaggcatgtatacagagaggaaaccatgtgaacat

SEQ ID NO: 13985 - DNA, 201 bp, Homo sapiens
ctgtccaagctgacccttgctctgttgtgtgtctgggctgttagctgaggtcccgttgggtctccaggccccaggggtcttctggaggggtcttctggagaggtcttgcaaccatttcttattgcctccttctcagaccatccgggctaccactgactactgccgccgccacaagatcccctttccccaagtagaagaggc

SEQ ID NO: 13986 - DNA, 201 bp, Homo sapiens
atggattttgtgaagaaaacaggcatttgcgcttcaaagtgggaatgggggaccactcacaacttcctgtacaaacacggtgagaagaccctcttcccacygccctggtctgtccttgcgtgtgaatgggctggagtaggggaagggggtgggcctgaaacaatcccaggctggtccttccccagagctttggaggggggt

SEQ ID NO: 13987 - DNA, 201 bp, Homo sapiens
gtccttgcgtgtgaatgggctggagtaggggaagggggtgggcctgaaacaatcccaggctggtccttccccagagctttggaggggggtggtgtcaaagkgcccagggatctgattaggggaactttcgctcagtggtgtggtccatactgaaaaatgtgtggcctcgctgcgagtcccagtcatcgtgaaaagcctcac

SEQ ID NO: 13988 - DNA, 201 bp, Homo sapiens
gctgtgtgtggcctgggaagggaaccctggctggatgtcagtcctgctcacctctcctggggtgcttcctacaaggcacacaggacttcagctgtgtctgmgcaccatgccatgcagctgccgggtcttatggcctcggaatacaccatcaagcatcaagtcactggatcatggcgatgagtgttttagcatcaaatttct

SEQ ID NO: 13989 - DNA, 201 bp, Homo sapiens; identical to SEQ ID NO: 1060

SEQ ID NO: 13990 - DNA, 201 bp, Homo sapiens
agtagagacaggatttcaccatgttggtcaggctggtcttgaactcctgacctcaggtgatccacccaccttggcctcccaaagtgctgggattacaggcrtgagccaccgtgcccggccaaaatagagtaattatgaaaattaatcctttatcacaaatacttgtagcagagcacatctccccatgtttttttgttgttg

SEQ ID NO: 13991 - DNA, 201 bp, Homo sapiens
tgttgttgttttcctatatataacaaaaggaggaggtggttgcatttctcctcttactttccgtaacaccctactctgtggagtaacgattctttcacccytttgctttcttaacagacttgctttcgctttgcactgtggactcaccctgaattctttcttgtatgagatccaagaaccctttcttggggtctggatcgg

SEQ ID NO: 13992 - DNA, 201 bp, Homo sapiens
atctgggaagagagagaagtcagctcctagttggcaacctcacaactgctgtctacactgacaacgatcattttcccatccccctctctgccttccatttmcaagtcttgctttcagtccccagaagcagctgatcctctttcttcctgggcaccacaggtggcatccgggacaagataatgagcagccggaagcacctcc

SEQ ID NO: 13993 - DNA, 201 bp, Homo sapiens
atgagaacatgggcaagagccttcgcctccatgccccagttccatcgtctgtagaatagaccatcacggagcctgtatcctagaaaggcttaaatgagttmatgagtctcaagaccttagaatagttagtctggcaccgacggagttccagagcaattattattcatacaggctttccagaattaaagcaggactgttatg

SEQ ID NO: 13994 - DNA, 201 bp, Homo sapiens
gggaggttcacctcatcctctccttcgacttcagtgccggagatcctttcgaggtaatcgagaagggctttggggccggtcctgggtgggaggtgggctgyggcgaagctgactttgcggaggaactgaggacgcgggctgggaagcgggcaatggggaggtgctggctgggaagtccagagagccaaatcaactcaccca

SEQ ID NO: 13995 - DNA, 201 bp, Homo sapiens
aacgtggagaaaccccatctctactaaaaatacaaaattagccgggcgtggtggtacatgcctgtaatcccagctacacgggaagctgaggcaggagaatygcttgaacccaggaggtggaggttgcagtgagctgagatcacaccattgcactccagcctgggcaacaagagtgaaacacagtctcaaaaaaaaaaaaag

SEQ ID NO: 13996 - DNA, 201 bp, Homo sapiens
ttgtctcaaaacaaacaaacaaacaaacaaacaaacaaaaaactagaatgtgttttgggcaccagcaaagcaaggggcatacaattttttttaaatggggyatttccagaaaaaattacaacaaaaaccaaaaacaaaacagtcatagtgagtaaaatcagaacttgattaaatgtccttgactgtagcttacacactggt

SEQ ID NO: 13997 - DNA, 201 bp, Homo sapiens
atttatgcccacagacaatcctccatgcaatcgtgtggctacactcttcccttgcactccaggattccatggagttgcagccacaatgagatggaagagaraggcagggctgagggttcaagctctggaaaatattggaaacaggctgctgtggaagttatgagctgccaccagcagcgtagactcaggtctgaggatgag

SEQ ID NO: 13998 - DNA, 201 bp, Homo sapiens
ggagtgtaatggcacgatctcggctcactgcaacctctgcctcccaggttcaagtgattctcctgcctcagcctcccaagtagctgggattataggcatgygccaccacgcctggctaatttttgtatttttagtagggatggggtgtcaccatgttaatcaggctggtctcgaactcctgaccttaggtgatccactcac

SEQ ID NO: 13999 - DNA, 201 bp, Homo sapiens
ggtgttgagaccatgagggtggagccctctagatttggattaatcccttataaaagaagcctcagagagctcactccaaggaatgcggtgaaggttgaagkgtagaatttatgcaaaatgccaagatgagcctggcaggtgacgttctcagcaaacgtgagcagagctattatcagtgtgtgtgtgtgagagagagagagt

SEQ ID NO: 14000 - DNA, 201 bp, Homo sapiens
agatttatgcccacagacaatcctccatgcaatcgtgtggctacactcttcccttgcactccaggattccatggagttgcagccacaatgagatggaagaragaggcagggctgagggttcaagctctggaaaatattggaaacaggctgctgtggaagttatgagctgccaccagcagcgtagactcaggtctgaggatg

SEQ ID NO: 14001 - DNA, 201 bp, Homo sapiens
tctcaaaaaaaaaaaaaaaaatatatatatatatatatatagactctatgtgacacaccagctcccttgccttctgccatgagtagaagctttttgcaccrtgcttcttgtacagcctgcagaactgtgagctaaataaacctcttttctttataaattaatatatataatatatatttattgagtgaacaaatgaatata

SEQ ID NO: 14002 - DNA, 201 bp, Homo sapiens
agcagagtcttccctaactcccccggggaaagggagactccctttcctggtctctaggcactgacgcaaccgctagaccaaggtccgctaggcaatgggcrtcttcccagacgctggcgttaccccaagaccaaggggccctctagtggccctattcgggcatgacagagggctcacacttgtcttctggtcactcttgac

SEQ ID NO: 14003 - DNA, 201 bp, Homo sapiens
cagaaaataaatttaaaaatgagcagggcatggtgatgcacctggtgggtagtggtcccagctacttgggaggctgaggtgggaggatcatttgagcctgsgggtttgagactgcagtgagccaagatcatgccactgcactctagtctgggcaacagagcaagacctgtctcaaaaaaaaaaaaaaaaatatatatatat

SEQ ID NO: 14004 - DNA, 201 bp, Homo sapiens
aggcccggggcagtggctcacacctgtaatcccagcacttcaagaggccgaggcaggtggatcacctgaggtcaggagtttgagaccagcctggccaacayggtgaaaccctgtctctactaaaaatacaaaaattagctgggtgtggtggcacgcacctgtaatcccagctacttgggaggctgaggaaggagaatcact

SEQ ID NO: 14005 - DNA, 201 bp, Homo sapiens
ttcctgagtattttattttatttttttgcagctgttgtaaaaggggttgagttcttgatttgaatctcagcttggtcattgttggtgtatagcagtgctaytgtttgtgtacattgattttgtatcctgaaactctactgaattcattcatcagacctaggagctttttggatgagtctttagggttttctaggtgtacaa

SEQ ID NO: 14006 - DNA, 201 bp, Homo sapiens
ccccgtgttggccaggctggtctcaaacttctgacctcaggtgatctgcctgccctggcttcccaaagtgctggaattacaggtgtaagccaccatgtccrgcccattttaaattttctagtagcctcttcaagaaggtaaaaagaaacagtgaaatgatccattttctttaacccaatatatccaaaacattagcatttt

SEQ ID NO: 14007 - DNA, 201 bp, Homo sapiens
gttcatcatttaaccctttgaatgacctgaagaagtggatgctgttgtcccctccattttgctgagagccaccgggtcatggaaaggatgcgtgactcacytatgtaactggttggtgagtgcagacacagggatctataggggaatcgtatggtggttctgatccaaagcctgtctgcctgaatccacatcccagctcca

SEQ ID NO: 14008 - DNA, 201 bp, Homo sapiens
tccccgtgttggccaggctggtctcaaacttctgacctcaggtgatctgcctgccctggcttcccaaagtgctggaattacaggtgtaagccaccatgtcyggcccattttaaattttctagtagcctcttcaagaaggtaaaaagaaacagtgaaatgatccattttctttaacccaatatatccaaaacattagcattt

SEQ ID NO: 14009 - DNA, 201 bp, Homo sapiens
attttcttccctggaatattctaatgactcacattggaatcatgcattagatttatgcccacagacaatcctccatgcaatcgtgtggctacactcttccyttgcactccaggattccatggagttgcagccacaatgagatggaagagagaggcagggctgagggttcaagctctggaaaatattggaaacaggctgctg

SEQ ID NO: 14010 - DNA, 201 bp, Homo sapiens
gaggattgctttagcctgggaggctgaggctgcattgagctacaatcacaccactgcacaccagcctgggtgacagagagaccctgtctcaaaaaaaaaawtttttttttctaaaaaagaaaattccaagggttttaggaactctgcaccaggaagcaggggaaaacaccaagtatctttctttgctacacaaagccatgg

SEQ ID NO: 14011 - DNA, 201 bp, Homo sapiens
aaatgtgtgtggttttttccaacgctgcttctcgagctctctggtactagctgggtgtcctacaattctgagcaattctgacgctggctacctggagttcrcatcagattccacaggtgaaaggggctcagtcccaaaaaactgctcccacttcagacacgagttgcaattacctagccgctggtgcttctgaccgactgg

SEQ ID NO: 14012 - DNA, 201 bp, Homo sapiens
gatccacctgcctcggcctcccaatgtgctgggattacaggcgtgagccacggtgcccggccccaggtacccttcttcttgttcccacctccatcctcagsctctaaacctctgatcgattttctccccaatgcctaggccccagttgttgctgtgctgggctcaggcggaggactgcgggctcacattgcctgccttggg

SEQ ID NO: 14013 - DNA, 201 bp, Homo sapiens
aaggatatgaacttctatgggacaggcattgcccctgcctaagggagatcctaggtctcctccttctcctcctcctcctttctttttcttttcttttcttycttttttttttttttttttttttgagacaacgtctcgctctgtcacccaggctggaatgcagtggcatgatcttggctcactgcaacctccacctcccag

SEQ ID NO: 14014 - DNA, 201 bp, Homo sapiens
agggagagctggaccgaaggatatgaacttctatgggatagaaatagaaggatatgaacttctatgggacaggcattgcccctgcctaagggagatcctakgtctcctccttctcctcctcctcctttctttttcttttcttttctttcttttttttttttttttttttttgagacaacgtctcgctctgtcacccaggct

SEQ ID NO: 14015 - DNA, 201 bp, Homo sapiens
aggaactgaggacgcgggctgggaagcgggcaatggggaggtgctggctgggaagtccagagagccaaatcaactcacccatcgctcccgaagcacccgcrgtcggccacatccaacgaacttctgatccaaagccatcccagaccttcccgggcccctcttcctggcagatgactctccccgcttctgcgtcctgcctgc

SEQ ID NO: 14016 - DNA, 201 bp, Homo sapiens
caccacccaaggctaggattacaggcacaagccgccctgcccagctattttattaaaaaatatatacacctacataatatataactatatctattacatgrtacataccaatacatagtagtatatataaaataatcatggtaaaacatatcatctattatatttatgtgtaatgtaatatatatttatattcacacactt

SEQ ID NO: 14017 - DNA, 201 bp, Homo sapiens
atatttatgtgtaatgtaatatatatttatattcacacacttctatcagtttacattctgtaatatgaattaggaacatccatcctcctccccataccatratccagaaccaacttgtcaccatctttctagacccttggcccaggaatacccaggctttctggtcttaggatttctgctgaaataaatatcccaagacaa

SEQ ID NO: 14018 - DNA, 201 bp, Homo sapiens
gacagagatcagaacttgtgaattctggcaggtatcatgacattcgatgtaggccaaagagttacctcctagcccagctcctgatacatgcttaataagcrtagtgttggataaataaacgtttacgtggtaaaagtagatcacaagagctccacaggaggaggtggtggagctccaggtcttctcaatgaatgaaagaat

SEQ ID NO: 14019 - DNA, 201 bp, Homo sapiens
ccacatgtggcacttgagcacttgaaatgtgcctggcccaagttgaagtgtgctatgaagataaaatacacctcggattttaatgaccgagtatggaaaaygcatgtcaaagaccttattcgtaattggtatattgacatactaggcagggctctccagagggacagaaccaataggatctatgtctagatgaaagggagt

SEQ ID NO: 14020 - DNA, 201 bp, Homo sapiens
tgaagtgtgctatgaagataaaatacacctcggattttaatgaccgagtatggaaaacgcatgtcaaagaccttattcgtaattggtatattgacatactwggcagggctctccagagggacagaaccaataggatctatgtctagatgaaagggagtttcaggatcacaaggtggagtcctacaataggccgtctgcgag

SEQ ID NO: 14021 - DNA, 201 bp, Homo sapiens
caggcatgcgccaccacacccagctaatttttgtatttttagtagagacggggtttcaccatgttggccaggctggtcttgaactcctgaccttgtgatcygcccgcctcggcctcccaaagtgcagggattacaggcgtgagccaccacgcccggccaataaacagaaatttaagcaagacatatctgtaacaatttaac

SEQ ID NO: 14022 - DNA, 201 bp, Homo sapiens
gcccggctaattttttgtaattttagtagagatggggtttcactgtgttagccaggatggtctcgatctcctgacctcgtgatccacccacctcagcctcycaaagtgctgggattataggcatgagccatgagccaccatgcccagcctctttcttgctcttgtcacccaggttggagtgcaatggcgctatctgggctc

SEQ ID NO: 14023 - DNA, 201 bp, Homo sapiens; identical to SEQ ID NO: 1138

SEQ ID NO: 14024 - DNA, 201 bp, Homo sapiens
  misc_feature (1)...(201): n = A,T,C or G, or insertion/deletion polymorphism (see Tables 1-2)
tacagagaacaataatattgggtggtgagcatctgtgtgggggttggggtgggataggggatacggggagagtggagaaaaagggggcacagggttaatgngaagtccaggatccccctctacatttaaagttggtttaagttggctttaattaatagcaactcttaagataatcagaattttcttaaccttttagcctta

SEQ ID NO: 14025 - DNA, 201 bp, Homo sapiens
  misc_feature (1)...(201): n = A,T,C or G, or insertion/deletion polymorphism (see Tables 1-2)
acccgtgagcccatagttaaaactctttagacaacaggttgtttccgtttacagagaacaataatattgggtggtgagcatctgtgtgggggttggggtgngataggggatacggggagagtggagaaaaagggggcacagggttaatgtgaagtccaggatccccctctacatttaaagttggtttaagttggctttaat

SEQ ID NO: 14026 - DNA, 201 bp, Homo sapiens
ggtcacggaagcccagagggcatcttgtggctcgggagtagctctctgctgtcttctcagctctgctgacaatacttgagattttcagatgtcaccaaccrccaagagagcttgatatgactgtatatagtatagtcataaagaacctgaacttgaccatatacttatgtcatgtggaaaatttctcatagcttcagatag

SEQ ID NO: 14027 - DNA, 201 bp, Homo sapiens
taagataaggaaagggtcacagtttggaatgagtttcagacggttataacatcaaagatacaaaacatgattgtgagtgaaagactttaaagggagcaatmgtattttaataactaacaatccttacctctcaaaagaaagatttgcagagagatgagtcttagctgaaatcttgaaatcttatcttctgctaaggagaac

SEQ ID NO: 14028 - DNA, 201 bp, Homo sapiens; identical to SEQ ID NO: 1151

SEQ ID NO: 14029 - DNA, 201 bp, Homo sapiens
cagctcatctggccagaagagctgagacatccgttcccctacaagaaactctccccggtaagtaacctctcagctgcttggcctgttagttagcttctgaratgagtaaaagactttacaggaaacccatagaagacatttggcaaacaccaagtgctcatacaattatcttaaaatataatctttaagataaggaaaggg

SEQ ID NO: 14030 - DNA, 201 bp, Homo sapiens; identical to SEQ ID NO: 1153

SEQ ID NO: 14031 - DNA, 201 bp, Homo sapiens
ttctaacagattctgtgtagtgggatgagcagagaacaaaaacaaaataatccagtgagaaaagcccgtaaataaaccttcagaccagagatctattctcyagcttattttaagctcaacttaaaaagaagaactgttctctgattcttttcgccttcaatacacttaatgatttaactccaccctccttcaaaagaaaca

SEQ ID NO: 14032 - DNA, 201 bp, Homo sapiens
aaatccctatgggggatgtggttcatgggctgggaagtgggttaccctgggaaaggtctacaggacagaggcagggatggagacaacagcatggtgagttmccaacccacccacgatgataggtgtctgaggcagaaggtaaagaggctgtcacctggtgggtgtcataagactcaagtgtcattgttgaggcacatgggt

SEQ ID NO: 14033 - DNA, 201 bp, Homo sapiens
gacagagtggcccttacctctgggtggagcaaaaggcaccttctgaagtgatagggatgttccttatcatcttgatccggagtggtagttacatgcatgtrtgcatatcaaaactcaccaagctgtaccactaagtgtgttcttcctcaataaaaataataaagaactacacttataaagaattttttaataatataggaa

SEQ ID NO: 14034 - DNA, 201 bp, Homo sapiens; identical to SEQ ID NO: 1158

SEQ ID NO: 14035 - DNA, 201 bp, Homo sapiens
gcaccaccacatccagctaattttgtgtatttttagtagagatggggtttcaccatgctggccaggttggtctcaaactcctgacctcaagttatccactygccttggcttcccaaagtgctgggattataggcatgagccaccgcacttggcctagacatttgtttttaaaaataaaagattcatttgctctttttacag

SEQ ID NO: 14036 - DNA, 201 bp, Homo sapiens
gctagaagcagaaatgtgaaccagaaaacaaatcatgaactttcctttttttttttgagatggagtctcgctctgttgcccaggctggagtgcaatggtgygatctcggctcactgcaaccactgcctcccgggttcaagcaattctcctgcctcagcctcctgagtagctgggactacaggcatgcaccaccacgcctgg

SEQ ID NO: 14037 - DNA, 201 bp, Homo sapiens
catgggtccccactttcttgtgaatccttgggctgaacccccctgtcctgagtggttactagaacacacctctggaccagaaacacaaaagtggagtaacrcacactgcaaagctgtgcttccttgtttcagcctgtgaatcctcaccttgtttcccatctagcctatatttttcaaactaacttggccatagaatcatgt

SEQ ID NO: 14038 - DNA, 201 bp, Homo sapiens
tgccacaaacagaaatacagtgttggtccggcagcctccgggggttctgcacaagtggattaccagtgaatacaaggctatctatctttcgaaaaaccaamgttgtatttatgctattttctataaaattttatattaatttatttgttacctatttttgaactctttcaaaagcacactttatatttccctgcttaaaca

SEQ ID NO: 14039 - DNA, 201 bp, Homo sapiens
agcttgttaacacatccacttacttattgtcagagtacgtggagattttccacaaccctcggggataaggctgaacagaagaggcaaaaacgtgaaaacayttcgatagctcctatactttgaaataaaattcactgtaaaagttgcttgtatttttccaaaacagagtcaacccttaatatttaagattctgtatacaaa

SEQ ID NO: 14040 - DNA, 201 bp, Homo sapiens
tgcatgcatataatatatatttccttcctaattttctataagcaattttacaagactgacttctatttgcctccttattgttactacgtggtttgataatmcgttttgtgtcattgtgattctgtcatgttttggggacttatttttgtttctctgggtggtcactagtttttttaaagcattcatggaagagtgtgaatc

SEQ ID NO: 14041 - DNA, 201 bp, Homo sapiens
atgcactgggaaaccaaaaaggttatttttgagatatttgctttactgtggtggtctgaagctgaactcacaatctcaccaaggtgtgcctgaacctcttyagctaactggccactgccacagtccactctgtgttggtcaagatgccccagagtggcaggcacactgtgtggtcacatccaagggcctagatatggtggg

SEQ ID NO: 14042 - DNA, 201 bp, Homo sapiens
ggatgaactagaacattttctcgatgattcgctgtccttgttatgattatgttactgagctctgttgtagcacagacatatgtccctatatggggcggggktgggggtgtcttgatcgctgggctatttctatactgttctggcttttcccaagcagtcatttctttctattctccaagcaccagcaattagctttacctt

SEQ ID NO: 14043 - DNA, 201 bp, Homo sapiens
actcagaaactacaaacacaaacttcacagaaaatgtgaggattttacaattggctgttgtcatctatgaccttccctgggacttgggcacccggccattwcactctgactacatcatgtcaccaaacatctgatggtcttgccttttaattctcttttcgaggactgagagggagggtagcatggtagttaagagtgcag

SEQ ID NO: 14044 - DNA, 201 bp, Homo sapiens
agagtgaaaatccccactaagatcctgggtccagaaaaagatgggaaacctgtttagctcacccgtgagcccatagttaaaactctttagacaacaggttktttccgtttacagagaacaataatattgggtggtgagcatctgtgtgggggttggggtgggataggggatacggggagagtggagaaaaagggggcacag

SEQ ID NO: 14045 - DNA, 201 bp, Homo sapiens
aatgaagagcattgcctgccctaagccccagagactctgatgtcgtgggtctggagtgggctccaacagcggcatgttttgatggtgcttcccagtggcaygccagcgatgagcctttgagtagggaaagtaggagcactcgtgactcccttcacgatcagcacctgtgtgctaataaattcacaaaagccaacatattgg

SEQ ID NO: 14046 - DNA, 201 bp, Homo sapiens
tgtatgacaactcttaattgtggcaactcagaaactacaaacacaaacttcacagaaaatgtgaggattttacaattggctgttgtcatctatgaccttcyctgggacttgggcacccggccatttcactctgactacatcatgtcaccaaacatctgatggtcttgccttttaattctcttttcgaggactgagagggag

SEQ ID NO: 14047 - DNA, 201 bp, Homo sapiens
atagtgaggttaaatccaacctcaaatagttctgattcgatctgcctgcattgctgccctgtggttccccactgtagaagctccccaggtgattctaagtrtagccaagtctgagaaatactgcctaaagcctgttggactgacagcaagggctgttgtctgagcaagactttgcctggcctggggtggcatgtgcaccag

SEQ ID NO: 14048 - DNA, 201 bp, Homo sapiens; identical to SEQ ID NO: 1137

SEQ ID NO: 14049 - DNA, 201 bp, Homo sapiens
acctcaaatagttctgattcgatctgcctgcattgctgccctgtggttccccactgtagaagctccccaggtgattctaagtgtagccaagtctgagaaawactgcctaaagcctgttggactgacagcaagggctgttgtctgagcaagactttgcctggcctggggtggcatgtgcaccaggaagagtctcaactttca

SEQ ID NO: 14050 - DNA, 201 bp, Homo sapiens; identical to SEQ ID NO: 1140

SEQ ID NO: 14051 - DNA, 201 bp, Homo sapiens
tgttggactgacagcaagggctgttgtctgagcaagactttgcctggcctggggtggcatgtgcaccaggaagagtctcaactttcataacagaacattcyccaagctggtttttttaaagcatgtgaatctagacttcattggcaataccaaagatctgtatttgaggctccaagtatttcactttcatttttggttttg

SEQ ID NO: 14052 - DNA, 201 bp, Homo sapiens; identical to SEQ ID NO: 1143

SEQ ID NO: 14053 - DNA, 201 bp, Homo sapiens
gggtgggataggggatacggggagagtggagaaaaagggggcacagggttaatgtgaagtccaggatccccctctacatttaaagttggtttaagttggcyttaattaatagcaactcttaagataatcagaattttcttaaccttttagccttactgttgaaaagccctgtgatcttgtacaaatcatttgcttcttgga

SEQ ID NO: 14054 - DNA, 201 bp, Homo sapiens
tgatatcctttattctttatattttctaacagattctgtgtagtgggatgagcagagaacaaaaacaaaataatccagtgagaaaagcccgtaaataaacyttcagaccagagatctattctctagcttattttaagctcaacttaaaaagaagaactgttctctgattcttttcgccttcaatacacttaatgatttaac

SEQ ID NO: 14055 - DNA, 201 bp, Homo sapiens; identical to SEQ ID NO: 1148

SEQ ID NO: 14056 - DNA, 201 bp, Homo sapiens
agtcataaagaacctgaacttgaccatatacttatgtcatgtggaaaatttctcatagcttcagatagattatatctggagtgaagaatcctgccacctaygtatctggcatagtgtgagtcctcataaatgcttactggtttgaagggcaacaaaatagtgaacagagtgaaaatccccactaagatcctgggtccagaa

SEQ ID NO: 14057 - DNA, 201 bp, Homo sapiens
actgtatatagtatagtcataaagaacctgaacttgaccatatacttatgtcatgtggaaaatttctcatagcttcagatagattatatctggagtgaagratcctgccacctatgtatctggcatagtgtgagtcctcataaatgcttactggtttgaagggcaacaaaatagtgaacagagtgaaaatccccactaaga

SEQ ID NO: 14058 - DNA, 201 bp, Homo sapiens
aggttgtttccgtttacagagaacaataatattgggtggtgagcatctgtgtgggggttggggtgggataggggatacggggagagtggagaaaaaggggrcacagggttaatgtgaagtccaggatccccctctacatttaaagttggtttaagttggctttaattaatagcaactcttaagataatcagaattttctta

SEQ ID NO: 14059 - DNA, 201 bp, Homo sapiens
aacagaaaaaatcgtctctccctccctttgaaatgaatataccccttagtgtttgggtatattcatttcaaagggagagagagaggtttttttctgttctdtctcatatgattgtgcacatacttgagactgttttgaatttgggggatggctaaaaccatcatagtacaggtaaggtgagggaatagtaagtggtgagaa

SEQ ID NO: 14060 - DNA, 201 bp, Homo sapiens
gtcatctatgaccttccctgggacttgggcacccggccatttcactctgactacatcatgtcaccaaacatctgatggtcttgccttttaattctcttttygaggactgagagggagggtagcatggtagttaagagtgcaggcttcccgcattcaaaatcggttgcttactagctgtgtggctttgagcaagttactcac

SEQ ID NO: 14061 - DNA, 201 bp, Homo sapiens; identical to SEQ ID NO: 1129

SEQ ID NO: 14062 - DNA, 201 bp, Homo sapiens; identical to SEQ ID NO: 1160

SEQ ID NO: 14063 - DNA, 201 bp, Homo sapiens
agtcactgcacactcatctcccagcgcaggtcatgggcagcagatgcaaaagctgcccgtggtcctatttggaggtgcatgaaatgagcagaagacagaayagcttgatctgactagaagggcagcttgtccctaccaagacttgaaggattgcctttcatctgttagggtaaaaggtagaatgaaccaaggaagggcagg

SEQ ID NO: 14064 - DNA, 201 bp, Homo sapiens; identical to SEQ ID NO: 1161

SEQ ID NO: 14065 - DNA, 201 bp, Homo sapiens
cctgagagaggacaggtgctacaggtggaggggacccgtctgggtcacgttcacattttgaacatgctggttttcagtcactgcacactcatctcccagcrcaggtcatgggcagcagatgcaaaagctgcccgtggtcctatttggaggtgcatgaaatgagcagaagacagaacagcttgatctgactagaagggcagc

SEQ ID NO: 14066 - DNA, 201 bp, Homo sapiens
taggaagccatggcaagccttgggtcatactgcccccgcgaggccacattggcaaaccagcaagggtgttcaacttccagacttggccatggagaagacayacgaggaggcttttcacattcagctctttaatgtttgtctctgccggcaccatcccagttgtgaaaaagaggtatttccacagcggctcagggtaggtag

SEQ ID NO: 14067 - DNA, 201 bp, Homo sapiens
tgttcaacttccagacttggccatggagaagacacacgaggaggcttttcacattcagctctttaatgtttgtctctgccggcaccatcccagttgtgaawaagaggtatttccacagcggctcagggtaggtagtgcacagctcacattcatcatttctgaaaaccgagaggagtctccattcggggtacaggttgatgc

SEQ ID NO: 14068 - DNA, 201 bp, Homo sapiens
gggaggaggtcaaaataccaacattaacaggagtgtgaaagacattgattccaacccccatagatgactttcaggggttcacgtcttcagtggaggaagtygctgtagatgtggtggaaacagcaagagaactagaactagaagtggagcctgaagttgtgactgaattgccgcactctcatgatcaaacttgaacagatg

SEQ ID NO: 14069 - DNA, 201 bp, Homo sapiens
tcttacatatgagcagtgaaagtggtctcttgagatggaatctcctcctggtgaagatgctgtgaacacggttaaaatgacaacaatcgatttagaatatyacataaatttagttaataaagcagtggcagggtttgagaggattgactccaattttgaaagaagtgggtaaaatgctatcaaatagcatcacatggtatg

SEQ ID NO: 14070 - DNA, 201 bp, Homo sapiens
cgtggtggcgggtgcttgtaatcccagctactcgggaggctgaggcaggagaatcgcttgaacctgggaggtggaagttgcagtgagctgacatctagccwctgcactccagcctgggtgacagagtgagactctgtctcaaaataaataaataaataaataaataaataaataaataaatagtaaatgcactgctttgct

SEQ ID NO: 14071 - DNA, 201 bp, Homo sapiens
aatacagtgttggtccggcagcctccgggggttctgcacaagtggattaccagtgaatacaaggctatctatctttcgaaaaaccaaagttgtatttatghtattttctataaaattttatattaatttatttgttacctatttttgaactctttcaaaagcacactttatatttccctgcttaaacagtcccccgagggt

SEQ ID NO: 14072 - DNA, 201 bp, Homo sapiens
acagcatttcctacttttatactgtctatatgattgatttgcacagctcatctggccagaagagctgagacatccgttcccctacaagaaactctccccgrtaagtaacctctcagctgcttggcctgttagttagcttctgagatgagtaaaagactttacaggaaacccatagaagacatttggcaaacaccaagtgct

SEQ ID NO: 14073 - DNA, 201 bp, Homo sapiens; identical to SEQ ID NO: 1139

SEQ ID NO: 14074 - DNA, 201 bp, Homo sapiens
gtgccctcgaggcctcttaattattactggcttgctcatagtgcatgttctttgtgggctaactctagcgtcaataaaaatgttaagactgagttgcagcygggcatggtggctcatgcctgtaatcccagcattctaggaggctgaggcaggaggatcgcttgagcccaggagttcgagaccagcctgggcaacatagtg

SEQ ID NO: 14075 - DNA, 201 bp, Homo sapiens; identical to SEQ ID NO: 1131

SEQ ID NO: 14076 - DNA, 201 bp, Homo sapiens; identical to SEQ ID NO: 1135

SEQ ID NO: 14077 - DNA, 201 bp, Homo sapiens
gatgcctgtcgtggaatgaaggttccaacacccagaccaatctctgcagtgtgctgctctcatgagcttgcaacaagatcagaaaatgttttgtgactaarcatttttcatattgcataaaatgcttcaagctcctcccttgtttctctctataatcctgtatatctgatgattgtgggtaccaagtgtttgaaataatca

SEQ ID NO: 14078 - DNA, 201 bp, Homo sapiens
tccccttcctatgtccatgtgatctcattgttcaattcccacctatgagtgagaatatgcggtgtttggttttttgttcttgcgatagtttactgagaatsatggtttccaatttcatccatgtccctacaaaggacatgaacatagcaaagacttggaaccaacccaaatgtccaacaatgatagactggattaagaaaa

SEQ ID NO: 14079 - DNA, 201 bp, Homo sapiens
ccttctgaatatgtgcccacaagaagttgtgtctaagtctggttctcttttttctttttcctccagacaagagggaagcctaaaaatggtcaaaattaatrttaaattacaaacgccaaataaaattttcctctaatatatcagtttcatggcacagttagtatataattctttatggttcaaaattaaaaatgagctttt

SEQ ID NO: 14080 - DNA, 201 bp, Homo sapiens
gcggcagggaggtttgaaggtatcagcttttgtggctgacatacatgcagtcatgtcaattgctcgtttttccttttccatcttattaaatgtcttccaaygttagcacgaagaaaagctatttgcagtgttgccagcctttccagagcccgtccccattacctccccaggcccatgcctttactccttggagtttcaact

SEQ ID NO: 14081 - DNA, 201 bp, Homo sapiens; identical to SEQ ID NO: 1155

SEQ ID NO: 14082 - DNA, 201 bp, Homo sapiens
ctttatattttctaacagattctgtgtagtgggatgagcagagaacaaaaacaaaataatccagtgagaaaagcccgtaaataaaccttcagaccagagayctattctctagcttattttaagctcaacttaaaaagaagaactgttctctgattcttttcgccttcaatacacttaatgatttaactccaccctccttca

SEQ ID NO: 14083 - DNA, 201 bp, Homo sapiens
acacctcctactatttactgaagagcagatatctgataacttaatctttttggttttgagtcaagacaattcctccttttgaaactgcataccgctgaatmtaataaaatgtaattaagattaaaaataagaaactaatgggagaatttcaatattgtctatgttcactttaaaattcctctacttaggtttactgccatt

SEQ ID NO: 14084 - DNA, 201 bp, Homo sapiens
ctgtcttggagcatatagttagatgaacttgccctgtaaagaatgtctggtgaaggggaagtaaaaggtgagatttgcatttctaaagggctaagtagaamgtggggtacaagaggaaaggagaaaagagaaaataatttaaaaaataattgtaacttattcccttttacttagaaaaaagggaatactcagttacattat

SEQ ID NO: 14085 - DNA, 201 bp, Homo sapiens
tgtatctataaaaataaacaaaattagcttggtgtggtggcgcctgtagtccccagccacttggaggggtgaggtgagaggattgcttgagcccgggatgrtccaggctgcagtgagccatgatcgtgccactgcactccagcctgggcgacagagtgagaccctgtctcacaacaacaacaacaacaacaaaaaggctga

SEQ ID NO: 14086 - DNA, 201 bp, Homo sapiens
tcaagacaattcctccttttgaaactgcataccgctgaatataataaaatgtaattaagattaaaaataagaaactaatgggagaatttcaatattgtctmtgttcactttaaaattcctctacttaggtttactgccattaccaaagactattcaaaaatcctttttaggagaatcctaatggtttcctgacatataatc

SEQ ID NO: 14087 - DNA, 201 bp, Homo sapiens; identical to SEQ ID NO: 1136

SEQ ID NO: 14088 - DNA, 201 bp, Homo sapiens
gtctcgctctgttgcccaggctggagtgcaatggtgcgatctcggctcactgcaaccactgcctcccgggttcaagcaattctcctgcctcagcctcctgrgtagctgggactacaggcatgcaccaccacgcctgggtaattttttgtatttttagtagagacagggtttcaccgtattagccaggatgctctcgatctc

SEQ ID NO: 14089 - DNA, 201 bp, Homo sapiens
acagcaagggctgttgtctgagcaagactttgcctggcctggggtggcatgtgcaccaggaagagtctcaactttcataacagaacattccccaagctggtttttttaaagcatgtgaatctagacttcattggcaataccaaagatctgtatttgaggctccaagtatttcactttcatttttggttttgggttatgttt

SEQ ID NO: 14090 - DNA, 201 bp, Homo sapiens; identical to SEQ ID NO: 1133

SEQ ID NO: 14091 - DNA, 201 bp, Homo sapiens
cacagggtggaacaagatggattatcaagtgtcaagtccaatctatgacatcaattattatacatcggagccctgccaaaaaatcaatgtgaagcaaatckcagcccgcctcctgcctccgctctactcactggtgttcatctttggttttgtgggcaacatgctggtcatcctcatcctgataaactgcaaaaggctgaa

SEQ ID NO: 14092 - DNA, 201 bp, Homo sapiens
ccctacaagaaactctccccggtaagtaacctctcagctgcttggcctgttagttagcttctgagatgagtaaaagactttacaggaaacccatagaagayatttggcaaacaccaagtgctcatacaattatcttaaaatataatctttaagataaggaaagggtcacagtttggaatgagtttcagacggttataacat

SEQ ID NO: 14093 - DNA, 201 bp, Homo sapiens
ataattaacattctccccatcctgttgacgatgctctgaaaatatggtccagaaatggtgtgagcaaggagacagcaaagcaatgcttggaacataggtgyagtgactagacatggggcagctgtttaaagacaaaaaggccccaaaaaggagggatggcacgaaacaccctccaatatgggcatggagtctagagtgaca

SEQ ID NO: 14094 - DNA, 201 bp, Homo sapiens; identical to SEQ ID NO: 1147

SEQ ID NO: 14095 - DNA, 201 bp, Homo sapiens
tcccaattttatacaatgagcatgtgttggttttataattagacattttgtttgtttggtttggttttgagacacagcttgctgtcacccaggttggagtrcaatggcccaatcttggttcactgcaacctccatctcctgggttcaagagattctcccacttcagcctcctgagtagctgggactataggggcgcaccac

SEQ ID NO: 14096 - DNA, 201 bp, Homo sapiens; identical to SEQ ID NO: 1128

SEQ ID NO: 14097 - DNA, 201 bp, Homo sapiens
ccatctagtggacagggaagctagcagcaaaccttcccttcactacaaaacttcattgcttggccaaaaagagagttaattcaatgtagacatctatgtakgcaattaaaaacctattgatgtataaaacagtttgcattcatggagggcaactaaatacattctaggactttataaaagatcactttttatttatgcaca

SEQ ID NO: 14098 - DNA, 201 bp, Homo sapiens
tttcccaattttatacaatgagcatgtgttggttttataattagacattttgtttgtttggtttggttttgagacacagcttgctgtcacccaggttggartgcaatggcccaatcttggttcactgcaacctccatctcctgggttcaagagattctcccacttcagcctcctgagtagctgggactataggggcgcacc

SEQ ID NO: 14099 - DNA, 201 bp, Homo sapiens
cttccttcctatgtagaagtttcaaggacctcatggcctgagtgtggataggcagaatgctgggaatcaggcaaaaataaaataatactgaaagtgaaggwcatgctaatattagtaagccagggtgatcctgaatttacaaaacatttttctttgggaaatttcacacctcacatgattctgtgtttttacttgggaaat

SEQ ID NO: 14100 - DNA, 201 bp, Homo sapiens
gaaagtgaaggtcatgctaatattagtaagccagggtgatcctgaatttacaaaacatttttctttgggaaatttcacacctcacatgattctgtgttttyacttgggaaatttcacatctcacatgactctgtgacatgcggtacatgaggtgcctgactgctgtttttgtcctctactaatgaggaagagtgtgcgtac

SEQ ID NO: 14101 - DNA, 201 bp, Homo sapiens
attgtttatagatccgggatctcactatgttgcccaggctggcctcaaactcctgggctcaagcgaccctcccacctcatacttctgagtagctggggctrtaggaatgcgcctcagtgccaggctagtttcttaattttctatttctattttgacaggtacaaattttgtattcaatcctacctcagacacatctttggt

SEQ ID NO: 14102 - DNA, 201 bp, Homo sapiens
tattatgtgttgactatacctcaaaaaggctattttttaaaatccccctcaggctccaggcactccattacgttggtgtgacttgtcttggaaatatactytgagcatttgccggaggagatccagtgcctgggcctctgtttcttctcccaagtagaattggcagctaaaacgggatgcccatgggcacaacttgtcacc

SEQ ID NO: 14103 - DNA, 201 bp, Homo sapiens
agatccgggatctcactatgttgcccaggctggcctcaaactcctgggctcaagcgaccctcccacctcatacttctgagtagctggggctgtaggaatgygcctcagtgccaggctagtttcttaattttctatttctattttgacaggtacaaattttgtattcaatcctacctcagacacatctttggtgggaaaagg

SEQ ID NO: 14104 - DNA, 201 bp, Homo sapiens
atgagaaaggttgaagaaaaagagaagaagggacagaaattctcttcacacatttgcagaagtaggtccggactctccatccacttctcctcctccgatasgtaggacaggaatctcagaggaaatggcatcatcttcccatgtttacagacacagcaatgaactcaaagaacaatcttatcaggattttccaaatgaaaa

SEQ ID NO: 14105 - DNA, 201 bp, Homo sapiens
agctgctgagtcgttgacccaagagaagctcatctagattttttcattattttcaagttcctcttctcggttcgtccttcttccagaccatgccctccccrtcccactctcttcccacagcctcccctccccacagcctcctcccaccattccaaatctgggctgttctctcaatttccttctctctggactcaaacctac

SEQ ID NO: 14106 - DNA, 201 bp, Homo sapiens
cagtttcctaaagataaaaatagcacatgcttttccacttttccataagtgactgcattagaaaactaacaaaccatgaaaagcaaaatatggctagtctmttcaagaaaaactggtgtttctattttgtctgtaaattactttctaatacaaaaaacaattcctgttacattgaggtaattctaactagggacatatgag

SEQ ID NO: 14107 - DNA, 201 bp, Homo sapiens
ttcctcttctcggttcgtccttcttccagaccatgccctccccgtcccactctcttcccacagcctcccctccccacagcctcctcccaccattccaaatytgggctgttctctcaatttccttctctctggactcaaacctaccctagcccccagcctcagtttggggttaaacttgtcctcctcacattctctcccacc

SEQ ID NO: 14108 - DNA, 201 bp, Homo sapiens
ttgttttgttttgtttttccctttgttttcttttttttccccgaaatctgaccaccttaactttaaggtatttattcatttttaaaaactaaatatttttyggcagtcagaactagagcaaagataaatgatcccaggactctgtttagcaggcagtcaggaagtgtgacagtgtggtgggtggcagccccggccaggcct

SEQ ID NO: 14109 - DNA, 201 bp, Homo sapiens
cagcaccaatcacttctggctgcttgcaaacccctttgctttcctcagtgttgacacccagggcagccctatgctcactgccgctgagaccccacctctgmccctggccttttcccagctgacatcaccctgtggcttccattttcctaaaattctcttttgaggcctcagtcttaaccaaagcacacagtgcccctcaaa

SEQ ID NO: 14110 - DNA, 201 bp, Homo sapiens
aatatttttcggcagtcagaactagagcaaagataaatgatcccaggactctgtttagcaggcagtcaggaagtgtgacagtgtggtgggtggcagccccrgccaggcctttcctcttccctaaactgccacagcaggactgccacacttgggaatcccagtttccatctgagcagcccctccagagtttggaaggagtca

SEQ ID NO: 14111 - DNA, 201 bp, Homo sapiens; identical to SEQ ID NO: 1168

SEQ ID NO: 14112 - DNA, 201 bp, Homo sapiens
ttaaccaaagcacacagtgcccctcaaaaatgacaataaaaacccaaacacaccgtgactgtcatggcaggttcctggtccccgtattgaatcagcgggtrggtttctgcgaacactggtgagaggccgcattagagggtcaggaccctcaggtctggactcgtggtcaccacataccttcctccctgctgacagtagctg

SEQ ID NO: 14113 - DNA, 201 bp, Homo sapiens
catgccagctttatttcccgtggcacctggcacactgctaagcacttacatgcttaacaactagattgggaatggtgctgctctggggaagtgggcacacrttaaagaaatgtttatttcagtcttctgaaatagggaattactctggctaaaatgtagctccagaaagggaaagtggggctgtatgaatccaggtccagt

SEQ ID NO: 14114 - DNA, 201 bp, Homo sapiens
aggataagatggtctccgaagccttaaaattatatgccattatttacctctttgatctactactcaatatcaaacaactaattcagaagaaaattgattgytttctaaaagtagtttttctacatttcccattaagaagcagtggtatttaaaacttataatggctattatgtgagattatcactatcatagtttttctct

SEQ ID NO: 14115 - DNA, 201 bp, Homo sapiens
gtgtcatgccagctttatttcccgtggcacctggcacactgctaagcacttacatgcttaacaactagattgggaatggtgctgctctggggaagtgggcrcacgttaaagaaatgtttatttcagtcttctgaaatagggaattactctggctaaaatgtagctccagaaagggaaagtggggctgtatgaatccaggtc

SEQ ID NO: 14116 - DNA, 201 bp, Homo sapiens
tctctttttttgaaattttccaaatttgttattatgcatttaaacaataattttttgaacttttattttaggttctggggtacatgtgaaagcttgttacrtaggtaaccttttgtcatgagggtttgttgtacaaattatttcatcactcagctatcaagcccagtactcaataggtatcttttctgctcctctccctcc

SEQ ID NO: 14117 - DNA, 201 bp, Homo sapiens
ttatttatacccttcgagagaaaaacgtctcagctgtcacaggaagctgcttcggggggtgagcaaactttttaaaatgcagaaattatgatctacacccrtttcttaaaagtaagccatcgtacttggttctctttaattatatattttcttacatattgtgttcatgtaggcaagtcctgtttctgctaaaagaaggta

SEQ ID NO: 14118 - DNA, 201 bp, Homo sapiens
cacacgtggagttaaatttaatgctcaatcacatatttgtctgggctctttctgtgtttatttttctcttaatagttctctctcctcccttcctctccccrcccctcctcctccttcttcttttttttttccagagacagtgtctcgctctgccacccaggccagagtgcagagtggcatgatcatggctcaccgcagcct

SEQ ID NO: 14119 - DNA, 201 bp, Homo sapiens
tttctggtattttctcgtactttatcaagactatggaatcttaggagacttaacaaaagcaaatgagaaattatgtttagaaatgtctaacaaaatgaatkctttgtccttttaagtataacacatacctcaggcctcaccagcacataactacaaaaggttgtcccacttcctttctgtggctgagttagtagaacacag

SEQ ID NO: 14120 - DNA, 201 bp, Homo sapiens; identical to SEQ ID NO: 1172

SEQ ID NO: 14121 - DNA, 201 bp, Homo sapiens
acataactacaaaaggttgtcccacttcctttctgtggctgagttagtagaacacaggctcccacctgccacatcagcagaaggtcacctcaacatgtgarctacctccccggagaccccccagatccgtaaggatgatgcatccttgatcctaaaaacattttcctgttcctggtgttcagaattggactccacactcac

SEQ ID NO: 14122 - DNA, 201 bp, Homo sapiens
ttgatcctaaaaacattttcctgttcctggtgttcagaattggactccacactcactggtctctttataatcttgcttctggccctttgaggcctcaaagytaccagggccttgctgccaggggacaatcaccgctcccggctgagtcctgcagacatagggcctgggctggctgcctcctcctgctggcccagcatcttg

SEQ ID NO: 14123 - DNA, 201 bp, Homo sapiens
tcagaattggactccacactcactggtctctttataatcttgcttctggccctttgaggcctcaaagctaccagggccttgctgccaggggacaatcaccrctcccggctgagtcctgcagacatagggcctgggctggctgcctcctcctgctggcccagcatcttgcttgcactaaagagagctggaggcttggcactg

SEQ ID NO: 14124 - DNA, 201 bp, Homo sapiens
cacaggaaaatgggaggtaagaagaaagggatcgaaatgctgcaaagtgtattacttcatggtaagcaaaggactcaagactctagaaaatgatgcccttscttccaagactatgttagtccaaatctttcaagatacagaacccaaggtggggtctggcatacaagaagtataatagaggaaatgtctgtgacatttgca

SEQ ID NO: 14125 - DNA, 201 bp, Homo sapiens; identical to SEQ ID NO: 1167

SEQ ID NO: 14126 - DNA, 201 bp, Homo sapiens
agccatcgtacttggttctctttaattatatattttcttacatattgtgttcatgtaggcaagtcctgtttctgctaaaagaaggtaagttctaccaaggyggtgtcatgccagctttatttcccgtggcacctggcacactgctaagcacttacatgcttaacaactagattgggaatggtgctgctctggggaagtggg

SEQ ID NO: 14127 - DNA, 201 bp, Homo sapiens
cacatgcgtgtgtcttcatggtagaatgatttatattcctctgggtgtatacccagtaatgggatttctgtttttagctctttgatctaatacctatttcycaagatcaagttagatctctaaaaaaggcatcatcctagcatttccccatcccttccctgaactaaatttaatgttgtgtgtatcaatcagcatacagtc

SEQ ID NO: 14128 - DNA, 201 bp, Homo sapiens; identical to SEQ ID NO: 1174

SEQ ID NO: 14129 - DNA, 201 bp, Homo sapiens
ctatgggtctgacctcaaggtgagctggaatgggcacaagtaatagataaaactgcaagaagtcactcaagggtccttcctagaacaaaggatccctacaytccaaaggcgaatgccggtcactatcataaaagaaaagaaagaaagaaactgatggtgacattttaaatggcaatttttctagcttctaaaaggttgtgg

SEQ ID NO: 14130 - DNA, 201 bp, Homo sapiens; identical to SEQ ID NO: 1162

SEQ ID NO: 14131 - DNA, 201 bp, Homo sapiens
gacctcaaggtgagctggaatgggcacaagtaatagataaaactgcaagaagtcactcaagggtccttcctagaacaaaggatccctacattccaaaggcraatgccggtcactatcataaaagaaaagaaagaaagaaactgatggtgacattttaaatggcaatttttctagcttctaaaaggttgtggagcaactgga

SEQ ID NO: 14132 - DNA, 201 bp, Homo sapiens; identical to SEQ ID NO: 1164

SEQ ID NO: 14133 - DNA, 201 bp, Homo sapiens; identical to SEQ ID NO: 1166

SEQ ID NO: 14134 - DNA, 201 bp, Homo sapiens
tcccagtaagtacatataaaatctgtatttccagggtggattatcaacacagctgtattttagaaatattatctgccctcccaggtatcacagctactaawtattgggtactgaggtggaattttagggatcagccaattatgggaaagaaaatctgggggcaggataagatggtctccgaagccttaaaattatatgcca

SEQ ID NO: 14135 - DNA, 201 bp, Homo sapiens
gttgtacaaattatttcatcactcagctatcaagcccagtactcaataggtatcttttctgctcctctccctcctcccaccctccagtctcaagtagaccycggtgtctgttgttcccttctttgagttcatgtgttctcatcatttagctcccacttataagtgagaatacaaggtatttggttttctgttcctgtgtta

SEQ ID NO: 14136 - DNA, 201 bp, Homo sapiens
actcctgggctcacgtgaacatcccaccttggcctctggaatgtctgggattacaggcacttgccactgcatctggctaatttttatattgtttatagatmcgggatctcactatgttgcccaggctggcctcaaactcctgggctcaagcgaccctcccacctcatacttctgagtagctggggctgtaggaatgcgcct

SEQ ID NO: 14137 - DNA, 201 bp, Homo sapiens
aggttagtcacagctgctgagtcgttgacccaagagaagctcatctagattttttcattattttcaagttcctcttctcggttcgtccttcttccagaccrtgccctccccgtcccactctcttcccacagcctcccctccccacagcctcctcccaccattccaaatctgggctgttctctcaatttccttctctctgga

SEQ ID NO: 14138 - DNA, 201 bp, Homo sapiens
gtccttcttccagaccatgccctccccgtcccactctcttcccacagcctcccctccccacagcctcctcccaccattccaaatctgggctgttctctcartttccttctctctggactcaaacctaccctagcccccagcctcagtttggggttaaacttgtcctcctcacattctctcccacccaacttgatgtcgcct

SEQ ID NO: 14139 - DNA, 201 bp, Homo sapiens
tttgcaaacatttatttatacccttcgagagaaaaacgtctcagctgtcacaggaagctgcttcggggggtgagcaaactttttaaaatgcagaaattatratctacacccgtttcttaaaagtaagccatcgtacttggttctctttaattatatattttcttacatattgtgttcatgtaggcaagtcctgtttctgct

SEQ ID NO: 14140 - DNA, 201 bp, Homo sapiens
gcccctcagggtcaggagcagtctgatcaaaaggagggcatccactgtccggggccattcccacagctcccggatgctgggtctggaggctgcgcccttcscctgcaggagctcagcccagtggtaagtcatctgtgtgtcatctatgtatttaaccccttatggccatgttgatgctgagcatggtttcacttttgcaaa

SEQ ID NO: 14141 - DNA, 201 bp, Homo sapiens; identical to SEQ ID NO: 1163

SEQ ID NO: 14142 - DNA, 201 bp, Homo sapiens; identical to SEQ ID NO: 1165

SEQ ID NO: 14143 - DNA, 201 bp, Homo sapiens; identical to SEQ ID NO: 1171

SEQ ID NO: 14144 - DNA, 201 bp, Homo sapiens
tgggtgtatacccagtaatgggatttctgtttttagctctttgatctaatacctatttctcaagatcaagttagatctctaaaaaaggcatcatcctagcmtttccccatcccttccctgaactaaatttaatgttgtgtgtatcaatcagcatacagtcaagacagaaaccacacatgaacattaaatataatgagttat

SEQ ID NO: 14145 - DNA, 201 bp, Homo sapiens
taaccttttgtcatgagggtttgttgtacaaattatttcatcactcagctatcaagcccagtactcaataggtatcttttctgctcctctccctcctcccrccctccagtctcaagtagacctcggtgtctgttgttcccttctttgagttcatgtgttctcatcatttagctcccacttataagtgagaatacaaggtat

SEQ ID NO: 14146 - DNA, 201 bp, Homo sapiens; identical to SEQ ID NO: 1173

SEQ ID NO: 14147 - DNA, 201 bp, Homo sapiens
ctcatgatccgcccgcctcagcctcccaaagtgctgggattacaggcatgagccaccacccctggccggccccgcttttaagagaggggagagaagacctrggccttagaagagctcagaggaaccacaattgactctgcagtcaaggagaggaggctcactgcggatgtggtatttgagccttgaaggatgagtgtggtt

SEQ ID NO: 14148 - DNA, 201 bp, Homo sapiens
ctaattgatcacagcactctttctgaccaagggtaaatgcaaccttggaatcctctctaagtggctgttccagagttctgctaccagacagtcttctttgrgtgtgaaaaaaggaatgtgcttgacatacaaggtctagatagcctctaagacagggtcccctctaagatggggtattggtccatggcctgttaggaactg

SEQ ID NO: 14149 - DNA, 201 bp, Homo sapiens
gagctcagaggaaccacaattgactctgcagtcaaggagaggaggctcactgcggatgtggtatttgagccttgaaggatgagtgtggtttcatcaagtaraaaaggcagggatgggaaagggaggtggtccaggcaggggtgatggtgtgggcaaagccttgctgatattaaagaacatagttctgtgcacctggaacac

SEQ ID NO: 14150 - DNA, 201 bp, Homo sapiens
ggacatccccatggagaacggcgtgggtggcaacagcatcttcctggtggccccgctgatcatctaccatgtcattgatgccaacagcccactctacgacstggcacccagcgacctgcaccaccaccaggacctcgagatcatcgtcatcctggaaggcgtggtggaaaccacgggcatcaccacccaggcccgcacctc

SEQ ID NO: 14151 - DNA, 201 bp, Homo sapiens
ttctgcttccagcccacccctgcccttctaccttcgacctcctccctctgcctctccctctggtgcactggcaaatgggacagagagcctcggtagggccytcctcttagagtcttgcacgcatccctcagtggtctccctgtggctgcttcctgctgccaccaacagatacagacccctgtcgcacagatcatggtagag

SEQ ID NO: 14152 - DNA, 201 bp, Homo sapiens
aaggcaggaagttgggggattaggaggtgtagaatggagaatgctctggggagatgggtgctttgttggtgcaactattcgtttattcctccagtgaccaygtgagcagtatggctgcacacacaggctctgcagccaagctgcctgggttcacatttggtctctgtgctttggaaaatttcataagctttctctaccagt

SEQ ID NO: 14153 - DNA, 201 bp, Homo sapiens
tccatcccaaagagctcatagtccagtagggtacaggacagtgtctcctgaatggctgagggcatgatgtgttcctcctctttggtgacagggcatcaacytgtctggtggtcaacgccagcgaatcagtgtggcccgagccctctaccagcacgccaacgttgtcttcttggtgagtgcaagttcccttggggtcctggt

SEQ ID NO: 14154 - DNA, 201 bp, Homo sapiens
gtcaagattagcagatacactcgggtgaaattctttccctggaaataaagaatagagccattaatatccacagtagagtgactttaaatgcccccgggggrtcagcaggaaccagggccctgaggaaaggatcagcgtggggaagaggctcccacttccctgtgaggagctgcacatgcagtctcactggagctccctgct

SEQ ID NO: 14155 - DNA, 201 bp, Homo sapiens
cttgagcaggttacttcacctctctgagacagactcactgtctggacaatgagtaaaaccctacctttcctgtctcagagatttggcaatgggacccaatsacatcaattggaaaggatgctgtgggtgaaaggtaacctttcaggacagcgacaagcctgtctgggcaggatgaatgggctgtggagccctgtatatcct

SEQ ID NO: 14156 - DNA, 201 bp, Homo sapiens
gagtcggagctattttctccgctacttactagctgtgtgactttgggcaagttacttagcctttctctgagcctcactttctttatctgtaaagtgagggygatcagaataaacctccttcatatggttattttgagctttataaagagacaatactggctgagcacggtggctcactgccagtaatcccagcactttagg

SEQ ID NO: 14157 - DNA, 201 bp, Homo sapiens
gagctattttctccgctacttactagctgtgtgactttgggcaagttacttagcctttctctgagcctcactttctttatctgtaaagtgagggcgatcaraataaacctccttcatatggttattttgagctttataaagagacaatactggctgagcacggtggctcactgccagtaatcccagcactttaggaggcca

SEQ ID NO: 14158 - DNA, 201 bp, Homo sapiens
ctgcccctctctcttaggaaacctctgccccagcccagggaacacaaggagcctctccaaggcagaggaccctaagcacttcttttttttattattttttrttttattttaggttctgagatacatgtgcagagtgtgcaggtttgttacatagctatacatgtgccatggtgctttgctgcacctatcaacctgtcatct

SEQ ID NO: 14159 - DNA, 201 bp, Homo sapiens
ggtctgactgctgcccctctctcttaggaaacctctgccccagcccagggaacacaaggagcctctccaaggcagaggaccctaagcacttcttttttttrttattttttattttattttaggttctgagatacatgtgcagagtgtgcaggtttgttacatagctatacatgtgccatggtgctttgctgcacctatcaa

SEQ ID NO: 14160 - DNA, 201 bp, Homo sapiens
gcagtccccacagtgacaggacattctggccacatgcctcatcctcctcctccaagccgcaggagggccaccctcagctgtggcccccaccgcgggtggtrttcccaccatcctgacccgccccctcctgccctgcccagcatcgagtgcacaccatcctgagtgcagacctggtgatcgtcctgaagcggggtgccatcc

SEQ ID NO: 14161 - DNA, 201 bp, Homo sapiens
taagaacagggggcttgctctgcagacactgcatccagacaagtcccccatcccaccacatcacacccccttccaaagggatagcttccactcccgttttygccttcttcatctatcccacccctgcctaagcccatccctgtatctcagaaggctgccccagtaggaacccggactctgacaccttctttgctggatgac

SEQ ID NO: 14162 - DNA, 201 bp, Homo sapiens
acaaggctaagaggtatactacttcaagcatggctggacccaggtgtttgacatccatctgggatgtgtcttcctttctgggttccattttcctccccttkcattatgacagatggccactagcaggtccagcttacatcctgccccaaggcaacccaagaggcaaaacagatactccttcccaatagttccagcaaaagc

SEQ ID NO: 14163 - DNA, 201 bp, Homo sapiens
ttagggaggttgactggcccaaggtcacacagctggtcaggggtaatgccaggacctaaacttccccaccacagagtttggttttaggcaagctctgctcmggggataggagctgaagtccctctggggagaagagaggaacatacaggaaatgggaagttattgagcagtgccctcgcatcacttggcctcggccccagc

SEQ ID NO: 14164 - DNA, 201 bp, Homo sapiens
ctgggattggtggcgccgcctctcagcgcctcctttcccggggaacctgcaaacctggcgcggccgagaggcggattactgacccaaatacggatggggayattgggggaggggagccagggcgacagggcggcggccccagactgggagggcgggtcacagatccctcccagccccccactttcgtagagcgtgggcagg

SEQ ID NO: 14165 - DNA, 201 bp, Homo sapiens
tggtggccccgctgatcatctaccatgtcattgatgccaacagcccactctacgacctggcacccagcgacctgcaccaccaccaggacctcgagatcatmgtcatcctggaaggcgtggtggaaaccacgggcatcaccacccaggcccgcacctcctacctggccgatgagatcctgtggggccagcgctttgtgccca

SEQ ID NO: 14166 - DNA, 201 bp, Homo sapiens
aagtggaggggagctggactttgggttttgtttgcttgtgcccaggctggagtgcagtggcaccaccttgggtcactacaacctccgcttcctgggttcargcggattcttgtgcctcagcctgctgagtagctgggaatacaggcgtgtaccaccacactcagataattttttgtatttttagaagagttgggatttcac

SEQ ID NO: 14167 - DNA, 201 bp, Homo sapiens
ttccccatggtcacaaggtggctgcctagctccgggtattgcttagcatgagcagagagggcatgctgccgacatgcctctcctttatgacagagatcatyctttctttgacatctcactggccagaatacgtggaccaacactggcaaaggagtatggaattgcatggctgcttaaaccaatcaccatccattccctggg

SEQ ID NO: 14168 - DNA, 201 bp, Homo sapiens
tctgaattcagaacaatcaaaacagtataagttagtgaagaagatattttttaataactacaatattttcccagaccaccatacactggataaagcctgtrtataaaactttacctaatttcttaactaattgaatgtgtattatttaacaaagcagctaaaaactattctatgaagccatgtcatgaaatatttagttca

SEQ ID NO: 14169 - DNA, 201 bp, Homo sapiens
gcctgagtgaggggcaggaaaagagcagacaggagaagtcacagacccttgtgatacctccagtctaatccagcctgggttttcagagctgtctggaaatwtagggggcaggtgggagggggctgattaaggcagccctgatttgatttagagtgagcctcatttagtgactaattaagccatcttaaacctgtagggctt

SEQ ID NO: 14170 - DNA, 201 bp, Homo sapiens
caagtgggcaggcatcctgcctctgactgtctctccctgcaggatggggaagtcagagctccaaggtgcacatccaccacagcacatggcttcatttcccygggcacaacctgcggtggatcctgaccttcatgctgctcttcgtcctggtgtgtgagattgcagagggcatcctgtctgatgggtgagtgactgtctgag

SEQ ID NO: 14171 - DNA, 201 bp, Homo sapiens
ctgggaagctggaaggaaggagtagctgttggaatgaagtagctgatagagagggtagcttgcagggggagactctagcatgggttcaaagatggaatggkgcataactcagcaaaattatgctctaaggagtatctgaccaggcagtagctggttaaacagggattagctcccatttccacagtcggctgtgctgactca

SEQ ID NO: 14172 - DNA, 201 bp, Homo sapiens
gcacagtggcttacatctgtaatctcagcattttggtgggctgtgacaggaagactgcttgagtccaggagttcgagaccagcctgggcaacatagtgagrccccccccgccctttctacaaaaaattaaaaattagctgagcatggtgatgtgcgcctgtagtcccagctactcaggaggctgaggcgggaggatcactt

SEQ ID NO: 14173 - DNA, 201 bp, Homo sapiens
gcttgaagtcctgaacttgttggggacgtttccatgagatgactgtggggatgatgaaggtgtctccaactaaaagatcctcttaggagcctgctccctgmcagccctctcatttcccttccagtgctgagcgtttccagtgtgggagggacccacaccctgggccaccctggcctcacttgtgcctctgtccacagactt

SEQ ID NO: 14174 - DNA, 201 bp, Homo sapiens
ggaaaagggaaagaggaggtctcagcacgcagtgggaaactggagaggggtcgggcctcaccctccgtggcgcagcttagggagccgggtcacccctcccscaaggcagcctccctgtcagccgcagctgggcctagggaagagggaagcctgtgctttggagtctgggatggaggcccagctaacccctatgctttcacc

SEQ ID NO: 14175 - DNA, 201 bp, Homo sapiens
gctgtggcatggtagtgggccctggaaaccatctagccttcatgaggaagggcagttaaagcacaggcatgtatgatgttggtattgattaaaagcctcaygggcagagaaattcgccatctgccagggccccagccatacgagggctccagccatacatcctccaggagactgggacctctccaattgcaggagccttgc

SEQ ID NO: 14176 - DNA, 201 bp, Homo sapiens
taacctggaccctgagaggaagtgctcagatagcacactgtgggaggccctggaaatcgcccagctgaagctggtggtgaaggcactgccaggaggcctcrgtaactactcctggctatgcagctgggttggttgggcactcaaggaccctgtaaggatggcagacagaagcccgtgtctcaggtttgccccaagtttgga

SEQ ID NO: 14177 - DNA, 201 bp, Homo sapiens
aagtatacatatttcgtacggctataatcatgggaagcacaattttgtttgccgtttttcacctgacactatcttgtaaagtttttctattgactacacaractcagctagcaccgtcccagcagttgcatttttcaaggttgattaacccctgtccctggtgctggatatttcttgccaccaagttttcactattttggc

SEQ ID NO: 14178 - DNA, 201 bp, Homo sapiens
tcccagctcaggtttgttgatttgttgttttgtttgtttcgttttgtatggggcaagggttgagggtatgaaaaacttacactatcatttactaccgtagyccccagaacccagcacaccagcacaaggcctggaacagggataccttttttgaatgaataagtctttttttttttttttttttttttttttgagacagag

SEQ ID NO: 14179 - DNA, 201 bp, Homo sapiens
caggagggccaccctcagctgtggcccccaccgcgggtggtattcccaccatcctgacccgccccctcctgccctgcccagcatcgagtgcacaccatccygagtgcagacctggtgatcgtcctgaagcggggtgccatccttgagttcgataagccagagaagctgctcagccggaaggacagcgtcttcgcctccttc

SEQ ID NO: 14180 - DNA, 201 bp, Homo sapiens
ttgctcaaagcaagctctcagagtctgaccttcttccagcccctagcaagagaaacaaaaggcatggctagaggtggggaagcaccagagacccagcatcwccccgacagaggcagacgtagccctgttacagacataaatgattttgtatgccacacaccgctctgcgtctgtgtcttggacatcttcccctgccagtaa

SEQ ID NO: 14181 - DNA, 201 bp, Homo sapiens
gagtgggtgatctgatcccagctcaggtttgttgatttgttgttttgtttgtttcgttttgtatggggcaagggttgagggtatgaaaaacttacactatcatttactaccgtagtccccagaacccagcacaccagcacaaggcctggaacagggataccttttttgaatgaataagtcttttttttttttttttttttt

SEQ ID NO: 14182 - DNA, 201 bp, Homo sapiens
aggccacacccacccagtagccggtgagtgtgagaatccaatcccggaaatccagccctagttttcattttgccaggagaatggctgggaattctcagagyggggtacccttgctcaaagcaagctctcagagtctgaccttcttccagcccctagcaagagaaacaaaaggcatggctagaggtggggaagcaccagaga

SEQ ID NO: 14183 - DNA, 201 bp, Homo sapiens
tgcctctctgacacgtaacttctggaacatgtatcaatgctttggaaatgaaaagctcctggtattgcaatgccaggctggtgcccataagggccagaaarcattccttgggcaaagccagggggagtgggtgatctgatcccagctcaggtttgttgatttgttgttttgtttgtttcgttttgtatggggcaagggttg

SEQ ID NO: 14184 - DNA, 201 bp, Homo sapiens
gctctgtacttgttctccactattccatagtataggtcacaccatgagttttgcttttgtctgtttttaaccaggccgctgttgattgtggttattgaaarggtttatttcttcaactataaccccactccattacgtcaccattgtcattgtaatgaccccctctgccatggtcactggaacactggcactcctagtcag

SEQ ID NO: 14185 - DNA, 201 bp, Homo sapiens
aggaagagagcaggtttggggatgaccagcagcttgggaagggagcaagacttgctagagaagtcctaagtgggtaagcaagctgaaggcaaatattgacytgctctgggtcacaatgggcatgttttttaaaaaagacaccgtgtggaagaaaggaagaggagatatgagatacacacaaaggagaagaccactgggggt

SEQ ID NO: 14186 - DNA, 201 bp, Homo sapiens
ctcagaacaggcagtggagaaaaacaacatgacctggagacctggtgccccttccttccccagcatctttgaaattcttttggttgttgttgttttgagayggagtctcactctgttgtcaggctggagtgcagtggcgcgatctcaactcactgcaacctctgcctcccaggttcaagtaattctccctgcctcagcctc

SEQ ID NO: 14187 - DNA, 201 bp, Homo sapiens
ggaagggactttttgtttgtttgttttgttttgttttgttttgagacagggtctctctctgtcgcccaggctggagtgcagtggcccgatcatggctcacsgcagccttaacctccctggctcaagggatctggaaaggacttttctgaagctctgcaccagcccctttactgcaccctgcctgaggccacacccacccag

SEQ ID NO: 14188 - DNA, 201 bp, Homo sapiens
tcgcttgagcccaggagttggagaccagcctgggcaacatagggaatgagactcctgtctctacaaaaaatatacaaaaattagtcaggcatggtggtacrtgcctgtaatcccatctactcaggaggctaaggcaggaggatcgcttgagcccaggaggtggaggttgcagtgagccaagatcacgccattgtactccag

SEQ ID NO: 14189 - DNA, 201 bp, Homo sapiens
ctgtgccaggctctacggaggttctggatgttaaagaggaagcaggcatggccctggccctcccagtcttgtgggagattgatcatgcccatgaatagtgrccatgtggtcagagccacagggtcaattccaaatgcccctgtttctcttttgtgttactcacctgactctgggtctttcgtttcttccattcattttttt

SEQ ID NO: 14190 - DNA, 201 bp, Homo sapiens
agcccctagcaagagaaacaaaaggcatggctagaggtggggaagcaccagagacccagcatctccccgacagaggcagacgtagccctgttacagacatraatgattttgtatgccacacaccgctctgcgtctgtgtcttggacatcttcccctgccagtaagcataactctattctctgcgcttgctccacagtatcc

SEQ ID NO: 14191 - DNA, 201 bp, Homo sapiens
cttgttctgacccctggcgccagtcttggagtcctgacgctgcagaggagccccagagtcacatttcctgttggggcccatcctgctcatatgcggcaccrtcagacttctgggcaggcaagattacctgtgactctgtctgatggtctcgccatcaatatcactgagagtagctgtgtatggagtcccgaactggtacag

SEQ ID NO: 14192 - DNA, 201 bp, Homo sapiens
ctcaggcccaagggagccacatcaccctgctgggcagcccccagaccccagccccagtgttgggggaggccagggagggcccctgtgctccaccaggtggmtcgggagctgctgctgtttctgtgcatccatttactcccttcacataagatcatttttatctgggatctctttttcttttttcttcaaaaaccacatcac

SEQ ID NO: 14193 - DNA, 201 bp, Homo sapiens
ttgtggaagcagcataactctaggtggttcctctgtatctgaggacaagctttgtagaggtgacaaaggggtcctaggtcctatcaggcaagcactcgatwtgctgccagttcattctgtccattgtgagatacccattccagagcgcttcctctgtgccaggctctacggaggttctggatgttaaagaggaagcaggca

SEQ ID NO: 14194 - DNA, 201 bp, Homo sapiens
actaagcagatttctaccaactgcacctccccatccccttgcctccatctgagccatcagcttgacaactgcctctgagaacaagcccctgagaatgcctyccgcaccccctactcccgccctgctttttccaggaagagaggccccgtggcctatgcttcgcagaaaccatggctgctaaatgccactgtggaggagaac

SEQ ID NO: 14195 - DNA, 201 bp, Homo sapiens
atcgatcacccacacccagccatctcactccccaggtgcttatctgcactccagcctctccatatggtgcacctggagaggggccaggtgtgcctgagcaytggggcaatccagctcccataggggagagggcaggaacggagggaagggagagagccccgctgccttttctctagctggtgggagggctagctagctctc

SEQ ID NO: 14196 - DNA, 201 bp, Homo sapiens
aaggcaaaaggcacagatacacaggtttcgccaaaggtctgttctttgggccttgcgctccttcctcaggagccaaagtctcagaagcagaaaaatcctcratacccccaggatccctttgggaagtggttaacagcacaggctttgaagccaggcctcactgagtttgggtcttttcttcaccaactcctccagctgtgt

SEQ ID NO: 14197 - DNA, 201 bp, Homo sapiens
atgagcgccctttcatcacttactctgcatatttgttcccaaccaattccatccttctagtatttaacctgcccaaacgctgtgtgaagtgctgacctcarctcttttcaagctcacacggtgtttgcttgcacccaagcgggaggcctattaaagccattgctcaccctgggcatagctacccagagactaatgaccctc

SEQ ID NO: 14198 - DNA, 201 bp, Homo sapiens
cttcatgcaagtatacatatttcgtacggctataatcatgggaagcacaattttgtttgccgtttttcacctgacactatcttgtaaagtttttctattgrctacacagactcagctagcaccgtcccagcagttgcatttttcaaggttgattaacccctgtccctggtgctggatatttcttgccaccaagttttcact

SEQ ID NO: 14199 - DNA, 201 bp, Homo sapiens
tggcccccaccgcgggtggtattcccaccatcctgacccgccccctcctgccctgcccagcatcgagtgcacaccatcctgagtgcagacctggtgatcgwcctgaagcggggtgccatccttgagttcgataagccagagaagctgctcagccggaaggacagcgtcttcgcctccttcgtccgtgcagacaagtgacct

SEQ ID NO: 14200 - DNA, 201 bp, Homo sapiens
taggctgcctgtctgtgggacagcccaacccctcaacacttatgcagcccgactataagaatggctgataacagaatgtgtgctgccacttcccatcttaygcccagtgcagacattgctaattgttcacagcattatttcccatggaacttaactcatcctcagaatccttctcaacacagcactccaggtaaccactag

SEQ ID NO: 14201 - DNA, 201 bp, Homo sapiens
gagctgggttcaagctatgcttccctgcttgctggcactgagaccttgggggaagtcatgttactggcctcccttcagctccctcgcagcttgggtttccscatcagaaaattggaagcgattagaacctgtacttagcaagagttctgggacatcccttgtgtgaaagtgccagatacgctgtaaagcagtacctaggag

SEQ ID NO: 14202 - DNA, 201 bp, Homo sapiens
ttcacagcattatttcccatggaacttaactcatcctcagaatccttctcaacacagcactccaggtaaccactagccatcaaacatgagataaaactagrccaggcgcggtggctcacgcctgttattccagcactttgggaggccgaggcaggcggatcacgaggtcgggagatcgagaccatcctggccaacacggtg

SEQ ID NO: 14203 - DNA, 201 bp, Homo sapiens
acttctcaggctctgcgcaaagtagctccgactcgccgacgcagcgaccccggcgcccttgcttgcaaagttgggcgccacggccgggacaatcgtgcgtrcctctccactgaggtcccccccatctctctccaagaccttgactcttccagaccagtcaagtctatcaactcatagggtgtcccctgcatccccaaaacg

SEQ ID NO: 14204 - DNA, 201 bp, Homo sapiens
cgcggtggctcacgcctgttattccagcactttgggaggccgaggcaggcggatcacgaggtcgggagatcgagaccatcctggccaacacggtgaaaccscgtctctactaaaaatacaaaaaattagctgggtgcggtggcgggcgcctgtagtcccagctactccggaggctgaggcaggagaatggcgtgaacccgg

SEQ ID NO: 14205 - DNA, 201 bp, Homo sapiens
cttgtcacacaagaagttagtatgtataatggggtaccttggcagggcacagtggcttacatctgtaatctcagcattttggtgggctgtgacaggaagaytgcttgagtccaggagttcgagaccagcctgggcaacatagtgagaccccccccgccctttctacaaaaaattaaaaattagctgagcatggtgatgtgc

SEQ ID NO: 14206 - DNA, 201 bp, Homo sapiens
gatcgagaccatcctggccaacacggtgaaaccccgtctctactaaaaatacaaaaaattagctgggtgcggtggcgggcgcctgtagtcccagctactcsggaggctgaggcaggagaatggcgtgaacccgggaggcggagcttgcagcgagccgagatcgcaccactgcactccagcctggggacaaaccgagacttt

SEQ ID NO: 14207 - DNA, 201 bp, Homo sapiens
cctatatttctgacccagtaccagccaggggggcaagtttccatcccccacaagtcacaaacctgtaactgacactaggatgcttaaggtcaaaggcctgracgaggcctagacagtgggtctggggtagtgtttttgacatcactcaggttcatgttcacatgttgtccccttaccagcatgtgaccttgggccagccac

SEQ ID NO: 14208 - DNA, 201 bp, Homo sapiens
tcaggtgccttgactgacactgaagaattctaagaaccagtccttggcctcaaagatttagaatctgattagggagacagagctcacccagttcaagaggmccagcccggttcaaatccaaactgtgcggcataaactatgagggggccttgtccagggagacaactgtgagggctggagtaatcagggagggcttcctgg

SEQ ID NO: 14209 - DNA, 201 bp, Homo sapiens
gtcctacctctgcagctaactcatttattctcctcagcagtcacattctgcaagcctcaaatgcaaaatgtgtaataacttctgtagaaagtacatggggrcatgaagatcattggcttgattgcttttaaaaaatcggtattgagcactactggggaaatccctggaaacaaacacaattcttccctgagagcttgtgaa

SEQ ID NO: 14210 - DNA, 201 bp, Homo sapiens
tcttgcataagacctttccttggttctcagctgttttgaagatgtggtctcagatcctcagcccaccattcaaggtcttcacagtcagccccacctatctytggcctcattccccatgcccaccttccgtttgggcctcacagcacactcctcacacctctgctacagcacagatcacactgtatgttaaagtttatgtct

SEQ ID NO: 14211 - DNA, 201 bp, Homo sapiens
ggccttgtagatgacatctaaagcttgagcctggggctggctgccgtggctcacacctgtaaccccagcactttgggaggccgaggtgggcggatcacccraggtcaggagtttgagaccagcctgaccaacatggagaaacccccacctctactaaaaatagaaaaattagctgggcatggtggcacgcatcggtggtcc

SEQ ID NO: 14212 - DNA, 201 bp, Homo sapiens
gtggagattgtagtgagctgagatcgcgccactgcagtccagcctgggtgacagagcaagactccatctagaaggaaggaaggaaggaaggaaggagggarggaaggaagggagggagggagggagggagggagaagaaagcttgagcctggatgaggtcacctggggagagaagagaaaggctctgggaccagagcttga

SEQ ID NO: 14213 - DNA, 201 bp, Homo sapiens
acaagttcaaactgtcccatatctccccacatcactatctacagttggtctcttcccatggcgatgtccatctgccaccgtggcactggtattgctttgartgcaggggtctctctttttggcatgttggccctgttactccctgggaactttgagtcttatttggaatgcgtgaagtccctgtgtccggggccagcactg

SEQ ID NO: 14214 - DNA, 201 bp, Homo sapiens
tttgctgtctgcaggagggagctgtggaagggcatgatcacgaccaactaaggtgaccctcctcaccaggcccagggaagactgaggcctggaaggaggcwctggctgcctctgggtcttacccccaggccacagtccacccacttagaggcctctgtgagttaaggtggagagactatgagctggtattgactgctccat

SEQ ID NO: 14215 - DNA, 201 bp, Homo sapiens
ggaggtggagattgtagtgagctgagatcgcgccactgcagtccagcctgggtgacagagcaagactccatctagaaggaaggaaggaaggaaggaaggarggagggaaggaagggagggagggagggagggagggagaagaaagcttgagcctggatgaggtcacctggggagagaagagaaaggctctgggaccagagc

SEQ ID NO: 14216 - DNA, 201 bp, Homo sapiens
ttgtctagaggccctgccctgggacaagaacacctttcttcaaaacagcccttgtatgtgagccaggcacagtggctcacacctgtaatcccaacactttsagaggccaaggttagggggcgggggggatcccttgacgccaggagtttgtgaccagcctgggcaaaacagtaatacctccatctctacaggaaaaaaaaa

SEQ ID NO: 14217 - DNA, 201 bp, Homo sapiens
gccaagtcccagtgaaataatgctagagcctattagaatgccacaactccagtgaaaaatgtctggcctcttctacaacctgccggagttaccttcttggaaaaaaaaaaaaatctaaccatgccacccactcttgcataagacctttccttggttctcagctgttttgaagatgtggtctcagatcctcagcccaccatt

SEQ ID NO: 14218 - DNA, 201 bp, Homo sapiens
ccccaggtgccccatgcagatgtgtattttgtgcactgttctgtgtaggctacaaaggaaaaggcctagcacctgcccttggggagctcacccacccaggrtggacagaggtgtgcagacagagctgcagggtgggcacaaagggtccatctgctgaagtcctgcagatgcagccccgagcttgtccctcacgtcagcagc

SEQ ID NO: 14219 - DNA, 201 bp, Homo sapiens
tacttagcatgtccccatcctgtctgtttctctctcccatctcagggtgaccgaatcccaccatctgcacctgtacatgccagccgggatggcgttcatgsctgctgtcacctccgtggtctactatcacaacatcgagacttccaacttccccaagctgctaattggtaggtgaggtgtaggagggaggggcagtacctt

SEQ ID NO: 14220 - DNA, 201 bp, Homo sapiens
aaacgatctcattcagtgctcacaaaagctcaatgggctggtggcattgtcttcccccttcacggggtaagaagctgaggcctagagaggtaaggccattyacccacacagcggtagcaggtggagctaggcttcaggcccaggccgagccctgagcctgccctcttaactgttccactctgttccccgccacagggacct

SEQ ID NO: 14221 - DNA, 201 bp, Homo sapiens
ctccagaactttttcatcttcccaggttgaaactctgtactcattaaatgataactccccatttctccctccttacagcccctgacgaccaccattctacyttctatctatgaatttgagcactctaggtacctcatctaagcggcatcatgcactgtctttttttttttttttttttttgagatggagtcttgctctgtt

SEQ ID NO: 14222 - DNA, 201 bp, Homo sapiens
cacaccccactctccacacctctctatgcagcatttgtggctacagactgggtccaggggattgtaaaggcatgctcatgttgggttggagggagctcagratcttcctggaggatatggttcactcccatgagagctcagtatgcctttcctcccctgctgcagcccagagcgggagacagcgaccgacttggatatcag

SEQ ID NO: 14223 - DNA, 201 bp, Homo sapiens
catttctccctccttacagcccctgacgaccaccattctactttctatctatgaatttgagcactctaggtacctcatctaagcggcatcatgcactgtctttttttttttttttttttttgagatggagtcttgctctgttgcccaggttggagtgcagtggtgcaatctcggctcaccgcaacctctgcttctctggtt

SEQ ID NO: 14224 - DNA, 201 bp, Homo sapiens
taagcggcatcatgcactgtctttttttttttttttttttttgagatggagtcttgctctgttgcccaggttggagtgcagtggtgcaatctcggctcacygcaacctctgcttctctggttcaagcgattctcctgcctcagcctcctgagtaactgggactataggtacctgccaccacgcctggctaatttttgtatt

SEQ ID NO: 14225 - DNA, 201 bp, Homo sapiens
tgctctgttgcccaggttggagtgcagtggtgcaatctcggctcaccgcaacctctgcttctctggttcaagcgattctcctgcctcagcctcctgagtarctgggactataggtacctgccaccacgcctggctaatttttgtatttttagtagagacggggtttcaccatattggctaggctggtctcaaactcctgat

SEQ ID NO: 14226 - DNA, 201 bp, Homo sapiens
ggtacgcttcctgcagcccttcgtgaatctgctgtccaaaggcacctactggtggatgaacgccttcatcaagactgcccacaagaagcccatcgacttgygagccatcgggaagctgcccatcgccatgagggccctcaccaactaccaacggctctgcgaggcctttgacgcccaggtggtcagtgggggcacagccac

SEQ ID NO: 14227 - DNA, 201 bp, Homo sapiens
tctgattcctgcccttttgatgacccatccccgcagtcatggggagtgcccatttggatggaaaagccctcttcccaccctatgaccttcccggggtggawggatgcaccaccccgggaatcatatgggaaatatggaaccaaacaatagcagtagtaatagaaacttcaggctgggcgcaggggctcacacctgtaatcc

SEQ ID NO: 14228 - DNA, 201 bp, Homo sapiens
caactgtgcacttgctgattccatgatctcttcctggagttcacctatttgcagaggatgtgactgctgggtttccccagacaacaggagctaggggcatcctgggaggctaggcccagccgtgaattagccctcaggcactctgacctggccatggtctctctgggcagcggaaggacattcagggcactcaaggtgccc

SEQ ID NO: 14229 - DNA, 201 bp, Homo sapiens
cctatgaccttcccggggtggatggatgcaccaccccgggaatcatatgggaaatatggaaccaaacaatagcagtagtaatagaaacttcaggctgggcrcaggggctcacacctgtaatcccagcactttgggaggccaggacaagaggatcacttgagcccagaagtttaaggctgctgtgaaccatgatcatgccac

SEQ ID NO: 14230 - DNA, 201 bp, Homo sapiens
cttggcaataccttgtagttcaggacaatcctgaggaacacagaagtgctggcttccttgaggaatcagtgatcaggactctcgagccccttgaaccccakcatagggcgggagggggtgagggcagcaggggtgggtgtctgaattaatgtcaggtctacgtgatggtgtcatcaagtgttccagataaaaagttttatt

SEQ ID NO: 14231 - DNA, 201 bp, Homo sapiens
ccagataaaaagttttattgagccgggcgcggtggctaatgcctgtaatcccagcaccttgggaggccaaggcgggtggattgcttgagcccaggagttcragaccagcttggggcaacatggtgaaaccctatctctataaaaaaaaaaaaaaaattagccaggtatggtggcatgcacctgtggtcccagctactcagg

SEQ ID NO: 14232 - DNA, 201 bp, Homo sapiens
agattgtagtgagctgagatcgcgccactgcagtccagcctgggtgacagagcaagactccatctagaaggaaggaaggaaggaaggaaggagggagggarggaagggagggagggagggagggagggagaagaaagcttgagcctggatgaggtcacctggggagagaagagaaaggctctgggaccagagcttgaggtt

SEQ ID NO: 14233 - DNA, 201 bp, Homo sapiens
ctaatgcctgtaatcccagcaccttgggaggccaaggcgggtggattgcttgagcccaggagttcgagaccagcttggggcaacatggtgaaaccctatcwctataaaaaaaaaaaaaaaattagccaggtatggtggcatgcacctgtggtcccagctactcaggaggctgaggcaggaggatggcttgagccaggaagc

SEQ ID NO: 14234 - DNA, 201 bp, Homo sapiens
ggagggagaagaaagcttgagcctggatgaggtcacctggggagagaagagaaaggctctgggaccagagcttgaggtttgctaacatttagagagactcrggaaggactgcccacttagagcttctgagatgttaaatactgcaggactggggtcccaggcagaagcaacaggatgatggttggtgtttactgagcatgt

SEQ ID NO: 14235 - DNA, 201 bp, Homo sapiens
aagggagcctggggatggggtggcactttcggatactagctgtggcccatgcctggtggctgagcccagcccggcccccagcaccatcgctgatcccaaasaactggccagaccaagggaagatccagatccagaacctgagcgtgcgctacgacagctccctgaagccggtgctgaagcacgtcaatgccctcatctccc

SEQ ID NO: 14236 - DNA, 201 bp, Homo sapiens
ggtggattgcttgagcccaggagttcgagaccagcttggggcaacatggtgaaaccctatctctataaaaaaaaaaaaaaaattagccaggtatggtggcrtgcacctgtggtcccagctactcaggaggctgaggcaggaggatggcttgagccaggaagcagagattgcagtgagctgagatggtgccattgcacccca

SEQ ID NO: 14237 - DNA, 201 bp, Homo sapiens
caagcagccacccctggatgcaaaggttctgctagaacctgaactcataaaggtcttcctgtccttagtgccccaggaagccccctaaagggcagatgtgrgagctgggcatgaactggctcctaccagaggagagacagtacctgtgccaggtgcccagggcagaatcaggtgggcaccttcgccttatcctgaggtagt

SEQ ID NO: 14238 - DNA, 201 bp, Homo sapiens
ggtgtttcttgcactagtcacaggtctgcctttctgtagaaggtgggatctgagctccattaggattatccaggtgatccccctacccctagcccaggggyccccacatgagtatgaatgggagctgggggaagcaggttgagaggggagatgttaaatacaggcttcagagagccaccctgcttccatttctgaagtagc

SEQ ID NO: 14239 - DNA, 201 bp, Homo sapiens
caggagggttgcatcattctagtggtcaggctgattgctgatgcatgaaatcggcgggcacctgattcaagcagtgttatgataacacctcccagcccacrtgagtccagagtgtagctgtaagccttgacttgagggagcctctcacagccattctcatggatcacatttgccctcatgagctttggatccatgcacgcc

SEQ ID NO: 14240 - DNA, 201 bp, Homo sapiens
aagcacaagttatcacccgtggatggatttgtccttttctaaggaacaaagactaactccctccattccccttgttggagttatctccccttgaaaggacrctccacagagccagaaattctagaacagggaaaagtggaggggacgtgcctgtgaactgcagggacagaaggaaatgggtattgggagaatggccagccc

SEQ ID NO: 14241 - DNA, 201 bp, Homo sapiens
aggtttttgtaccagaggtgtcatcagaactaggactcaaaggaggggcaggagttcaccaggctgaggaattcctgaaaacttcagtgcccctgccatcrtctcactaccctgagtggtgatgttggggtggacaggagcatctgaggttgcctggggaatgagggaagctgttgtttcccactccccaagagtctgtct

SEQ ID NO: 14242 - DNA, 201 bp, Homo sapiens
cttgttggagttatctccccttgaaaggacactccacagagccagaaattctagaacagggaaaagtggaggggacgtgcctgtgaactgcagggacagarggaaatgggtattgggagaatggccagccctccaaggggctgatgtctggcctgggtatggagtcccacagaaaggggacctgtgatgcagcttacattg

SEQ ID NO: 14243 - DNA, 201 bp, Homo sapiens
gccccccaagccatcccatctgctccactcacagcacaagattaactcagtcctacttcatctccccgggctgttttcagatgccatcatcacagaaggcrgggagaatttcagccagggacagaggcagctgttctgcctggcccgggccttcgtgaggaagaccagcatcttcatcatggacgaggccacggcttccat

SEQ ID NO: 14244 - DNA, 201 bp, Homo sapiens
ggaagactttagtattgtcacagagcttttaaaaagctgagtggctgcagcatagtgtgtggggtgtttgtggcaggaattaggttggcaggagggggttyttcatcctataagcagtggaaggtcattaatattcttttttatttgtttttttttttttttttttttttttttgaggcagagtctcactttgtcacccag

SEQ ID NO: 14245 - DNA, 201 bp, Homo sapiens
gttggagttatctccccttgaaaggacactccacagagccagaaattctagaacagggaaaagtggaggggacgtgcctgtgaactgcagggacagaaggmaatgggtattgggagaatggccagccctccaaggggctgatgtctggcctgggtatggagtcccacagaaaggggacctgtgatgcagcttacattgtcc

SEQ ID NO: 14246 - DNA, 201 bp, Homo sapiens
ctccccttgaaaggacactccacagagccagaaattctagaacagggaaaagtggaggggacgtgcctgtgaactgcagggacagaaggaaatgggtattrggagaatggccagccctccaaggggctgatgtctggcctgggtatggagtcccacagaaaggggacctgtgatgcagcttacattgtcccgtgagggaac

SEQ ID NO: 14247 - DNA, 201 bp, Homo sapiens
cctttgaaattcaaggcctgggctgctctattgcagtacttagcatgtccccatcctgtctgtttctctctcccatctcagggtgaccgaatcccaccatstgcacctgtacatgccagccgggatggcgttcatggctgctgtcacctccgtggtctactatcacaacatcgagacttccaacttccccaagctgctaat

SEQ ID NO: 14248 - DNA, 201 bp, Homo sapiens
gcaaggggaagagtgggaggtgagggcaggcgtcaggagaggagcgagcaagagtcccaggctctgggcctgagagcctgggtgaactgtggcatcaatawctgatgtgacagaggagggggaggtgggctgtggtggggataaagttttctactgggggcatatcgagtttgagatgtcacagagacagccaactcaagt

SEQ ID NO: 14249 - DNA, 201 bp, Homo sapiens
tgcagcttacattgtcccgtgagggaaccatgatcctggaacccagatgaggccaaggaaatgttctctgaaaaagtcatatttgagctgagaactgaagraactaactgggagaagggaggaaagagtgcttcaggcagaggaaacagcatgtgcaaaggccccaaggcagaaggaacaaaacacattagaaaattcaga

SEQ ID NO: 14250 - DNA, 201 bp, Homo sapiens
tgatcctggaacccagatgaggccaaggaaatgttctctgaaaaagtcatatttgagctgagaactgaaggaactaactgggagaagggaggaaagagtgyttcaggcagaggaaacagcatgtgcaaaggccccaaggcagaaggaacaaaacacattagaaaattcagaagaagaagagtggcgtgggtgcaaagtgga

SEQ ID NO: 14251 - DNA, 201 bp, Homo sapiens
ccccaggtatacactgagagcccacacagcactgtgctcagcctggggttgtattgttcctgttcatcctccagatggggtcccctccacaagcttagacraacaggattctcctgtgactgtcctccttttgtgtgattttaatccctgctgcctctgtctttgtttgtactggtcagatggtccctagcgcctacacaa

SEQ ID NO: 14252 - DNA, 201 bp, Homo sapiens
acttgctgattccatgatctcttcctggagttcacctatttgcagaggatgtgactgctgggtttccccagacaacaggagctaggggcatcctgggaggmtaggcccagccgtgaattagccctcaggcactctgacctggccatggtctctctgggcagcggaaggacattcagggcactcaaggtgcccgggccatct

SEQ ID NO: 14253 - DNA, 201 bp, Homo sapiens
tctaagatgctgtcccccacccactgccaccacctcggtgcttctcccagccagacctccaactcagtctgctctcgctcactgccctctttgccgcctgsggatgcaggcaggaccctgctccctccctactggggctttctgtgccacttccagatttaacctggaccctgagaggaagtgctcagatagcacactgtg

SEQ ID NO: 14254 - DNA, 201 bp, Homo sapiens
gtgaaaatgcaagactagggcctatgattttccaaagcattttcttccaccaagtgtcaggttgtaggtccttggtcttttctctcttgccttggtacctkcagggtgctgaccagtgctatcatatcccctccccgtttcctaggaccctcttctcggtagactccaacagggcctgccttccttgggcagcatggcagg

SEQ ID NO: 14255 - DNA, 201 bp, Homo sapiens
acccagccccaggccggctcagttccatcagatctggagcacaaagaggagggggttgggggagaccaggatcccagaggtgtttcctgctcatgcccttytccatcccatcaggcccaggcagcctctggaaggggatcccccacccatgggtctaagatgctgtcccccacccactgccaccacctcggtgcttctccc

SEQ ID NO: 14256 - DNA, 201 bp, Homo sapiens
tgaaacactctgctctcatttctagaccaagatttacaataaaattatgcacctgtccacctccaacctgtccatgggagaaatgactgctggacagatcygtaatctggttgccatcgacaccaatcagctcatgtggtttttcttcttgtgcccaaacctctgggctatgccagtacaggtactagatgggctgagggg

SEQ ID NO: 14257 - DNA, 201 bp, Homo sapiens
gtagtctcagccactcaaaaggctgaggtaggaggatggcttgagcccaagagttcgagtccagcctgggcaacatagagagacctcatctctaacacaattttttttttgaaacatgaaaaatgaagatttctgaccatgcttctctcattagttaacactttgggctgtgagggtctgatgcagagagacacagcctgg

SEQ ID NO: 14258 - DNA, 201 bp, Homo sapiens
gttgctaatagtgctaactaatattaacagcccttgccctatgcctggccctgtcccagcccccctcccttgtataatttaacccttgcactgggggtagrgattttcatatctactgatttcttacctttgctcatttatcatggagtgtcctttggttttctgtgtttgtatatacctttaccacttatagatttgacc

SEQ ID NO: 14259 - DNA, 201 bp, Homo sapiens
agacggagcagaagcctctcccctctgactcggggacccctgcaggagtattccaatgagcggctgaagcagaccaacgagatgctccgcggcatcaagcygctgaagctgtacgcctgggagaacatcttccgcacgcgggtggagacgacccgcaggaaggagatgaccagcctcagggcctttgccatctatacctcc

SEQ ID NO: 14260 - DNA, 201 bp, Homo sapiens
tggagcagctgctttgaggagaaaatgtatagcttttgacacaacaggaagatccagaaaattatcattgaacatattaaaggttatttctttttcttgcaaaacacacacacacacacacacacacacacacacacgcgaacacacgcagctgatgattctactctcccagccccagccctgaaggggacccagaactcc

SEQ ID NO: 14261 - DNA, 201 bp, Homo sapiens
gcagctgctttgaggagaaaatgtatagcttttgacacaacaggaagatccagaaaattatcattgaacatattaaaggttatttctttttcttgcaaaacacacacacacacacacacacacacacacacacgcgaacacacgcagctgatgattctactctcccagccccagccctgaaggggacccagaactccctgc

SEQ ID NO: 14262 - DNA, 201 bp, Homo sapiens
caattatcctggcttcctcagcctcccaagtagctgggattacaggtgtgcaccaccatgcccagctactaatttttgtattattagtagagacagaattycaccatgttggccaggctggtcttgaactcttgacctcaggtgatccgcccgcctcagcctcccaaagtgctgggattacaggggtgagtcaccgcatcc

SEQ ID NO: 14263 - DNA, 201 bp, Homo sapiens
ttttgacacaacaggaagatccagaaaattatcattgaacatattaaaggttatttctttttcttgcaaaacacacacacacacacacacacacacacacrcacgcgaacacacgcagctgatgattctactctcccagccccagccctgaaggggacccagaactccctgcacaaaggctgtccttcaaggggagggtga

SEQ ID NO: 14264 - DNA, 201 bp, Homo sapiens
agtgacaagtgcaaagtcctctgatagggatagatttggcaaagatgtcactgtgggcaaagccaaatgagcaaggggaagagtgggaggtgagggcaggmgtcaggagaggagcgagcaagagtcccaggctctgggcctgagagcctgggtgaactgtggcatcaataactgatgtgacagaggagggggaggtgggct

SEQ ID NO: 14265 - DNA, 201 bp, Homo sapiens
tgtgggccagctgaggcgtgcatgttaaagggtgtgcaggggctagggggtaggggagcatgagcttgtgggacatgttggctcctggggctccagccttygcagcccttgtgtgtgtctggtgacgtgtgcatgagttgcagggctggagtggaggcctggctgagctgctctctgccccgaaaaggagtgaggtagaac

SEQ ID NO: 14266 - DNA, 201 bp, Homo sapiens
gggatgctatgaagaaaatcaagctgagtaaggggtaggggcaatgacaatgttgctatctacacaggatggtcagggaagggctgtggtaactgtgggcmtgcagatatttgggggaaggtattccctgcaaggggagtgacaagtgcaaagtcctctgatagggatagatttggcaaagatgtcactgtgggcaaagcc

SEQ ID NO: 14267 - DNA, 201 bp, Homo sapiens
ggggcccatctttcctctccttctattgccttcccccagtgctgccctcaggccttgtcttctcactcatccaccaaggagaccgacactctggactcccscagctcacacgggctttgtcagggcctccctctctgcgaatggtcaggggctttccctagggcactgccccgagcttcagggcagggacctgggggcaga

SEQ ID NO: 14268 - DNA, 201 bp, Homo sapiens
agtggcgtgggtgcaaagtggaggggagctggactttgggttttgtttgcttgtgcccaggctggagtgcagtggcaccaccttgggtcactacaacctcygcttcctgggttcaagcggattcttgtgcctcagcctgctgagtagctgggaatacaggcgtgtaccaccacactcagataattttttgtatttttagaa

SEQ ID NO: 14269 - DNA, 201 bp, Homo sapiens
gggagcaaatctcaatgcaccaacttggatcacattcccatccccaccccactgtgatcagaggggtggcatacactggctggctaggcctggatcatgtstccatctccatccctcaagcaggggcattcagaagtggaaaggtggtccttcagagggaaagcacagtgcatgagtcacaggtcagccaggtggtgtctg

SEQ ID NO: 14270 - DNA, 201 bp, Homo sapiens
tttagaagagttgggatttcaccctgttgaccatgctggtcttgaactcctggccttaagtgatcaggtctcaacttcccaaagtgttgggattacagccrtgagccaccgcacccacctggaaggtcataccacagatgtttgcctttatcccaacagcaatgggaagttgtgtgtgtgtgtgtgtgtgtgtgtgtgtgt

SEQ ID NO: 14271 - DNA, 201 bp, Homo sapiens
gtggggagggcatcatatcagagagccctgaatgccagagcaaggagtttggtttatgcccatggacaaaaagggagaagggttttgagcaagaaagcgamttgacaagttcagtatttggtggagatgactataagcaagtgcaggatggagcaaaaggggaggctgagcctttcaggtgggagactcagcctctcagaa

SEQ ID NO: 14272 - DNA, 201 bp, Homo sapiens
ttcaccctgttgaccatgctggtcttgaactcctggccttaagtgatcaggtctcaacttcccaaagtgttgggattacagccgtgagccaccgcacccasctggaaggtcataccacagatgtttgcctttatcccaacagcaatgggaagttgtgtgtgtgtgtgtgtgtgtgtgtgtgtgtgtgtgtgtgtgtggttt

SEQ ID NO: 14273 - DNA, 201 bp, Homo sapiens
tgaactcctggccttaagtgatcaggtctcaacttcccaaagtgttgggattacagccgtgagccaccgcacccacctggaaggtcataccacagatgttkgcctttatcccaacagcaatgggaagttgtgtgtgtgtgtgtgtgtgtgtgtgtgtgtgtgtgtgtgtgtggtttaacatgtttaacataaaatttatca

SEQ ID NO: 14274 - DNA, 201 bp, Homo sapiens
gcaggaagagtaagtccctgcctaagtcatagggttgtaatgaagagcaaagcagaccatatctgttaagtgttagggacaagacaagcatgaggcatatyttcaagtctcggctcctgtaggcagctctcactaagggctaaagggcttctgatgcctgggatagaatctgtccggcagagtggagtggaggcaggggga

SEQ ID NO: 14275 - DNA, 201 bp, Homo sapiens
gccgggcatggtggctcatgcctgtaatcccagcaccttggcaggccaaggcaggtgaattgcttgagctcagaagttcgagaccagcctggccaacatgscaaaaccccgtctctacaaaaaacataaaaattagctgggcgtggtaatgtacacctgtagttccagctacttgggaggctgaggtgggagtatcatggg

SEQ ID NO: 14276 - DNA, 201 bp, Homo sapiens
acagagtgagaccctgtctcaaaaaaagaaaaaaaaagtatattcacagtgctgtgtagccatcaccactatccatctccagaactttttcatcttcccargttgaaactctgtactcattaaatgataactccccatttctccctccttacagcccctgacgaccaccattctactttctatctatgaatttgagcactc

SEQ ID NO: 14277 - DNA, 201 bp, Homo sapiens
ccagcagtcttaggtttacattctcccagctcaacaactctgccagaaaaaaagtgcctctttccccatagttcagcaaaagtcccagggctgagtctcaytggtccagtttggtcatgtgcccacccctgaacaaatcactgtggccagcggtgtggaatgtgaggattggcctgtcctgggtcacgtgccactttggga

SEQ ID NO: 14278 - DNA, 201 bp, Homo sapiens
gtggtgcaatctcggctcaccgcaacctctgcttctctggttcaagcgattctcctgcctcagcctcctgagtaactgggactataggtacctgccaccaygcctggctaatttttgtatttttagtagagacggggtttcaccatattggctaggctggtctcaaactcctgatcttgtgatctgcccacctcggcctcc

SEQ ID NO: 14279 - DNA, 201 bp, Homo sapiens
gaaatttcaggatagacactgcatctggcccacgtgtgctctaccccagggtcccagagggagaggggggtgatgggtgtgttcgctgaggttggcggatractttccgtagaaagggaagataagcatcaggcactggcctctcctactttctttcttcgggggtgggggactttgctttaatgtattcatatcgtcacg

SEQ ID NO: 14280 - DNA, 201 bp, Homo sapiens
gtcagaaaaccaggccaaaaagataccctgtgacctcccacacctgcacacacacccagagctagcatagaggctattcccagcagccccagagtcccagyggcggtgcctgcttctctctttccagatcgggatctgcggccgcaccggcagtgggaagtcctccttctctcttgccttcttccgcatggtggacacgtt

SEQ ID NO: 14281 - DNA, 201 bp, Homo sapiens
ggacctgggggcagacagcgaggccacccttgtattgagggtgagcccctgcctatggccctggcccagctctcctctcgtttcccactctgtctctttgyctctgtctcactttgctgtggctgtccatgtcattctctgaccttgggatgtacctctgtccctgcctctctcatccttctatgtcactatctgtctccg

SEQ ID NO: 14282 - DNA, 201 bp, Homo sapiens
  misc_feature (1)...(201): n = A,T,C or G, or insertion/deletion polymorphism (see Tables 1-2)
aaagaactggccagaccaagggaagatccagatccagaacctgagcgtgcgctacgacagctccctgaagccggtgctgaagcacgtcaatgccctcatcncccctggacagaaggtcagagcacgggcccaacccaatgctgcaggacaggcgtgagcaggggatggggcatgcacggagctggatggcttcgcagtcac

SEQ ID NO: 14283 - DNA, 201 bp, Homo sapiens
ttgacacaacaggaagatccagaaaattatcattgaacatattaaaggttatttctttttcttgcaaaacacacacacacacacacacacacacacacacrcgcgaacacacgcagctgatgattctactctcccagccccagccctgaaggggacccagaactccctgcacaaaggctgtccttcaaggggagggtgaaa

SEQ ID NO: 14284 - DNA, 201 bp, Homo sapiens
aactcctggtctcaggctattttccacaaagagctgggggcctctgtggggtgaagaagacttaggacaccatggggcaccattatgaggccatttcctcytaggagaaaaaaaatctctgggctctgaaaggagtagaattagggtaggaaattaagagaggctaccgaccacctcctccaactaaaattggttcttttg

SEQ ID NO: 14285 - DNA, 201 bp, Homo sapiens
tgacacaacaggaagatccagaaaattatcattgaacatattaaaggttatttctttttcttgcaaaacacacacacacacacacacacacacacacacasgcgaacacacgcagctgatgattctactctcccagccccagccctgaaggggacccagaactccctgcacaaaggctgtccttcaaggggagggtgaaag

SEQ ID NO: 14286 - DNA, 201 bp, Homo sapiens
gctatgcctagtgatgtccatgaagttgtggtaaaatcctgaagctaccttgttctttggaaatgttcctcagaatcattaacattagtcatgtgggagayaggagaagaagctctgcagaaaagggaccgagaggacaaggatatagcttgggctggggacaatgtcagagtccaaactctggctatcttggaatagtct

SEQ ID NO: 14287 - DNA, 201 bp, Homo sapiens
cctctcccctcccctctgcccctggcaggggtgaggggtgtctctgtgcttcccgagcagcgtgcaaaagctaagcgagttcctgtccagtgcagagatcygtgaggagcagtgtgccccccatgagcccacacctcagggcccagccagcaagtaccaggcggtggtgagtgcccggcctccccttgctactcccagcat

SEQ ID NO: 14288 - DNA, 201 bp, Homo sapiens
gacataaaaaaggttgagttcgtgtcctttgcagggacatggatgaagctggaaactatcattctcagcaaactcacacaggaacagaaaagcaaataccrcatgttctcactcataagtgggagttgaacaatgagaacacatggacacagggaggggaacatcacacactggggcctgtctgggggtggggggcaaggg

SEQ ID NO: 14289 - DNA, 201 bp, Homo sapiens
gagatacatgtgcagagtgtgcaggtttgttacatagctatacatgtgccatggtgctttgctgcacctatcaacctgtcatctttttaagccccacatgyattaggtatttgtcctaatgctctccctcctcttgcctcccaccccccgacaggctcggtgtgtgatgttcccctccctgtgtccacgtgttctcattgt

SEQ ID NO: 14290 - DNA, 201 bp, Homo sapiens
ctgcacctatcaacctgtcatctttttaagccccacatgcattaggtatttgtcctaatgctctccctcctcttgcctcccaccccccgacaggctcggtrtgtgatgttcccctccctgtgtccacgtgttctcattgttcaactcccacttatagtgagcacatgtggtggttggttttctgttcctgcctaagcactt

SEQ ID NO: 14291 - DNA, 201 bp, Homo sapiens
gtccacagtgacgtattcactcacccagttgagcgcctagtgtatactagaccctgtgacagcaacaggagtgcaaaggtgactaagacgtggcccctgctttttttttttttttttttttttgagacggagtctcgccctgttgcccaggctggagtgcagtggtgcgatctcagctcctcacaagctctgcctcctagg

SEQ ID NO: 14292 - DNA, 201 bp, Homo sapiens
ctgaggcaggaggatggcttgagccaggaagcagagattgcagtgagctgagatggtgccattgcaccccagcctaggcaacagagtgagaccctgtctcaaaaaaaaaaaaaaaaaaagatttattgattccaaagaggcatggccacacacacttagaccagcaggtgctttgctaagccctgatggaggctgccagac

SEQ ID NO: 14293 - DNA, 201 bp, Homo sapiens
atccactccttctcgtctgccttccttttctccattgaggtccaagtgactattggctttggggggcgcatggtgactgaggagtgcccactggccatccygatcctcatcgtgcagaacatcgtggggctcatgatcaacgccatcatgcttggctgcatcttcatgaagactgcccaagcccaccgcagggctgagacc

SEQ ID NO: 14294 - DNA, 201 bp, Homo sapiens
cccccaccaaccatatatcctgaagacattgcccaggccacatctgtcttttaggagactgtcacagagagaaaagccacagagccaccccagggcctatytcgtgccatgtcctcgagggatggccttctgcaggatgaggaagaggaggaaggtacaggcaatgggactgggagtgaaattatggcctgaggtctgatc

SEQ ID NO: 14295 - DNA, 201 bp, Homo sapiens
ctcagtcctacttcatctccccgggctgttttcagatgccatcatcacagaaggcggggagaatttcagccagggacagaggcagctgttctgcctggccygggccttcgtgaggaagaccagcatcttcatcatggacgaggccacggcttccattgacatggccacggttggtcctgggcccctccatgggaccatggt

SEQ ID NO: 14296 - DNA, 201 bp, Homo sapiens
atcattgatggcattgacatcgccaaactgccgctgcacaccctgcgctcacgcctctccatcatcctgcaggaccccgtcctcttcagcggcaccatccrgtgagccccaccacccctcaggcccacccagccccaggccggctcagttccatcagatctggagcacaaagaggagggggttgggggagaccaggatccc

SEQ ID NO: 14297 - DNA, 201 bp, Homo sapiens
agtcaccgccttcccctgcaccctcactgggacccatgcagggcacatcatcattgatggcattgacatcgccaaactgccgctgcacaccctgcgctcaygcctctccatcatcctgcaggaccccgtcctcttcagcggcaccatccggtgagccccaccacccctcaggcccacccagccccaggccggctcagttcc

SEQ ID NO: 14298 - DNA, 201 bp, Homo sapiens
catgatctcttcctggagttcacctatttgcagaggatgtgactgctgggtttccccagacaacaggagctaggggcatcctgggaggctaggcccagccrtgaattagccctcaggcactctgacctggccatggtctctctgggcagcggaaggacattcagggcactcaaggtgcccgggccatctggcaggcactca

SEQ ID NO: 14299 - DNA, 201 bp, Homo sapiens
gccccagagtcccagcggcggtgcctgcttctctctttccagatcgggatctgcggccgcaccggcagtgggaagtcctccttctctcttgccttcttccrcatggtggacacgttcgaaggtgagttgtaaggcgggcaccccacgtgtacccacagccaccagatgaggcctcagccctggcacgtggtcagacatgac

SEQ ID NO: 14300 - DNA, 201 bp, Homo sapiens
acacctgcacacacacccagagctagcatagaggctattcccagcagccccagagtcccagcggcggtgcctgcttctctctttccagatcgggatctgcsgccgcaccggcagtgggaagtcctccttctctcttgccttcttccgcatggtggacacgttcgaaggtgagttgtaaggcgggcaccccacgtgtaccca

SEQ ID NO: 14301 - DNA, 201 bp, Homo sapiens
catgcctggtggctgagcccagcccggcccccagcaccatcgctgatcccaaagaactggccagaccaagggaagatccagatccagaacctgagcgtgcsctacgacagctccctgaagccggtgctgaagcacgtcaatgccctcatctcccctggacagaaggtcagagcacgggcccaacccaatgctgcaggacag

SEQ ID NO: 14302 - DNA, 201 bp, Homo sapiens
gccctaggccacgtccgaggggtgcctccgatgggggaagcccctccctgggggtcaccggagccatgctgtcccgcaagggcatcatccccgaggaatamgtgctgacacgcctggcagaggaccctgccgagcccaggtaccgtgcccgccagcggagggcccgctttgtgtccaagaaaggcaactgcaacgtggccc

SEQ ID NO: 14303 - DNA, 201 bp, Homo sapiens
cctgagcgcccaggtcagctcctctccctccccaggagtacatcggtgcatgtgtggtgctcatcgcagcggtgacctccatctccaactccctgcacagrgagctctctgctggcctggtgggcctgggccttacctacgccctaatggtgagcggcagtgggctagggcagaggaggggtcagacaccagcactcccgg

SEQ ID NO: 14304 - DNA, 201 bp, Homo sapiens
ccaacttccccaagctgctaattggtaggtgaggtgtaggagggaggggcagtaccttcattcatttcttcagataatgtttactgaggactcattatgtrccagctattgctctaaacagtagagatttggaatagaaaaagaaaaaaatccctgccttcatggagcttacagtctggtgaaggaggatagacaggcaaa

SEQ ID NO: 14305 - DNA, 201 bp, Homo sapiens
catacctcacatggtattataattatttgctaatgcgtctgtctcctccatgactctgagctccttgagggattattccatgttgtaccccaggtgccccmtgcagatgtgtattttgtgcactgttctgtgtaggctacaaaggaaaaggcctagcacctgcccttggggagctcacccacccaggatggacagaggtgt

SEQ ID NO: 14306 - DNA, 201 bp, Homo sapiens
tgtgtggttagctcatttaattgttaccatggccctttaaagtgagcgtctgcacatccaagtaaagattgttttctcctccctaagtgggtgtaatttgyccatccccacccatgagttcagctccctgccctcccctcactctctctccctcagccagcctcaggttttgacactgggggaacaggtagctgttctatt

SEQ ID NO: 14307 - DNA, 201 bp, Homo sapiens
tctgttccccgccacagggacctgcagcagctggatgacaccacccagcttccacttctctcacactttgccgaaaccgtagaaggactcaccaccatccrggccttcaggtacgagtccacattcccccaaggtaggagtggaacaggggtggggccagggggcacaggccatgagatttgattctcaggactccacttg

SEQ ID NO: 14308 - DNA, 201 bp, Homo sapiens
aactggcatttactcagccagatactgtgataggcattgtgtgtggttagctcatttaattgttaccatggccctttaaagtgagcgtctgcacatccaastaaagattgttttctcctccctaagtgggtgtaatttgcccatccccacccatgagttcagctccctgccctcccctcactctctctccctcagccagcc

SEQ ID NO: 14309 - DNA, 201 bp, Homo sapiens
agtgagagcaaaacatggcggccagtagcactctaaacacagtcaataccaaaattcacctcactctctccccctcgtctccctcagcacatcccatccaygctggagtgcctgagccgctccaccctgctctgtgtctcagccctggccgtcatctcctatgtcacacctgtgttcctcgtggccctcttgcccctggcc

SEQ ID NO: 14310 - DNA, 201 bp, Homo sapiens
ctttcgtgggccacgtcagcttcttcaaagaggccgacttctcgccctccgtggcctttgcctccctctccctcttccatatcttggtcacaccgctgttsctgctgtccagtgtggtccgatctaccgtcaaagctctagtgaggtgaggggagggtccgggcgagggcactgggcaggcaggtcctgtgtcagcctcaa

SEQ ID NO: 14311 - DNA, 201 bp, Homo sapiens
gtaggtactgggttaggaaacagcttgggcaaatgcatggggaaatgagagatgtcaagatgcattctaatggcagcctcttgaagatcttaagttgtttytggttcactcatttcgcaaatgaattcatttagcaaaagcactatggatacagtgcttacctctaggaagtaagttttagcccaaatgctgcagaaggat

SEQ ID NO: 14312 - DNA, 201 bp, Homo sapiens
ctggtgtggtgatgatgatgagaatgatgatgaatgtgaaacactctgctctcatttctagaccaagatttacaataaaattatgcacctgtccacctccracctgtccatgggagaaatgactgctggacagatctgtaatctggttgccatcgacaccaatcagctcatgtggtttttcttcttgtgcccaaacctctg

SEQ ID NO: 14313 - DNA, 201 bp, Homo sapiens
acactaagcagatttctaccaactgcacctccccatccccttgcctccatctgagccatcagcttgacaactgcctctgagaacaagcccctgagaatgcyttccgcaccccctactcccgccctgctttttccaggaagagaggccccgtggcctatgcttcgcagaaaccatggctgctaaatgccactgtggaggaga

SEQ ID NO: 14314 - DNA, 201 bp, Homo sapiens
gtcaagttcttggaccacgccatcggcttctcgcagctacgcttctgcctcacagggctgctggtgatcctctatgggatgctgctcctcgtggaggtcartgtcatcagggtgagggtaagcaggccacctgggccagggtggggtgggaagcagaggctctggcctctgtcctgccctgggttcaggcccccaccctgc

SEQ ID NO: 14315 - DNA, 201 bp, Homo sapiens
agcactggatggctttatgcatgctgggcatttcagggagaccctgtacaggccaggggtttggtatcacctagacccacagacactccccatcctggccygggccccccatggtacactcaaggctggcaccaagaagtctcaggaataatcaagtgctcacttctcaccttctgattcctgcccttttgatgacccatc

SEQ ID NO: 14316 - DNA, 201 bp, Homo sapiens
tttgtcaagttcttggaccacgccatcggcttctcgcagctacgcttctgcctcacagggctgctggtgatcctctatgggatgctgctcctcgtggaggwcaatgtcatcagggtgagggtaagcaggccacctgggccagggtggggtgggaagcagaggctctggcctctgtcctgccctgggttcaggcccccaccc

SEQ ID NO: 14317 - DNA, 201 bp, Homo sapiens
gcacctggaggagagacggggcgggggtggccaggacctgagctggagcctgggagcccgaaggccagacaggtgaggcgggagacccggaggtgggggtsaggtccggttagtgggagagatccggaggtgttaagttctgagctgggctgggaaggcaggctgggcggggagaagggctcttagcgggaggcccagggg

SEQ ID NO: 14318 - DNA, 201 bp, Homo sapiens
tcctgcctctgactgtctctccctgcaggatggggaagtcagagctccaaggtgcacatccaccacagcacatggcttcatttccctgggcacaacctgcrgtggatcctgaccttcatgctgctcttcgtcctggtgtgtgagattgcagagggcatcctgtctgatgggtgagtgactgtctgaggactcaggaaagtg

SEQ ID NO: 14319 - DNA, 201 bp, Homo sapiens
ggctgctctattgcagtacttagcatgtccccatcctgtctgtttctctctcccatctcagggtgaccgaatcccaccatctgcacctgtacatgccagcygggatggcgttcatggctgctgtcacctccgtggtctactatcacaacatcgagacttccaacttccccaagctgctaattggtaggtgaggtgtaggag

SEQ ID NO: 14320 - DNA, 201 bp, Homo sapiens
cagagtgtgcaggtttgttacatagctatacatgtgccatggtgctttgctgcacctatcaacctgtcatctttttaagccccacatgcattaggtatttktcctaatgctctccctcctcttgcctcccaccccccgacaggctcggtgtgtgatgttcccctccctgtgtccacgtgttctcattgttcaactcccact

SEQ ID NO: 14321 - DNA, 201 bp, Homo sapiens
ttctcatgatgtgttgttgctttaaaatagtggactccagtctccagagctgcgtctctgcagaggacagtgggacagaagaatcccagggcatgttaaamaggaccgggtcttcctaaacccacatgcctatatttctgacccagtaccagccaggggggcaagtttccatcccccacaagtcacaaacctgtaactgac

SEQ ID NO: 14322 - DNA, 201 bp, Homo sapiens
aatctgctgtccaaaggcacctactggtggatgaacgccttcatcaagactgcccacaagaagcccatcgacttgcgagccatcgggaagctgcccatcgycatgagggccctcaccaactaccaacggctctgcgaggcctttgacgcccaggtggtcagtgggggcacagccacaccatctattcactgccttctggtt

SEQ ID NO: 14323 - DNA, 201 bp, Homo sapiens
atctgctgtccaaaggcacctactggtggatgaacgccttcatcaagactgcccacaagaagcccatcgacttgcgagccatcgggaagctgcccatcgcyatgagggccctcaccaactaccaacggctctgcgaggcctttgacgcccaggtggtcagtgggggcacagccacaccatctattcactgccttctggttt

SEQ ID NO: 14324 - DNA, 201 bp, Homo sapiens
cccatctagaccatgttggtgttgatagggccctcccaactgtgcacttgctgattccatgatctcttcctggagttcacctatttgcagaggatgtgacygctgggtttccccagacaacaggagctaggggcatcctgggaggctaggcccagccgtgaattagccctcaggcactctgacctggccatggtctctctg

SEQ ID NO: 14325 - DNA, 201 bp, Homo sapiens
ccatctagaccatgttggtgttgatagggccctcccaactgtgcacttgctgattccatgatctcttcctggagttcacctatttgcagaggatgtgactrctgggtttccccagacaacaggagctaggggcatcctgggaggctaggcccagccgtgaattagccctcaggcactctgacctggccatggtctctctgg

SEQ ID NO: 14326 - DNA, 201 bp, Homo sapiens
tcttccagcccaaggtaggcagccccaggggtagggtaaggcaccctctagatggttttcagttgtttctgagagtgcaacaggccaatgtgtgtgagccrtggccacactggagtggctcctcacacatgcgcaaagcccatagcagtatccccaccacagaatactctacatctggtcaacagaaatgccagagggcga

SEQ ID NO: 14327 - DNA, 201 bp, Homo sapiens
cgccccttgggagcatcctgaacagattttcatctgactgtaacaccatcgaccaggtacagaggaccgtgccacactatccccccttccagagacacctmggacccctgggggcttctcctgtctgaggctgggttccccagatcaggtgatcacagccctctgggaagaagccagtgtccccgatccgattataatgct

SEQ ID NO: 14328 - DNA, 201 bp, Homo sapiens
ctgactgtctctccctgcaggatggggaagtcagagctccaaggtgcacatccaccacagcacatggcttcatttccctgggcacaacctgcggtggatcstgaccttcatgctgctcttcgtcctggtgtgtgagattgcagagggcatcctgtctgatgggtgagtgactgtctgaggactcaggaaagtgaatctgct

SEQ ID NO: 14329 - DNA, 201 bp, Homo sapiens
gccacattttgtttatctattcgtctgtcagtgggttgcttccacctcttgactcttgtaaatagcactgctatgaacatgggtgcattgaggggttttcracataatcataataattgctttatggagaccagcttggaggagaacaagatggggaggaagtgtggaaaccaatgagaaggctctcagggtatagcggga

SEQ ID NO: 14330 - DNA, 201 bp, Homo sapiens
tgactgtctctccctgcaggatggggaagtcagagctccaaggtgcacatccaccacagcacatggcttcatttccctgggcacaacctgcggtggatcckgaccttcatgctgctcttcgtcctggtgtgtgagattgcagagggcatcctgtctgatgggtgagtgactgtctgaggactcaggaaagtgaatctgctc

SEQ ID NO: 14331 - DNA, 201 bp, Homo sapiens
tcagggcactcaaggtgcccgggccatctggcaggcactcagccatgccttcgggaggcgcctggtcctcagcagcactttccgcatcttggccgacctgmtgggcttcgccgggccactgtgcatctttgggatcgtggaccaccttgggaaggagaacgacgtcttccagcccaaggtaggcagccccaggggtagggt

SEQ ID NO: 14332 - DNA, 201 bp, Homo sapiens; identical to SEQ ID NO: 1230

SEQ ID NO: 14333 - DNA, 201 bp, Homo sapiens; identical to SEQ ID NO: 1231

SEQ ID NO: 14334 - DNA, 201 bp, Homo sapiens; identical to SEQ ID NO: 1233

SEQ ID NO: 14335 - DNA, 201 bp, Homo sapiens
ggttgccatcgacaccaatcagctcatgtggtttttcttcttgtgcccaaacctctgggctatgccagtacaggtactagatgggctgaggggaagggagrggggcagcaggacacacaaccagaatctgctggtccatggccagtaactaggagcacaccgtcttccactccatgcttgcctgtacctttcacacacttg

SEQ ID NO: 14336 - DNA, 201 bp, Homo sapiens
cttgccaaggggctgaatgtgaatccaggtgattcctgggtgagaaactgggtaaagggaggtgccccttattataatgggaaagacctagagaaaatggrtcttggggtgaaaacaagagtttggaggaggtggggattctggacaggtttgaataagcagaaaggagtggggtggacattccagagagggatagcttac

SEQ ID NO: 14337 - DNA, 201 bp, Homo sapiens
accagcagcccccatgttatgcctctttccttccttttccctcttctctcatcaggcattcagcttttgctgagtacttctgtgtctgacaacaggctgarcactcagcactgcaggacaggactatgcaaaaaacctctgggcctagtcctgggtgcactgctaattccctgtgtgaccttgcacaagacatccaagctc

SEQ ID NO: 14338 - DNA, 201 bp, Homo sapiens
gagaaaaaatcacgaaaaatacagtaccacgtgcagtacacactgattccatctattctttttttttctttttcctcaaatgcacttgccgcctacttatkccagacccaatgattgggtccctatccacagtttggaaaacactataagaaatgattgtgtcctctcactttccctctctgggatttagttttccaacta

SEQ ID NO: 14339 - DNA, 201 bp, Homo sapiens
ctgcagacacgtcaccctcccacacgtctccaccctgggggtgtgcagtagcatgctctctcccacctcagaacctcccttcagtcccctcagacacatgmcctctctccacgcagagacaatcaaagctgaactaacaccttccagggtgaaaagcaaatgcccagtaaggtacgtcttgggtgcctccgtgtcccctga

SEQ ID NO: 14340 - DNA, 201 bp, Homo sapiens
tggagggagctcaggatcttcctggaggatatggttcactcccatgagagctcagtatgcctttcctcccctgctgcagcccagagcgggagacagcgacygacttggatatcaggtactgcgtcctgggaacattgccccccagggtcaactccctccagggtgctctcaggcccaagggagccacatcaccctgctggg

SEQ ID NO: 14341 - DNA, 201 bp, Homo sapiens
atgaaaggctttttaatcaaccccatacacatttaatgcattggctttaatccagcagcctgttgagagctattagcacttattgattgcccacttactgyatgccaggcaccgtgctaagtgttgtatgtgcattattacatttaatcctcacaaggaccacataacataggtacgaatcgccacattctccagatgcag

SEQ ID NO: 14342 - DNA, 201 bp, Homo sapiens
cctctctcaattggtgtctcagagggccctggggtagagagatggtgactcttctagagtgggccacagccccttgtgtgcagatcccagcttcctgtaarcagcctcagatcaggccaaacctgtggtcagccagagccactgctacccagtgaggtcttccacaccctactgacacggtgaatgatttttaaatttgaa

SEQ ID NO: 14343 - DNA, 201 bp, Homo sapiens
ctgaagtccagcttcagccctggagaggtatccaggcccctctgcccaccctggagcacctagggccagtggaaatccacctcttagggatcttgtctaaktaaagaagagcagagcaaagctctgccctggccttggcgctgctccctggacatcccttgcccctggacaagcctatgctgtgtcttccacaaagaagct

SEQ ID NO: 14344 - DNA, 201 bp, Homo sapiens
aaggtgggcgcaggacactacctgaagcttcaccccaagagatgagggccagctccactcttcccagtcaccgcctgtgggggagggaggctggacagggsatgaaggcagagcctggtggtctgcccctcccatctaggggtggcgcacagaaagggagactccaggccacagctcacttacaccccagaataaccttgc

SEQ ID NO: 14345 - DNA, 201 bp, Homo sapiens
gtgctctttcctctgcagcttactgactataaaggttggagtgttcacttgatttggagcaggggtgttagtggcctgatccttatggtaactctatgagytgagccagacaggaatctccccatatcactgaggagcaaattgaggccctgagaaaggctgtgacctgcccagagctggccacagctggcaggcggcaga

SEQ ID NO: 14346 - DNA, 201 bp, Homo sapiens
gcccaggtggtcagtgggggcacagccacaccatctattcactgccttctggtttagggtcacagagagggacctcaaagggcattaggtcaaaatcctgrtgggacaagaggggaaactgaggctggtgaggggaagaagcttgccttaagtcacacagtgaaccagggacaggtgcagggctgaggattcataggacag

SEQ ID NO: 14347 - DNA, 201 bp, Homo sapiens
attccaatgagcggctgaagcagaccaacgagatgctccgcggcatcaagctgctgaagctgtacgcctgggagaacatcttccgcacgcgggtggagacracccgcaggaaggagatgaccagcctcagggcctttgccatctatacctccatctccagtgagttcaccccacacagccagccctgggtgctgctgcgta

SEQ ID NO: 14348 - DNA, 201 bp, Homo sapiens
ccaatgcctacgtcttagctgtgcttctgttccttgccctcctactgcaaaggacatttctgcaagcatcctactatgtggccattgaaactggaattaayttgagaggagcaatacaggtacttggatgattattttttcactttgccataagaaccattattaggaataatgtccatgagtgttattcatcctcatgga

SEQ ID NO: 14349 - DNA, 201 bp, Homo sapiens
ttttgctggcaatgacagtcacctctgaacttctctttccaacagacacaatttctcggggtttactttgtctcatcccaagagttccttgccaatgcctrcgtcttagctgtgcttctgttccttgccctcctactgcaaaggacatttctgcaagcatcctactatgtggccattgaaactggaattaacttgagagga

SEQ ID NO: 14350 - DNA, 201 bp, Homo sapiens
tcttcccatctgacccccgactgataacagtgacagaactaggcctttctttcgggttctaacacagagaaaaggcaaaaggcacagatacacaggtttcsccaaaggtctgttctttgggccttgcgctccttcctcaggagccaaagtctcagaagcagaaaaatcctcgatacccccaggatccctttgggaagtggt

SEQ ID NO: 14351 - DNA, 201 bp, Homo sapiens
gcctcggccttgctgacagcgtgctggagaggctcaccaggctcagcagcctcagggcaggctcagtgaagcttgtaggcaaaggggctgaaggggtcttycttttgtgttcccctgactgttcctaagaacatgtgcatttatgcttcataccctaactaggaaagttctccttaaatctaacccccaaatcccatcttc

SEQ ID NO: 14352 - DNA, 201 bp, Homo sapiens
gcccccaccgcgggtggtattcccaccatcctgacccgccccctcctgccctgcccagcatcgagtgcacaccatcctgagtgcagacctggtgatcgtcstgaagcggggtgccatccttgagttcgataagccagagaagctgctcagccggaaggacagcgtcttcgcctccttcgtccgtgcagacaagtgacctgc

SEQ ID NO: 14353 - DNA, 201 bp, Homo sapiens
catggaaacctctggccttaccccgagacgaaacctatcatttcagcacatcactggccagggtctaaagagctccttgatggggtaagcggaagacgggrttgaacgctttgagtttggtcttctgttcctttggccagctgtctcaaggttcagattgttcacctgtaaaatggaactagcactgcctgcccagcctta

SEQ ID NO: 14354 - DNA, 201 bp, Homo sapiens
tttgtataaatggctttttgcttggatgatccagaatggcccgacacccacacgaacaacatagctttttgacactcaaaaaattcaaagtgctgcacaarctgttctacaaagttcatttcttctgccagagaaacagcccagtctctgtggcacccagtctgaccctggagatggtttatcagggaaatcaacttcctg

SEQ ID NO: 14355 - DNA, 201 bp, Homo sapiens
ccctgttcctcttggcaggttgtccctctggagaggactctgtgtcccaggaggacagctgctgagtcaggccgagccggcagctgagaaaggcggcagtsgtcagatgggcttgagaaactgaaaggctaacgaaaggccagcgcccctttgggcagctgcaggaattcacggggatacaggccagatgtctacaaattg

SEQ ID NO: 14356 - DNA, 201 bp, Homo sapiens
accaaggcatgtccctgtctaggggactggggaaatatcccatagcagtgttctcacagtatggggctggccatgaataccccaggagtccaacctccctktgtccagctagaccatggtgtcctatgcctcaggcagggaatgtggtccagtcatcagtggctgggccgtctgccatacatggcgcaagccatggcgttt

SEQ ID NO: 14357 - DNA, 201 bp, Homo sapiens
aatacctgatttgcacataccctctcgcatcccattggtgagaaagtggccaaatggccgtatctagagagtctagaaagagcttggtctttattcttgayagctatatatgcactgctagaaattctctgtgcaaagaggagaatgggcattgggaataactagatgcagctatgcctagtgatgtccatgaagttgtgg

SEQ ID NO: 14358 - DNA, 201 bp, Homo sapiens
cagccagccggcaggctgtccccagggccctgttcctcttggcaggttgtccctctggagaggactctgtgtcccaggaggacagctgctgagtcaggccragccggcagctgagaaaggcggcagtcgtcagatgggcttgagaaactgaaaggctaacgaaaggccagcgcccctttgggcagctgcaggaattcacgg

SEQ ID NO: 14359 - DNA, 201 bp, Homo sapiens
gtgtcctctggaaacaccctgtctggacatctgaggagttcattttctcattctccagcaaacacataatgttctctctttaaagcacaagttatcacccrtggatggatttgtccttttctaaggaacaaagactaactccctccattccccttgttggagttatctccccttgaaaggacactccacagagccagaaat

SEQ ID NO: 14360 - DNA, 201 bp, Homo sapiens
gatggtgggatttcaatgaggagaagacaaagtgggaggaagctggagacaaggactgtggtctcttcctttagaagtcagttcaatctttttttccttgyggaagcagcataactctaggtggttcctctgtatctgaggacaagctttgtagaggtgacaaaggggtcctaggtcctatcaggcaagcactcgatatgc

SEQ ID NO: 14361 - DNA, 201 bp, Homo sapiens
cttccacagcaaaaggcgaagcacagagaaggaagtccatgtgggctgggagttcacccagagattcatgtaggggcaatgtgggctgtaccttgcaagayggtgggatttcaatgaggagaagacaaagtgggaggaagctggagacaaggactgtggtctcttcctttagaagtcagttcaatctttttttccttgtgg

SEQ ID NO: 14362 - DNA, 201 bp, Homo sapiens
gaattgaaatgtctcagtgaggtcttccacagcaaaaggcgaagcacagagaaggaagtccatgtgggctgggagttcacccagagattcatgtaggggcratgtgggctgtaccttgcaagatggtgggatttcaatgaggagaagacaaagtgggaggaagctggagacaaggactgtggtctcttcctttagaagtca

SEQ ID NO: 14363 - DNA, 201 bp, Homo sapiens
ccgaactggtacaggataaaacagggggctgaaaagggaatgaatgggcacagtttctctggcatcaaaagtcacatccagaattgatatttcctgttgartaaaaatagaaatataagttgctcagtggatgttgagtgagccctattcatgtgccccactctgtgccaagcaccaggaaggagggaagggaaaaatgat

SEQ ID NO: 14364 - DNA, 201 bp, Homo sapiens
ctggggccaggaggacctagggatatgttgtgaagagctgagaagactctggaaaaaaggggctctggagccaagcaggagcccgcccaggactcctcacstgtccaagtcacctagggagagaaacagagcagcccaggttggtccctggaagagagcagcggaggaggggaaaggggagagcccctggggagagctttg

SEQ ID NO: 14365 - DNA, 201 bp, Homo sapiens
ctcagccaaactgagaagggatcagcttgttttacccgcccgtgtaaaggggagtggggccgtggcggaaatttcaggatagacactgcatctggcccacrtgtgctctaccccagggtcccagagggagaggggggtgatgggtgtgttcgctgaggttggcggatgactttccgtagaaagggaagataagcatcaggc

SEQ ID NO: 14366 - DNA, 201 bp, Homo sapiens
gtcatgtagtgggggcaggtgacatctgctttgactgctcctaagagatatgtactcatctcctggattccaaactgcagcctgggacatgttttcttatrtaaacagcatcaaaagatgtgtgagttcccaggctagcccactgaaccctacctagtgggtgctcattgtcccccagagcccccagaagacaagccgtgg

SEQ ID NO: 14367 - DNA, 201 bp, Homo sapiens
ggagtccaacctccctttgtccagctagaccatggtgtcctatgcctcaggcagggaatgtggtccagtcatcagtggctgggccgtctgccatacatggygcaagccatggcgttttatgcagaaagtcctgctagcatttgattttctcagaatggagctgtgagcatggcaggcaaccactgtttcctggattcttca

SEQ ID NO: 14368 - DNA, 201 bp, Homo sapiens
aattaattcagtgaacaatggtcccctggtcagagtgagggcttacggaggtcaggtgatccatggagtcctggcccaagtttatctcacagttggtctcrtggctccgtggacccatcccatggtggttacttcccaagtgcataattgggatgtagatatttagcaaccagctgacttcacactagttccctgacctgt

SEQ ID NO: 14369 - DNA, 201 bp, Homo sapiens
gactttgactttgactttgagtaggccacttcacctgtccaggcctcagcttctttgtctgggaaatggagtcaatgggggaggaggctgcctcccggtgrggacaggaggcgggcatggcagtgacagtattgacactcaggccttcctctcgggtgggagacggagcagaagcctctcccctctgactcggggacccct

SEQ ID NO: 14370 - DNA, 201 bp, Homo sapiens
ggaccaaggagtcttgggagcacctaggaggaggggatgggggagcatgaggaggagccagggaacagcagcagctgcagcaccagctcccaccccagcckctgccagtctcttggaggtggtgtgggtgcagacaccggctcacaaggtgccctgttagtgagcttggggtgccatgggagccttcttgttgtcaggccc

SEQ ID NO: 14371 - DNA, 201 bp, Homo sapiens
cccagcccataccccaaatacgcccattaactaaagggccctgcagcctataaagtgatgctataaaggttcagtgttcagcctttgaaattcaaggcctkggctgctctattgcagtacttagcatgtccccatcctgtctgtttctctctcccatctcagggtgaccgaatcccaccatctgcacctgtacatgccagc

SEQ ID NO: 14372 - DNA, 201 bp, Homo sapiens
aacccttgtgcttagggctcagcacatagtaaggcctccagatcatatacccagctctactccatgtactggcagctctgcccagcccataccccaaataygcccattaactaaagggccctgcagcctataaagtgatgctataaaggttcagtgttcagcctttgaaattcaaggcctgggctgctctattgcagtact

SEQ ID NO: 14373 - DNA, 201 bp, Homo sapiens
gctgtgtgccaggcctgggttgggctgtgggaatatgaaagcaatagttatgatgaggatgattaacaatattaacagccacttactgaccacataatacrtacctggctgtgtgcaggagttatccatgtgttatttaatccctaaaactatcctttggcgtgagtatattttgcaacatctttactgtggtatacctca

SEQ ID NO: 14374 - DNA, 201 bp, Homo sapiens
aaaaattgtcttccacgaaaccagtccctggtgccaaaaaggttgaggaccactgctctaagttctatttgaacccttaagtcttgctcactaatgagagkgacctatttggtctgttgggtcacttaagtctaggctcttggtcctgccttctgtgatttccttcttagagtttctggaaagatgatcaaagccagggag

SEQ ID NO: 14375 - DNA, 201 bp, Homo sapiens
cccagcagtaggaacagctgccgaggtgggagagggcttctcccgatagccgggggacttcctctcccaggaacaacagggtggggtagagcaggcttgtsgttgctgagatagagagagggaagggaaacaacaaggaaagtgggggcactgggtccccaaggttcctggcacagcaagcagtgaagttggggcagcctc

SEQ ID NO: 14376 - DNA, 201 bp, Homo sapiens
ggtctcaaactcctgacctcaggtgatccacctgccttggcctcccaaaatgctgggattacaagcatgagccactgtgcctggcctgaaattcttcaatwtctacctgcccttctgccagttggtgcagccacagtgggctgcttatgcatatcctggcctggcttggtggggagcatggctgagggagagccggggcac

SEQ ID NO: 14377 - DNA, 201 bp, Homo sapiens
ggcctggggtcagggcactgttgagcattttacaccctaggccagaggaggggtgacctgtggagcagggctaagctagtagcccatgaggtatgatgtgkaggcagcacctggggctcacagagcctgttacccatgttatctcctctgaccttggaaagagctggggtgtatgaacaagtatttataagtttacaaaaa

SEQ ID NO: 14378 - DNA, 201 bp, Homo sapiens
accggaggcttagtatttagagaaattaaactttcttttaaaaaatagctatccaaatttttaatttttaaagtgaaacatgtgtattgtagaagtgatgrgaaatccagaacagaaagctcaaagagaattaaaatcacccataatcccactggtaacatttttaatgtgtttctttccagtctttttttaaggcctatg

SEQ ID NO: 14379 - DNA, 201 bp, Homo sapiens
gatgggaaatccagaacagaaagctcaaagagaattaaaatcacccataatcccactggtaacatttttaatgtgtttctttccagtctttttttaaggcytatgatatgtcattttctacaaaaataggaatgtgctatgcatgcagttttgcaacctgctcttttaaatttaggaatatgccacacacaattctccatg

SEQ ID NO: 14380 - DNA, 201 bp, Homo sapiens
atattatgatggtggctttctaaagcaattttgataaaagctgtgtgtgagctgagccatgggggtcaagcagcatgctcctacagaaaggcctgggcccytacgagcctgcagccccctcacccagcctcccatccccatcttctgtgatggctgcagttccttaaaaagatctgcttatttcccccggggccagtgtcc

SEQ ID NO: 14381 - DNA, 201 bp, Homo sapiens
tattttcaaacactctggatcccactgtttccaggaatggaacaccagagtagcagaggccttttcagtgaggcagctcaggctctggctgaaggtgggckcaggacactacctgaagcttcaccccaagagatgagggccagctccactcttcccagtcaccgcctgtgggggagggaggctggacagggcatgaaggca

SEQ ID NO: 14382 - DNA, 201 bp, Homo sapiens
ggagagggagtggtggaggagagggatatttggcttgagtatctgaggtccagcgccccctgagctggaatcagattatacccagactgcactcctgcagygctgcctggctcctgtagttggatggcaggggataggctccctcatcctccctcccgttccccaccttcccttccccaatgtccctgcatcctggcttca

SEQ ID NO: 14383 - DNA, 201 bp, Homo sapiens
ctgcagtagtctaggtgagcaataactgcagacagaaatggtgtgtcagcagtcagggacagaagaggagcgggagcagccatctcactaaggaagaatcyagtaaccagcaaggatgagagactgccaggagagggagtggtggaggagagggatatttggcttgagtatctgaggtccagcgccccctgagctggaatc

SEQ ID NO: 14384 - DNA, 201 bp, Homo sapiens
agcagcgcaggggctggagcattaaacacaggctggggagcgatggaggctgaggctgggaacccaggttggggcatctcaggaggactgtgaatcccagmctgcatgtttgggtcggatttggtcagcagtttggaacagaagagagatgtcatcagcataacacttttaggtgggaacctgaggtgttcagcgcaggct

SEQ ID NO: 14385 - DNA, 201 bp, Homo sapiens
ctcacagttgctttgcacactcagaatccatgatttcttctgcatgagggccattcagacctgtgcagaagagagtaatggaccaaggagtcttgggagcrcctaggaggaggggatgggggagcatgaggaggagccagggaacagcagcagctgcagcaccagctcccaccccagccgctgccagtctcttggaggtgg

SEQ ID NO: 14386 - DNA, 201 bp, Homo sapiens
aggttaagtaactcacccaagactgcacagcaaaaggctggggctttgaaactcagggccacagactccaaagactatgtcctccccactatgctagattkttttcctaacctgtgaataggagacaaaatagtccttttatttctcacagttgctttgcacactcagaatccatgatttcttctgcatgagggccattca

SEQ ID NO: 14387 - DNA, 201 bp, Homo sapiens
cagtggcagcaccatactcacacatctcctttctgcggttccccagtgacagagttctcaggaagctttttcatttattttctgagaggagggtaggccaycttgtattgatctccaactatatgccagccacaattctaggtgcttatcataaaggttcatttaatcttcacaatagtcctgcagagtggacagagtcct

SEQ ID NO: 14388 - DNA, 201 bp, Homo sapiens
tgggtgtggtggctcatgcctgtagtctcagccactcaaaaggctgaggtaggaggatggcttgagcccaagagttcgagtccagcctgggcaacatagasagacctcatctctaacacaattttttttttgaaacatgaaaaatgaagatttctgaccatgcttctctcattagttaacactttgggctgtgagggtctg

SEQ ID NO: 14389 - DNA, 201 bp, Homo sapiens
aagacagatcaatgactataaaagctacaaaagggcctggagatctcatctagtttagttaccaaccaaccttttatgcacaagactttctaagctgggtrtggtggctcatgcctgtagtctcagccactcaaaaggctgaggtaggaggatggcttgagcccaagagttcgagtccagcctgggcaacatagagagacc

SEQ ID NO: 14390 - DNA, 201 bp, Homo sapiens
tgatttgtattggtcctccttacttgtaaagcttagagtttaaaaatattaaaagaaaaaaaggggagaggctcccacagggacacagctagacaagatgrgatgcagggaatctgatgttcttttttatgggaacagtcatatatgccatcccccattaccacctacccatgcccagactgcccccgctccattctgcca

SEQ ID NO: 14391 - DNA, 201 bp, Homo sapiens
gctatggcaattcagttagataatgtaagtaacacagcaggcagagtggcccccagagtcttcacttcgtaaatatcagatccctctaccttgcacatgtktggtatgagtgaggtgttaccaatccagaatccattgcttcttgggataaagattccataaaccttcatctccagtgatttgtattggtcctccttactt

SEQ ID NO: 14392 - DNA, 201 bp, Homo sapiens
gggagagcttgatgtagcagaaagtgacttgggtgagacaggctgattcaaatacttaacctctctgagccttggtttctttatctatgaaatggggaggmtgcccaccctctggagttgctatggcaattcagttagataatgtaagtaacacagcaggcagagtggcccccagagtcttcacttcgtaaatatcagatc

SEQ ID NO: 14393 - DNA, 201 bp, Homo sapiens
cactgcactccagcctgggcgatagagtgacaccttgtctcaaaaacaaacaaaacctggtgttttttagccagatgtggtggtgcgcccctttagtcccrgctacctgggagtctgagatggaaggattgcttgaccccaggagttcaaggctgcagtgagcaatgatcacgcccctgcacttcagcctggacaacagag

SEQ ID NO: 14394 - DNA, 201 bp, Homo sapiens
ggatgcaaggagatgctgagtttgaccttaagtggcctcaagggtatagagcaaccaggccatccgtaggagttacccttctgcattgtgttactgtcgtragggggatcttggaccaaaacttaagtgggcaagagcaagaatgttatttaatttctgtatcaagtccccatcccactagactggcagaaaacattagcc

SEQ ID NO: 14395 - DNA, 201 bp, Homo sapiens
tttacacaaaagaggaattaagggcggggagcccaccttacaacagaatgaataatagaattttatccaagagcaggcatcctgaggacatttaagacccrgatgcatttttccttgttcaagagcacacatccaaaaattgcagtctttctgcgagtcatgatcactctgcacataaagcgtttaggttcagagctcggg

SEQ ID NO: 14396 - DNA, 201 bp, Homo sapiens
accaggccaaaaagataccctgtgacctcccacacctgcacacacacccagagctagcatagaggctattcccagcagccccagagtcccagcggcggtgyctgcttctctctttccagatcgggatctgcggccgcaccggcagtgggaagtcctccttctctcttgccttcttccgcatggtggacacgttcgaaggtg

SEQ ID NO: 14397 - DNA, 201 bp, Homo sapiens
tgtataatggggtaccttggcagggcacagtggcttacatctgtaatctcagcattttggtgggctgtgacaggaagactgcttgagtccaggagttcgaraccagcctgggcaacatagtgagaccccccccgccctttctacaaaaaattaaaaattagctgagcatggtgatgtgcgcctgtagtcccagctactcag

SEQ ID NO: 14398 - DNA, 201 bp, Homo sapiens
ctacctggccgatgagatcctgtggggccagcgctttgtgcccattgtagctgaggaggacggacgttactctgtggactactccaagtttggcaacaccrtcaaagtgcccacaccactctgcacggcccgccagcttgatgaggaccacagcctactggaagctctgaccctcgcctcagcccgcgggcccctgcgcaa

SEQ ID NO: 14399 - DNA, 201 bp, Homo sapiens
atttgtccttttctaaggaacaaagactaactccctccattccccttgttggagttatctccccttgaaaggacactccacagagccagaaattctagaasagggaaaagtggaggggacgtgcctgtgaactgcagggacagaaggaaatgggtattgggagaatggccagccctccaaggggctgatgtctggcctggg

SEQ ID NO: 14400 - DNA, 201 bp, Homo sapiens
tcatgatcaacgccatcatgcttggctgcatcttcatgaagactgcccaagcccaccgcagggctgagaccctcatcttcagcaagcatgcggtgatcgcyctgcgccacggccgcctctgcttcatgctacgtgtgggtgacctccgcaagagcatgatcatcagcgccaccatccacatgcaggtggtacgcaagacca

SEQ ID NO: 14401 - DNA, 201 bp, Homo sapiens
ggacactccacagagccagaaattctagaacagggaaaagtggaggggacgtgcctgtgaactgcagggacagaaggaaatgggtattgggagaatggccrgccctccaaggggctgatgtctggcctgggtatggagtcccacagaaaggggacctgtgatgcagcttacattgtcccgtgagggaaccatgatcctgga

SEQ ID NO: 14402 - DNA, 201 bp, Homo sapiens
tgcaggacaggactatgcaaaaaacctctgggcctagtcctgggtgcactgctaattccctgtgtgaccttgcacaagacatccaagctctctgagcctcsgattccccacctgggcaggaagagtaagtccctgcctaagtcatagggttgtaatgaagagcaaagcagaccatatctgttaagtgttagggacaagaca

SEQ ID NO: 14403 - DNA, 201 bp, Homo sapiens
ttgggatttcaccctgttgaccatgctggtcttgaactcctggccttaagtgatcaggtctcaacttcccaaagtgttgggattacagccgtgagccaccrcacccacctggaaggtcataccacagatgtttgcctttatcccaacagcaatgggaagttgtgtgtgtgtgtgtgtgtgtgtgtgtgtgtgtgtgtgtgt

SEQ ID NO: 14404 - DNA, 201 bp, Homo sapiens
ctggtctcaaactcccgacctcaggtgatctgcctacttcagcctcccaaaatgctggaattacaggcatgacccaccacgcctagtcaggtacccacttyttaactgaaacttagctattccaggttctatcccttttaaaccaactctttgaagagaggtctaataatgacccaatgacttatagctgcagtgagattt

SEQ ID NO: 14405 - DNA, 201 bp, Homo sapiens
tctgcagaggacagtgggacagaagaatcccagggcatgttaaaaaggaccgggtcttcctaaacccacatgcctatatttctgacccagtaccagccagsggggcaagtttccatcccccacaagtcacaaacctgtaactgacactaggatgcttaaggtcaaaggcctggacgaggcctagacagtgggtctggggta

SEQ ID NO: 14406 - DNA, 201 bp, Homo sapiens
ttccagaaggattgcagggctcagacactggagctgcccctgccttgacctgctcagcatggatgtcaaaacccactctgaacctggtccctttgccctgytttcttctcctcccccaccctcatgccctcatgtggcatcgtgcctgcctcaggagctctccttgtcctatgtagatgaagcaggcatgattggcagggg

SEQ ID NO: 14407 - DNA, 201 bp, Homo sapiens
actccaagtttggcaacaccatcaaagtgcccacaccactctgcacggcccgccagcttgatgaggaccacagcctactggaagctctgaccctcgcctcrgcccgcgggcccctgcgcaagcgcagcgtgcccatggccaaggccaagcccaagttcagcatctctccagattccctgtcctgagccatggtctctcggg

SEQ ID NO: 14408 - DNA, 201 bp, Homo sapiens
cacccaggatggacagaggtgtgcagacagagctgcagggtgggcacaaagggtccatctgctgaagtcctgcagatgcagccccgagcttgtccctcacrtcagcagcctggctcctggtctcagagagaactgtgtggttcccaagcattcactttaggaagaatcacttgcccctccctggctctctgcttcaaggaa

SEQ ID NO: 14409 - DNA, 201 bp, Homo sapiens
gccctctcatttcccttccagtgctgagcgtttccagtgtgggagggacccacaccctgggccaccctggcctcacttgtgcctctgtccacagactttcrtgggccacgtcagcttcttcaaagaggccgacttctcgccctccgtggcctttgcctccctctccctcttccatatcttggtcacaccgctgttcctgct

SEQ ID NO: 14410 - DNA, 201 bp, Homo sapiens
gaaaatccaatataaaatgcatatcttgcccccactgtggcccacagccacactgccttttccagaccctgtctcaagcccccactccaacaaaatggccrcagatggtcaggggttcttccataaggatctgagccacagacagcggtaaagccgttactgttccaacaacagagatctagcaggctttccctcccagct

SEQ ID NO: 14411 - DNA, 201 bp, Homo sapiens
gagagcctcaaagggagagtcaattaaacagaaggaaagagggaggccatttgcacagtgagttggaagaaggaagctcaagtctctgattccagctttaktccctcccctctccctacaccacacgcacaagcactcctttactaaagacacttcacagtgggaagattcagtctccgttaccgtctgacacacacacag

SEQ ID NO: 14412 - DNA, 201 bp, Homo sapiens
gcttttcccactgcacagagatcatgagcgccctttcatcacttactctgcatatttgttcccaaccaattccatccttctagtatttaacctgcccaaaygctgtgtgaagtgctgacctcagctcttttcaagctcacacggtgtttgcttgcacccaagcgggaggcctattaaagccattgctcaccctgggcatag

SEQ ID NO: 14413 - DNA, 201 bp, Homo sapiens
actgagatgcctcctgccacacttcctcagctgccagcaactgacaccattaacctgatttccttccccctctgttgactgcactgactattggactgaawgggaaacagccccgtgcacctcaaaatgcacttcccctcctgcagatgcatcttgcaattaggcccaaactgtgagcctgcatgctcctcccctggccct

SEQ ID NO: 14414 - DNA, 201 bp, Homo sapiens
tacctttctgatttgccctaccagagtgtgagcccctggaaggcagcctctgcaccctgattcaggttgccacacatatgccagctcctagtgggctggarggaaggacatgcggttggggaactggaagactcatgctttcagctgtgtgcttcctccctagagtgcaggcagaggaggaatcgaatcccctcagcactc

SEQ ID NO: 14415 - DNA, 201 bp, Homo sapiens
tgcagacccctgtggatgttccaggagccagagaagctcggaaaggaagagctctgtaaagcctggcagcctgcctggaaaagacaaaatttgagttaaayattgtgggggatagggattggttaggcagaaagtcagagaaagggttggggtggcaggtagggacagcaggagctaaggagtgatggtggaagtgtgtta

SEQ ID NO: 14416 - DNA, 201 bp, Homo sapiens
cacccagaagcttccagtttttctttatgcatttgcatatgcatttgtgtttacttttccccaaaagttctccgatactttgtcctacttttcttttgacscttataacttcctgacttcggtacctttctgatttgccctaccagagtgtgagcccctggaaggcagcctctgcaccctgattcaggttgccacacatat

SEQ ID NO: 14417 - DNA, 201 bp, Homo sapiens
caggagccaaagtctcagaagcagaaaaatcctcgatacccccaggatccctttgggaagtggttaacagcacaggctttgaagccaggcctcactgagtktgggtcttttcttcaccaactcctccagctgtgtcactagggaatggggcttaacctctctgagtctcagttctcccgatagttgtaactactaggcagg

SEQ ID NO: 14418 - DNA, 201 bp, Homo sapiens
  misc_feature (1)...(201): n = A,T,C or G, or insertion/deletion polymorphism (see Tables 1-2)
gcaaaacagtaatacctccatctctacaggaaaaaaaaaataatcttaaaaacctaaaaagcccttgtatggattttctaacacagtctacacacaacctnccctttctgggtggctgtcccccagccacctctacaacagacaggcagggaggctgggcacaggctccctctcaaaagaacttctctctctacttccctc

SEQ ID NO: 14419 - DNA, 201 bp, Homo sapiens
tttcactggttctacagtcttccaagttcccctgtggatacaggctttgagcacctgaaggagacaggaaaggacacacctttcccagtcagtaagggtcrcccgaacttaggctctgtacttgttctccactattccatagtataggtcacaccatgagttttgcttttgtctgtttttaaccaggccgctgttgattgt

SEQ ID NO: 14420 - DNA, 201 bp, Homo sapiens
ggcgggagacccggaggtgggggtgaggtccggttagtgggagagatccggaggtgttaagttctgagctgggctgggaaggcaggctgggcggggagaarggctcttagcgggaggcccaggggtggtcagctggtgggggaagctgggggaggacgcagggccaggtggagagccggcagggttgggggctccctaggc

SEQ ID NO: 14421 - DNA, 201 bp, Homo sapiens
  misc_feature (1)...(201): n = A,T,C or G, or insertion/deletion polymorphism (see Tables 1-2)
agaacgtggcaaggagagtaagttggtagaaccattttacagatgggaaattaaggccagaggggagtgtgttcctgagatccctcctgaggttagtagcntggctcggactagatcctccaaagtctcttaactcctggtctcaggctattttccacaaagagctgggggcctctgtggggtgaagaagacttaggacac

SEQ ID NO: 14422 - DNA, 201 bp, Homo sapiens
ctttctgggttccattttcctcccctttcattatgacagatggccactagcaggtccagcttacatcctgccccaaggcaacccaagaggcaaaacagatrctccttcccaatagttccagcaaaagcttgggagcaaatctcaatgcaccaacttggatcacattcccatccccaccccactgtgatcagaggggtggca

SEQ ID NO: 14423 - DNA, 201 bp, Homo sapiens
tcccagcctctcctcacacccctccagtgacaggcagacttgcaccaccacaagcaacagccacttttgtggttgggcagttttgtaattaaatatactamtgtgtgtatgtcataaattacattttccaattatgccaaaagagccaaaaatggttttttaatggttagcatataatcgtttttatcaaattgcttgaat

SEQ ID NO: 14424 - DNA, 201 bp, Homo sapiens
cccctattacctcattaaaccttaattatctcctcacaggccctgtttccaaatacagttacattgtaggattaggcttcaacctgtgaatttggcaggayacaattatgtccatagcaagggtgatagcatttctgcaatgagcttatcagataaggtaacagatctccatacagcttggtctcctttcttctcactttc

SEQ ID NO: 14425 - DNA, 201 bp, Homo sapiens
tttgtctccatagccatggtgggtattgaaactgccactatatttacatttaaactagccagaagaagggacaagaggagggaacgcattttccttttaaratggtaatacctgatttgcacataccctctcgcatcccattggtgagaaagtggccaaatggccgtatctagagagtctagaaagagcttggtctttatt

SEQ ID NO: 14426 - DNA, 201 bp, Homo sapiens
gtgcacatgcatccctgctttctctctgtgtcttaaaaggacaccagtcatattggattagggccccacccctattacctcattaaaccttaattatctcytcacaggccctgtttccaaatacagttacattgtaggattaggcttcaacctgtgaatttggcaggacacaattatgtccatagcaagggtgatagcatt

SEQ ID NO: 14427 - DNA, 201 bp, Homo sapiens
ccttcttttgtgacttttgtctccatagccatggtgggtattgaaactgccactatatttacatttaaactagccagaagaagggacaagaggagggaacrcattttccttttaaaatggtaatacctgatttgcacataccctctcgcatcccattggtgagaaagtggccaaatggccgtatctagagagtctagaaag

SEQ ID NO: 14428 - DNA, 201 bp, Homo sapiens
tctaggtaggaagaaagaaaacaggggccccagggttgggtgcatctgtctgtctgtctttctgggtaatggttgttcagactcccccggccccactcacrtctgccaccctccctccctgcaggccagctgactatgatcgtggggcaggtgggctgcggcaagtcctcgctccttctagccgcactgggggagatgcag

SEQ ID NO: 14429 - DNA, 201 bp, Homo sapiens
aggtggtgatgacagccttcgcagaccgcactgtggtcaccatcgcggtaaggggcccattgatggggtgcagagggacacccagggacaggactggcctsttgtggccgtcatcagtgcacagcccctgggcttgcctggtcccagtaatcaagaaagaaccctgaagcaggcagttcagggcaaggggcctggagggca

SEQ ID NO: 14430 - DNA, 201 bp, Homo sapiens
atccagctgctcagcccttggcttgaaagtggtagacgtcactaattgatcacagcactctttctgaccaagggtaaatgcaaccttggaatcctctctamgtggctgttccagagttctgctaccagacagtcttctttgggtgtgaaaaaaggaatgtgcttgacatacaaggtctagatagcctctaagacagggtcc

SEQ ID NO: 14431 - DNA, 201 bp, Homo sapiens
ctgcagcccagagcgggagacagcgaccgacttggatatcaggtactgcgtcctgggaacattgccccccagggtcaactccctccagggtgctctcaggyccaagggagccacatcaccctgctgggcagcccccagaccccagccccagtgttgggggaggccagggagggcccctgtgctccaccaggtggctcggga

SEQ ID NO: 14432 - DNA, 201 bp, Homo sapiens
atgcttaatttggaaatagacacactgttgatccctggtatctttagcaacaaagttaaaatgtttgtttttcttcactggttgccatctgagatcttgcyggaagtacacaagagaaccttaaatttaacaggaggccctgggagcccatgaggctggcgggcttgggtctgaaatcttttcagtctcttgtaagtgatg

SEQ ID NO: 14433 - DNA, 201 bp, Homo sapiens
gacagaaggtcagagcacgggcccaacccaatgctgcaggacaggcgtgagcaggggatggggcatgcacggagctggatggcttcgcagtcacctcgtgkccctccagggccgaggcctctcactattcagacatcgcagtctcctgccctgggcctgtgggggcccatctttcctctccttctattgccttcccccagt

SEQ ID NO: 14434 - DNA, 201 bp, Homo sapiens
gggcttgggtctgaaatcttttcagtctcttgtaagtgatgagctctcattctctcctgagagctctacggtgccatgttttccactggccttttctgctyagtaattgctacattacaggctgttggtaagttcggaacaagggagctgctgattccatttctgtagcagagaacatgcaccgtgagacttgttgtacca

SEQ ID NO: 14435 - DNA, 201 bp, Homo sapiens
atgaggtcctgctgccccagtcagttgagacccagacctctcaaacctgcctgggggaaggcaaggccaccagaggccacactaagcagatttctaccaaytgcacctccccatccccttgcctccatctgagccatcagcttgacaactgcctctgagaacaagcccctgagaatgccttccgcaccccctactcccgcc

SEQ ID NO: 14436 - DNA, 201 bp, Homo sapiens
cgacaccaatcagctcatgtggtttttcttcttgtgcccaaacctctgggctatgccagtacaggtactagatgggctgaggggaagggaggggggcagcmggacacacaaccagaatctgctggtccatggccagtaactaggagcacaccgtcttccactccatgcttgcctgtacctttcacacacttggctatacca

SEQ ID NO: 14437 - DNA, 201 bp, Homo sapiens
caccatgttggccaggctggtcttgaactcttgacctcaggtgatccgcccgcctcagcctcccaaagtgctgggattacaggggtgagtcaccgcatccrgccggagatcattaatattctaaacagtgggggagaggacacagtttgcgatttagatagattaagccagccactgtgtggagcatggactgtagggaga

SEQ ID NO: 14438 - DNA, 201 bp, Homo sapiens
cctcatgaaccgacaggaccaagagctggagaaggtgggtatatccagggatggccaagcagccacccctggatgcaaaggttctgctagaacctgaactyataaaggtcttcctgtccttagtgccccaggaagccccctaaagggcagatgtgggagctgggcatgaactggctcctaccagaggagagacagtacctg

SEQ ID NO: 14439 - DNA, 201 bp, Homo sapiens
ggggatgaacaaattacacgggagctgatcagagaggaaggcagtccattatgagggctaattgagcagtgcagaccatgttgcaaactgagttagggccyggagagcttactgtgtgctggggtcctcaggaatgccacagatgcatcaataaccacctctgctactctggaagtagtcacatcaggaagactccagaga

SEQ ID NO: 14440 - DNA, 201 bp, Homo sapiens
tcctctgggccgggcctacgtcagcaaggtctgagggaagcggccaaggagagtgatgacggcagcccaggttgatcagagaaaggaggcaggtccatgcrcagtaactcagggaaaacatgatgaggacctaaggatgagaaagaagcctccagagttccctgtgcagagagattccatcaatttcagagggtcagggga

SEQ ID NO: 14441 - DNA, 201 bp, Homo sapiens
ctcacacgggctttgtcagggcctccctctctgcgaatggtcaggggctttccctagggcactgccccgagcttcagggcagggacctgggggcagacagygaggccacccttgtattgagggtgagcccctgcctatggccctggcccagctctcctctcgtttcccactctgtctctttgtctctgtctcactttgctg

SEQ ID NO: 14442 - DNA, 201 bp, Homo sapiens
agagaaaaagacagacagactgtaggaagggaggtattagcaaataatcataacacagtgtgaggtgtgcattaatattcactcattccaagtattgatcragaagagaggtaggtactgggttaggaaacagcttgggcaaatgcatggggaaatgagagatgtcaagatgcattctaatggcagcctcttgaagatctt

SEQ ID NO: 14443 - DNA, 201 bp, Homo sapiens
accaggtggacatccccatggagaacggcgtgggtggcaacagcatcttcctggtggccccgctgatcatctaccatgtcattgatgccaacagcccactstacgacctggcacccagcgacctgcaccaccaccaggacctcgagatcatcgtcatcctggaaggcgtggtggaaaccacgggcatcaccacccaggccc

SEQ ID NO: 14444 - DNA, 201 bp, Homo sapiens
tttcgttccttcctccatcatcaaacaagtgctcctgcatctcctctgggccgggcctacgtcagcaaggtctgagggaagcggccaaggagagtgatgayggcagcccaggttgatcagagaaaggaggcaggtccatgcgcagtaactcagggaaaacatgatgaggacctaaggatgagaaagaagcctccagagttc

SEQ ID NO: 14445 - DNA, 201 bp, Homo sapiens
gaggaccctgccgagcccaggtaccgtgcccgccagcggagggcccgctttgtgtccaagaaaggcaactgcaacgtggcccacaagaacatccgggagcrgggccgcttcctgcaggacgtgttcaccacgctggtggacctcaagtggccacacacattgctcatcttcaccatgtccttcctgtgcagctggctgctc

SEQ ID NO: 14446 - DNA, 201 bp, Homo sapiens
ggaaccctgtgatgcaagcaccatcccctttatagatgaggaaacattttagatgaggcttgtccaaaaacaccttgctagtaagtggaggaggcaggatycaaaaccaggtctgcatgacttggagttctgtgaactgtatatgaaacatggtggtatccttagatctgtggagaagatagcatatgagagattcctgct

SEQ ID NO: 14447 - DNA, 201 bp, Homo sapiens
atcatgcttggctgcatcttcatgaagactgcccaagcccaccgcagggctgagaccctcatcttcagcaagcatgcggtgatcgccctgcgccacggccrcctctgcttcatgctacgtgtgggtgacctccgcaagagcatgatcatcagcgccaccatccacatgcaggtggtacgcaagaccaccagccccgagggc

SEQ ID NO: 14448 - DNA, 201 bp, Homo sapiens
gtaccgtgcccgccagcggagggcccgctttgtgtccaagaaaggcaactgcaacgtggcccacaagaacatccgggagcagggccgcttcctgcaggacrtgttcaccacgctggtggacctcaagtggccacacacattgctcatcttcaccatgtccttcctgtgcagctggctgctcttcgccatggcctggtggct

SEQ ID NO: 14449 - DNA, 201 bp, Homo sapiens
tatcctttggcgtgagtatattttgcaacatctttactgtggtatacctcaaatactgtacagtttatgagatgataggtattcttatccccattttacaratgagaaagttgaggctcagaaagtttaagtaattttccccagggtctctcagctagttaataacagaggcagaatttgaacacaagactcactccacag

SEQ ID NO: 14450 - DNA, 201 bp, Homo sapiens
taccgtgcccgccagcggagggcccgctttgtgtccaagaaaggcaactgcaacgtggcccacaagaacatccgggagcagggccgcttcctgcaggacgkgttcaccacgctggtggacctcaagtggccacacacattgctcatcttcaccatgtccttcctgtgcagctggctgctcttcgccatggcctggtggctc

SEQ ID NO: 14451 - DNA, 201 bp, Homo sapiens
aaactttgatggcttttgaagccatatctggctttttgagcctctctactttacctggcccataaaagagaggggaagcggctgcttctcttgtctacagkagtgtcacctttggctctagcctgaccataggctaccccagaatacccccattggcgatcctgaagcagcatggagccagttgttaatatcagggggaaa

SEQ ID NO: 14452 - DNA, 201 bp, Homo sapiens
gcctgaatccatcctgcagcagttggcacagcgaggcacctgtggtttattcatcatcactcttccttcctaagatactcagagttggcaagaaacatgtyatccttggtatccgcaaggacgaacatttctgatgtcctctttagttactgaaagtgtctgtgacttgccagatctttgatgctcctgtcaccccgctgc

SEQ ID NO: 14453 - DNA, 201 bp, Homo sapiens
cttcatgaagactgcccaagcccaccgcagggctgagaccctcatcttcagcaagcatgcggtgatcgccctgcgccacggccgcctctgcttcatgctaygtgtgggtgacctccgcaagagcatgatcatcagcgccaccatccacatgcaggtggtacgcaagaccaccagccccgagggcgaggtggtgcccctcca

SEQ ID NO: 14454 - DNA, 201 bp, Homo sapiens
aacagtcttgtatgaatgggtaggtgtgttggtctctgggtggccaaagataattttattctttacccagggcctcccggggctgggacctacggacaackcaccttttgacacctgccaaaataggaaacaagagtccaagtgatcccctctcctttaagcaccagagaacatgtgaaggggacctttccaatcatacct

SEQ ID NO: 14455 - DNA, 201 bp, Homo sapiens
tgggggaagcccctccctgggggtcaccggagccatgctgtcccgcaagggcatcatccccgaggaatacgtgctgacacgcctggcagaggaccctgccragcccaggtaccgtgcccgccagcggagggcccgctttgtgtccaagaaaggcaactgcaacgtggcccacaagaacatccgggagcagggccgcttcct

SEQ ID NO: 14456 - DNA, 201 bp, Homo sapiens
ttcatgaagactgcccaagcccaccgcagggctgagaccctcatcttcagcaagcatgcggtgatcgccctgcgccacggccgcctctgcttcatgctacrtgtgggtgacctccgcaagagcatgatcatcagcgccaccatccacatgcaggtggtacgcaagaccaccagccccgagggcgaggtggtgcccctccac

SEQ ID NO: 14457 - DNA, 201 bp, Homo sapiens
ggaaatccctggaaacaaacacaattcttccctgagagcttgtgaaaatgcaagactagggcctatgattttccaaagcattttcttccaccaagtgtcargttgtaggtccttggtcttttctctcttgccttggtacctgcagggtgctgaccagtgctatcatatcccctccccgtttcctaggaccctcttctcggt

SEQ ID NO: 14458 - DNA, 201 bp, Homo sapiens
tacaggcgtgagccaccgcgcccggcctgaggctggtattaagaagtgaagtgggacccaggtggaggtaaggaagagtctggtggggagttatctcagargtgaggccagcacaggctgagtgcagccccagggtgagaaggtgcccaccgagaggactctgcagtgaggccctaggccacgtccgaggggtgcctccga

SEQ ID NO: 14459 - DNA, 201 bp, Homo sapiens
tgcctcctgggttcaagcaattctcctggcccagcctcccaagtagctgggattacaggcatgcatcaccatgtccagctatttttttgtatttttagtaraaacagggtttcagcatgttggccaggctggtctcaaactcccgacctcaggtgatctgcctacttcagcctcccaaaatgctggaattacaggcatgac

SEQ ID NO: 14460 - DNA, 201 bp, Homo sapiens
aggcatggtggcgggtgcctgtagtcccagctactcgggaggctgaggcaggagaatggcgtgaacccaggaggaggagcttgcagtgagccgagatggcrccaccgcactccagcctgggcgacacagcaagactctgaaaaaaaaaaaaaggaaagaaagaaggaaaggaaaggaaagaaaggaaaggaaaggaaggaa

SEQ ID NO: 14461 - DNA, 201 bp, Homo sapiens
gcttgcagtgagccgagatggcaccaccgcactccagcctgggcgacacagcaagactctgaaaaaaaaaaaaaggaaagaaagaaggaaaggaaaggaargaaaggaaaggaaaggaaggaaagaaagaaagaaaggaaagagagagagagaaagaaagaaagaaagaaagaaagaaagaaagaaagaaagaaagaaaga

SEQ ID NO: 14462 - DNA, 201 bp, Homo sapiens
agatgggtgtccctcaggccaggcagaaaattcagtcttgttgctttatgttcatgtgcaaatctaaaaaatccaagtgatatagattaatgaggctctgrgtccctcaaaaccttccctccccttacctctccaaaaaacacttgagataccctagaggtggtatgaagtcaggatgggaaggttggctcagctttgcaa

SEQ ID NO: 14463 - DNA, 201 bp, Homo sapiens
gcctggggtcagggcactgttgagcattttacaccctaggccagaggaggggtgacctgtggagcagggctaagctagtagcccatgaggtatgatgtgtrggcagcacctggggctcacagagcctgttacccatgttatctcctctgaccttggaaagagctggggtgtatgaacaagtatttataagtttacaaaaat

SEQ ID NO: 14464 - DNA, 201 bp, Homo sapiens
tgcctcttcctttaacctgcagttccctcccttcacctccaccgtctcaatccttcccactctttaaggttcagttcagctatgacttcttctatgaggcyctactcattttctcagatttcttcctcctccaaatttcttgtaaaaattatgttttttctctgattctaaaagaatgcacattacattagaaaagataca

SEQ ID NO: 14465 - DNA, 201 bp, Homo sapiens
ccccctccattactggcaggaactccacacctcagacattgagccccaggtctgcagggagaagacgtgcttgcaaagtgagctaaaagcaaaacagcctytgacctggcaagcattcccaagtctgcacgcctgcagccagaggagagggtgatgccaggctgctgctcagatgcttttcagccatacccaggccaagac

SEQ ID NO: 14466 - DNA, 201 bp, Homo sapiens
tctctcttgccttcttccgcatggtggacacgttcgaaggtgagttgtaaggcgggcaccccacgtgtacccacagccaccagatgaggcctcagccctgrcacgtggtcagacatgacaggaggcccagcagtcaccgccttcccctgcaccctcactgggacccatgcagggcacatcatcattgatggcattgacatc

SEQ ID NO: 14467 - DNA, 201 bp, Homo sapiens; identical to SEQ ID NO: 1215

SEQ ID NO: 14468 - DNA, 201 bp, Homo sapiens
aagatattttttaataactacaatattttcccagaccaccatacactggataaagcctgtatataaaactttacctaatttcttaactaattgaatgtgtwttatttaacaaagcagctaaaaactattctatgaagccatgtcatgaaatatttagttcaattatggttaatcctcatcttatttcgtcttataaaattt

SEQ ID NO: 14469 - DNA, 201 bp, Homo sapiens
atgatgcacacacgtctctgcgatcttccatctctcctcggcagccctgctggtgtattggaccctggccttcatcaccaagaccatcaagtttgtcaagytcttggaccacgccatcggcttctcgcagctacgcttctgcctcacagggctgctggtgatcctctatgggatgctgctcctcgtggaggtcaatgtcat

SEQ ID NO: 14470 - DNA, 201 bp, Homo sapiens
tctctcctcggcagccctgctggtgtattggaccctggccttcatcaccaagaccatcaagtttgtcaagttcttggaccacgccatcggcttctcgcagstacgcttctgcctcacagggctgctggtgatcctctatgggatgctgctcctcgtggaggtcaatgtcatcagggtgagggtaagcaggccacctgggcc

SEQ ID NO: 14471 - DNA, 201 bp, Homo sapiens
agtgagcgtctgcacatccaagtaaagattgttttctcctccctaagtgggtgtaatttgcccatccccacccatgagttcagctccctgccctcccctcrctctctctccctcagccagcctcaggttttgacactgggggaacaggtagctgttctattaataatttcctgtaatgggatggataaaaatctcaaaggc

SEQ ID NO: 14472 - DNA, 201 bp, Homo sapiens
catagaagagagacagtccgggaaggtttttgtaccagaggtgtcatcagaactaggactcaaaggaggggcaggagttcaccaggctgaggaattcctgaaaacttcagtgcccctgccatcgtctcactaccctgagtggtgatgttggggtggacaggagcatctgaggttgcctggggaatgagggaagctgttgtt

SEQ ID NO: 14473 - DNA, 201 bp, Homo sapiens
ggggaatgagggaagctgttgtttcccactccccaagagtctgtctgatctccagaggcatctctcttccagtcaggcaggccagagacccctgacacacaaagttgggctcttttctcatcttcatccagagagtgataataggttatttttagggtggcacagctgcacgaagtatgacagtaaccatgagacaccaag

SEQ ID NO: 14474 - DNA, 201 bp, Homo sapiens
cctaaggacacagtggctaatatatgatgagtcaggacctctaagtccaggctcttaaccaccgtgtcaaacagtcttgtatgaatgggtaggtgtgttgrtctctgggtggccaaagataattttattctttacccagggcctcccggggctgggacctacggacaactcaccttttgacacctgccaaaataggaaaca

SEQ ID NO: 14475 - DNA, 201 bp, Homo sapiens
ttcccaaaagagtttcaagagtgcccagcactgggctcagtggcgggctcggaggttgttttcgttcatgtaggaactatcacttccccatttttttcatragaaaactgagtctcagtcctgatacacagccaggaagttgtgatgttcaggctccaacctgggtttacatggctccgaggctggggctcttttctagtc

SEQ ID NO: 14476 - DNA, 201 bp, Homo sapiens
attgttattagaactgactcttgcatatgtgaaaccaaagcctgcctctgttccacttagtgtcctggttctaccctttgggccacaaaaaactactagtycatcctccttcaaggccaggtgtttctgcaatagtgcccaaatccctgggggactttccttttctgatggctggacagttgtagttgcctcagagatttc

SEQ ID NO: 14477 - DNA, 201 bp, Homo sapiens
atgaggaaactgaagctaagagaggttgaggaacttacctaaggacacagtggctaatatatgatgagtcaggacctctaagtccaggctcttaaccaccrtgtcaaacagtcttgtatgaatgggtaggtgtgttggtctctgggtggccaaagataattttattctttacccagggcctcccggggctgggacctacgg

SEQ ID NO: 14478 - DNA, 201 bp, Homo sapiens
ccggcccccagcaccatcgctgatcccaaagaactggccagaccaagggaagatccagatccagaacctgagcgtgcgctacgacagctccctgaagccgrtgctgaagcacgtcaatgccctcatctcccctggacagaaggtcagagcacgggcccaacccaatgctgcaggacaggcgtgagcaggggatggggcatg

SEQ ID NO: 14479 - DNA, 201 bp, Homo sapiens
caccttacagatgaggaaactgaagctaagagaggttgaggaacttacctaaggacacagtggctaatatatgatgagtcaggacctctaagtccaggctsttaaccaccgtgtcaaacagtcttgtatgaatgggtaggtgtgttggtctctgggtggccaaagataattttattctttacccagggcctcccggggctg

SEQ ID NO: 14480 - DNA, 201 bp, Homo sapiens
ccacagagatacatcttcttcaagacaccgagggaggtgaagcctcccgaggacctgcaagacctgggggtacgcttcctgcagcccttcgtgaatctgcygtccaaaggcacctactggtggatgaacgccttcatcaagactgcccacaagaagcccatcgacttgcgagccatcgggaagctgcccatcgccatgagg

SEQ ID NO: 14481 - DNA, 201 bp, Homo sapiens
taactcagtcctacttcatctccccgggctgttttcagatgccatcatcacagaaggcggggagaatttcagccagggacagaggcagctgttctgcctgrcccgggccttcgtgaggaagaccagcatcttcatcatggacgaggccacggcttccattgacatggccacggttggtcctgggcccctccatgggaccat

SEQ ID NO: 14482 - DNA, 201 bp, Homo sapiens
taacgcgcacatgccctgatgcacacacatcttcaacacgcacttactctacccttcaggcatggtttcacactcactgcagacacgtcaccctcccacaygtctccaccctgggggtgtgcagtagcatgctctctcccacctcagaacctcccttcagtcccctcagacacatgccctctctccacgcagagacaatca

SEQ ID NO: 14483 - DNA, 201 bp, Homo sapiens
cagacaggaatctccccatatcactgaggagcaaattgaggccctgagaaaggctgtgacctgcccagagctggccacagctggcaggcggcagaggcagyctcctggctcccagtccagtgctccttcacttcctctgccctcgcaccagggcagttgctgaggcagacacggtggcaggtggtaatgagtgagtgtggc

SEQ ID NO: 14484 - DNA, 201 bp, Homo sapiens
tcagtcctacttcatctccccgggctgttttcagatgccatcatcacagaaggcggggagaatttcagccagggacagaggcagctgttctgcctggcccrggccttcgtgaggaagaccagcatcttcatcatggacgaggccacggcttccattgacatggccacggttggtcctgggcccctccatgggaccatggtc

SEQ ID NO: 14485 - DNA, 201 bp, Homo sapiens
atctcacacttgccgaccctcaactcacacagtcctgagacccacatacgctgagcgcctcacactcctataacgcgcacatgccctgatgcacacacatyttcaacacgcacttactctacccttcaggcatggtttcacactcactgcagacacgtcaccctcccacacgtctccaccctgggggtgtgcagtagcatg

SEQ ID NO: 14486 - DNA, 201 bp, Homo sapiens
tcaacacaagtgaatatgtaggtttcccccacggtatttatcttgtaagaatgggatcatattatgcagttttctgcactgtgcttttctcacccaacaawtatctcttgggactccctccaagccatctgatatggctaattccgttttcttaatggctgcataatattccatcgtatggatgagccataatgtgttcag

SEQ ID NO: 14487 - DNA, 201 bp, Homo sapiens
ttttaagcaaaaagagtaagttacaaatagtatatgttgtatgcttactactaaactggaatatatgttatgtatacatttgtacagattcacacatgaaraagaattggaaaatcacatagtgggattataagtgatttttattttctttatgtgtttctaaattctctaataagcgtgtataagatttggaaatcaaca

SEQ ID NO: 14488 - DNA, 201 bp, Homo sapiens
gtcgcacgcctgtggcagaagctcccatctcacacttgccgaccctcaactcacacagtcctgagacccacatacgctgagcgcctcacactcctataacrcgcacatgccctgatgcacacacatcttcaacacgcacttactctacccttcaggcatggtttcacactcactgcagacacgtcaccctcccacacgtct

SEQ ID NO: 14489 - DNA, 201 bp, Homo sapiens
tttccgtagaaagggaagataagcatcaggcactggcctctcctactttctttcttcgggggtgggggactttgctttaatgtattcatatcgtcacgctsgtaaatgaatgagtaagtgttttgttttcctttctgtttgctcccgcctccctctctcttcctcaccccagactccaaccttccccttcccctgccccta

SEQ ID NO: 14490 - DNA, 201 bp, Homo sapiens
ggacgtgttcaccacgctggtggacctcaagtggccacacacattgctcatcttcaccatgtccttcctgtgcagctggctgctcttcgccatggcctggyggctcatcgccttcgcccacggtgacctggcccccagcgagggcactgctgagccctgtgtcaccagcatccactccttctcgtctgccttccttttctc

SEQ ID NO: 14491 - DNA, 201 bp, Homo sapiens
tcgcagctacgcttctgcctcacagggctgctggtgatcctctatgggatgctgctcctcgtggaggtcaatgtcatcagggtgagggtaagcaggccacytgggccagggtggggtgggaagcagaggctctggcctctgtcctgccctgggttcaggcccccaccctgcttctcagccaaactgagaagggatcagctt

SEQ ID NO: 14492 - DNA, 201 bp, Homo sapiens
tgccaacagcccactctacgacctggcacccagcgacctgcaccaccaccaggacctcgagatcatcgtcatcctggaaggcgtggtggaaaccacgggcmtcaccacccaggcccgcacctcctacctggccgatgagatcctgtggggccagcgctttgtgcccattgtagctgaggaggacggacgttactctgtgga

SEQ ID NO: 14493 - DNA, 201 bp, Homo sapiens
ccatacacatttaatgcattggctttaatccagcagcctgttgagagctattagcacttattgattgcccacttactgtatgccaggcaccgtgctaagtrttgtatgtgcattattacatttaatcctcacaaggaccacataacataggtacgaatcgccacattctccagatgcagaagcgagacccagagaggctgg

SEQ ID NO: 14494 - DNA, 201 bp, Homo sapiens
cagtcctagagaccagcctgagctgggggacattattccagtcctgaggcatgagagcagaaggccgatgcttctgccctccatcctaatgtcctcctgcmgggacccaaggtggatggcatcgatccccccgggtgagctcagccctgggcgcatggtggggcccaacatctcaacctgtttcctaaccctgagccaggc

SEQ ID NO: 14495 - DNA, 201 bp, Homo sapiens
agctgtggaattcctccagtcctagagaccagcctgagctgggggacattattccagtcctgaggcatgagagcagaaggccgatgcttctgccctccatsctaatgtcctcctgcagggacccaaggtggatggcatcgatccccccgggtgagctcagccctgggcgcatggtggggcccaacatctcaacctgtttcc

SEQ ID NO: 14496 - DNA, 201 bp, Homo sapiens
ctcaaggacttccagaggtctgaatgccagctctttgagcactggaagaccctcatgaaccgacaggaccaagagctggagaaggtgggtatatccagggrtggccaagcagccacccctggatgcaaaggttctgctagaacctgaactcataaaggtcttcctgtccttagtgccccaggaagccccctaaagggcaga

SEQ ID NO: 14497 - DNA, 201 bp, Homo sapiens
ggcagagtggagtggaggcagggggacagccttcagctgtggaattcctccagtcctagagaccagcctgagctgggggacattattccagtcctgaggcrtgagagcagaaggccgatgcttctgccctccatcctaatgtcctcctgcagggacccaaggtggatggcatcgatccccccgggtgagctcagccctggg

SEQ ID NO: 14498 - DNA, 201 bp, Homo sapiens
taccttgtagttcaggacaatcctgaggaacacagaagtgctggcttccttgaggaatcagtgatcaggactctcgagccccttgaaccccagcatagggygggagggggtgagggcagcaggggtgggtgtctgaattaatgtcaggtctacgtgatggtgtcatcaagtgttccagataaaaagttttattgagccggg

SEQ ID NO: 14499 - DNA, 201 bp, Homo sapiens
agactctgaaaaaaaaaaaaaggaaagaaagaaggaaaggaaaggaaagaaaggaaaggaaaggaaggaaagaaagaaagaaaggaaagagagagagagaragaaagaaagaaagaaagaaagaaagaaagaaagaaagaaagaaagaaagaaagaaagaaagagaaagaaagaaagaaaaagaaaagaaaggagttaggg

SEQ ID NO: 14500 - DNA, 201 bp, Homo sapiens
aggtttgtttctgagtttctgtagtgaccttggcaataccttgtagttcaggacaatcctgaggaacacagaagtgctggcttccttgaggaatcagtgaycaggactctcgagccccttgaaccccagcatagggcgggagggggtgagggcagcaggggtgggtgtctgaattaatgtcaggtctacgtgatggtgtca

SEQ ID NO: 14501 - DNA, 201 bp, Homo sapiens
tggccaacatggcaaaaccccatctctgctaaaaatataaaaattagctgggcatggtaggcacgtgcctataattccagctactccggaggctgaggcaygagaattgcttgaacccggaaggtggaggctgcagtgagctgagatcatgccacttcactccagcctgggaagcagagcgagactctgtctctaaataaa

SEQ ID NO: 14502 - DNA, 201 bp, Homo sapiens
acttaatttttaagatggagatcatgtaattttgaactctaggtcttgcctactcctatataaattctcctctaaacaacagccaaaattgaggccctctytgagcttcaggctggtgccaaatggctctgcttattttccccaaaataaatcttccttccatgtatgatgagaccccctccagtataaagaagacccaaa

SEQ ID NO: 14503 - DNA, 201 bp, Homo sapiens
ggctgagacaggagaattgcttgagcccaggaggcggagactgtggtgagctgagatcgtgtcactgcgttccagcctgggtaacagagcgagactcggtytaaaaaaaaaaaaaaaaaagaaatcaggttttgtctactaaacctgctgcacggttaccgttactagtactcacagggtttgttgcacatgcatcgttgc

SEQ ID NO: 14504 - DNA, 201 bp, Homo sapiens
catttatcatggagtgtcctttggttttctgtgtttgtatatacctttaccacttatagatttgaccagcactcaagaaccagtgttactcctgggagttratacaatcccagccccatggcaaagaaactcatgtggttaggattctgtgtgcagcctggttagccacagggcacgtaaggctttttataatattgacat

SEQ ID NO: 14505 - DNA, 201 bp, Homo sapiens
gtgcagcctggttagccacagggcacgtaaggctttttataatattgacatgagtgcagaagccccattcccgtgtaagccctgagggctcttgtttcatmatctttttttggtcacatgcacacagctttattgagatataacccactcatttaaagcatacaactcagtgggttttagtgtcctatattcacagagctg

SEQ ID NO: 14506 - DNA, 201 bp, Homo sapiens
cattcccgtgtaagccctgagggctcttgtttcatcatctttttttggtcacatgcacacagctttattgagatataacccactcatttaaagcatacaamtcagtgggttttagtgtcctatattcacagagctgtgcagccatcatcacaaatgtggaagttttcatttccccaaaaagaaacccgtacccattggcag

SEQ ID NO: 14507 - DNA, 201 bp, Homo sapiens
tgttagtgagcttggggtgccatgggagccttcttgttgtcaggcccaacccaagctggctgaagaacaccctgatggcctccatttgagcacaactaatraaggactggatgccagagataagtccaggagggtgatgctgcagggcaggccagggaagagggtacttcatctctatcatggtcctctgcccatccatgc

SEQ ID NO: 14508 - DNA, 201 bp, Homo sapiens
aatggtcccctggtcagagtgagggcttacggaggtcaggtgatccatggagtcctggcccaagtttatctcacagttggtctcgtggctccgtggacccrtcccatggtggttacttcccaagtgcataattgggatgtagatatttagcaaccagctgacttcacactagttccctgacctgtccagtctaagagtcat

SEQ ID NO: 14509 - DNA, 201 bp, Homo sapiens
ttttttcccaggaagaggggctcccttccctacacagctcccagcccagtgggtcctcacctccaaaccacccccagcccctcagggttgtgaaccgcaarcgtccagcccgggaggattgtcggggcctcaccggcccactgcagagcctggtccccagtgcagatggcgatgctgacaactgctgtgtccaggtgagtc

SEQ ID NO: 14510 - DNA, 201 bp, Homo sapiens
ctgtaggcagctctcactaagggctaaagggcttctgatgcctgggatagaatctgtccggcagagtggagtggaggcagggggacagccttcagctgtgraattcctccagtcctagagaccagcctgagctgggggacattattccagtcctgaggcatgagagcagaaggccgatgcttctgccctccatcctaatgt

SEQ ID NO: 14511 - DNA, 201 bp, Homo sapiens
atttcccttccagtgctgagcgtttccagtgtgggagggacccacaccctgggccaccctggcctcacttgtgcctctgtccacagactttcgtgggccaygtcagcttcttcaaagaggccgacttctcgccctccgtggcctttgcctccctctccctcttccatatcttggtcacaccgctgttcctgctgtccagtg

SEQ ID NO: 14512 - DNA, 201 bp, Homo sapiens
tctgagagacagtctgcaacactgtggccctgagcagggagcgggttcagccagcacaccttatgggattccacagcattgggccagacccagagctgtcsccgtgctgttcacacacatttccttccatcagcagtggcagctgtctccaaagcaaatcactgcagggtcatttgtgtacctgtttcacccacgggtata

SEQ ID NO: 14513 - DNA, 201 bp, Homo sapiens
aaaccaatgagaaggctctcagggtatagcgggaatacagaggacgcatgatgatgcctggacttaggtggtaccacagggatggagagaagtagatagaktcaagctatttaggacgtgaaatagacagcatttgttaatgggagaggtgtggggcgagggagaagaatagagggagaaggaggagtaatgggagctcac

SEQ ID NO: 14514 - DNA, 201 bp, Homo sapiens
aaaaagaattggaaaatcacatagtgggattataagtgatttttattttctttatgtgtttctaaattctctaataagcgtgtataagatttggaaatcarcaacatgatacttttagcctaggcaacaaagtgagaccctgtctgtacaaaaaattagctggaagtggtggctcacaactatagccccagctactcagag

SEQ ID NO: 14515 - DNA, 201 bp, Homo sapiens
tttcgacataatcataataattgctttatggagaccagcttggaggagaacaagatggggaggaagtgtggaaaccaatgagaaggctctcagggtatagygggaatacagaggacgcatgatgatgcctggacttaggtggtaccacagggatggagagaagtagatagattcaagctatttaggacgtgaaatagacag

SEQ ID NO: 14516 - DNA, 201 bp, Homo sapiens
cttatctgcactccagcctctccatatggtgcacctggagaggggccaggtgtgcctgagcattggggcaatccagctcccataggggagagggcaggaayggagggaagggagagagccccgctgccttttctctagctggtgggagggctagctagctctctctgtgagtctccattcgcctggctcctgcactatttt

SEQ ID NO: 14517 - DNA, 201 bp, Homo sapiens
gttttgtctgtttgaaccagccccatactgatgagcatttgggttgattccaggaatacaacccatatactacaaaggaagtcctttcatgcctccgtgcrcacctgactccacactttttcaaagtaattctcccacccacatggtgggcagtgtggtgcatgtcctcagtgtagacctaggtgcagggaaaggtggaat

SEQ ID NO: 14518 - DNA, 201 bp, Homo sapiens
caggatgtggaggggaggaactgtctctggccagcctgccccagttccgggcccctccatcgatcacccacacccagccatctcactccccaggtgcttayctgcactccagcctctccatatggtgcacctggagaggggccaggtgtgcctgagcattggggcaatccagctcccataggggagagggcaggaacggag

SEQ ID NO: 14519 - DNA, 201 bp, Homo sapiens
aaacaacggtaaaagcctgtcggagggaggcaggatgtggaggggaggaactgtctctggccagcctgccccagttccgggcccctccatcgatcacccayacccagccatctcactccccaggtgcttatctgcactccagcctctccatatggtgcacctggagaggggccaggtgtgcctgagcattggggcaatcca

SEQ ID NO: 14520 - DNA, 201 bp, Homo sapiens
gcaccaggcaatgtggggtgagggagagaccattaaataaccctgattgatcaaggggctgccgtgtgtagtcacccatgggatgaagtagcttggactawctccccaacttgcaaagcacattcatacccatgatctcatcttaatcttctgggttccatattattatcttttccatttagaaataaggaaactgaagtg

SEQ ID NO: 14521 - DNA, 201 bp, Homo sapiens
acacctctctatgcagcatttgtggctacagactgggtccaggggattgtaaaggcatgctcatgttgggttggagggagctcaggatcttcctggaggayatggttcactcccatgagagctcagtatgcctttcctcccctgctgcagcccagagcgggagacagcgaccgacttggatatcaggtactgcgtcctggg

SEQ ID NO: 14522 - DNA, 201 bp, Homo sapiens
tgctttatgttcatgtgcaaatctaaaaaatccaagtgatatagattaatgaggctctgagtccctcaaaaccttccctccccttacctctccaaaaaacrcttgagataccctagaggtggtatgaagtcaggatgggaaggttggctcagctttgcaaataagtttaagcctctggcctttgctctccaacaccaaaga

SEQ ID NO: 14523 - DNA, 201 bp, Homo sapiens
gtttgtgccttcacccccattttatagatcaggaaacagaggctcctccaagtaaaggagcttgcctcagatttcacagccaatgagtggaaaagcctctrggattcaaatgtcagagcccatatttttcctacttctcgcacctgttatcatatgctgcctcttcctttaacctgcagttccctcccttcacctccaccg

SEQ ID NO: 14524 - DNA, 201 bp, Homo sapiens
tcctgatgctgccacttgctagctctgtgaccttgagcaggttacttcacctctctgagacagactcactgtctggacaatgagtaaaaccctacctttcytgtctcagagatttggcaatgggacccaatgacatcaattggaaaggatgctgtgggtgaaaggtaacctttcaggacagcgacaagcctgtctgggcag

SEQ ID NO: 14525 - DNA, 201 bp, Homo sapiens
aggcaggtgtggtgagacagctgacagacaggagaagggatgctctgaggaagtgactgtccagccatgggaaccagatggcccctggctgtagtcctgaygctgccacttgctagctctgtgaccttgagcaggttacttcacctctctgagacagactcactgtctggacaatgagtaaaaccctacctttcctgtctc

SEQ ID NO: 14526 - DNA, 201 bp, Homo sapiens
gccatgaataccccaggagtccaacctccctttgtccagctagaccatggtgtcctatgcctcaggcagggaatgtggtccagtcatcagtggctgggccrtctgccatacatggcgcaagccatggcgttttatgcagaaagtcctgctagcatttgattttctcagaatggagctgtgagcatggcaggcaaccactgt

SEQ ID NO: 14527 - DNA, 201 bp, Homo sapiens
agtgcgtgttcatttacctcctctggacttcctgccttctgttaccagggatcaagacacaggtcattaggcgtgaggtaatggggcatctcttgttctgrcccctggcgccagtcttggagtcctgacgctgcagaggagccccagagtcacatttcctgttggggcccatcctgctcatatgcggcaccatcagacttc

SEQ ID NO: 14528 - DNA, 201 bp, Homo sapiens
tttgtatttttagtagagacggggtttcactatgttggccagggtaatctcgaactcctgacctcatgatccgcccgcctcagcctcccaaagtgctgggmttacaggcatgagccaccacccctggccggccccgcttttaagagaggggagagaagacctgggccttagaagagctcagaggaaccacaattgactctg

SEQ ID NO: 14529 - DNA, 201 bp, Homo sapiens
ctggcttggtggggagcatggctgagggagagccggggcacccatcaattaaggaggtaaagatcagtctgactgagatgcctcctgccacacttcctcakctgccagcaactgacaccattaacctgatttccttccccctctgttgactgcactgactattggactgaatgggaaacagccccgtgcacctcaaaatgc

SEQ ID NO: 14530 - DNA, 201 bp, Homo sapiens
tcctgccacacttcctcagctgccagcaactgacaccattaacctgatttccttccccctctgttgactgcactgactattggactgaatgggaaacagcyccgtgcacctcaaaatgcacttcccctcctgcagatgcatcttgcaattaggcccaaactgtgagcctgcatgctcctcccctggccctgcacaggcaac

SEQ ID NO: 14531 - DNA, 201 bp, Homo sapiens
cctcccagagtgctgggattacaggcgtgagccactgtgcccagccttgaatggataagtcttaagggatatttttggaaaggatattctaaaaaataccyatgtctctacactattgcagaagggctttcagttttgatggcagcctttcaggccagcctacacgcaactaaacttttccataacagcatcacacttaca

SEQ ID NO: 14532 - DNA, 201 bp, Homo sapiens
acgcaactaaacttttccataacagcatcacacttacacaagaagaaggttttataatccacttgccattatttaacatagttcttcctccttaactttcragatctgagcactataatgttcttctttttgtttttgtttttttctaaatcaaattaaggtgagtcacctcaccttgggcctgagttggacagaaatcta

SEQ ID NO: 14533 - DNA, 201 bp, Homo sapiens
caagaagaaggttttataatccacttgccattatttaacatagttcttcctccttaactttcaagatctgagcactataatgttcttctttttgtttttgkttttttctaaatcaaattaaggtgagtcacctcaccttgggcctgagttggacagaaatctattcttggctatattccccacccctccaccaccttggaa

SEQ ID NO: 14534 - DNA, 201 bp, Homo sapiens
aatttaggcctggggtcagggcactgttgagcattttacaccctaggccagaggaggggtgacctgtggagcagggctaagctagtagcccatgaggtatratgtgtaggcagcacctggggctcacagagcctgttacccatgttatctcctctgaccttggaaagagctggggtgtatgaacaagtatttataagttta

SEQ ID NO: 14535 - DNA, 201 bp, Homo sapiens
aaaaaaaaaaaccagtgttgagccaaatgtggaatcctcctaaattctacccactggtcctaacttcaccctccagagccaccaagaatgaggccatcccktccccacgtggctgccccatggatatcagaaggcatccactgtgtctatctttcccaggccaagtatcccctaccctttccacagcccctgagccctcac

SEQ ID NO: 14536 - DNA, 201 bp, Homo sapiens
caggggccccagggttgggtgcatctgtctgtctgtctttctgggtaatggttgttcagactcccccggccccactcacatctgccaccctccctccctgyaggccagctgactatgatcgtggggcaggtgggctgcggcaagtcctcgctccttctagccgcactgggggagatgcagaaggtctcaggggctgtcttc

SEQ ID NO: 14537 - DNA, 201 bp, Homo sapiens
aggatagacaggcaaagacagtgaataaacaagcaaacaaataggtggtggggatgctatgaagaaaatcaagctgagtaaggggtaggggcaatgacaawgttgctatctacacaggatggtcagggaagggctgtggtaactgtgggcatgcagatatttgggggaaggtattccctgcaaggggagtgacaagtgcaa

SEQ ID NO: 14538 - DNA, 201 bp, Homo sapiens
agcctggctcctggtctcagagagaactgtgtggttcccaagcattcactttaggaagaatcacttgcccctccctggctctctgcttcaaggaactgtgwcaaccttgggatttgcaaactctctctttaatccttaagaggaaaatgttttggtaaaaagtcaagattagcagatacactcgggtgaaattctttccct

SEQ ID NO: 14539 - DNA, 201 bp, Homo sapiens
ttgcctggtcccagtaatcaagaaagaaccctgaagcaggcagttcagggcaaggggcctggagggcatgcagggagcctgggttgcaggatttggggtgsggggttttgcccctgtgcttccctcagacctcccctctccttctccaggttccaaggcctgcccctgtcccaaggccttatatgttaggctggcgttact

SEQ ID NO: 14540 - DNA, 201 bp, Homo sapiens
tagtgggctggagggaaggacatgcggttggggaactggaagactcatgctttcagctgtgtgcttcctccctagagtgcaggcagaggaggaatcgaatsccctcagcactcttgtaaagaccacagcaatgagtgagagatggtgcctgccagacataccattctttacttttcagcttaaaacagatacaaagtttgg

SEQ ID NO: 14541 - DNA, 201 bp, Homo sapiens
ctcagtatcctcatgtgtaaaatggggatagggtttatagggttgtaaggatgagatgatgagttgtttgcaaacaacttctcacagtgcacagtgaaggycagcaatgagagccagccccgccctttcttctttccaaatgattaatatatctgttaccagcctccattcattatatagctctgtcatgtgctaagcacc

SEQ ID NO: 14542 - DNA, 201 bp, Homo sapiens
gactggcggcccatggcagaggttgggagtggggatgggggaagggctgagcccatgggcaccctggaactccaaatcactctctgcctgtgaaggagtgyaccctcgaccagactgtctatgccatggtgttcacggtgctctgcagcctgggcattgtgctgtgcctcgtcacgtctgtcactgtggagtggacagggc

SEQ ID NO: 14543 - DNA, 201 bp, Homo sapiens
cacaacaggcaaacagattttctggccccttgtcgaggctagacctcacaatctaactgcactttttactttccagcctcatgagttttctgtggcccacrgatatggcctccaagtttatttacttttactctctatttgccccagctctgtagttctgaaactccctggttggggttgggctgactctgggtcagccag

SEQ ID NO: 14544 - DNA, 201 bp, Homo sapiens
ccacgctggagtgcctgagccgctccaccctgctctgtgtctcagccctggccgtcatctcctatgtcacacctgtgttcctcgtggccctcttgcccctsgccatcgtgtgctacttcatccagaagtacttccgggtggcgtccaggtgatggcctcaggggtgaggggtgggaggtgctttgcaatgtgcagtttggt

SEQ ID NO: 14545 - DNA, 201 bp, Homo sapiens
gggatcagcttgttttacccgcccgtgtaaaggggagtggggccgtggcggaaatttcaggatagacactgcatctggcccacgtgtgctctaccccaggstcccagagggagaggggggtgatgggtgtgttcgctgaggttggcggatgactttccgtagaaagggaagataagcatcaggcactggcctctcctactt

SEQ ID NO: 14546 - DNA, 201 bp, Homo sapiens
ggacgtttccatgagatgactgtggggatgatgaaggtgtctccaactaaaagatcctcttaggagcctgctccctgacagccctctcatttcccttccartgctgagcgtttccagtgtgggagggacccacaccctgggccaccctggcctcacttgtgcctctgtccacagactttcgtgggccacgtcagcttcttc

SEQ ID NO: 14547 - DNA, 201 bp, Homo sapiens
gtccagcttccctttcaagcatagtgaagtgcatttgttagcttgcagccaaccctgggaaatcatgagaatttgttcccaagtcaactcattctccagcrtccacagtgacgtattcactcacccagttgagcgcctagtgtatactagaccctgtgacagcaacaggagtgcaaaggtgactaagacgtggcccctgct

SEQ ID NO: 14548 - DNA, 201 bp, Homo sapiens
cctttacaggtagcctaggccccagctcccagctctgttcgaggctcgcagaggggcggtagtgaaggggtctcatttctccaggatcctctttgctctcycgcccggtcctggtccagcttccctttcaagcatagtgaagtgcatttgttagcttgcagccaaccctgggaaatcatgagaatttgttcccaagtcaac

SEQ ID NO: 14549 - DNA, 201 bp, Homo sapiens
cattgtcccacaggctaattcccccagcctccttattggtattgttaatatccccattttccagtgtggaccctgaaactgagaggttaaaaataataacrgtaaatactcactttgtacttactgtatgccaggccccatcctacctatgtgatatattaattcatttaatccttgcaacaactctatgaggtaggtacc

SEQ ID NO: 14550 - DNA, 201 bp, Homo sapiens
caagactccatctagaaggaaggaaggaaggaaggaaggagggagggaaggaagggagggagggagggagggagggagaagaaagcttgagcctggatgargtcacctggggagagaagagaaaggctctgggaccagagcttgaggtttgctaacatttagagagactcgggaaggactgcccacttagagcttctgaga

SEQ ID NO: 14551 - DNA, 201 bp, Homo sapiens
gtaaggggcccattgatggggtgcagagggacacccagggacaggactggcctcttgtggccgtcatcagtgcacagcccctgggcttgcctggtcccagkaatcaagaaagaaccctgaagcaggcagttcagggcaaggggcctggagggcatgcagggagcctgggttgcaggatttggggtggggggttttgcccct

SEQ ID NO: 14552 - DNA, 201 bp, Homo sapiens
ctgctctgccctgcctcagtccccacctcttctccaagctgtgccaaccctccgggtctgactgctgcccctctctcttaggaaacctctgccccagcccrgggaacacaaggagcctctccaaggcagaggaccctaagcacttcttttttttattattttttattttattttaggttctgagatacatgtgcagagtgt

SEQ ID NO: 14553 - DNA, 201 bp, Homo sapiens
caccccataaaatgggagactaagagtacccactcgatggggtttaatgaagattaaatgggttaacatatatcgcatgcttagaacagtgcctggcacaragtaaatgctccataaatactgactctcatcagtttgttatcacagcctctggggagggcgccagtgctgacttatgctgttcgtgttaaatggggctgt

SEQ ID NO: 14554 - DNA, 201 bp, Homo sapiens
cctcatgccctcatgtggcatcgtgcctgcctcaggagctctccttgtcctatgtagatgaagcaggcatgattggcaggggtctgctctgccctgcctcrgtccccacctcttctccaagctgtgccaaccctccgggtctgactgctgcccctctctcttaggaaacctctgccccagcccagggaacacaaggagcct

SEQ ID NO: 14555 - DNA, 201 bp, Homo sapiens
gcatggcagccccctccataccatcagcttctcaagggcagggacccttggcacactggatagaagtagcctggtgggcaacagcagcactgaggcagcargctgtagcaggccatctgggaatggagtgggtaccacagggctggagcagaaagggcaggctgggcagatctgataaagtggctggaggccacatagcct

SEQ ID NO: 14556 - DNA, 201 bp, Homo sapiens
atttaggaataaaagttgcagccaatcagcagaagggcaagctttccctaccaatcatttctaggggaaaattattgaaggtgtcaggtttttcataagcwtgagtacagaactgagcagggagaaagactttgggcccaatgtctgaatatcaacatgcacccccgtttcctgcatttccaagatgtccctgaatggtgt

SEQ ID NO: 14557 - DNA, 201 bp, Homo sapiens
tggccacccagcaccaactcccagagggagctcagcacctggaaagccagaaagctgcatgcttagtcctctgcagaggtcaccctgcctgcctgtacggkccataggagtccagaaaccagggaccaccaagtggggggacccccagccttaggcaagggtcagcatgagaaggccagtctcccactcccctgctctgga

SEQ ID NO: 14558 - DNA, 201 bp, Homo sapiens
taagaaaataggaactgagaaatgaagagggtaaaaagatgttcagcaacctgggcagaggacaactacagccatcaacataaaacctggctctgtgccckctggtagccaagggaaaaagggatctctgggctttggagtattcatttaggaataaaagttgcagccaatcagcagaagggcaagctttccctaccaatc

SEQ ID NO: 14559 - DNA, 201 bp, Homo sapiens
atggatgaagctggaaactatcattctcagcaaactcacacaggaacagaaaagcaaataccacatgttctcactcataagtgggagttgaacaatgagarcacatggacacagggaggggaacatcacacactggggcctgtctgggggtggggggcaaggggagggatagcattaggagaaatacttaatgtagatgaa

SEQ ID NO: 14560 - DNA, 201 bp, Homo sapiens
gaatggacaaaggccctgaggccatgaggcaggaggattttctggcagaggcagccatgagcaaagtatggaggtgggttggaggtgggacccaggatggygtttcttgggaccacaaggagcctgggctcatactaggagcatgggaaaggagaagcgagtgcttaggaagggtggcggggcaggaaatcagagaggggg

SEQ ID NO: 14561 - DNA, 201 bp, Homo sapiens
tgaggcattgcctcacccaggaagtgcaaggggtcaggtagttccctttcctagtcaaagaaaggggtgacagacggcacctggaaaatcgggtcactacmaccctaatactgtgctcttccaacgggcttaacaaacagcacacgaggagattatatccagcacctgacttggagggtcctacacccacagagcctcgct

SEQ ID NO: 14562 - DNA, 201 bp, Homo sapiens
gaaaatcgggtcactaccaccctaatactgtgctcttccaacgggcttaacaaacagcacacgaggagattatatccagcacctgacttggagggtcctayacccacagagcctcgctcattgctagcacagcagtctgagatcaaactgcaaggcggcagcgaggctgggggaggggcacctgccattgcccaggcttga

SEQ ID NO: 14563 - DNA, 201 bp, Homo sapiens
catgaacttcgaggatgggttcatagacatgaagtagaaaggaccaagtcaagaagaatgacaaataatcaacagaaaacccgtattcttcaggtatgttyctgtttgtctttgaacaatagttggcgtatttgttggaaggcttctcccagctgggttactctcttccctagaaggttggtaaacttgagctttagcctc

SEQ ID NO: 14564 - DNA, 201 bp, Homo sapiens
ttcggatgtggacaattcagatgataatttcctacttcaggtggactcatacacttgatatttttcaactctgatgggtaagaaaagtaagcaaagagtartgtattttaattattctaaacaaatggacatctacttcccttagaatgaaaagaggaatctgtggaaaatgacttccttccataatcttctatcatctca

SEQ ID NO: 14565 - DNA, 201 bp, Homo sapiens
agtgattttgaattatgaataatgtctctgtataagattaacctgagaaccagacagggcttagggaatcaaagggaagagcctgggttaccagaacctargaacttggtggaggagtcccatgcatttaatacatgtacttctaagaaggggcagcacctggctgatactaatatctttaagggggcctgatgaggtcgg

SEQ ID NO: 14566 - DNA, 201 bp, Homo sapiens
atcccttcatagatgttatctgccaacctattccattgtgaagttgctttttctctctatgccatacatattttgtgagaaagatactttaagactatgtwaaaatatcctgttcatcatcacactttatatttgttcacttatttgttaatatctgtatggattcatcgtttcttattttattcaacagattataatccg

SEQ ID NO: 14567 - DNA, 201 bp, Homo sapiens
caagatagtatattccaaattatttcatattatagaaataaaaaatattccatagtccttaagccacgcctttttttttttttttttttttttttttttttgagatggagtgttgctcttcttgccgaggctggagtgcaatggcatgatctcagctcactacaacctctgcctcccaagttcaagtgattctcctgtctc

SEQ ID NO: 14568 - DNA, 201 bp, Homo sapiens
ttaaaactgcaagctactctcccatcccacctcaccccacactcaatccctaatcaacttccatgctttttccccccatagcacttattcatcattctctrtaacttattttctttattttctgtatccaccctctcactctctttttttataagaattaagctccatgaggacaggatttttttttccgttttgtttact

SEQ ID NO: 14569 - DNA, 201 bp, Homo sapiens; identical to SEQ ID NO: 1302

SEQ ID NO: 14570 - DNA, 201 bp, Homo sapiens
tacataaattacaaaactacaataacatcagggttctctgagaggcaaaactacatttgtttcagaagatactttaatggacttatttagaaaatgagaccccccccccccgccccctcatctaggagaccaacctcaaatcacctctactgcagacaaagttagcagagattggagggtagagggttgaacagcagaaaa

SEQ ID NO: 14571 - DNA, 201 bp, Homo sapiens
tactaatgtcttgaattcgatttttttcctccaaaagtgctgtggatatagtgtgcttgggacatggtggtttgggcattttaggctaaatcaggatttcrttgaattattgagcatttagaaagccacaaatatacactgtccttccaggagtctgcatgatagactggcatttgtcacactgcactagctaccgcaccc

SEQ ID NO: 14572 - DNA, 201 bp, Homo sapiens
aattacctgttgggtactgtgctcattacctgagtgatgaaataatctgtatgccaaacacctgtgacatgcaatttatccatgtaacaaacctgcctgtstaccccctgaacctaaaataaaagttgggggaaagaaaaactgaatccaagggaaaacgagaaggtaaaaatgtttaatgatcatttatgccgaagtatt

SEQ ID NO: 14573 - DNA, 201 bp, Homo sapiens
atgaggcatcatttgttttcctcttccccttttcttttcttttttttttttttttgagatgaggtctcgctctgttgcccaggctggagtgcagtggcgcsatctcggctcactgcaagctctgcgtctggggttcacgccattctcctgcctcagcctcccaagcagctgggactacaggcgcccgccaccacgccctgc

SEQ ID NO: 14574 - DNA, 201 bp, Homo sapiens
tcttttttttttttttttgagatgaggtctcgctctgttgcccaggctggagtgcagtggcgcgatctcggctcactgcaagctctgcgtctggggttcaygccattctcctgcctcagcctcccaagcagctgggactacaggcgcccgccaccacgccctgctaattttttgtatttttagtagcaacggggtttcacc

SEQ ID NO: 14575 - DNA, 201 bp, Homo sapiens
atcacagatttatgtttaccgtgattgttagctaagatttaatctcaaatggttttaagttttttggtatttgtagtcttttttttttttttttttttttygtcctttttagggatctgcctgcctcagcctcctgagtagctaagactcgaggcacataccaccatacctggctaatttttaaatttttttttgtagaga

SEQ ID NO: 14576 - DNA, 201 bp, Homo sapiens
cttttttttttttttttgagatgaggtctcgctctgttgcccaggctggagtgcagtggcgcgatctcggctcactgcaagctctgcgtctggggttcacrccattctcctgcctcagcctcccaagcagctgggactacaggcgcccgccaccacgccctgctaattttttgtatttttagtagcaacggggtttcacca

SEQ ID NO: 14577 - DNA, 201 bp, Homo sapiens
ttagtgaagtgtagtaatcccagttactcaaatttaaaatgtttcactagtaaactgaatttaacgaattctctttcatagagaatgttgtgttatttttmcttattggtgaaaacctagctggtgcagatgaacaggaatcgaacctattatcagtaaaattagattccttttacaatttggccatttattttagcttta

SEQ ID NO: 14578 - DNA, 201 bp, Homo sapiens
ttcaccatgttagccaagatggtctcgatctcctgacctcatgatccatccgccttggcctcccaaagtgctgggattacaggtgtgagccaccgggcccrgccttccccttttcttttcatcctattgctttttcctctggcttcagtctgtggcatattagaaatgggcctggaaagaggatgtaaaccagcgagtctg

SEQ ID NO: 14579 - DNA, 201 bp, Homo sapiens
aagtcctattaaattaggataaattaatataaattcctaatttaaaatgatcaaaaaaatattttttatcatataccttttgtgcctttaaaccaaaagtrtggtgaaagaattgtaatccaccaaaaaaaaaaaaatcatatcagtttttttgtggctttgtaatgctgacatggcttctttttctaccttttttagttc

SEQ ID NO: 14580 - DNA, 201 bp, Homo sapiens
taggctgaggcaagagaattgcttgagcctgggaggcggaggttgcagtgagtggagatcgtgccactgcactccagcctgggcgacagagctagccagamtctgtctccattaaaagaaaaaaaaagcaaagaaagaaaaagaaagaattgtgtgtgtgtgctgcatttttggaagtccacaggggttacatcttcagca

SEQ ID NO: 14581 - DNA, 201 bp, Homo sapiens
gcaacgtatgataaaaaatcgagaatccgcttgtcagtctcgcaagaagaagaaagaatatatgctagggttagaggcgagattaaaggctgccctctcasaaaacgagcaactgaagaaagaaaatggaacactgaagcggcagctggatgaagttgtgtcagaggtaagtgttagtaatacggctgagtcgagatgggc

SEQ ID NO: 14582 - DNA, 201 bp, Homo sapiens
agcagaatcgcttgaacctgggaggcggagattgcggtgatccgagatgatgccactgcactccagcttggcgacaaagtgacactccgtctcaaaaaaayatatatacatatatatattgaattctttcctcttgggtgaagaggcaactgcaatggagtggctgctgtgtttttttctcttctgcttctctccttttct

SEQ ID NO: 14583 - DNA, 201 bp, Homo sapiens
caaagggaacagcatgtttaaaggcacagttatgaaatggcatgacatgttcataaaaaagtgaaaagttcagtgtatcttgtatatgtggggagtgtgcytgaggctagatatatggttagaagtataggtgctgctgtgtacaatgaggcatccctagcttttaggtggagggtaacataatcagctttgcatattagg

SEQ ID NO: 14584 - DNA, 201 bp, Homo sapiens; identical to SEQ ID NO: 1310

SEQ ID NO: 14585 - DNA, 201 bp, Homo sapiens; identical to SEQ ID NO: 1313

SEQ ID NO: 14586 - DNA, 201 bp, Homo sapiens; identical to SEQ ID NO: 1314

SEQ ID NO: 14587 - DNA, 201 bp, Homo sapiens
aaaatcgggtcactaccaccctaatactgtgctcttccaacgggcttaacaaacagcacacgaggagattatatccagcacctgacttggagggtcctacrcccacagagcctcgctcattgctagcacagcagtctgagatcaaactgcaaggcggcagcgaggctgggggaggggcacctgccattgcccaggcttgag

SEQ ID NO: 14588 - DNA, 201 bp, Homo sapiens
tttcaagcaagtctttatactacctgttatttctctaaaattcaaataaagaatttttaaacttaccttgtttattctgtatgtagaaagagagaaaaaarcccccaaatgaatcttcagtgttggggggttagtaatgggaaaggaagcctgaaaaggctttgtggcttgtgttactgttcagatgaaactgttgaacta

SEQ ID NO: 14589 - DNA, 201 bp, Homo sapiens
gaggagattatatccagcacctgacttggagggtcctacacccacagagcctcgctcattgctagcacagcagtctgagatcaaactgcaaggcggcagcraggctgggggaggggcacctgccattgcccaggcttgagcaggtaaacaaagcagctgggaagcttgaactgggtggagcccaccacagctcaaggaggc

SEQ ID NO: 14590 - DNA, 201 bp, Homo sapiens
tttaatggacttatttagaaaatgagaccccccccccccgccccctcatctaggagaccaacctcaaatcacctctactgcagacaaagttagcagagatyggagggtagagggttgaacagcagaaaagagaaatgggaccaaggaatagggctggagactaaagcccccaaggggagtgtcatgaaaagaccccctggt

SEQ ID NO: 14591 - DNA, 201 bp, Homo sapiens
taagggcagccagagagaaaggttgggttacccacaaagggaagtccatcagactaacagctgatctctaggcagaaactctgcaagccagaagagagtgrgggccaatattcaacattcctaaagaaaagaattttcaacccagaatttcatatccagccaaactaagcttcataagtgaaggagaaataaaatacttca

SEQ ID NO: 14592 - DNA, 201 bp, Homo sapiens
tatcatagatagagggcctctttagcatttaccctgtaatttacctaactggtccaattttggtagagatttaaatcacttccaatgttttgctcaccatrggaaacctatcgcatatttcactccgtcgtattcattcggcatgatctgtgcaaatgcctgaagagaatcgttctcttagttcagttcagagtaggagct

SEQ ID NO: 14593 - DNA, 201 bp, Homo sapiens
cctgagtagttagtactctagatacacaccaccgtacctggctcatttaaaaaagtttttttgaagtgatgacatcttattatgttgctcaggctggtctygaatttctgggctcaagtgatgctcctgcctcagcctccttaagtgttgggattgcagatgtcagccagcatgcccagccttactctggaatcttaaaaa

SEQ ID NO: 14594 - DNA, 201 bp, Homo sapiens
tgttttaaatgactctacaggtcaccacccaggggagcacaactagaagcacattgcaagtagcagcacggttggggccgattccatcttcccaggatttrtcatctggtacaaggcagcagggctcaaatagtccaaggaaggaaaaggccactcatagaaagattgtttttgttgccatagcagcatcttgtacttatc

SEQ ID NO: 14595 - DNA, 201 bp, Homo sapiens
aaatgtggaaccaacccaaatgcccatcaatcaacaagtggataaagaaactgtggtatatatatatgatggaatactactcagtcataaaaaggaatgarttaatagcattcgcagcaacctggatgggattggagactattctaagtgaagtaactcaggaatggaaaaccaaacagcgttatattctcactcataagt

SEQ ID NO: 14596 - DNA, 201 bp, Homo sapiens
tccccttttcttttcatcctattgctttttcctctggcttcagtctgtggcatattagaaatgggcctggaaagaggatgtaaaccagcgagtctgcaagyggggccctgagactgcagcagcacctcaaaacttgttagaaatgcaacttttctggtcccaacccagacccattgagtcagactccaaggccgggcctag

SEQ ID NO: 14597 - DNA, 201 bp, Homo sapiens
agactatgctgtaaagaggagcatgtgaaagaatcaagaaactataatcttgaaaaagaaagcctggggtaagggggatgttagatgtctttggacattasaagaaggcttacttagacttgttctggatagccacagaatccagaactagtatcaaaaggtggaagtttttttgttttttgttttttaaaaaggaagcac

SEQ ID NO: 14598 - DNA, 201 bp, Homo sapiens
tattagaaatgggcctggaaagaggatgtaaaccagcgagtctgcaagcggggccctgagactgcagcagcacctcaaaacttgttagaaatgcaactttwctggtcccaacccagacccattgagtcagactccaaggccgggcctagcaccctgtgtttcaacaagttccccagatgactctgagaggggactgagaaa

SEQ ID NO: 14599 - DNA, 201 bp, Homo sapiens
gggaaactcttaataattagggtggtagagatactggagggatcagggagtgagtacttccaccaaacaggaacattagtatatggatatttcactaatamcaatagcggggtcagtaggggttgaattaattgagattctctaaacttaggggaaagttcttaactttgattttattcatagcttactttcataattaga

SEQ ID NO: 14600 - DNA, 201 bp, Homo sapiens
agtgttaattaaggctgggcgcagtggcttacatctgtaatcccagcactttgggaggccaaggtgggaggatagctttagctcaggagtttgagactagyctgggcaacatagtgagacctcatttctactaaaattaaaaaaaataaaaattagccagatgtggtggcacatgcctatagtctcagctactcagagggg

SEQ ID NO: 14601 - DNA, 201 bp, Homo sapiens
tagatgtctttggacattagaagaaggcttacttagacttgttctggatagccacagaatccagaactagtatcaaaaggtggaagtttttttgttttttkttttttaaaaaggaagcacatttctagttaaaacaaggggaaactcttaataattagggtggtagagatactggagggatcagggagtgagtacttccac

SEQ ID NO: 14602 - DNA, 201 bp, Homo sapiens
cagtggaggacccaaaggattttatggcagtagctgcaacgcaacatagcaatgatagatgtcataatgttggaaaacatagcatttcctgcttttttacrtgccaaaattcatcatacttcttaaaatattcaccttgatgatctcttaacggtgcccctgaatattggtagagtttaatagtatatttaattttcataa

SEQ ID NO: 14603 - DNA, 201 bp, Homo sapiens
aatgtcagtcactctgttgttttattagtgattcacattcttccatgatcccatagtttatattcggcttttcaactctttcacttttctcctgccaagcrttttatgtctcaccctatccttaacatacacacacacacacacacacacacacacacccctacctgttttacagatactatccagttttatcatagaatt

SEQ ID NO: 14604 - DNA, 201 bp, Homo sapiens
gagactggaagtgggtcctctagggatgaggaggcattctgctggatgacttctaaaaatgttttctatggagtcatctgcctcattaacaagtttttgtyttagaagtctctttttgattttgtaaactgacatgatttctttttctgttatgactgtatgctgctttagtccttcactaggcccatcacacatttttac

SEQ ID NO: 14605 - DNA, 201 bp, Homo sapiens
ggtattgtatgcatttgtaaatcctattaatttagaatacatgactctccatattcagtgtaaaagatttgttatttataataagacaaatccttttagcrctaataaatttcagaggttaattcttagaaatctagggattacagcaaatttgatagctgtttagttgagaaagataaataagaaagtatattaaagtat

SEQ ID NO: 14606 - DNA, 201 bp, Homo sapiens
ctaaaaatacaaaaattggccaggtgtggtgaggcatgcctgtagtcagtccctgctactcgggaggctgagttgggagaatcacgtgaacccaggcagcrgaggttgcagtaagcagagattgtgccactgcactccagcctgggcgacagagtgagactccctctcagttaaaaaaaaaaaaaaaaaaaaaaaatcacc

SEQ ID NO: 14607 - DNA, 201 bp, Homo sapiens
ttgcaaacaatccaattattacactctttaagttattttaaaatgttacagatgtttttcaaacatgtctctgttctaccctatctctctcatcatatatwtgtatgggattttacattttgacatattaaatttcatcttgttggagtttgctcgttttcttcttacctatgaagctgttttgggaccctaactatgaca

SEQ ID NO: 14608 - DNA, 201 bp, Homo sapiens
agaagaagataggaagtgagaacgtatcccttccctttaggactcagaagttaaacatgtttcatctgctctcatttcattggccagaactgagtcacatsatgataacttgctgaagagaatttaggaaatatagtctttaggtaggtagctatggcttccagctaaaatggagcagttcttttactagaggaaaaagag

SEQ ID NO: 14609 - DNA, 201 bp, Homo sapiens
tttctgtcaggtgttaagctcaaataccatgtacccctgagcttcaaataaaagttttaaaaaagtgattaaaaaacatcaagtttttttggtcaaaattaaaaaaaaaaaaaaaagctcaaatgccacccctgtgaggctttcctggactaccttttctaaatgtctatcccagctcctgccattgcattccctatcgcc

SEQ ID NO: 14610 - DNA, 201 bp, Homo sapiens
acagtgatttgaaagactgaaatttgtccctgaatcaaatgttgggaattgagatgtttcatcatttgtgttattcaaaagaattttttgattggccccatttttttttttttttttttgagatggagtctcagtctgttccccaggctggagtgcagtggtgcgatcttggctcactgcaacctctgcctcccaggttca

SEQ ID NO: 14611 - DNA, 201 bp, Homo sapiens
atttgtgttattcaaaagaattttttgattggccccatttttttttttttttttttgagatggagtctcagtctgttccccaggctggagtgcagtggtgygatcttggctcactgcaacctctgcctcccaggttcaagcgattctcctgcctcagcctcccgagtagctgggattacaggcacctgccactatgcccag

SEQ ID NO: 14612 - DNA, 201 bp, Homo sapiens
gagtccatccttttaatctctgtctgtgccactctggccagtgtttgtgaatgcagagtcctggaactatctgcatcagaatcaccagggatacttgttamtagtgaaaaattctggcccacctcagacttaccatgtaagaaattgtttttcaagagttgaggaatgtgggtatttatattataaaatcctgcaggtgat

SEQ ID NO: 14613 - DNA, 201 bp, Homo sapiens
atcaagtgggcttcatccctgggatgcaaggctggttcaacatacacaaatcaataaatgtaatccagcatataaacagaaccaaagacaaaaaccacatrattatctcaatagatgcagaaaaggcctttgacaaaattcaacagcccttcatgctaaaaactctcaataaactaggtattgatggaacatatctcaaaa

SEQ ID NO: 14614 - DNA, 201 bp, Homo sapiens
atgacatttcttttctttacctctttttttgagatggagtttcgcttttgttgcccaggctagagtgtaatggcgcaatcttggctcaccgcaacctccgycactcgggtttgagcgattctcctgcctcagcctcccgagtagctgggattacaggcatgcaccaccacgcccggctaattttgtatttttagtagagac

SEQ ID NO: 14615 - DNA, 201 bp, Homo sapiens
tcaagtgggcttcatccctgggatgcaaggctggttcaacatacacaaatcaataaatgtaatccagcatataaacagaaccaaagacaaaaaccacatarttatctcaatagatgcagaaaaggcctttgacaaaattcaacagcccttcatgctaaaaactctcaataaactaggtattgatggaacatatctcaaaat

SEQ ID NO: 14616 - DNA, 201 bp, Homo sapiens
catgctaaaaactctcaataaactaggtattgatggaacatatctcaaaataaaagagctatttatgacaaacccacagccaatatcatactgaatgggcraaaactggaagcattccctttgaaaactggcacaagacagggatgccctctctcaccactcctattcaacatagtgttggaagttctggccagggcaatc

SEQ ID NO: 14617 - DNA, 201 bp, Homo sapiens
cctcttcaaggacaactacaaaccactgctcaatgaaataaaagaggacacaaacaaatggaagaacattccatgctcatggataggaagaatcaatatcstgaaaatggccatactgcccaaggtaatttatagattcaatgccatctccatcaagctaccaatgactttcttcacagaattggaaaaaactactttgaa

SEQ ID NO: 14618 - DNA, 201 bp, Homo sapiens
cttcaaggacaactacaaaccactgctcaatgaaataaaagaggacacaaacaaatggaagaacattccatgctcatggataggaagaatcaatatcctgraaatggccatactgcccaaggtaatttatagattcaatgccatctccatcaagctaccaatgactttcttcacagaattggaaaaaactactttgaagtt

SEQ ID NO: 14619 - DNA, 201 bp, Homo sapiens
agcaacaaacattattcttatctataataaagcagatatttctgtctgtcatacatatgaaatatttgtatgtatttattggaagtaatttttaaggctaktctttttttataatttcaacttttattttagatttggggtagatgtgcagatttgttacattggcatattgggtgatgctgaggtttagggtatgaatga

SEQ ID NO: 14620 - DNA, 201 bp, Homo sapiens
aatggatagataataaaattgagacccacagactatttggatcctaaattttgtttcatcatgactcccttgttgaaaatactttattgactctgtgtaaygtaaataagataatttttgtgaagctcattgaatgcgtctgagctccttaactcaaaaaaggctaaaagttactgaaatagctatggttaagggtatatt

SEQ ID NO: 14621 - DNA, 201 bp, Homo sapiens
tgagatgtgggaggaaactggagtacccacaggaaactcatgcagacttggggagagtatgcaaactccacacagacagtgaccttggctgggaattgactttttttttgtcatcagtgttatcacaaaatgacattgcatgaaccagcattgtttgaagacttgctgtattctgattttttttatctttcatctttgagt

SEQ ID NO: 14622 - DNA, 201 bp, Homo sapiens
tggctctggaatactttataaagtccctacttctgcaaaaattaatctctttgtgattttcccctttcttgcaaatggttggaaaaacttttataataatraacttaggaactggtgttacaatatggtatccaatgtgaatcatttgcctgttattagtacttgttacttgaagccacgtttttgttccttttaagatgg

SEQ ID NO: 14623 - DNA, 201 bp, Homo sapiens
ctgatagcctgccttctggaattgtgaaaggctaacaatgaatttgacttttattcctacttcatttgaagtattctctcattgaaaacaccagtttgcaccatccaggaggccttcttatttcagttattattggagtttaaaatttgtttttaggtgtgtcgtatttatttctacttcatatatacatgtaattatcaa

SEQ ID NO: 14624 - DNA, 201 bp, Homo sapiens
cttaacatacacacacacacacacacacacacacacacccctacctgttttacagatactatccagttttatcatagaattgtgtctcaccctatccttaacacacacacacacacacacacacacacacacacacacacacccctacctgttttacagatactatccaattttattatcatagaattgtgaatgacccct

SEQ ID NO: 14625 - DNA, 201 bp, Homo sapiens
ttaacatacacacacacacacacacacacacacacacccctacctgttttacagatactatccagttttatcatagaattgtgtctcaccctatccttaacacacacacacacacacacacacacacacacacacacacacccctacctgttttacagatactatccaattttattatcatagaattgtgaatgaccccta

SEQ ID NO: 14626 - DNA, 201 bp, Homo sapiens
taacatacacacacacacacacacacacacacacacccctacctgttttacagatactatccagttttatcatagaattgtgtctcaccctatccttaacacacacacacacacacacacacacacacacacacacacacccctacctgttttacagatactatccaattttattatcatagaattgtgaatgacccctaa

SEQ ID NO: 14627 - DNA, 201 bp, Homo sapiens
acatacacacacacacacacacacacacacacacccctacctgttttacagatactatccagttttatcatagaattgtgtctcaccctatccttaacacmcacacacacacacacacacacacacacacacacacacccctacctgttttacagatactatccaattttattatcatagaattgtgaatgacccctaaac

SEQ ID NO: 14628 - DNA, 201 bp, Homo sapiens
cacacacacacacacccctacctgttttacagatactatccagttttatcatagaattgtgtctcaccctatccttaacacacacacacacacacacacacacacacacacacacacacccctacctgttttacagatactatccaattttattatcatagaattgtgaatgacccctaaactttagtctggtcacataat

SEQ ID NO: 14629 - DNA, 201 bp, Homo sapiens
cacacacacacacccctacctgttttacagatactatccagttttatcatagaattgtgtctcaccctatccttaacacacacacacacacacacacacacacacacacacacacacccctacctgttttacagatactatccaattttattatcatagaattgtgaatgacccctaaactttagtctggtcacataatac

SEQ ID NO: 14630 - DNA, 201 bp, Homo sapiens
ataactgtgggacacttcctggtagcataattttatgtcgtcttctgatacccaggctgcattttccagacttatctgatcacttgacttaatgttctctracagagcattcagttctttgtagtcagttcaccgactcacttctatcgggtatcctgccctgtccctccctgaatgtgcccatttccattgttttccagg

SEQ ID NO: 14631 - DNA, 201 bp, Homo sapiens
aaagtacaccctatgtgatatgaaaagtgaactcttctagattgtggaacagctttatatagtatcatacctccatctttaactaggattgcagctggcartaaagctcagcttctaatgcgagcaagtgttgagtttggctattttgttaacccaagatcctgagagaaaatttgttcactgatgtacataaagcatatt

SEQ ID NO: 14632 - DNA, 201 bp, Homo sapiens
ttaattaatttctatgtttaattaattaaactatattttataggttaaatcatgaacttcgaggatgggttcatagacatgaagtagaaaggaccaagtcwagaagaatgacaaataatcaacagaaaacccgtattcttcaggtatgtttctgtttgtctttgaacaatagttggcgtatttgttggaaggcttctccca

SEQ ID NO: 14633 - DNA, 201 bp, Homo sapiens
caagtgttcataagcggtaaataaagcccttgggctaggtaatgtaagatccattgcaacctggagatgaagaactttgtaaaggggataattgttatcayccatcagagcatcagagttttaagatgatctagatttagtcccactaattatatttctcctaacttttatagacagagaaatcagtgaaaaatatgtatt

SEQ ID NO: 14634 - DNA, 201 bp, Homo sapiens
cttttaaggtgaagattcattttttaatagctttattgaggtataattgacatataataaactgcacatatttaacaccacattttatgtgtgatatgtakgtgtgtgtgtgtgtgtgtgtgtatatatgtatatacttatataggtgaaatcatcaccatagtcaaaataatcagcatccccatcagtcccaaaagtttt

SEQ ID NO: 14635 - DNA, 201 bp, Homo sapiens
tgcaacctccacctcccgggttcaatctgttctcctgcctaagcctcccgagtggctggaattacaggcatatgccaccacacctggctaatttttgtgcttttttttttttagtagagacggggtttcaccatgttggccagtctggtctcgagctcctgacctcaactgatccgcctgccttggcctcctaaagtgctg

SEQ ID NO: 14636 - DNA, 201 bp, Homo sapiens
atttttgtgcttttttttttttagtagagacggggtttcaccatgttggccagtctggtctcgagctcctgacctcaactgatccgcctgccttggcctcvtaaagtgctgggattacaggcttgagccactgcactcggcctgaagcattttatgatgctcactaccaagtgttcataagcggtaaataaagcccttggg

SEQ ID NO: 14637 - DNA, 201 bp, Homo sapiens; identical to SEQ ID NO: 1296

SEQ ID NO: 14638 - DNA, 201 bp, Homo sapiens; identical to SEQ ID NO: 1297

SEQ ID NO: 14639 - DNA, 201 bp, Homo sapiens; identical to SEQ ID NO: 1298

SEQ ID NO: 14640 - DNA, 201 bp, Homo sapiens
acttcaaataaaaactataatttttcatcatcccaacgaaatattgacctcttagaagccctgaatttggcctgttctaggactaagccaattgttatatrtaacagattgttctttgttaattttaggatcacctgctgttaccagctaccacccataacaagaccacaagaccaaaaatgtcaattgtgttaccagcaa

SEQ ID NO: 14641 - DNA, 201 bp, Homo sapiens
cagatattaatcacggagttccagggagaaggaacttgtgaaatgggggagccggctggggttgccggcaccatggagtcaccttttagcccgggactctytcacaggctggatgaagattggggtgagtgggatctgagaatgtaccagggtggctcgggttcgcgtctaaaggtttcttcctccctacttccgcccact

SEQ ID NO: 14642 - DNA, 201 bp, Homo sapiens
gccggctggggttgccggcaccatggagtcaccttttagcccgggactctttcacaggctggatgaagattggggtgagtgggatctgagaatgtaccagkgtggctcgggttcgcgtctaaaggtttcttcctccctacttccgcccactcgtggtgacaggtgtggaccaaccctgcctggggagtgaggcccctcgtc

SEQ ID NO: 14643 - DNA, 201 bp, Homo sapiens
tgctgtgactcctcatgccaggccgcctgccatatcagtgccctctctacccttcttggaccctgacattccaccaggctacttctctgcgtggatggtgrtcttgctttaccccatctagtggcttaggataaaattattcaggaaggaatattttctaagtgactatgaataagtatttatcatgagatattattttta

SEQ ID NO: 14644 - DNA, 201 bp, Homo sapiens
tcttttaagaacgatttttaatatatagagtataaatcagtgagaaaaatgcaaattaattcaaccatcaatggacaatatatacgaatagataattcacraagaagagtggtaaattttaaaaatgaaagtatcaatggctgtgtattcctgaagggatattccctctgaaagattactattttataactatgtgaaaga

SEQ ID NO: 14645 - DNA, 201 bp, Homo sapiens
agatcttgtggctggttacaggtagttcgagaatgatattcaagaatttaaagtgttatggttagacttttctgtggctcttacctcccttgagtatgagwtctaaaggaaaatgtcttatggcttcttataacttcccagtgtgtatacactgcggttgtgtgtgtgtgctgacacatgttaaactttggttattgtatg

SEQ ID NO: 14646 - DNA, 201 bp, Homo sapiens
tttcatctttccaacttccagaccttttttttctgctgataactcataccttttaattaaactttaatttaatttaatttaatttagtttcttccaactckgctctccaccacttccttgcccctagcacacacacaattaatcagcacttacaaaaacaaaaatttacctctttacaaaaggtacagggatagagtagag

SEQ ID NO: 14647 - DNA, 201 bp, Homo sapiens
cagattaaggaacttgctctatatcctacagctagaaattaagtgatggaagcagaattcaaacccaggcagtctagctccagagtccatccttttaatctctgtctgtgccactctggccagtgtttgtgaatgcagagtcctggaactatctgcatcagaatcaccagggatacttgttaatagtgaaaaattctggcc

SEQ ID NO: 14648 - DNA, 201 bp, Homo sapiens
agattaaggaacttgctctatatcctacagctagaaattaagtgatggaagcagaattcaaacccaggcagtctagctccagagtccatccttttaatctctgtctgtgccactctggccagtgtttgtgaatgcagagtcctggaactatctgcatcagaatcaccagggatacttgttaatagtgaaaaattctggccc

SEQ ID NO: 14649 - DNA, 201 bp, Homo sapiens
gattaaggaacttgctctatatcctacagctagaaattaagtgatggaagcagaattcaaacccaggcagtctagctccagagtccatccttttaatctctgtctgtgccactctggccagtgtttgtgaatgcagagtcctggaactatctgcatcagaatcaccagggatacttgttaatagtgaaaaattctggccca

SEQ ID NO: 14650 - DNA, 201 bp, Homo sapiens
attaaggaacttgctctatatcctacagctagaaattaagtgatggaagcagaattcaaacccaggcagtctagctccagagtccatccttttaatctctgtctgtgccactctggccagtgtttgtgaatgcagagtcctggaactatctgcatcagaatcaccagggatacttgttaatagtgaaaaattctggcccac

SEQ ID NO: 14651 - DNA, 201 bp, Homo sapiens
gtaaaaaagctttaaatagtacctgactattttggggttagctgctgttttactgcaataatcatcattgccattgtccttaagacatcattgccaacttytaaggtaatttcttccttttggaccctgactcctagcacttctcacagtgctcaaagactttactctgcatttataacattcgtcttttatacagtttct

SEQ ID NO: 14652 - DNA, 201 bp, Homo sapiens
gccggcaccatggagtcaccttttagcccgggactctttcacaggctggatgaagattggggtgagtgggatctgagaatgtaccagggtggctcgggttygcgtctaaaggtttcttcctccctacttccgcccactcgtggtgacaggtgtggaccaaccctgcctggggagtgaggcccctcgtcactcctgttcgtg

SEQ ID NO: 14653 - DNA, 201 bp, Homo sapiens
gtttttgttttttttagagtttcttatattgcatcaaataaaagagtgtgctgaattgcacatctagtctttggaggaaaattagggtaaggcttactacrttagaatctaagtgaaaaggtttttgaaagtgaagtggtttgatgaaaagcaaagtatgcatacctccctcttctttactccttctttagaaccaaccct

SEQ ID NO: 14654 - DNA, 201 bp, Homo sapiens
gcgtctaaaggtttcttcctccctacttccgcccactcgtggtgacaggtgtggaccaaccctgcctggggagtgaggcccctcgtcactcctgttcgtgyccctggaagagtctgggagtatcgttcggcttctgtcctggccacagggagagtagaatattgtctaactggagttaactgtcgtttttcactattccca

SEQ ID NO: 14655 - DNA, 201 bp, Homo sapiens
aaccctaattattgcaagaaagtttcaggacaacaggttcaggctagtaatttaagttacatacttaatggtaaatagcttctaccattaagtatgaaagytagtagccattttgtaatcagtaaatgtaggacagtagaaattgcattgtattgcaattctaggcccacctttggccctagggatgggtgactttggaaa

SEQ ID NO: 14656 - DNA, 201 bp, Homo sapiens
tgattttaagatgtgtatgttttattcttttaatattcttttgctgatttgaaacctacaggaaaacaattttgataatcttgattttgatttggatttgdtgccttgggagtcagacatttgggacatcaacaaccaaatctgtacaggtaattatgtgtttcactggtaaaagttttaaaaagatcaattttattttgt

SEQ ID NO: 14657 - DNA, 201 bp, Homo sapiens
tggggttattgggctattctggtaggttaaaagattcctggtgttatgcattctacttctggtatggcaattatgtaaacaaatttcttgccaaaaatggrtatgaggagtttcatagttatgtttcagtagtgtaatgaatgaacagttcatatcagaaatagaaatagtgattttgaattatgaataatgtctctgtat

SEQ ID NO: 14658 - DNA, 201 bp, Homo sapiens
tgaatgaacagttcatatcagaaatagaaatagtgattttgaattatgaataatgtctctgtataagattaacctgagaaccagacagggcttagggaatsaaagggaagagcctgggttaccagaacctaggaacttggtggaggagtcccatgcatttaatacatgtacttctaagaaggggcagcacctggctgatac

SEQ ID NO: 14659 - DNA, 201 bp, Homo sapiens
atataccccctccccacatatatatataatttgtaacacaagtggaaacatactagatatattgttttctgcatctttcattttcactcgttatattttgrtgaccttagcttccatatctgattgaattttaaaagtagattttaccttctttcttgttcattttattataagtttttattgtccagtgggtaaaacctt

SEQ ID NO: 14660 - DNA, 201 bp, Homo sapiens
atatctttaacaggatggcatagacttactctgcattttgagttatttttcctttggtatagatggatcatgctgatagtcacttattacttaatatatakatacagtttctaatatacctttcctttgaagttaccctgaagtgtttttctgtttatatgtgggtctcctccttttctatgcaatttgctgcttaaggat

SEQ ID NO: 14661 - DNA, 201 bp, Homo sapiens
gtcttctagttctcagatgtctcccctttccttatatggtgaaaactctaatagtctctcttcagcggagccactgaaggaagataagcctgtcactggtyctaggaacaagactggtattactctatctcctaacttctgttatttctatttcagattgagcttaggttccatttcttaaaagaaaatgctggattaaat

SEQ ID NO: 14662 - DNA, 201 bp, Homo sapiens
caaccatattagtagttaaattcagtgggctaaacacatcaattaaaaggaagaaattttcaaactagatttttttaaaaaggaaagatccaactatataktgtttataagaaataacactttaaatatgaagacactgacagatggaaaataaaggtgaaaaaggatgtatgccatgcaaacatgaagcattaaaaagct

SEQ ID NO: 14663 - DNA, 201 bp, Homo sapiens
ggccttcttatttcagttattattggagtttaaaatttgtttttaggtgtgtcgtatttatttctacttcatatatacatgtaattatcaagtttttaaarcatatagaacactactattgtttaaacagtttataaataaggtacttttatacttagaaaaattgtttttgatatgtgcaggttaccatgctaaggattt

SEQ ID NO: 14664 - DNA, 201 bp, Homo sapiens
ttataaataaggtacttttatacttagaaaaattgtttttgatatgtgcaggttaccatgctaaggatttgaacaccttcagtaccctatttgtacttgcktctatgcctagcatttttgttacgtgcatggatctgcaaaggaattgtggtttgtttcacagctgcatgtagcaggcatatgtgtgacatatttttattt

SEQ ID NO: 14665 - DNA, 201 bp, Homo sapiens
aagtatatcttaaatcaaaacttgaatttgtacttattaggatttcaagctcatttttcctctggtgaccttgccagcattatcagatttgtattaagtgwcaaaagtttcctcttgtcaaagtgtaaaccttggctcattcttgggccatctgttgtacactaatagttttgatttattcttctggctgacatgcgtatt

SEQ ID NO: 14666 - DNA, 201 bp, Homo sapiens
tcatcattctctataacttattttctttattttctgtatccaccctctcactctctttttttataagaattaagctccatgaggacaggatttttttttcygttttgtttactactgtgtccccctgtgcctgtcatgtggtaggaattcactaaatgtttgttgaataaatgaatatttaatgttcaggcattatatata

SEQ ID NO: 14667 - DNA, 201 bp, Homo sapiens
cctctactgcagacaaagttagcagagattggagggtagagggttgaacagcagaaaagagaaatgggaccaaggaatagggctggagactaaagcccccraggggagtgtcatgaaaagaccccctggtggcaggagggcaaaggacttttacaaactgtgatgctgaaatgcaaatcctcttcattgccccaactcttc

SEQ ID NO: 14668 - DNA, 201 bp, Homo sapiens
caactgaagaaagaaaatggaacactgaagcggcagctggatgaagttgtgtcagaggtaagtgttagtaatacggctgagtcgagatgggctaaagtatyctctggattaataaatagagaaacttttacattttaaattaaattatgtaaaataatagtgctaggaaaaggagggtataataagtcctaaaacatttgc

SEQ ID NO: 14669 - DNA, 201 bp, Homo sapiens
cttaccctttttccattttgtggggaaagagaatcagaaacttgaaaggaagagctcttccaaacagaaagatagctagaatctctctcaatagtctatakaatctcttctaataatctttagcaaaagtgacttttgagttcttttaaatatttcctgtattgattctaattcagtgctcatttcatgtgatgtctatag

SEQ ID NO: 14670 - DNA, 201 bp, Homo sapiens
gtcctaaaacatttgcagtaaggataaagcatttgaaggggaccctttgaattgtactccccaatctacatagaaaagttgtctccttttcctaggtttckcctcattcattgccttagcaccctcttttctggctaagtgaatcacactgaggcttctaaagtgccctgccatattttcccttttaaaaaagaaaacaat

SEQ ID NO: 14671 - DNA, 201 bp, Homo sapiens
tttttaaaaaatcccaagaaaggtaggttctctttaaaaagtttatggcctgtatttgctgtcataaaccaacccagttttcagcctttagccgggctccrctcccttagagatgaatggtaacccatataaactacatggcgattctagttgtttttagtcaggaaaagccccaaggtttttattaagaagcccagaaag

SEQ ID NO: 14672 - DNA, 201 bp, Homo sapiens
atgtggaactggttagaagtaaaatgtttctattccagcattctctgagtttgtcagcttttcattattttataggaagaattctagcttcttatcctgaratgagcttgtctccaaatctggttccaattttttgttgttgttgttgagcacatttcgccatatgatatcactattggctgtaggttaaaagttaccgtg

SEQ ID NO: 14673 - DNA, 201 bp, Homo sapiens
aatgaaatctaatttgagtttttggctaaaagtactttccacatttatcaaagtgacacatgaactgaagaaatacaatgtatctgagtaccaggtgttaytgaatctggaattgcaggagggtaacagagccaaaggcagtcctttcctcaaatagtcttaacgtattcatgtttgtcaaaaatgtgtctacacaaagta

SEQ ID NO: 14674 - DNA, 201 bp, Homo sapiens
atacaatgtatctgagtaccaggtgttactgaatctggaattgcaggagggtaacagagccaaaggcagtcctttcctcaaatagtcttaacgtattcatstttgtcaaaaatgtgtctacacaaagtaattggttctcttttctctgtagatttcatcctttgttgaaaaagatgtcttagaacctatcaagtgcagagc

SEQ ID NO: 14675 - DNA, 201 bp, Homo sapiens
cacaatctgcctctggagccttggcttaatcactgacagagcaacagccactcaggcagagaaaaaggagttggcatttacagttagaggagttaggactytagtaactctgcccgtttccctaaagcttaggattggctgtgataggggaaagtagcttatgaattgactggattgatgtaagtataacagaaaagagag

SEQ ID NO: 14676 - DNA, 201 bp, Homo sapiens
aaaacctaaacgcttaagacaacagcagttattattttggtaaagaaatctgcaaattgggcagagttcaggacagacagttcttctttgcctccgtggartgttagctggggtggcttaggttggaggacccactttcagattggctcattcacatggccagtaagttggtgacggctttcagctgggacctgagcctgg

SEQ ID NO: 14677 - DNA, 201 bp, Homo sapiens
ggaaatgtgtcttgcatgttcaaggaaaaacaaggtggctttgctaaagagagagtagtaggagatgatgtcagagaggtgagatacagggagaggtcaawtgaggtaagacttctgtcgttttaaagatttgggcttttaccatgatagaaatgggaagccatcagaaggttttgagcagaggtgacataataatctgac

SEQ ID NO: 14678 - DNA, 201 bp, Homo sapiens
gagtaacatcttgaacccagatctcctgtctccaaattttgtgctcattccactatttcacattaaaacctgaagatctccctgctcttttcatcttaacrtaatttcagctttttgtgtgtggctctccaagccacagagcagcagcagcttttgaggataagaagcagtttcttttaaggataagaagcagtatggttc

SEQ ID NO: 14679 - DNA, 201 bp, Homo sapiens
aaattttgtgctcattccactatttcacattaaaacctgaagatctccctgctcttttcatcttaacgtaatttcagctttttgtgtgtggctctccaagycacagagcagcagcagcttttgaggataagaagcagtttcttttaaggataagaagcagtatggttcttacctggtaagatggcttgaattcaaaattga

SEQ ID NO: 14680 - DNA, 201 bp, Homo sapiens
agtttcctaaagaagaaataaaatttcttagttgtcatcacactcttcatttgacttccctcccaaattgctattgttttctgcttctctcatgttttctkaaatactcatcagggtgacttttcttaagtttagacagacattccactaggtctcttacctcatttgtggcaaggtttatattgatgtgtgactgctcag

SEQ ID NO: 14681 - DNA, 201 bp, Homo sapiens
atacatgtaattatcaagtttttaaaacatatagaacactactattgtttaaacagtttataaataaggtacttttatacttagaaaaattgtttttgatrtgtgcaggttaccatgctaaggatttgaacaccttcagtaccctatttgtacttgcgtctatgcctagcatttttgttacgtgcatggatctgcaaagga

SEQ ID NO: 14682 - DNA, 201 bp, Homo sapiens
attttgagaacagagctgacagaattttctggtagattgattatggagagtgaggaagagaagtaaataattaagtaataatgatcccaaggtttttggcytgagcaactgggaaaatccaattgtcattaactgagatgaggacaaagcagtaggaggtttggtggggttgatgaggagctcattttggatatgttaggt

SEQ ID NO: 14683 - DNA, 201 bp, Homo sapiens
ttttaaaaaacaactgctgattgctgacgtctatgagggaagaaaaattaggggctgttattttcctatcaaccatcactctcattaacaagaacaggaawcattacgaataaataaaactcttacatcataccagaaaaaagaacagctgaatcccctaaaggatttcatattctatcatcagacaacgaaagaaaataa

SEQ ID NO: 14684 - DNA, 201 bp, Homo sapiens
taaccttccactccagcacagtttttcttgctcctccccatgttgatgctcatgcatgcctcagggcttttccatcttcctgaaaacctcttacccagatygttacatggctcgcttcacttcatttacttctctgctccagcatcactaccataaagaagcatcccaccagcactcttcacaatacagcagggaccatca

SEQ ID NO: 14685 - DNA, 201 bp, Homo sapiens
tcttcacttttctccccaaactcctacccatcttaggtctcccaggtgctcatgccagaaacttagaacagtcttgattccttgccttctctttcatccayttttgatccatctgccaatcctattaactttaccttcaaaatggactccaaatccaaccacttctcatcagatctatcttccacattaccaccaatgact

SEQ ID NO: 14686 - DNA, 201 bp, Homo sapiens
tgatcatgggaacaaactcccattgggagagcatcacctctgccttacatatctgagaaaagcccttgtttattgtaccctatcaactgaatctgctgggstatatattaaagtgggtattttaggccctgcttaaaaaataaaggttaaattgagcatattcattgctctgttaggattacataatgcctgatagtgcaa

SEQ ID NO: 14687 - DNA, 201 bp, Homo sapiens
gtcctttacatgtctagacacatgagttatgtctcttccatgggactatgtggtcacccttctgtccccacagaagagtaaagatcatttccaggtgaggrtaagatttctggtcagcctgaaaaagaaagttcagttggacacaagctactctcaggagagtttgggggtgggaggttcatggccagcatctttgccatg

SEQ ID NO: 14688 - DNA, 201 bp, Homo sapiens
cttgaagtgtgggttggagatgtatatttggaaatccttggtatatagattttatttaaagccgtgagctcagctgagattaccaaggaagtaagatagayagaaacgtttatgctgagcccagggacaaatttgtgttagggagatgaggaagaaccagcaaggtaggtcaaccactgaggtgggaggaaaactgggtaa

SEQ ID NO: 14689 - DNA, 201 bp, Homo sapiens
gatagatagaaacgtttatgctgagcccagggacaaatttgtgttagggagatgaggaagaaccagcaaggtaggtcaaccactgaggtgggaggaaaacygggtaagtgtgatattctggaagtcaagtgaagaaaatgcttcagttaaaatgaaaggatcaactatgttaatgctgttgataggtcaagtaagatgagg

SEQ ID NO: 14690 - DNA, 201 bp, Homo sapiens
catgacaggacactgtgctcagtaaattttttttaagtgaacagtaagggccggtcacagaggctcacacctgtaatcccagcactttgggaggccgaggygggcagatcacgaggtcaggagatcaagaccatcctggctaacatggtgaaaccccgtctctactaaaaatacaaaaaattagccgggcatggtggcggg

SEQ ID NO: 14691 - DNA, 201 bp, Homo sapiens
tggggctgctcacaacatggcttccccaaagcaactgttccgtaagagtgagaaagcaagtgagtaagagcactcccaagatggaagccactgtcttttaracttaatcttggaagtctcataccatcacttctgctgcgtgctgttggttacttagaccaaccctcgtacattgtgggaggggactgtacaagggtatga

SEQ ID NO: 14692 - DNA, 201 bp, Homo sapiens
gttttagaaaattagttttattttataggattaaaaagtggtgttttttttgattcataaaagttttagaaatttaagaagtatagaactgtagaaaaaargaaaattactcagtgattcataaaagttttagaaatttaggaagtatagaacagtagaaaaaaaagaaaattactcagtggtaactatcctctttatgat

SEQ ID NO: 14693 - DNA, 201 bp, Homo sapiens
ccttgctctggagaccccatttggtgaggttcttttcaaaagagattgtatatttttgacccagggattgtcgatttgttgagctcccatgtaagtatgcygccttgccattgacaggtcttcacaatgctttcttaaacgacattctttggaactgtctttcatagtcaggcgacccgccagccaggccgccaggtaggt

SEQ ID NO: 14694 - DNA, 201 bp, Homo sapiens
gaaagattatggattcttgattccatgcaagtcctttgaaatatttttcagcaacttgagagatttaaataaatgtcagtccattaatttgatgttcttgmttttatcagtataaatactgaataaaagataccaaaaaatgtttgtgaaacatttgaaagcacctaatattactttgttctgtgttctgaactgaatttt

SEQ ID NO: 14695 - DNA, 201 bp, Homo sapiens
aacatacacacacacacacacacacacacacacacccctacctgttttacagatactatccagttttatcatagaattgtgtctcaccctatccttaacacacacacacacacacacacacacacacacacacacacacccctacctgttttacagatactatccaattttattatcatagaattgtgaatgacccctaaa

SEQ ID NO: 14696 - DNA, 201 bp, Homo sapiens
ttgtggattccatatttgctaattcacctactaaaatctgctaaaatgtatttgtaacccctaatattagcagtgcttttgtcatcatttgcaaacatgcrtagatgctccctggtgaggttgaacaaggcagtgttctgccttttagtctcagctatataaacaaggtccttttcacagtccacatttttcatatttttg

SEQ ID NO: 14697 - DNA, 201 bp, Homo sapiens
aaaattcttgccctaaatgctttttttttggccttatcattagatggaacttgtcatgtttttctttcctagtcattaaatgaatagagcatttactgtgraaggggtgcttggtattctttattcttaaaggaattccaatgcaagaaaaagaattttgttttaattttactgtctttgttcatttggagatgtgtagtt

SEQ ID NO: 14698 - DNA, 201 bp, Homo sapiens
ttttttggccttatcattagatggaacttgtcatgtttttctttcctagtcattaaatgaatagagcatttactgtggaaggggtgcttggtattctttawtcttaaaggaattccaatgcaagaaaaagaattttgttttaattttactgtctttgttcatttggagatgtgtagtttaaagtcttatttcattctgtgc

SEQ ID NO: 14699 - DNA, 201 bp, Homo sapiens
gtaaagaagttcctggttagaggaaggagaagaattattctgcttttatgctgttgtcaatgccaaagcatatcaagattttaaaaaaattctgtttcttrgtgtaaagagcctgtaactgctctcctttttcttttctcatttcaacctttttttcttccggttacctctttcagttgctaagagtatcccaaactctta

SEQ ID NO: 14700 - DNA, 201 bp, Homo sapiens
ggtataaatcttggataggtaaacggaatatctgttttctgtttgcctgatatctctgtaacttggcttttcctaaggcctacccattgctttctgagackagggaaataagtctggcttctttcaaacttctttgctcatttcatatgggccaaagtagcactaatcatttaaaattcaccagttaatctgttcattttc

SEQ ID NO: 14701 - DNA, 201 bp, Homo sapiens
aaaattgtttccttttcttttctcccttaaacttctgtacatgcttctgttttagcgcttatcgcattgtattgttttcctatatctgtcttcccagttaractgcgagcttcttaaaggcagaagtcaaatatttaattttgtagcttgggcacatgtaggtgctttgattactgaaagatggatatatggacacagtaa

SEQ ID NO: 14702 - DNA, 201 bp, Homo sapiens; identical to SEQ ID NO: 1299

SEQ ID NO: 14703 - DNA, 201 bp, Homo sapiens
ataaatggctgcatgaatcattgaaagaaacttccctgcttttttaaaagagcaactagaagtatttactttttgaaaatagagtaaccatttgttaaacygtatataccattgaagatgttttgggtataaaagggaatttccataataattacatagtaatcttttatagccaaagttatgaagaagatcaggatttgg

SEQ ID NO: 14704 - DNA, 201 bp, Homo sapiens
ctcacataatgtaggtactagtaaattttctgtctggtagcaaaaacctcagtatatgaagaagatggaaacgaaaagccctttgaactaacctgcagtcraaccagttcacattttgattgataaatataattaaaccttcaaatacaattataaaacaaaacactagaattttggggggattccagataagtttcaata

SEQ ID NO: 14705 - DNA, 201 bp, Homo sapiens
tactgatctttgagaaaaaataaaggacccagtgagttacagaaatagatgctggaccatccctgttctctgcattagaaaactatactgctaacacatakaaataactgctcaccttgaactgaaattatccatgggaagccaaatacatccgtctatctatccatcaatcgatagatagatgtatttgtctcattctgt

SEQ ID NO: 14706 - DNA, 201 bp, Homo sapiens
cccacctcagacttaccatgtaagaaattgtttttcaagagttgaggaatgtgggtatttatattataaaatcctgcaggtgattctgatatgtatctttygttaagaacttctgttttagaaggacctaccattggcactgtttttgcttctgatcccagcttcctatgattaaatgctttctgaaagatacatagttag

SEQ ID NO: 14707 - DNA, 201 bp, Homo sapiens
tatggtgtcatggttaagatgctagctttatttgccctgttgggcagagttcaaattataactctacctcttactttgtgggctcaagcagattacatgcmattgaagttttctcatctacaaaatgctggctgcacagagttgatataatggttaaattagataatatatttagagcacttagcatggtacataagtgcc

SEQ ID NO: 14708 - DNA, 201 bp, Homo sapiens
tgttaaagaaggtatctctaaacagaaacacataaataaggttatatatttatcacttaacagaaatattgtaaccagaggcttgcaggaacctaaccctrtatttcccccaggaggatggtttaggattcactaattcattgctggcagtgactttttagaacataactatcacaaaatagcaagaagcgactatatatt

SEQ ID NO: 14709 - DNA, 201 bp, Homo sapiens
accatctagtacattttagagccttgattcagaaatcagaattttagcataagtgaatgggttcttataaaatatcctgatccttgggctttacaaaataktgttataaaaattactgccaaagtgcaactaatattttggttgagagagattcttagaattcagacatagccttagaatgggaagtattttgggaaaaca

SEQ ID NO: 14710 - DNA, 201 bp, Homo sapiens
ggaccagagaactttgatacttgaaaactagggagatcaaacatcttatatattttcagttattaatcaaacatgctaagagatttggaacactttagccrtagcgtctcatgatcactgccttttcacaaaattccctgtgttcaccttactctatcagacataactggtatgtttctgtacaggaccagcctcaaagtt

SEQ ID NO: 14711 - DNA, 201 bp, Homo sapiens
tccctgtgttcaccttactctatcagacataactggtatgtttctgtacaggaccagcctcaaagtttcttttcagcagcaagggggcagctgagaacaawgtttcctgcaaggctccaactgtactggtctatgaaaacaaagtatttcccttactattgacacaattatgttcaaagtaggagaaaaaaagtaaacttt

SEQ ID NO: 14712 - DNA, 201 bp, Homo sapiens
tcagagcagctgtgaaaaatatatgggaaaaaatcttatttagtggtaaaacttttcaaacattcacattaaaatttagaagtaagttaaaagatgtctascccctaccttctgtatcgtattagagggcctaaccattgcagtaaaacaaggggctaaacagtttaagacgtaggaaaaaaatctgaactcactaataaa

SEQ ID NO: 14713 - DNA, 201 bp, Homo sapiens
taagaagattcagtactatgaagaagaaacctgctgggtgttaaaatgattgtgttgaagtatattttatggaagttactgtaggagaatgtttttaacaytcaaatagacagtttttctgaggttcaggataattactgtattatttgatcaaaacagtataacagatattagaagtaacacttgtcaagccatggattg

SEQ ID NO: 14714 - DNA, 201 bp, Homo sapiens
tggcgacagagcaagactccatctcaaaaaaaaaaaaaaggccttgtctcttagagatatacattgaagtatttatgggtgaaataatatatctagatatgctttaaaatactccaggaaggctgggcaaggtggctcacgcctgtaatcccagcactttgggaggccgaggcaggtggatcaccttaggtcaggagttca

SEQ ID NO: 14715 - DNA, 201 bp, Homo sapiens
agaacaagtattttttatagagaagacaatcctagcttttttttttttcttttgagatggattctctctctgttgcccaggctggagtgcagtggtgccaycttggcttactacaacctccacctcccaggttcaagtgattctcttgcctcagcctcctgaatagctgggactatagccgcatgccaccatgcctggcta

SEQ ID NO: 14716 - DNA, 201 bp, Homo sapiens
attcatacactgaagtgtcagtggacgtcaggtgaaacagggaaataaaaacttccaaccccccaccccgcccccacaatctttatggcattgtcccctgsgacttctcactctatgtgggatatggttcaagccaatttttgaatctcaaagggtaaccacaaatgacatttgggttatataatacatggtatcatagat

SEQ ID NO: 14717 - DNA, 201 bp, Homo sapiens
atggagtgggtttttgtgtgtttggtgtatatgagagaatgtggttatatacaagaaattctaatcttacagcttttactattggtttaagcctgatgtcygtcttggcagaaaagcaaaacacccaagcacctgacctcgggtccctgcttagctacacctaatacttatggtgtaatcctgactgctctccagatacag

SEQ ID NO: 14718 - DNA, 201 bp, Homo sapiens
ttgcccaggcttgtcttgaactcctggactcaataatgcttattttaaaaatacttttgtggccaggcgcggtgactcacgcctgtaatcccagcacgttkggaggccgaggcgggtggatcacgaggtcaggagattgagaccatcctggctaacacggtgaaaccccgtctctactaaaaatacaaaaaaattagccgg

SEQ ID NO: 14719 - DNA, 201 bp, Homo sapiens
gtccaattttggtagagatttaaatcacttccaatgttttgctcaccataggaaacctatcgcatatttcactccgtcgtattcattcggcatgatctgtrcaaatgcctgaagagaatcgttctcttagttcagttcagagtaggagctgatgcttattgaggacttaaccttccagacatcatgctaagcctttacaag

SEQ ID NO: 14720 - DNA, 201 bp, Homo sapiens
tacaaagagtccacatacttccccttcatccccagcttctcctattggtaacatcttgcattagtgtggtacattggttacaattgatgagccagtattgrtacattattattaactaagcccatcatttaaagttcactctgttgtacattctatggcagggatccccagccttttggcaccagggactggtttcatgaa

SEQ ID NO: 14721 - DNA, 201 bp, Homo sapiens
ctggctaacacggtgaaaccccgtctctactaaaaatacaaaaaaattagccgggcgtggtggtgggcacctgtagtcccagctactcaggaggctgaggygggagaatggcgtgaacctgggagacggagcttgcagtgagccgagatcgcgccactgcactccagcctgggtgacagagtgagactccatctcaaaaaa

SEQ ID NO: 14722 - DNA, 201 bp, Homo sapiens
ggttagagttcaagatcaagatggccgcaccttcaggttctggttagggctctcttcctggcttgcatgcacatggctgccttcttcttgtgtcctcacayggcactgagagagagaatcttcttcttcttataaggccacagtcctatcagattagtgccccactttaatgacctcatttaactttaattacctcctaaa

SEQ ID NO: 14723 - DNA, 201 bp, Homo sapiens
acgcagagaattactatggcagctttggcttatgatccacagttattcatttgtgacaagagaaaaacctggggccactcttctgagaaaatgactttggyaggcactgggagcttcataaactactataccacacagcctgttttttttaattattattcttttttccccgttcttagtaagtgtgcattaaattctttc

SEQ ID NO: 14724 - DNA, 201 bp, Homo sapiens
ctggtcacataataccacttgattttcgcctcaattaccccgttactgtgttactacctctgtaccagcagcattgtgcatgtcttaagctcattgaagayatgatgaaccatgtgttattgtatcgcttattccaaattaattgctcaataaatggtgattagacaaatgtgaattaccatcctgtctctgtagaaaatc

SEQ ID NO: 14725 - DNA, 201 bp, Homo sapiens
actgagagagagaatcttcttcttcttataaggccacagtcctatcagattagtgccccactttaatgacctcatttaactttaattacctcctaaagacwgtatctctcgatatagtaatatttggggttagggcttcaacatacgaattttggaggacacagtttaggccataaattcacagtttgcttatccacttac

SEQ ID NO: 14726 - DNA, 201 bp, Homo sapiens
cctcatttaactttaattacctcctaaagactgtatctctcgatatagtaatatttggggttagggcttcaacatacgaattttggaggacacagtttagkccataaattcacagtttgcttatccacttacctattgaagcacatcttggttgcttccaacttttggcaattatatataaaactgctgaaaacatttgtg

SEQ ID NO: 14727 - DNA, 201 bp, Homo sapiens
gctcctggatgacacaacttcccgtaatgccccggtgaacggttgctaattttattctcaaaaccttttcaccatagggcctctgttggtgggataggtgyctccattgtccttcactgctattctcctttcctcctccctaaaaatatctaagttgaaatctcattttgtcacaatatcccatcctctacctctcctgat

SEQ ID NO: 14728 - DNA, 201 bp, Homo sapiens
aactttattcatactaagtgtgactatctgaataattaccttacttttatagttttttttttaaaaaagctcttctaactgtaattatcctcaaagaattrgattaagaaattcaataattttctgtcattagtccagcgagatatttactgaatagccattacgttcctggctgttaacactacaaggactccagcaatg

SEQ ID NO: 14729 - DNA, 201 bp, Homo sapiens
gtttagacagacattccactaggtctcttacctcatttgtggcaaggtttatattgatgtgtgactgctcaggtaaacctttagtctgaatgatacagctrtgacaaaatatagcctcagttgtagcaaaattaaatgttacacaatggctttaattggtggtacacctttgaagagtttgcagtatgcccaagtgctaaa

SEQ ID NO: 14730 - DNA, 201 bp, Homo sapiens
acgccattctcctgcctcagcctcccaagtagctgggactacaggtgcccgccaccatgcccggctaattttttatatttttagtagagacggggtttcaygatgttagccagggtggtctcgatctcctgacctcatgatctgcccgcctcggcctcccaaagtgctgggattacaggtgtgagccactgtgcctggcca

SEQ ID NO: 14731 - DNA, 201 bp, Homo sapiens
gatacagatttaagatgtatgtatatatgcatatatatttaaagatactttctgagggagtttctaaggggaaaattggaagattaataaacgagccttaraaaacataagaagaaattatttaacatttgggttttagaaggccttatttaatcatttgattttaacttatttagtttgagcagtgtgttttcaaacctc

SEQ ID NO: 14732 - DNA, 201 bp, Homo sapiens
catcttggttgcttccaacttttggcaattatatataaaactgctgaaaacatttgtgtgcaggtttttgtgtggacatgcattttccaattgtttgggtraatatcaaggagcacaattgctggattgtgtggtaagaacatgttttttgtttgttttgtaagaaattgccaaactgtcttccaaagtggctataccatt

SEQ ID NO: 14733 - DNA, 201 bp, Homo sapiens
acttcctctgtcagcacttaaacatttctggaaaatgctgtagtgcattgacatcaggcatttttaaaaaattactgatctttgagaaaaaataaaggacmcagtgagttacagaaatagatgctggaccatccctgttctctgcattagaaaactatactgctaacacatagaaataactgctcaccttgaactgaaatt

SEQ ID NO: 14734 - DNA, 201 bp, Homo sapiens
aggaggtgtgtttggtgggaatgtgtgtgtacaatttaactaaggtggctaggaaagacctcactgagaaattgacatttgaatgaagatctgaagtgggrgcaggtaaaggtgtgtgcctctacaaaggccacagctgaggccgcccttctttatctacctcttttcatctttccaacttccagaccttttttttctgct

SEQ ID NO: 14735 - DNA, 201 bp, Homo sapiens
gttgactgagtaccctaggttaataaacttaacctagatttatttaatcattatgccaataatgttctttttatatgtccattttctatttcactttattrtatacaaatattaacacttcaatgtatactacctttgtagtttacaaacctctttcacatacataatcttagcaattccttacatataatcacaagtatt

SEQ ID NO: 14736 - DNA, 201 bp, Homo sapiens
ctgggaataatttatatcaccgattatagaaagtggacttagtgctgagagacagtgaataaataaccagcacattctcctatctaaattcctctctaccyctgcactacctattcctcttcattttatgtatttacttatactgtttcatgcctgtttgccttcatagaatgtgggatacacaaagtcagtgttctggtt

SEQ ID NO: 14737 - DNA, 201 bp, Homo sapiens
tgtgcccatttccattgttttccaggtttcccttttcaaactgttaacagtcttctcttctttgaagactttaatttaattccttaggtgttcagtaagtmggatagattttgttggcaatagagtgaaacactactgtctgatagtgtttcgttctgtgacagttgctgttttggatgttcaagtacttcactgatttac

SEQ ID NO: 14738 - DNA, 201 bp, Homo sapiens
ctcagcctcccgagtagctgggactacagacacatgccaccatgcctggcttctttttggctttttgaaaacattttgccactagcttactgttactttcytcaccattacttccatcatgattcttggatgatttcagtatccttagagaagatccttcagatacactgacctgtcattttctggacctcctctttatca

SEQ ID NO: 14739 - DNA, 201 bp, Homo sapiens
ggcagtcgtgtccattgtgaactccaataagaaagattaaaaagaaggaagaaaaagtccgctgtagaaatgaaaaaacaaatttatccattgtgacatcrtttagaaatagcagtcagaatttaaccaagaaagtctggctctatgttcttgatcatttccctctattgcctgtttaagatatccaaatatcatatcttt

SEQ ID NO: 14740 - DNA, 201 bp, Homo sapiens
ttgcctgtttaagatatccaaatatcatatctttgaaggtagtcaacttggagtttaattccgttgatctctcttttcaaaacatattttgagttgtttcrggatcattttccagagactaagacaaagccctgtggaaaaccaagccacatgttactcaaagtaatagtgtaggaggaacaagagccagcagggaaacac

SEQ ID NO: 14741 - DNA, 201 bp, Homo sapiens
ttaaatacttttttttcatgtgcactttcacatgttctctttatgtaccttgtactaatatttactcagttatgggcatcataagaaaatagtttcccttstgtgtttctgttacattctcaataaaaatgaaccatatagtagtcattttgaaatgataatattcttctagaaattgttaacaaatggtcgttaccaatt

SEQ ID NO: 14742 - DNA, 201 bp, Homo sapiens
attttaccttctttcttgttcattttattataagtttttattgtccagtgggtaaaacctttcctccatgttttccagttaaagatattaaggcagaaccycagccactttctccagcctcctcaagttattcagtctcgtctcctcggtcagtggactcttattcttcaactcagcatgttcctgtgagtagccagtctt

SEQ ID NO: 14743 - DNA, 201 bp, Homo sapiens
attaaaattgatagtgaaattttatgtgccatgcaatgtcatgtgtgttcttttaaggtgaagattcattttttaatagctttattgaggtataattgacmtataataaactgcacatatttaacaccacattttatgtgtgatatgtatgtgtgtgtgtgtgtgtgtgtgtatatatgtatatacttatataggtgaaat

SEQ ID NO: 14744 - DNA, 201 bp, Homo sapiens
attgtccagtgggtaaaacctttcctccatgttttccagttaaagatattaaggcagaacctcagccactttctccagcctcctcaagttattcagtctcrtctcctcggtcagtggactcttattcttcaactcagcatgttcctgtgagtagccagtcttttacaatgattttggttataatatgctatctggaaaata

SEQ ID NO: 14745 - DNA, 201 bp, Homo sapiens
tagaaagccacaaatatacactgtccttccaggagtctgcatgatagactggcatttgtcacactgcactagctaccgcaccctattcagatattcacagrgcacagaagttgcagtatgtgcgatgcccagtgctgaggcaggactgcaagggaaaacagcagagatccctgccttcccttaaaagatgaggcatcattt

SEQ ID NO: 14746 - DNA, 201 bp, Homo sapiens
agcctcctcaagttattcagtctcgtctcctcggtcagtggactcttattcttcaactcagcatgttcctgtgagtagccagtcttttacaatgattttgsttataatatgctatctggaaaatatgtatatggaggaggcagttaacatttattgaatactactatgagttatattgtctcatttattgagggaactgag

SEQ ID NO: 14747 - DNA, 201 bp, Homo sapiens
tacaatgattttggttataatatgctatctggaaaatatgtatatggaggaggcagttaacatttattgaatactactatgagttatattgtctcatttawtgagggaactgagactcaagaaagagccttgtgggagctagaaagttgttagtgcctttggttttgctctcttttcccctctgttcatgcctccataatt

SEQ ID NO: 14748 - DNA, 201 bp, Homo sapiens
tctgcaagcggggccctgagactgcagcagcacctcaaaacttgttagaaatgcaacttttctggtcccaacccagacccattgagtcagactccaaggcygggcctagcaccctgtgtttcaacaagttccccagatgactctgagaggggactgagaaacacccgtgtagttccctgtcagcaagactggagaatggga

SEQ ID NO: 14749 - DNA, 201 bp, Homo sapiens
agtcatttgcttaaaactttttagtaacttcccagtccttacaaggatgaaatttaaattcccagagtactaggctttccatgatctggcccccatttacytttccagtctcttttcttgctatcccctcctacttccacattccccttaatttgagccctgtgagagttcctctctgagagctcctatgcactctactca

SEQ ID NO: 14750 - DNA, 201 bp, Homo sapiens
attattgagcatttagaaagccacaaatatacactgtccttccaggaatgtgcatgatagactggcatttgtcacactgcactagctaccacaccctatgsaaaaagaaaaagaaaaaaagaattgattaaggaatcagatgcatgcactcagccaagtcagccaccatccaggctcgggggatgcatccaggacgagagg

SEQ ID NO: 14751 - DNA, 201 bp, Homo sapiens
taatctctgaggaggctgcatggtttagtaaacagtatattgacctggtcatgaggagacctgaactctgctttcaactagctaagaatttgtgtgtttcrtattttatccaccagatggcctcatacacttgtgattctatgagaggtttatgtcattattgaaagaagttcaagtctgaggatttggtactattcagat

SEQ ID NO: 14752 - DNA, 201 bp, Homo sapiens
gctttcagctgggacctgagcctgggatgtgggccagggttcttggtttttcttcatttggacctctccacagctgcatgggtttcctcacagtttagtgkctgggttccaagaataagcatcatctattagaatagtgcttgctttataattgcttattgaatgaatgaaagaatctcaggttgttttcttgctcatgtt

SEQ ID NO: 14753 - DNA, 201 bp, Homo sapiens
ccttaagacatcattgccaacttctaaggtaatttcttccttttggaccctgactcctagcacttctcacagtgctcaaagactttactctgcatttatamcattcgtcttttatacagtttcttcttctctactgggtcattcccatcagcatacaaatgtctttttttttttttcctcgagggagggactcattctgtt

SEQ ID NO: 14754 - DNA, 201 bp, Homo sapiens
taagataatttttgtgaagctcattgaatgcgtctgagctccttaactcaaaaaaggctaaaagttactgaaatagctatggttaagggtatattgtcatyacaatgtgataatcattaccaaagtgggcacttggaaaaatagtgaccacttatgagccaaaccaatcaacattaaaactgatttccagtaagtacagct

SEQ ID NO: 14755 - DNA, 201 bp, Homo sapiens
tcatgctgagctgccagttaagtgcaggctaactgttctttattcaaatgctgggatcatgtggtgtgaatccattggtcaaaaaggaaagataagaaggmcaaaatgcatgggaccagaattatttcagattttggattgtttcagattgtggaatatttgcatatacataaggagatatcctggggatgggacccaagt

SEQ ID NO: 14756 - DNA, 201 bp, Homo sapiens
ctgagctccttaactcaaaaaaggctaaaagttactgaaatagctatggttaagggtatattgtcattacaatgtgataatcattaccaaagtgggcactkggaaaaatagtgaccacttatgagccaaaccaatcaacattaaaactgatttccagtaagtacagctgccaagtgattatagagcagcctggatacagat

SEQ ID NO: 14757 - DNA, 201 bp, Homo sapiens
ggttggaatgcagtggtgcgatctcagctcactgcaagctccacctcccgggttcacaccattctcctgcctcagcctcccgagtagctgggactacaggygcctgccaccacgcccggctaattttttgtattttcagtagagttagggtttcaccgtgttagccaggatggtttcgatgtcctgacctcgtgatccgcc

SEQ ID NO: 14758 - DNA, 201 bp, Homo sapiens
tgtttaggtcattgtatgcctccagtttaacagattgaaataaaacttggttataaaattttgtgatggcctgagtgtgcttatctgagctttaattttcrgatgtggacaattcagatgataatttcctacttcaggtggactcatacacttgatatttttcaactctgatgggtaagaaaagtaagcaaagagtaatgt

SEQ ID NO: 14759 - DNA, 201 bp, Homo sapiens
ctattacctagagcaggtaaataaagtcatttgcttgactgaaaggtaagagggttaaaacccaccattctaaatgtcaagtaatagttacgttgcagtcwgcttagttttatactataaattatgatgatttggttccatgtttttttttagtataatgtgattgctgttcagctttatattcagcgcatagcactatgc

SEQ ID NO: 14760 - DNA, 201 bp, Homo sapiens
catctcaggatcttcatttctttttacacaatttagaattccttctgtatatccgtttgtctctttaagtctctgctaaatccatcaagctgtgtatcctrtaatactttttcccccagttgattttcattgccctttctttttgtctcttagatatttcttaaagtccctcattagcatttccctctcaggttatacagg

SEQ ID NO: 14761 - DNA, 201 bp, Homo sapiens
tcctgtcatctgaagactatagttatttttttgtgagcatgtgctaatatgaggaactgcaccttgcctgttttttttcttttatttgagacagagtctcrctgtgttgccaggctggagtgcagtggtgtgatcttggctcactgcaacttccacctcctgggttcaagtgattctcctgcttcagcctccagagtagct

SEQ ID NO: 14762 - DNA, 201 bp, Homo sapiens
actacaggcacgtgccaccatgcccagctaatttttatatttttagtagagacagggtttcaccatgtcggccaggatggtcttgatctcttgacctcgtratcgcctgcctcggcctcccaaagtgctgggattacaggtgtgagccaccgcgcctggtgccttgtctgtttttatagtacaatctaaataggtggtatt

SEQ ID NO: 14763 - DNA, 201 bp, Homo sapiens
cctgatttagctgctgggtaatttgaggatagttgggtactctgggatgaaaaggcttgatacaatatgggaaaaaaaggaagcagcagtggcttggtagractcaagccacatttggccttgccttggtattcttccatctcctttgtgtgatgcggtcgtctcagcaaggagacagtggtaattacacaattggtagta

SEQ ID NO: 14764 - DNA, 201 bp, Homo sapiens
atttactgtaatttcttattgttattaaaacctaacacttggtcatatgctatttactttatgtgtttctaatttttatttgcgtatttggcctaagcatrtttatatctgcttctgagtaatttctgcattttatatgtttttacttcataaaagatggaggccacctcaaaacaaattaggcatcaaaggaacatacct

SEQ ID NO: 14765 - DNA, 201 bp, Homo sapiens
aataacttaaagtagaactaccatttgacccagcagtcccattactgggtatatacccaagggaatataaagacacacgcacacatatgttcatcacagarctattcacaatagcaaagacatggaatcaacctagatgcccatcagtggtgaactggataaagaaaatgtggtacatatacaccattcaatactacacag

SEQ ID NO: 14766 - DNA, 201 bp, Homo sapiens
gccataaaaaagaatgaaatcatgttctttgcagcaacatggatggagctgaaggccattatcctaagataattaatgcaggaacagaaaaccaaatactkcatgttctgtcttataagtgggagttatacattgagtacacatagacataaaaaggggacaatagacaacaggggctacttttgagggtggaggatgcaa

SEQ ID NO: 14767 - DNA, 201 bp, Homo sapiens
gatctgcctgcctcagcctcctgagtagctaagactcgaggcacataccaccatacctggctaatttttaaatttttttttgtagagacaggctatcactrtgttgccttggctggtctcaaactgctggcctcccaaagcactgggattacaggtgtaagccacagtgcatggcctgtagctccttcttcttctaatatt

SEQ ID NO: 14768 - DNA, 201 bp, Homo sapiens
gcaggcgtcagccactacacctggcccctgcagagtctttatcaaacagaagtgaatattaggaggagcctggggaagaattctctttgatttaccttggkgttaacactccagcgatacaactatggatcctccagaaagactatgtttttgctgtatcagtgccacctattaggaattgttccataaaagagcatgaga

SEQ ID NO: 14769 - DNA, 201 bp, Homo sapiens
cttgctgagagctttcatacatcatttattgtcatgcacttgtatgattattgtatactgtacacatttttattttacaatgatttgtattttccaatgcrtttattgcagttcagtgtggtagatggctggagcctatcctggtagctcggcgcacaagtcaagaattaaccctggacagggtgccatccctttgaaggg

SEQ ID NO: 14770 - DNA, 201 bp, Homo sapiens
acctatgtctgtgaattacagatgaagaaatagtcacaagagattaagtaacttgcccaggatctcacaactagtacatagcagagttgagatttgaaatkaagtctgtcatgattttaaagccacattccttctactatgctacattgtcattcatcctttgaagtcataaagagacaaatgagtgaggaagaaaccaag

SEQ ID NO: 14771 - DNA, 201 bp, Homo sapiens
tggtagatggctggagcctatcctggtagctcggcgcacaagtcaagaattaaccctggacagggtgccatccctttgaagggtgcactcacgcatgttcygcacactcattcagactggagccatttagacgtgccagttaacttaacatgcacatctttgagatgtgggaggaaactggagtacccacaggaaactcat

SEQ ID NO: 14772 - DNA, 201 bp, Homo sapiens
ctcaaaagtggtagctactgttaaaatatactgtatttgcatcttagaagagcatttaacattcttgtgatatctttatggtcaagatgggaaattttgayctaggtggtatttcagttaattcataagtagataaacctacgtttttacagatttagaaggagctttttattttaataacaactcagtacaggatattga

SEQ ID NO: 14773 - DNA, 201 bp, Homo sapiens
agctttattgagttataattcacataccatacatttcacccatttaaaatctataactcagtggtttttagtacaattttagaacatatcaccccaaaagaaacccatccccattagcagtgactcctcattcacccctttccccactccagtaatgctgagcatctttttatgtgttactggccatttgtatatcttctt

SEQ ID NO: 14774 - DNA, 201 bp, Homo sapiens
ggagcttactgagggccatcttagaggctgcctgtcacactcagtgaatctattgtttaatcatggagaatccaaaagtcatggtgtttttatatagaacrttgatatgtacagttccatcctgcaaacaagtgataattttatctgaaaatatataaggaagtctctccatcctaaaatatgcatatgtgtatatgtatt

SEQ ID NO: 14775 - DNA, 201 bp, Homo sapiens
caactgcctgttaaatatcttcacttagatgattcctgtcagttcacacttaaccaaactgatttccaccctcaaccttctcctgtagtcttctcatcctrgtcacagtgaagcatatccgtccttcacattgcacagccaaaaaccttccttgcagtcatccttgacccattttgtttcctcccacatcccatatctaat

SEQ ID NO: 14776 - DNA, 201 bp, Homo sapiens
ctagaacaaatggaggaattatccttttccattctgtagtggtcatactacctaagaagtactgtggccaattctggacattacctctgagaagcatgttkataggacagtgatcaaatatgctaaaggaacttcagactatgctgtaaagaggagcatgtgaaagaatcaagaaactataatcttgaaaaagaaagcctg

SEQ ID NO: 14777 - DNA, 201 bp, Homo sapiens
gtggctaggaaagacctcactgagaaattgacatttgaatgaagatctgaagtgggggcaggtaaaggtgtgtgcctctacaaaggccacagctgaggccrcccttctttatctacctcttttcatctttccaacttccagaccttttttttctgctgataactcataccttttaattaaactttaatttaatttaattta

SEQ ID NO: 14778 - DNA, 201 bp, Homo sapiens
tcttccaactctgctctccaccacttccttgcccctagcacacacacaattaatcagcacttacaaaaacaaaaatttacctctttacaaaaggtacaggsatagagtagaggctttgaatacttgtgcttcaattatttttctcctgtcatcttttatattaaaggaaataaaatataggggtgtctccttttcctggtt

SEQ ID NO: 14779 - DNA, 201 bp, Homo sapiens
tatgagtgagaacatgtgtgttcggttttttgtccttgtggtagtttgctgagaatgatggtttccagcttcatccatgtccctacaaaggacatgaactyatccttttttatggctgcatagtattccatggtgtatatgtgccacatttttttaatccagtctgtcattcatggacatttgggttggttccaagtcttt

SEQ ID NO: 14780 - DNA, 201 bp, Homo sapiens
ttttgtttttggattggatgagacctttagaggactaatgaagtggctttaaacttttttgtacacagtccacagtaagaaatgtatttaacctctctttytctcttatactcaatctcatgaaacaactcttactaaatataatgcaccctttttcttttattctgtcctgtgcttttctgtcaaattgtttttgaaggc

SEQ ID NO: 14781 - DNA, 201 bp, Homo sapiens
ctttctatggcaacattcttattctactatcctttttatttttaagtagtttcatttttgtcactgttgggttattttaaacgatttaattggagggaaaraaatacaaattcatcaaattttacctccagaattgaatttccttcactagttccttaataagtatttaagtaaaagggggtgcaatatcaagaagactaa

SEQ ID NO: 14782 - DNA, 201 bp, Homo sapiens
tacaggcatgcaccaccactcccagctaatttttttgtatttttagtagagatgggttttttccatgttgaggctggtctcgaactcctgacctcaggtgrtccgcccgccttggcctcccaaagtgctgggattacaggcgtgagccaccgcgcccggcctccatcaagtatttctgaagacacgtgaagcagtggagtc

SEQ ID NO: 14783 - DNA, 201 bp, Homo sapiens
aggagttcaagaccagcctgggcaacatagagagatcctatctctacaaaaaaataaactagccaggcacggtagcatgcacctgtagtcccagctactgrggagcctgaggctggaggatctgttgaacctgtgaggttgaggctgcagtaagctgcaattgtgccactgcactccagcctgggtgacagagtgagattc

SEQ ID NO: 14784 - DNA, 201 bp, Homo sapiens
gtaaccacacagttctctgaggttagagttccatgctgtgatgcaagcctctctatttggtatttaaaagcagtttgaagctgttgtgtaagtatcactgracttggagtcaactgacctaagttctagccttggcccttctactgtcttaacagtggattaaatgatgaggcttattttaaagaatcttgaaaactatag

SEQ ID NO: 14785 - DNA, 201 bp, Homo sapiens
tcaaggtataaaatctaggtggggaaagagagagagagttaacattcttgaaacaattgagagcattagagtgttccagtatatcctccaaattctaaggktataagatgttcagagaaaataaaaaatcagggtgggttagaataattgagttcaaatggaccttggaattaggttagtggaggagatagcattccaaat

SEQ ID NO: 14786 - DNA, 201 bp, Homo sapiens
ttaaaggctgccctctcagaaaacgagcaactgaagaaagaaaatggaacactgaagcggcagctggatgaagttgtgtcagaggtaagtgttagtaatasggctgagtcgagatgggctaaagtatcctctggattaataaatagagaaacttttacattttaaattaaattatgtaaaataatagtgctaggaaaagga

SEQ ID NO: 14787 - DNA, 201 bp, Homo sapiens
ttactgaaaacaatgatttaaaaggttagggaggcaaactatagaagtgactcaaaattctttggggatccgtaaaaatataaaaaatgttgaattctggycgggcgtggtggctcacgcctgtaattccagcactttgggacgctgaggcaggcggatcacaaggtcaggagatcaagaccatcctggccaacatagtga

SEQ ID NO: 14788 - DNA, 201 bp, Homo sapiens
ttagaagactattgaggtgtttcaggtaataaatgagagtctgaacttacactatggttataaaaaggatgagcaatcttagggtacctctctgatgtagmttttgtgggatttgttaactggtataatgtgggacatgaggaagaaaagagggaagttaaggataattcaaaaatttctaccttgagggaccgaatggtg

SEQ ID NO: 14789 - DNA, 201 bp, Homo sapiens
taaacattggaacaaatgagtgaccaacagaaatggaggaattatgtattctattggatttaaaatagaatatatcatctgctcaagacacttagaattgrtagattagatctgtctaataatttttaactcttgggggtcacagaccccattcagaatctgatggcccctctctccaaaaacatgcacacacaaaacttt

SEQ ID NO: 14790 - DNA, 201 bp, Homo sapiens
aattccttacatataatcacaagtattcttagtcctattttatggctgaaaaagctgaagcaaagagagattaagtagcttatctaaggacacaaaaatgrtaagcattagaactagggcaataattgatagattctaatttaatacagtgatttttttttctttacattgttgtgcttttttctttatatctggcacttt

SEQ ID NO: 14791 - DNA, 201 bp, Homo sapiens
acttctgaagcctccgagttatctccatttcctgagcacccaatggagcttcgattcttgggctgcatttcttcatagtgggctagaggcaatggccctgraatttaaacatttgccactagttctaagtgttgtgcgaagctccaacatctaccatggagctgtaggaaaccatacagatgaactagacaacatccttga

SEQ ID NO: 14792 - DNA, 201 bp, Homo sapiens
cctccaaatagaatcttttgtgcttctctagggagattccctttgtgttgaattttatgagtagtgtaaattgtgtgggttgcatcataaaacaaagtgcraacacacacacaaagtcttattgatgagccaagttcctaagcactattaatgagttaaaagtgttaattaaggctgggcgcagtggcttacatctgtaat

SEQ ID NO: 14793 - DNA, 201 bp, Homo sapiens
tcagatatgatcattctgtttcaaatgacaaagccctgatggtgctaactgaagaaccattgctttacattcctccacctccttgtcagcccctaattaayacaacagagtctctcaggtgagtgttgtagattattgcagaaacatctgagttggttcccatgtttagttttggaacctagacaagtaattggtcaagtt

SEQ ID NO: 14794 - DNA, 201 bp, Homo sapiens
tctctgttggaatatttgtgtcccattaaaattcgtatgttgaaatctcttcactaatgtaatgatatgaaaatcagcctttatgggggtgattaggtcaygaaggcagagccctcatgaatggaattactgctcttataaaaagacaaaggactttgcagggacgtggatgaagctggaaaccatcattctcagcaaact

SEQ ID NO: 14795 - DNA, 201 bp, Homo sapiens
cgagccctatacgtcaaaaggtctttcaggacatgaagccatgcaaatgtgcgacctctgtagaccagccagaaccagtccatggccagtggtcttcttayctggagaaagttactgaaatcaacaaaaagttgtccaatgaaagctgtagctatggctggtggaacggggactgggggtcagtaagtcagcatctcgtgg

SEQ ID NO: 14796 - DNA, 201 bp, Homo sapiens
ctttgaatatcagagaaacataagagtgtaaagatttcaaggaaatggtcatatttttcagatgagaaaagttcaccaaagattttacccattggtgccaraaatgtaaggcaggcaagaagttagtagaagaaagtcatcacactgtaacaattattttttttaagttgtaggcactgatttccaaatgagttccataaa

SEQ ID NO: 14797 - DNA, 201 bp, Homo sapiens
tttttcagatgagaaaagttcaccaaagattttacccattggtgccagaaatgtaaggcaggcaagaagttagtagaagaaagtcatcacactgtaacaawtattttttttaagttgtaggcactgatttccaaatgagttccataaaccactgctatttccatttgtagtatagcaataggttgtgatactaaccttaaa

SEQ ID NO: 14798 - DNA, 201 bp, Homo sapiens
ccatttctgaacttagacatttactactatggtttaatgacaggtcttacttagaatctgttaagtgggggttccatctcaatgttgtttgccacaaaacrccattaagtcattccgtcattcatcaaatatttgttgttagaatttagactagcaactggcatctgcaagttcccaataatgagccaaggactgttcttg

SEQ ID NO: 14799 - DNA, 201 bp, Homo sapiens
tccttctctttattcttctgtcagctgtacttaagatatgtgtatcaagatcagaagctttcgtctgccactgtggtttcgtttatgtcttcagtctcttstgtgaaggttctcttggctttctagcactaaatcaaaatctggtgctcctggatgacacaacttcccgtaatgccccggtgaacggttgctaattttatt

SEQ ID NO: 14800 - DNA, 201 bp, Homo sapiens
cctttcctcctccctaaaaatatctaagttgaaatctcattttgtcacaatatcccatcctctacctctcctgattcctggatcactctctttcacttttytttttttcttttagagatggggtcttgttctcttgcccaggttggagctggagtatgcggtggagcaatcacagctcactgcatcttcagacccctgggg

SEQ ID NO: 14801 - DNA, 201 bp, Homo sapiens
agcaagaaggagaaagggaaggaggagggaagccttccaccattaccaccttgaagaagttgccatttcttcttacagtccgttgaccagaccgtgtagcyttatttggttgcaaaggaggctaggaaatatagtctttattctgggtggccttgtgcccaactaaatatcacaagtcctgttgctattttaatgttacag

SEQ ID NO: 14802 - DNA, 201 bp, Homo sapiens
cacagagagaaagtaatgattcaggattcattgttgtgaggttcaagaaacatttattttgaggaagtggaggtaaatattcaatgaagttaactacattrtcccagatatatagataagatagataaaatgtatatattatatagacacttatttttattataagatatgtactgttagagttggtagtataccagcttt

SEQ ID NO: 14803 - DNA, 201 bp, Homo sapiens
ggactcattctgttgcccaggctggggtacaatggcgtgacccatggctcactccagcctccacctcctgggctcaagcagttctcccacttcagcctccygagcagctcctgaacacaggcacattccactcccagctaatttttaaattgtttgtagagacagagtctccctatgttgcccaggctggtcttgaactcc

SEQ ID NO: 14804 - DNA, 201 bp, Homo sapiens
ggggcagaactgaaagaaagtagctttttgaagccaaagtaaaaagagcttcaagcaggtcttgggcagtggtatcacatgctgctgagagcttgggagaygtagaaagctgaatttggcaattatcaggtcagttgtaatcttggaaagcagatttagtaggggtaggcatgaagtctgtattaaaattggttgagaaat

SEQ ID NO: 14805 - DNA, 201 bp, Homo sapiens
attctgttgcccaggctggggtacaatggcgtgacccatggctcactccagcctccacctcctgggctcaagcagttctcccacttcagcctcccgagcasctcctgaacacaggcacattccactcccagctaatttttaaattgtttgtagagacagagtctccctatgttgcccaggctggtcttgaactcctaggct

SEQ ID NO: 14806 - DNA, 201 bp, Homo sapiens
ggcagaactgaaagaaagtagctttttgaagccaaagtaaaaagagcttcaagcaggtcttgggcagtggtatcacatgctgctgagagcttgggagatgyagaaagctgaatttggcaattatcaggtcagttgtaatcttggaaagcagatttagtaggggtaggcatgaagtctgtattaaaattggttgagaaattg

SEQ ID NO: 14807 - DNA, 201 bp, Homo sapiens
gtttgggttgaaataaatgaagaaaatttagactcacatcggtatgcagttggaaaagggagaactttgcagactttgaaagacttttaggatccccagarttccttggactgcttaaaaccccagtgcacacttgcccaactgctgccgtaatttatttaaccatcttttgataggcagctagggtatttccagttactt

SEQ ID NO: 14808 - DNA, 201 bp, Homo sapiens
taaatgtctatcccagctcctgccattgcattccctatcgcctttctttcttcatttttctacatagcacctctccccttcaagtatgctatgtaacttayttattttctttctctccctggaggtatttttatctcttttgttttccagtgcttagaacagtggctggcacatagtagttactcaataaatacttgtagt

SEQ ID NO: 14809 - DNA, 201 bp, Homo sapiens
gtaaggtataggggaagagtgcagagctttcatgccctctccaggtgcaccaccctcctagtacctccttgtgtttgctaacctggaagctctccaaattycattgttaggggtttttatggagcttcattaggtaggtgtgattgattaaaccattggccattggtgattgcacttaaactccagccccctctcccctac

SEQ ID NO: 14810 - DNA, 201 bp, Homo sapiens
cttttgttaagtaccacaaaattaagtttgtcagacaaatagacatttgaatcagagatttccaaagtattttaaatttaggaacctaaactcttttagarcagatcacattaccgagtaaagtgattaatgtggtttcagatgttcagcgtagaactgaatgtttgtgccttattggtatgggccaaatgaaaaaaaaaa

SEQ ID NO: 14811 - DNA, 201 bp, Homo sapiens
tcttttagaacagatcacattaccgagtaaagtgattaatgtggtttcagatgttcagcgtagaactgaatgtttgtgccttattggtatgggccaaatgaaaaaaaaaaaataaaacacacaagtttgccaaatattggtatgccttaaacatttcctgaaggcatttggtgatgaaatataaatatatctaatgtataa

SEQ ID NO: 14812 - DNA, 201 bp, Homo sapiens
agagcacaggagtcaggaatagatcattgccagtaggtaatcccacacagctagtataattaacttaatgaaaaattagattaaaattcttgccctaaatrctttttttttggccttatcattagatggaacttgtcatgtttttctttcctagtcattaaatgaatagagcatttactgtggaaggggtgcttggtattc

SEQ ID NO: 14813 - DNA, 201 bp, Homo sapiens
ctagaagaaggtatagtggacatttttatagttgtatactttttgataaacatttccctgtgttatttagaatttgtattagagccaaatggagccaggtmcttgactaacaaggcaaagggaggtcacagtatggtaactattgcacagtataatgcttgaaaattattacagatttgtttacttttatctctttaagga

SEQ ID NO: 14814 - DNA, 201 bp, Homo sapiens
tctttttaaatttgcttttgactgtttgttgctggcgaaaattatttaaagtaattaggaactcatcgtaaatattttgtacactactctaaaaatctaaytccaactagtgaatttagcatttataaatggaggtgtctatagaggaataaaatctttggttaaccactactttacttttagcagtaaagtctgcagctc

SEQ ID NO: 14815 - DNA, 201 bp, Homo sapiens
ttgaacttcttcaacctcaaatttccagtctttatacttaaccaatgaaatgttatttatatactctttggaaacataacatatactgtagataattatarcaaaagtgtaatgggtagcagaagatattgccaaaccaaaattctggagaccagatgagacaaacacataatatgtgcctgtatgggtcacagtgctagg

SEQ ID NO: 14816 - DNA, 201 bp, Homo sapiens
agcagattacatgcaattgaagttttctcatctacaaaatgctggctgcacagagttgatataatggttaaattagataatatatttagagcacttagcayggtacataagtgccccccaaaatggtaaatgataatgatgtgatgtcattgacaacagtatcactgaagtgaaatttgaggatctcagcttctatctgta

SEQ ID NO: 14817 - DNA, 201 bp, Homo sapiens
catctttttttgtttgtttgtttgtttgttttgagacagagcctcactctgtcacccaggctggagtgcagtggcgcaatcttggttcactgcaacctccrcctccagggttcaagtgattatcctgcctcagcctcccaagtagctgggattacaggcatgcgccgtgacacccggctaatttttgtatttttagtagag

SEQ ID NO: 14818 - DNA, 201 bp, Homo sapiens
ttctgccatgattgtaagtttcctgaggcctccccagcaatgtggaactgtgagtcaattaaacctctttcctttataaattacccagtctcaggtatttmttcatagcagtgtgagaacggactaatacaacctgtaaggagagtggtccgctggtttcctctccagcctcatcgcctcctactcttcccttgattctct

SEQ ID NO: 14819 - DNA, 201 bp, Homo sapiens
ctcccgaagtgctgggattgcaggcgtcagccactacacctggcccctgcagagtctttatcaaacagaagtgaatattaggaggagcctggggaagaatyctctttgatttaccttggtgttaacactccagcgatacaactatggatcctccagaaagactatgtttttgctgtatcagtgccacctattaggaattgt

SEQ ID NO: 14820 - DNA, 201 bp, Homo sapiens
tacaaaatgctggctgcacagagttgatataatggttaaattagataatatatttagagcacttagcatggtacataagtgccccccaaaatggtaaatgrtaatgatgtgatgtcattgacaacagtatcactgaagtgaaatttgaggatctcagcttctatctgtagctctaccacacatttgcagttcacttatatg

SEQ ID NO: 14821 - DNA, 201 bp, Homo sapiens
taaaagagaagtcgagtccttgagaaggggcaaaagggtggaattcagataacaggtggaaggatggccctttgctagtaaggcaggacattatggtagargcaagatgagttcatagataggaccttaggttccaggaagataaagagaagacacttctaacagtttctgttttcccagtgaaggacatctcaactgatg

SEQ ID NO: 14822 - DNA, 201 bp, Homo sapiens
agttgtcccatacataacaatggaatctgaagaccaaatgtcagactttgcattttcttcctccagatttgtaatgcttggcatgctcagtgtcaaagttaaaaaaaaaaaaagtagaatagaaagaattctacgtttaaattcaattctttgtcttggaaaagccaaacatttaattttaaaaatcactggttggctctg

SEQ ID NO: 14823 - DNA, 201 bp, Homo sapiens
cttggccagtgggatagtgagcctactagagacatttggattgtgaggccttggtggggtgtcagtatgccgtatgctttaaagtcaaatctctgcaacaraatgccaggtgtagagttacagttgattaataagacacagcccctgtactcaaggagtttgtaatctagagaatgaaagacatataattacaatatggtg

SEQ ID NO: 14824 - DNA, 201 bp, Homo sapiens
agggaattgggagaactatatgaaagtagcatattttctcatgcacaatattgcacaacattagaaaactgatgctttattttcatggtgaaatgttttgrtgtttctccccgccccctcccctccatgtttctctaactttttctgggaataagagtaacaatacattgattataatatttgtccacatgatttcattcc

SEQ ID NO: 14825 - DNA, 201 bp, Homo sapiens
gtgcggtgatgcaatcatagttcactgtgacctggaactcctgggctcaagtgatccttccatctgagcctcctgagtcgctaggactacaggtgcacacygctaccatgcctggttaatttttaatttttgaattttttgtagagacaggggtcttgctgtgttgcccagactggtctccaactggcctcagtcatcctg

SEQ ID NO: 14826 - DNA, 201 bp, Homo sapiens
gaagtaaccagtaacgctgctagtggcaatcatgggaggctttatgcagtagtactcgatgaaggaataaagaggattagattatgctacaggaagtgacrgtggggttaggggggacatctcattgtggaagccctcatgaatcaatagaattttaggaaagaaaagactggaacaaaaaaaattttttgagtgccccca

SEQ ID NO: 14827 - DNA, 201 bp, Homo sapiens
gtgtttatcacaagaacaatccttaataaacttcctgtaagcacactctcagagtcagcttgctggggaacccaagctataacaacatgtttatcttgttsacactttcttctgagttctaaatcatgggaagttacagttatccaaaatcttactaattggaagatcatttcatcagacgtgtattgagcacctgcttca

SEQ ID NO: 14828 - DNA, 201 bp, Homo sapiens
acccatatataattctctttaccgcatcctttatcacactcctacaagccttgaagcaatctgaacacagaaaccatctttgattttcaactcctaattgrgactgaacatacttgtcttgaacacagattgctgccttgttagtataggtatcctaatatggcacatgtgtatagttgaagctataatgcattccccaag

SEQ ID NO: 14829 - DNA, 201 bp, Homo sapiens
atattctttaaaagaaaatatcctctgtagcacagtgctgaatacatgacaggacactgtgctcagtaaattttttttaagtgaacagtaagggccggtcrcagaggctcacacctgtaatcccagcactttgggaggccgaggcgggcagatcacgaggtcaggagatcaagaccatcctggctaacatggtgaaacccc

SEQ ID NO: 14830 - DNA, 201 bp, Homo sapiens
tgtctgcagagaatgtgatcaatgggcaggactacgaagtgatgatgcagattgactgtcaggtgatggacaccaggatcctccatatcaaaagttcgtcrgttcctccttacctccgagatcagcagaggaatcaaaccaacaccttctttggctcccctcccgcagccacagaggcaacccacgttgtcagcaccatcc

SEQ ID NO: 14831 - DNA, 201 bp, Homo sapiens; identical to SEQ ID NO: 1312

SEQ ID NO: 14832 - DNA, 201 bp, Homo sapiens
atacataaattacaaaactacaataacatcagggttctctgagaggcaaaactacatttgtttcagaagatactttaatggacttatttagaaaatgagaccccccccccccgccccctcatctaggagaccaacctcaaatcacctctactgcagacaaagttagcagagattggagggtagagggttgaacagcagaaa

SEQ ID NO: 14833 - DNA, 201 bp, Homo sapiens
aggggagcacaactagaagcacattgcaagtagcagcacggttggggccgattccatcttcccaggatttatcatctggtacaaggcagcagggctcaaayagtccaaggaaggaaaaggccactcatagaaagattgtttttgttgccatagcagcatcttgtacttatcccttcctaactcccatcgcctttgcaatta

SEQ ID NO: 14834 - DNA, 201 bp, Homo sapiens
aggaaggaaaaggccactcatagaaagattgtttttgttgccatagcagcatcttgtacttatcccttcctaactcccatcgcctttgcaattaccaggtmaacatttatcatccctgtgggacagtgagctccagaagagcaggaaccctactaatgtcttgaattcgatttttttcctccaaaagtgctgtggatatag

SEQ ID NO: 14835 - DNA, 201 bp, Homo sapiens
aaggtatagtggacatttttatagttgtatactttttgataaacatttccctgtgttatttagaatttgtattagagccaaatggagccaggtccttgacwaacaaggcaaagggaggtcacagtatggtaactattgcacagtataatgcttgaaaattattacagatttgtttacttttatctctttaaggatttgtag

SEQ ID NO: 14836 - DNA, 201 bp, Homo sapiens
ttctttcattggagtggtgatggcaaaagccaactgaagtggattcagggaagtaataatagagggggaagtgaagaaaattatttcagggtgatccctayacatgggaatagagaaatggagtagctacaggagtcaagaaagagttttatttttggatgggaaatatttcaccaggtttacatgtttacatgctaatgg

SEQ ID NO: 14837 - DNA, 201 bp, Homo sapiens
acatctcactttcaaacatcctgctctgactgccttcgcctgttttaccagcttacttcctttagtattccagtttcaatagttgttcagtccttctgagrttttgccatgtttccagtgtctctcattctcttcagttcatcacgtccctcttacccagtttaaataccatggacagtcattgtcactatttccttcctt

SEQ ID NO: 14838 - DNA, 201 bp, Homo sapiens
tccctcttgaggtttgataattttctagaatggctcacagaactcaggaaaacactctatttactattactggttttattataaaggatatgtggggcaarctaaatgggagagacgcatagggtaaggtataggggaagagtgcagagctttcatgccctctccaggtgcaccaccctcctagtacctccttgtgtttgc

SEQ ID NO: 14839 - DNA, 201 bp, Homo sapiens
tttcacattatgataaatatatattttcatagtgccagatttactgtaatttcttattgttattaaaacctaacacttggtcatatgctatttactttatrtgtttctaatttttatttgcgtatttggcctaagcatgtttatatctgcttctgagtaatttctgcattttatatgtttttacttcataaaagatggagg

SEQ ID NO: 14840 - DNA, 201 bp, Homo sapiens
ctctgaagaggatatacattgatgagtgaagatattagggagggtagggagaaagaatagaagtttttacatataaatacaaatagaagtatttaaaaaawttttttttcttagctttatctgatagcctgccttctggaattgtgaaaggctaacaatgaatttgacttttattcctacttcatttgaagtattctctca

SEQ ID NO: 14841 - DNA, 201 bp, Homo sapiens
ttttctgtagagacagggtctcactgtgttgcgcaggctgatctcaaactcctgggctcaagcagtcttcccaccccagcctcccaaagtgctaggattayaggtgtaagccactgtgcctggcaaggaaatactttttttggtggaaaaaccttagcatccagtgtttatatttgggaggtatttagctgtagttttctt

SEQ ID NO: 14842 - DNA, 201 bp, Homo sapiens
tcataaagagacaaatgagtgaggaagaaaccaagccacacaacacaggcaaccagggtattgaggcatgttcaggaaagagggagagtcgctaagaggcraggtccagcagtactcgagggttttctatgagtgactcagaaggcatacactcgatgctggctgcatgcagagcccatgctgggctgctgcaccaattct

SEQ ID NO: 14843 - DNA, 201 bp, Homo sapiens
acatctcattgtggaagccctcatgaatcaatagaattttaggaaagaaaagactggaacaaaaaaaattttttgagtgcccccacccaccagacaaaaawtttttaaaaatgaattaatgatcttcacagctgctgaagtaaaggtggggatggatctcatttccatggtagattgattgattatgaaaggaagagatga

SEQ ID NO: 14844 - DNA, 201 bp, Homo sapiens
tctcccctacttggaggttgagggatgggactgaaaatcccaacccactaattatgtggttggtttctctggcaatcagcctccatcatccaagagtcacytcattagcataaactcaggtccagctggaaggggcttattacggataacaaaagatgctcttcttaccccctatcactcaggaaattccaagggttttag

SEQ ID NO: 14845 - DNA, 201 bp, Homo sapiens
tctactaaaaatacaaaaaaattagccgggcgtggtggtgggcacctgtagtcccagctactcaggaggctgaggcgggagaatggcgtgaacctgggagrcggagcttgcagtgagccgagatcgcgccactgcactccagcctgggtgacagagtgagactccatctcaaaaaaaaaatgcttttgtatgatagtctat

SEQ ID NO: 14846 - DNA, 201 bp, Homo sapiens
acatagggacacagtgcttgtttctttgtcaaataattgaattgacagttcatttctattcttttcctttgtccaaagattctgctctctttgctgaactyggttatttcacagacactgatgagctgcaattggaagcagcaaatgagacgtatgtaagtatttactaaggttgaataatgtgatatttagtctttaacc

SEQ ID NO: 14847 - DNA, 201 bp, Homo sapiens
atgtcagttcagagctcttcacagctctaatcttgaatccatctcatggatgaatgaaatgcctggttttctttgtaatttgttcagttctatgcatacarggtatgcagtttgttctgtagataaactacacatgggtatttctgtaactctccttttatcatcattaccgtctgtttgattctttcccctacatttgtg

SEQ ID NO: 14848 - DNA, 201 bp, Homo sapiens
gacttcacagataagtcttgcagtttccaaaacaccatcccatccttactgcgtttattcttgaatgacttttcactgggagatagtatacttatcttttwcaacaaaactacaaatgggatcctaataacaagtttactgtttgttaatttgtgttagatataggcatactgtcatattttcctgtaatttttcatatct

SEQ ID NO: 14849 - DNA, 201 bp, Homo sapiens
tgctccacatccttgctaacatttggtgttgccagtactttggattttagtcattctaataggtgtgtagtggtatgttttaatttgcagtttcctgatgrcatatgatgttgagcatcttttcatatgcttatttgccgtctgtatgttttaccctcctctctccttctctcttctcttttactcttgcttgaatttgtg

SEQ ID NO: 14850 - DNA, 201 bp, Homo sapiens
tagtatatcagaattcacagaaaggaacaattatttagtgtgcaagatagtatattccaaattatttcatattatagaaataaaaaatattccatagtccytaagccacgcctttttttttttttttttttttttttttttttgagatggagtgttgctcttcttgccgaggctggagtgcaatggcatgatctcagctca

SEQ ID NO: 14851 - DNA, 201 bp, Homo sapiens
attccttgccttctctttcatccacttttgatccatctgccaatcctattaactttaccttcaaaatggactccaaatccaaccacttctcatcagatctrtcttccacattaccaccaatgacttattttaataaaatacatatccccatcctgtttcttacttccttaaaaccttcctctgtctccttattgcctttgg

SEQ ID NO: 14852 - DNA, 201 bp, Homo sapiens
agtcctgaaaactccaaaagggaaatatttactcagaggtctattcaaatttgcttagtctctgacgttttcctgtgtcgtacaaatccctcgtgcggcaraagtagtttgtctttactaggccaccgtctcgtcagcgttacggagtattttgtccgcctgccgccgccgtcccagatattaatcacggagttccaggga

SEQ ID NO: 14853 - DNA, 201 bp, Homo sapiens
ttctgtttactcagaaagcccagaacataagatttgaaccatttgtgcagtgcccaaatgtgtgctgatggaagagtgaacctttaatgttttgactcccrtactatttggttctatttttcctaaataagtcatggtcttttttcattaagtatacatttacaaaaatggttcagtctttgcacataactcagctctcac

SEQ ID NO: 14854 - DNA, 201 bp, Homo sapiens
gcttctttgcaaagtactggtgaagtcttatcactttttaatattaaacttcatgtaaatgttttggatatttaattgtttatgatcaaggtgtctggctwgtgtgttagtcatctcccagctaacagtctcttggcaggccatgcttaattcagttattgcatgttaacaggctgttcaaaattccacattgcctagagt

SEQ ID NO: 14855 - DNA, 201 bp, Homo sapiens
ttagggtatattaaactcatgtaaaagtactttatatttaaatttaaaacagtgagcttctagactaatttagtaataatcaagtttctttttaacctacrtgaattatatgagatataagacagttgtcatatgggactgtcctgtgtgtcacagaacggccagcatccctgacccctgctcactaaattttagtaatac

SEQ ID NO: 14856 - DNA, 201 bp, Homo sapiens
ttccttttgagactctgaagaaagggtacgttcctaatgtttttggtttggattatcagttcatggcagagcagtgccttaattgtacttggtagtgaccmctactagttgttcaatcatgaatcctccagtactttttatctgaataatatggagatcctttcttagtactttgttagacagcttttctagatcggtttc

SEQ ID NO: 14857 - DNA, 201 bp, Homo sapiens
ttcttgccgaggctggagtgcaatggcatgatctcagctcactacaacctctgcctcccaagttcaagtgattctcctgtctcagcctcccgagtagctgkgattataggtgtgcgccaccacatctggctaattttgtatttttagtagagacagggcttcgccacattggtcaggctggtctcgaactcctgacctcaa

SEQ ID NO: 14858 - DNA, 201 bp, Homo sapiens
aattcaaccatctgtgtactcatactaatcaatgtaatataggttggcgctttttatgcacttaattttgccacctctctcacttccccaaagaaattagwctaatgtataacaataggcttcataacttaatttagaaaacataacaaaaataatttcgctcagtaagtttctgttgtagtagatattgttggtattaaa

SEQ ID NO: 14859 - DNA, 201 bp, Homo sapiens
aagggaaatatttactcagaggtctattcaaatttgcttagtctctgacgttttcctgtgtcgtacaaatccctcgtgcggcaaaagtagtttgtctttamtaggccaccgtctcgtcagcgttacggagtattttgtccgcctgccgccgccgtcccagatattaatcacggagttccagggagaaggaacttgtgaaat

SEQ ID NO: 14860 - DNA, 201 bp, Homo sapiens
gtggcacaatcttggctcactgcaacctccgcctcccgggttcaagcgattcttctgcctcagcctcctgagtagctgggactacaggcatgtgccaccayacccagctaattttttttgtttttttttagtagagacagggtttcaccatgttggccaggatggcctcgatctcttgaccttgtgatccgcccacctcgg

SEQ ID NO: 14861 - DNA, 201 bp, Homo sapiens
cttcatgtctaaaacaccaaaagcaatggcaacaaaagccaaaattgacaaatgggatctaattaaactaaagagcttctgcacagcaaaagaaactaccrtcagagtgaacaggcaacctacagaatgggagaaaatttttgcaatctactcgtctgacaaagggctgatatccagaatctacaaagaactcaaacaaat

SEQ ID NO: 14862 - DNA, 201 bp, Homo sapiens
ttttgtattcagcttagattagggagaatatagtgtctccttaggtaaaatacttactagaaccaaaaagtccagattaaattgtttttatttttattttmctgcagttttgtgcagttgacctgattttaaaatataaaactaggaaggcatatttttcatctaccaaaatgtgaatcttactttcattttgaaacaaac

SEQ ID NO: 14863 - DNA, 201 bp, Homo sapiens
aacaatgtaaagatttaggggaggctgggcgtggtggctcacgcctgtaatcccagcactttgggaagctgaggctggtggatcacgaggtcaggagatcragaccatcctggctaacacagtgaaaccccatctctactaaaaaatacaaaaagttagccaggcgtggtggcgggtgcctgtagtcccagctacttggga

SEQ ID NO: 14864 - DNA, 201 bp, Homo sapiens
cccaggctaggtaggcaccttcctctttattcttgttgcaccatatgcatacccgtatcacacctatcctggatgataccagtttacatagctgcctcttytcctagatgcaagtgccttggtcaggggcaagggcttactcatctctcagtgcccaacacataatagctgctaagtaaatatttatgtaattgaatcata

SEQ ID NO: 14865 - DNA, 201 bp, Homo sapiens
tcacaggaaaacagcaatcattgttaacccccatccattggggagatgaagaaaatgagcaaactatgaagaatgcagtttatttcgtctccataagactrtgaggcagtggaaggtaagggctagaccccaggatggctgattcctagggctcttttcctgtgctccagaatgcagtgacacctttcagttgttgctgta

SEQ ID NO: 14866 - DNA, 201 bp, Homo sapiens
gtttactgaaatcttttatgccttagttcagttgtgtagttttcttcatatgggtcctgcacattccttagaaaatttctaggtattttgtaattgttatygctattgtgagtgaaatatttatttatttgttttatttaaatcttttttatttttaactttttttgggtacatggtaggcatatatatttgtggggtaca

SEQ ID NO: 14867 - DNA, 201 bp, Homo sapiens
aactagatccggctggttctctgctaacatgtggtcctcgatgctctagcggattggccccaaacctcagcacacagagctttggtagggctggggatgcmggtcagcctgctgaaggcgtctagaggacttgggcgggggcgtgacttcctgctgcaccacttcctttccagccacgtgggcttctgggaccctatgaca

SEQ ID NO: 14868 - DNA, 201 bp, Homo sapiens
agagatcaaaagagacaaagaaggccattacataatggtaaggggatcaattcaacaagaagagctaactatcgtaaatatatatgcatccaatgcgggarcacccagattcataaagcaagtccttagagacctacaaagagacttagactcccacacaatcataatgggagactttttttttttttttttttttttttg

SEQ ID NO: 14869 - DNA, 201 bp, Homo sapiens
cagaaagtcctgaaaactccaaaagggaaatatttactcagaggtctattcaaatttgcttagtctctgacgttttcctgtgtcgtacaaatccctcgtgyggcaaaagtagtttgtctttactaggccaccgtctcgtcagcgttacggagtattttgtccgcctgccgccgccgtcccagatattaatcacggagttcc

SEQ ID NO: 14870 - DNA, 201 bp, Homo sapiens
acagttataaatgttagaaatttctttctgttactgctccagaatctgtgcttttcaattattggttctaattcagtatttttaggcctcagagaaaaagycttaatgccgtcttcacgtggtaggctaccaggtctttgaagatggccattttgtatcccacatcttctccacatctgctcatagaaatacagtttcttc

SEQ ID NO: 14871 - DNA, 201 bp, Homo sapiens
ttctctgtgcagggataaagtctattcattctgttttgtcttttacaagatctattgcaatgcattgcaggctcggcagagtaagtcctaaataaatgttsactactcagaccactaactgtttatttgtgttgtttacccttattttttatgtcctactcttcaaaagattactagaggtggggtttgcagaaacaaagg

SEQ ID NO: 14872 - DNA, 201 bp, Homo sapiens
atttaaaatggatgaaaaagaaattctcttaagtagcgttcttgaaactgctttatcaaactcagttcatattttcagttggagttcgtgatgtatgtgawtttcctttaaataaaacccgaatctttagtaatacaaatattgggaacttcgattactgtaggtcttagggtagactcgcttggactttgactaaatact

SEQ ID NO: 14873 - DNA, 201 bp, Homo sapiens
ttcccactggggaagtaccgggtgatctttttgtgtggctaacactggacgtctttaggaggtttagagcaaaatggctgggaccgccaaaaaggctacargctatttcctgagtgtgaaatgtgggcggtgagcacaatggagtgggtttttgtgtgtttggtgtatatgagagaatgtggttatatacaagaaattcta

SEQ ID NO: 14874 - DNA, 201 bp, Homo sapiens; identical to SEQ ID NO: 1329

SEQ ID NO: 14875 - DNA, 201 bp, Homo sapiens
ttgagttatttttcctttggtatagatggatcatgctgatagtcacttattacttaatatatatatacagtttctaatatacctttcctttgaagttaccytgaagtgtttttctgtttatatgtgggtctcctccttttctatgcaatttgctgcttaaggattatactcattaatttttgtttttattatgctacagga

SEQ ID NO: 14876 - DNA, 201 bp, Homo sapiens
aaaagttttagaaatttaagaagtatagaactgtagaaaaaaggaaaattactcagtgattcataaaagttttagaaatttaggaagtatagaacagtagraaaaaaagaaaattactcagtggtaactatcctctttatgattcttgcctgtcttttggatatatctatattctttctattgtatatagagattatatta

SEQ ID NO: 14877 - DNA, 201 bp, Homo sapiens
ttttagaaatttaagaagtatagaactgtagaaaaaaggaaaattactcagtgattcataaaagttttagaaatttaggaagtatagaacagtagaaaaaraagaaaattactcagtggtaactatcctctttatgattcttgcctgtcttttggatatatctatattctttctattgtatatagagattatattatgaat

SEQ ID NO: 14878 - DNA, 201 bp, Homo sapiens
atccttacatgtagctgtctcatccactaatatataaggaaagaatttcttcctggggcagtttttcattaaaaacaggttctctttgaatcagatggctrtgaatgtcagtttgccatattatctctacttgtttaatatttttcttttgcaaatgagatggatgcctactttgggaacattttttatttctattacatt

SEQ ID NO: 14879 - DNA, 201 bp, Homo sapiens
tatattctagcaatagtaccatatttgggtatgcaccccttactggtcccttataaaaattattaacactgtcatatatacggcatggattataagggtarccttaagtaatagggacttattgtaagttatgtgagattaaagaagcacaggaaactggctcagaatccaaataatccctctgtgcttgtgcttcattgg

SEQ ID NO: 14880 - DNA, 201 bp, Homo sapiens
accctgagggcaggaaccctctatcttagtcatgactttgttcccaatacatggtatatcaggcatgtagcaggtattcaataaacattgaatgaataaaygaacaaattaattagataccaaatccatcagtttgacactatattctaaattagtttatatagtcaccgtaatgtgataaagaaattgtgatagtctagt

SEQ ID NO: 14881 - DNA, 201 bp, Homo sapiens
ggtatgatagtcacactgtattattatatctttatgcagtagcttttatttctgctgacatcatcaggcatctttgaaatttcttttttttttaacacttygaaatgctgtgaagcaaagtatcatccctctctttcctcaccctcttctcttccttaacacctttcttcagttctagctgttggcagctagatgcaactt

SEQ ID NO: 14882 - DNA, 201 bp, Homo sapiens
tttttgaaaatagagtaaccatttgttaaaccgtatataccattgaagatgttttgggtataaaagggaatttccataataattacatagtaatcttttakagccaaagttatgaagaagatcaggatttgggaaaattgtggtcaatatttgattttccttttctgtttgatagccttatctaaattcccctagcttgaa

SEQ ID NO: 14883 - DNA, 201 bp, Homo sapiens
gctagaagtgtttcctaataacttttctcaggaaacttgttgactcaatttactgtagtcatagagcctcctacctgaccccctgtggtctgctttggtarcacacctgtaggaggcaatgtaatcttcaggaaattcacttcctaccagtagtcctgagtaaagtgaattttctaaaatgaaacatcttgtaaacattat

SEQ ID NO: 14884 - DNA, 201 bp, Homo sapiens
ttttgtttttattatgctacaggaggagttggatttgtcttctagttctcagatgtctcccctttccttatatggtgaaaactctaatagtctctcttcascggagccactgaaggaagataagcctgtcactggtcctaggaacaagactggtattactctatctcctaacttctgttatttctatttcagattgagctt

SEQ ID NO: 14885 - DNA, 201 bp, Homo sapiens
ttggtgagaatgagtggcttcttgctcctagctagagccagtccttccatatgtgctttagattcttcctgttttgttcaagaatattgctcaagctattyttcctcctgtttcctgcatcagcatttcccctctctactagatcatctctgtcagtaaatgaacatgttgttgtttctcctagaagtactgtttctatat

SEQ ID NO: 14886 - DNA, 201 bp, Homo sapiens
atttttgagtgcttgccgtacacaagacattgggctgaatattgtggaaaatacaaagatgtgagaaataggaagcaatataaaataaattatgtgagtgraacagtctaagtactgtaatatatgctttactttgagctgttgagtattataaagatgaacatggaattggtgtcagactatgagtttgtatttaggaaa

SEQ ID NO: 14887 - DNA, 201 bp, Homo sapiens; identical to SEQ ID NO: 1325

SEQ ID NO: 14888 - DNA, 201 bp, Homo sapiens; identical to SEQ ID NO: 1326

SEQ ID NO: 14889 - DNA, 201 bp, Homo sapiens
tggtaattggattgtgtagaaggaggctgaacgatagagaggaaggtgtctaggatgacttccgtttttctatcttggggctttttgggtagatgatggcraaaattattgaaatgggagacagaggtaaaatatgttgcccagatcactctgctaataagaagtggagccagaacttgagcccaggtggtctggctcgga

SEQ ID NO: 14890 - DNA, 201 bp, Homo sapiens
taatataaattcctaatttaaaatgatcaaaaaaatattttttatcatataccttttgtgcctttaaaccaaaagtatggtgaaagaattgtaatccaccaaaaaaaaaaaaatcatatcagtttttttgtggctttgtaatgctgacatggcttctttttctaccttttttagttcttttgtttggctggtttcactctc

SEQ ID NO: 14891 - DNA, 201 bp, Homo sapiens
tctagggccagcttagcagggtgattctgcttccggatctctcttgagattgaagtcaagctgttgactggggctgaagacttgattgggtctcagggatrtgcctccacattcactcacgcagcaggtggcctctttctggggctgctcacaacatggcttccccaaagcaactgttccgtaagagtgagaaagcaagtg

SEQ ID NO: 14892 - DNA, 201 bp, Homo sapiens; identical to SEQ ID NO: 1327

SEQ ID NO: 14893 - DNA, 201 bp, Homo sapiens
gggattacaggcgtgagccaccgtgcctggccagaaaatgttctttgtcatctctccacctccccaggctaggtaggcaccttcctctttattcttgttgyaccatatgcatacccgtatcacacctatcctggatgataccagtttacatagctgcctcttttcctagatgcaagtgccttggtcaggggcaagggctta

SEQ ID NO: 14894 - DNA, 201 bp, Homo sapiens
aaataaaattttgactgtcatgagattgagaagagtagagatagtgaaagtctaaattttctctttttttctgctttaaacaatttaatgagaaaaataartgtacgtaagattcttaacaaaaatcaaattaagttttttaatgtatttgaatatttaaagtaggattgccacaaattaaatttgccaatgattttaact

SEQ ID NO: 14895 - DNA, 201 bp, Homo sapiens
tcttaaacgacattctttggaactgtctttcatagtcaggcgacccgccagccaggccgccaggtaggtggaagggcggcttcgggaactagatccggctsgttctctgctaacatgtggtcctcgatgctctagcggattggccccaaacctcagcacacagagctttggtagggctggggatgcaggtcagcctgctga

SEQ ID NO: 14896 - DNA, 201 bp, Homo sapiens
agatgtctttggacattagaagaaggcttacttagacttgttctggatagccacagaatccagaactagtatcaaaaggtggaagtttttttgttttttgktttttaaaaaggaagcacatttctagttaaaacaaggggaaactcttaataattagggtggtagagatactggagggatcagggagtgagtacttccacc

SEQ ID NO: 14897 - DNA, 201 bp, Homo sapiens
ttgggtagtaaaggtagctagttttttctgcgtgttgtattaagccattatttatcaaatactaattacgttttatgcactaaatactagtccaagtattytatttgatatatggattaattcatttgttcctcctagtgccatgaggcaggtattattattcctgatttacagatgaggaaaccgaagacacagctaata

SEQ ID NO: 14898 - DNA, 201 bp, Homo sapiens
ttctttgtctctataacattgctagctaacataaaaacatgttttttacttacacttttcaatcacaaagtctaaaataacttgctttatgtttgagaaamgattgttcagtagtctgtaagtagacttgtatatagccacaaacagagaacttataactcaagaataatacgaagtcttcaaaattctcagaatggtggg

SEQ ID NO: 14899 - DNA, 201 bp, Homo sapiens
tgtgtgtagttttgtatttctttcttcctatacattgttttgtatagttttgtatttctttcttcctatacattagccactatggaaattgtaaaagcacktattcattagattataagataatgtacgtaagggaagtttttattaaaatgtctctagacagacacctctgtatagataggtttgtctcatatacttgag

SEQ ID NO: 14900 - DNA, 201 bp, Homo sapiens; identical to SEQ ID NO: 1301

SEQ ID NO: 14901 - DNA, 201 bp, Homo sapiens; identical to SEQ ID NO: 1303

SEQ ID NO: 14902 - DNA, 201 bp, Homo sapiens; identical to SEQ ID NO: 1305

SEQ ID NO: 14903 - DNA, 201 bp, Homo sapiens; identical to SEQ ID NO: 1306

SEQ ID NO: 14904 - DNA, 201 bp, Homo sapiens
gctccaatcagagtaatacactgcacagaaagcatacaagatatacgatgtctgtggacagatgctctgtggcattattaaccctggcagttgctttagcygttgtttagtcaatggaggttgtttgggagctagaattgggagagaacaggtgatcctggcacccagcccacttgtagctctgcttactgactgagagtc

SEQ ID NO: 14905 - DNA, 201 bp, Homo sapiens
cattcacatggaatgctggtccttttgacagttgtttcttcccattgttgaaggcagggaggaggacttagggattcttctctgtattccccactaaaaascccttctgttccagttgctccaatcagagtaatacactgcacagaaagcatacaagatatacgatgtctgtggacagatgctctgtggcattattaaccc

SEQ ID NO: 14906 - DNA, 201 bp, Homo sapiens
aacccaccttcagttatttttttaaccacagaaaagtcaaaagatcagtacactgataaacgtgcgttttccttatctagatttaccaactgttaacatcstgccacattcactttatatcttaatattacccacactttcctcctttttcacatctgaaagtgggctgcagataatatgaaactcctaaacacttcacca

SEQ ID NO: 14907 - DNA, 201 bp, Homo sapiens
aaaggcagtacagaactaggttgttgccggcagttcttccccagccccacaccccgctctggattcatggatgaaaatgcaaactcagatgccatattaastactcagaattctcccatgttcacacatctttttactgtattgctgtgattgttcagttgggcttgaaaaatattatttattttctcatcagttttatgt

SEQ ID NO: 14908 - DNA, 201 bp, Homo sapiens
aattcaattctttgtcttggaaaagccaaacatttaattttaaaaatcactggttggctctgtgtcatctttgtagaaaggcagtacagaactaggttgtygccggcagttcttccccagccccacaccccgctctggattcatggatgaaaatgcaaactcagatgccatattaagtactcagaattctcccatgttcac

SEQ ID NO: 14909 - DNA, 201 bp, Homo sapiens
acttcaactataatggaagagattttcaaaactggtaatgggaaatttatcatcaatgaagactattttaaacattggaacaaatgagtgaccaacagaartggaggaattatgtattctattggatttaaaatagaatatatcatctgctcaagacacttagaattggtagattagatctgtctaataatttttaactct

SEQ ID NO: 14910 - DNA, 201 bp, Homo sapiens
aaataattagagcctcgtcagtaatgacgagattgcctcactaactgtccaagggtgttagtactaagccacccaaagaacctttttataatgtctcatasagtagaccagagaatgttgctgtgactcctttatcatttatagagatgtggctatgttgggactcctaatggcatgttaccccaaatgctgaactatcca

SEQ ID NO: 14911 - DNA, 201 bp, Homo sapiens
cgtaatttatttaaccatcttttgataggcagctagggtatttccagttacttgttgatatgtgtacataaaatgtatttccatatatttatgtgtctgtrtgtgtatgatagaatctagactagagctagaggttacgattatctgaaattgtgatagagtttgccaaattgccttccaaaaagactgtatccgtttaca

SEQ ID NO: 14912 - DNA, 201 bp, Homo sapiens
acccactaattatgtggttggtttctctggcaatcagcctccatcatccaagagtcacctcattagcataaactcaggtccagctggaaggggcttattayggataacaaaagatgctcttcttaccccctatcactcaggaaattccaagggttttaggagctctgtgacaggaaccagaataaaaaccaaatatattat

SEQ ID NO: 14913 - DNA, 201 bp, Homo sapiens
ctgacctcaactgatccgcctgccttggcctcctaaagtgctgggattacaggcttgagccactgcactcggcctgaagcattttatgatgctcactaccragtgttcataagcggtaaataaagcccttgggctaggtaatgtaagatccattgcaacctggagatgaagaactttgtaaaggggataattgttatcacc

SEQ ID NO: 14914 - DNA, 201 bp, Homo sapiens
tcatttgcaggtaagataaattactgcactgtgagtctattctaacctatgtagattagaaaaatcatacactggtttagcggaaactttattttctttcyttctttctttctttttttttgagatggagtttcgctcttgttgaccaggctggagtgcagtggtgcgatctcgactcactgcagcctccacctcccaggt

SEQ ID NO: 14915 - DNA, 201 bp, Homo sapiens
cctaccaggtttaagcaattctctgcctcagcctcccgagtagctgggattacaggcgcccaccactaagccgggctaattttttttttttttttttttgkatttttagcagagacggggtttcaccatctcagccaggctgaccgggaactcttgacctcgtgagccacccgccttggcctcccaaagtgctgggattac

SEQ ID NO: 14916 - DNA, 201 bp, Homo sapiens; identical to SEQ ID NO: 1319

SEQ ID NO: 14917 - DNA, 201 bp, Homo sapiens
gttttgttgaattattgagcatttagaaagccacaaatatacactgtccttccaggaatgtgcatgatagactggcatttgtcacactgcactagctaccrcaccctatgcaaaaagaaaaagaaaaaaagaattgattaaggaatcagatgcatgcactcagccaagtcagccaccatccaggctcgggggatgcatcca

SEQ ID NO: 14918 - DNA, 201 bp, Homo sapiens
ccatatgcttgtatttctcttctgccgctatgagaatcctgattcccaataacatcctttgtttttataggctcacttcagcagctctgttggaaataaaytgaaagaggggcaagggcagaagcagggagacgttttggaggctgttatagcaatccccatgagttacaatagtagcagtggagtaatgagaagtagttg

SEQ ID NO: 14919 - DNA, 201 bp, Homo sapiens
gtttttataggctcacttcagcagctctgttggaaataaactgaaagaggggcaagggcagaagcagggagacgttttggaggctgttatagcaatccccrtgagttacaatagtagcagtggagtaatgagaagtagttggattatggatatgtacacacacacacacacacacacacacacacatacacacatatatat

SEQ ID NO: 14920 - DNA, 201 bp, Homo sapiens
aatccccatgagttacaatagtagcagtggagtaatgagaagtagttggattatggatatgtacacacacacacacacacacacacacacacatacacacrtatatatacatacattttaaaattttgaaatagtttgaaatctatagaaaagttttaagaacagtgcaaagaactcttgcatgccttttacacagactcc

SEQ ID NO: 14921 - DNA, 201 bp, Homo sapiens
gagacggggtttcactacattggccaggctagtctcaaactcctgagctcaagtggtccacccacctcggcctcccaaagtgctgggattacaggcatgarccaccacacctggctaaggctgcttaattttttgatgtgaagatccaaataagagaaaaaagtgaaggagattgattttttaaaaaatggtttttttatg

SEQ ID NO: 14922 - DNA, 201 bp, Homo sapiens
aaccacaatgcagttgtcaaattcaggtaatttgaccttgatctttaatctacagtccagattcagattttgttaattgtccccaaaaagatgagtttagraagagtcatataacttaacatttgtaatgtaaattaaagatctcggaagtttgctaacctgatttaaataccacagtgaaatgaaccacttctgattttc

SEQ ID NO: 14923 - DNA, 201 bp, Homo sapiens
agaaacattggctaacttatagactttcagatttatttctgtaaagataagtaatagccattgcaaagcagccgtacttgtgaaattggagttaagcttcyataacagcggtcttaaagaataggtagggttagttaatacacagcagcaaccagctgttcttcctccctgctgagactgggaaagaaggaaattaacttc

SEQ ID NO: 14924 - DNA, 201 bp, Homo sapiens
aaaggtcattttgatacactgtatgtgcaaaagcagtttaccaaacagaattacatacagtgtaatcctttttttcttatataggaaaatacccacttccycccacttaaaaaaataccaaacaccacaatgtgtgtatgtttagcctacaaatcatattttttttgcctaggaagtattgaataatttaaatattttata

SEQ ID NO: 14925 - DNA, 201 bp, Homo sapiens
atgggagggacagtgtgagatttatgcatcttgaattagagatgtcattggtgggtatttttgtgtatctcttgtaacagattggtgtgtatttctgtgtrtctcttgtaacggaataccaagtaattcttgactgatgaatttcattttctttcctttttgttagatactaccagccccctcacaagttagtgtcccttt

SEQ ID NO: 14926 - DNA, 201 bp, Homo sapiens
aagacctttttgattgggtaatgaggggataacagttaaaccaagatctgaaggatgagaagaatcaactgtgaagagtcaaggggcagaagattccaagmagagggagcaacaagagagcagaggccctgaggctggaaagaatgtgttcgttttaggatttgtcagaagaccagtaaggctagagtaggacccagtagg

SEQ ID NO: 14927 - DNA, 201 bp, Homo sapiens
gctgaaatcctaccacctctgcaaaacttttgctttacttctgtggaccactagaatacttctgtaggtcctagaataaatagtctttcctccactgaacmtccttaatgtaaccacctctcatttatggctttatctaacactactcaaagataattaccttgaaggtggtggtgctttttttttatttaactgtgtctc

SEQ ID NO: 14928 - DNA, 201 bp, Homo sapiens
gaaggcatatttttcatctaccaaaatgtgaatcttactttcattttgaaacaaacacctctgctttaagaagatgaacggtagtgataaatacaaaaacrttaaaattttttaaatgaatagcgtttgttgatctttaaagaaaacataaatgtgaaataactttagagcttaaaagttttcttcctcaaaccttttagg

SEQ ID NO: 14929 - DNA, 201 bp, Homo sapiens
taaatagtctttcctccactgaacatccttaatgtaaccacctctcatttatggctttatctaacactactcaaagataattaccttgaaggtggtggtgytttttttttatttaactgtgtctcttcctcctcttcatcccatgcctaaagaaatgctctgatacttaatttttaatatatacttagagttgggaaattt

SEQ ID NO: 14930 - DNA, 201 bp, Homo sapiens
taactttctgtggagtgttacataggtgtgtcagcagttacatgatactttctttgttatttaagacatctgcaagctgaggatggccagtgtcatttcasagatgtacatgccaaagacatggtagttttcattgacattgggaaatactccttctcttgagcttttacaaataaaagttagagagtgctaagaaatcca

SEQ ID NO: 14931 - DNA, 201 bp, Homo sapiens
tctgagtaatggggaactattaaaatattttgagcagggaagaggcacaaacagagttacatttcaaaagatttccccagcagcaacataaaagatagatkagaggggattatgcttttatagggacaacagttagaaagttatcatctaggcaatagatgatgggtagttcatatttaaaaaaggattctttctgtatac

SEQ ID NO: 14932 - DNA, 201 bp, Homo sapiens
tagaaaatcttagaccccagagaaaacttaggggagtttaacacaacagcctcatgaaacagctaagaaaacgggttgagggaggtgaatggctgatccarcccagctactgacagagctgagaccagatctcagacctttaggtctgtaggcaagcattttatttaaatataaaatgtaatttgtttacgataccaagaa

SEQ ID NO: 14933 - DNA, 201 bp, Homo sapiens
ctctttagcagaactccttaaaagactcatctatacttgctgtttcctccttctctcctgctgttctctctataacccactccaaataggctttcatctcrtcgctccactgaaactacttatcaaagtttccatcaccgtcatgctaccatattatcttctccatcctcatcttattcccagcaacatttgacatcacct

SEQ ID NO: 14934 - DNA, 201 bp, Homo sapiens
gattactgtgtgactttgagctaaattacaacacattagtaaatacagaagaaaataatgagcaatgccacatcccttgcattttttaaagcaaggaccascctaattgacagtgagatctttatattaattttcccatttaaaatagataatattcagtgttcgatgaagaaagaattatggggtagattatgaaataat

SEQ ID NO: 14935 - DNA, 201 bp, Homo sapiens
agtcttggaatcagatcatagctttacatttccctcaaagcatctgagcttacattcccaggttttccatctcttcttgatatttaaagctttaaaaaacygcagttatcagtttaaaccataacaggcacgtgggctctaatgacttctgcaggtggtttgggctgtattagagaacctagtcttgatcttaaactgtca

SEQ ID NO: 14936 - DNA, 201 bp, Homo sapiens
tactttaccgttagtacacacttctttatcaatttttcccttgaatttttttttcctgtgattttggaccttacccttaaaacctcaaaaactacctcagrttttttgtgatatgtagtaatcaactacagttaaacatagtttaacatcttcacagctgctgtaaaaagtaagcaaaataagggaagttatatatgagct

SEQ ID NO: 14937 - DNA, 201 bp, Homo sapiens
cttgggctgcatttcttcatagtgggctagaggcaatggccctggaatttaaacatttgccactagttctaagtgttgtgcgaagctccaacatctaccayggagctgtaggaaaccatacagatgaactagacaacatccttgacatgtcctttacatgtctagacacatgagttatgtctcttccatgggactatgtgg

SEQ ID NO: 14938 - DNA, 201 bp, Homo sapiens
aatcaactacagttaaacatagtttaacatcttcacagctgctgtaaaaagtaagcaaaataagggaagttatatatgagctatgcttttatttcgtgtgktgaaaaatttgaatttttttttaccccaggcaattgagttcattctttttcttctcccaaaagagcatgattttcaagaggttttaatgcatctatttgt

SEQ ID NO: 14939 - DNA, 201 bp, Homo sapiens
catggatatctatatcaaatgtctttgtcacaatggtataataaataatactgcttatctcctcttttcttagagcttttcaaaaagagaatgttaagacmtggggcagtttggaaatgaagacatccatttctgaacttagacatttactactatggtttaatgacaggtcttacttagaatctgttaagtgggggttcc

SEQ ID NO: 14940 - DNA, 201 bp, Homo sapiens
ttaaaaggttggtgtttgcataatgttctgctaaataaaaaatcctaaagaactttagacaaatttttttaaagtcatttttattttatcacatactagtytccatctaccataatatgatttttttttttagagacagaatcttgctatattgcccaggctagccttgaacacctgggttcaagcaatcctcctgcctca

SEQ ID NO: 14941 - DNA, 201 bp, Homo sapiens
cctgaaataaagtaatgggtatgataaagtccctaccttaatggagcttacactctagtgcagagctaaacaataagcaaataaataaatacacaaatacmctgaaaattagagctaagttctctaaagaaacacaaagcagcataggaggttagaatttgaattgagaaatgagtgactagactgagtggtcagggaagg

SEQ ID NO: 14942 - DNA, 201 bp, Homo sapiens
agatggatatatggacacagtaatgaacaaatgattaaaaaattatttaaaccattgtttgacagggtaagattactttctaatgaaatagaacttggtartatgcccttgaagtctgataccctgacaaaccgcttctgaaaatcagcttacataactaccagggagaataaaaaggcatagtgcaaagcaaatgctgtg

SEQ ID NO: 14943 - DNA, 201 bp, Homo sapiens; identical to SEQ ID NO: 1304

SEQ ID NO: 14944 - DNA, 201 bp, Homo sapiens
taatctgacataacaccaatatccttttcttattaaacctctaaccacgagccctagcctcattaataaccccaatctatatcagttaccactctaatggktgccaaatggtaactatctaactctatcattctgtctatcattctatcattgttgattgacattgcactataagaaccaacctacctacctaccttcctt

SEQ ID NO: 14945 - DNA, 201 bp, Homo sapiens
aggcgtggtggcgggtgcctgtagtcccagctacttgggaggctgaggcaggagaatggcatgaacttgggagacggagcttggagtgagccgagatcacrcagtccagcctgggtgacaaagcgagactccgtctaaaaaagaaaaaaaaaaagatttaggggaaaatctggagaaagagcttccagacagagggaacag

SEQ ID NO: 14946 - DNA, 201 bp, Homo sapiens
cagttaattacaggggctaagagagctaagagatgctgattcagataaagagtgagaaattacttttggaattgaccatcagaacttgttagtgaccttcrtgaaagttctttcattggagtggtgatggcaaaagccaactgaagtggattcagggaagtaataatagagggggaagtgaagaaaattatttcagggtga

SEQ ID NO: 14947 - DNA, 201 bp, Homo sapiens
ggtaactatctaactctatcattctgtctatcattctatcattgttgattgacattgcactataagaaccaacctacctacctaccttccttccttccttygttccgtgatgaactcattgattccttttttatttggtggttggtaaaccgctactctcattttattctgatgctcagattttcccagatttgaccactg

SEQ ID NO: 14948 - DNA, 201 bp, Homo sapiens
gccaaagcatatcaagattttaaaaaaattctgtttcttggtgtaaagagcctgtaactgctctcctttttcttttctcatttcaacctttttttcttccrgttacctctttcagttgctaagagtatcccaaactcttataaaatattctgtaattttagtgaactgacatttctttgaaatatctgttgtatttaagca

SEQ ID NO: 14949 - DNA, 201 bp, Homo sapiens
taaaagacttgggtaaatgataccagatagaaccccagattagcaggaaggaagagcatcagaatgggcaaatatttgggtaaaaagaacaggactttttwaaaagaaactatatttatcttatgtgtgtgtatttaaatgtctttaaaagactattgtctttttaaagcaataataatggcaatttattatggggtttac

SEQ ID NO: 14950 - DNA, 201 bp, Homo sapiens
gggtcttgctctgtcgcccaggctggagtgcggtgatgcaatcatagttcactgtgacctggaactcctgggctcaagtgatccttccatctgagcctccygagtcgctaggactacaggtgcacaccgctaccatgcctggttaatttttaatttttgaattttttgtagagacaggggtcttgctgtgttgcccagact

SEQ ID NO: 14951 - DNA, 201 bp, Homo sapiens
ccttccttcctttgttccgtgatgaactcattgattccttttttatttggtggttggtaaaccgctactctcattttattctgatgctcagattttcccasatttgaccactgagaattcattcatattggggcctttgttctttttgacatattcctgtcatttgctgagaatttctggcacagcaagatttccaggctt

SEQ ID NO: 14952 - DNA, 201 bp, Homo sapiens
agctttcttgcccttgatttgcatctgtttcatgaacctagggaagggaatgttattttttgagtgctctgtaccaggtgtcctgctgagtgttttacatrtattttatctttaaatccatgtaataactaaaagtttattttatatatagaaaaactggtcaaatcatttattttttttgtaattttcagagtcataaga

SEQ ID NO: 14953 - DNA, 201 bp, Homo sapiens
cacctttttgcacagcctcgtaggcaagcataccttcatatattcgacagggtggtgaaaaatgacttttcctcagatttaatttgtattactaaaaaaawtaaaaatcgttcaaacctatgcagaaatctctctattttctgatactttcattatttttacatgctttgcaatgtacttgaccatctagtacattttaga

SEQ ID NO: 14954 - DNA, 201 bp, Homo sapiens
atttataagaattgtttaaagaaggcagtcatcagttacttttttcacatgattgtattgctgagagtagtatctgcattagtctcttaagcaagactttwaaaaaatcctactgttgtccccacctttatttttgaaagataaacttaaaatttacatttttaaaaatttttaaaaagtaaaattttaaatgactcaaca

SEQ ID NO: 14955 - DNA, 201 bp, Homo sapiens
tatatgattaaaaagcagccaagttcagcgtggactgagaactgctgacaatggagaacatgagacccagaatggcaaataatgtttcagacattgacttstcagactggtctccaccctgtacttaaccccattctcacccttttttggaggggaaaggaattatctagttaaaaactgaatctataggacaacctgtct

SEQ ID NO: 14956 - DNA, 201 bp, Homo sapiens
gctctatctcacaagataggaggttctgtaaacctaggtatgcagtcaggcactaagtggccaaaaacttctatcagcagcattttgaataatcagagaarattcaacacaggagatgagaaccaggaaacaacaaccaaaaaagaaatatggtgagtttggccttaatatcacaaaaagatgaaaaaacaatgtgttcct

SEQ ID NO: 14957 - DNA, 201 bp, Homo sapiens
ctcgaactcctgacctcaggtgatccacccgccttggcctcccaaagtgctgggattacaggcgtgagccaccgcgcctggcgggtcattctttaaagacyctaaaatgtggctttgtgttcttttgctacgtcgttgaggggaagccattgtcttctcaacagtaagctatatggttggtatttttaaagttcagcattt

SEQ ID NO: 14958 - DNA, 201 bp, Homo sapiens
cctaaagaatgtagcctctacttgagacccatttggtctgtgcaggtacaggcactatcatctctctctgtaaagggtcagtatgatgtttaggaaagcarcccacatttggagtcaaagccttttgttcttaccctgcgcagcccttaaccagatgtgtgacctgtaagcaaggagttcagttagtatcctcatctataa

SEQ ID NO: 14959 - DNA, 201 bp, Homo sapiens
tgactgtaaactatgttatgggacaggaattttgttctttaatacctggattgttctttttgctcttgctgaaatgaaaatgaaataataaattacctcakgcttggtcttctttcatctttcaatataaaatattctaacagtttcattaaaaaggtgagtggcatcatttcttgtgcagaaggatgtagactttttctc

SEQ ID NO: 14960 - DNA, 201 bp, Homo sapiens
gataggtgcagttatcatcattttacagatgaagaacctgaggcagtcgtgtccattgtgaactccaataagaaagattaaaaagaaggaagaaaaagtcmgctgtagaaatgaaaaaacaaatttatccattgtgacatcgtttagaaatagcagtcagaatttaaccaagaaagtctggctctatgttcttgatcattt

SEQ ID NO: 14961 - DNA, 201 bp, Homo sapiens
tgtgattttaacaactctaaataatttaaataaagtgattaactcagaacagcctgtgagggatgtgctttcctttttctttttaacttaggtaatgaaayttagagcaagagtcttcaaacattttctgtaaaggttcagatagtaaatattttaggctttgtgattacatggtcactgttgcaactactcaagtctgct

SEQ ID NO: 14962 - DNA, 201 bp, Homo sapiens
agaagagtagcattttgttaacattaagaaaaacctctttaataactggcttaatagaaaccagctggattcttatatctgttctttttggtcaaaatatrtgaagaaaatccagcctcacacagagatgtaattggaaaggaaggactattttaaaagcctttcagataattgtgggtattctttgatgctacaccaaaa

SEQ ID NO: 14963 - DNA, 201 bp, Homo sapiens
gtaggtgtatccttacctttgattggttagaggtctgtgtgaaaactattataacactgagtccccgagaatatcttagattttcttttcttgattagtayatataaaactctttgccctatagaactttgattttgtcttattctttaatggatgaggtgctgtttcacttaagaagtaattcaagtgagcagagtaatt

SEQ ID NO: 14964 - DNA, 201 bp, Homo sapiens
ctacatgattggtttcagaatgacatcacaacttaattggcaccattatagtatttgaaagattttgttgcataagcgacaagaagatagattattcataygtctgaaacaagagaaagatggctttcaatgtatggtcattttttattaacaattttgaccagtttctttgctagattccacctttccgtgagtcataaa

SEQ ID NO: 14965 - DNA, 201 bp, Homo sapiens
tttcaccatgttggccaggctggtctcgaacttctgacctcaggttatccacctgcctcggccccccaaagtgcttgggattacaggtgtgagacactgcrcccggccgttcattttttaattgaattgtattggtctttttctctttaatattttaggtgctttattatatattaggattattagtccttagtttgtgaa

SEQ ID NO: 14966 - DNA, 201 bp, Homo sapiens
ggcaccattatagtatttgaaagattttgttgcataagcgacaagaagatagattattcatatgtctgaaacaagagaaagatggctttcaatgtatggtyattttttattaacaattttgaccagtttctttgctagattccacctttccgtgagtcataaaattctcaaatatatcagttttatcttttctgtatctta

SEQ ID NO: 14967 - DNA, 201 bp, Homo sapiens
taattttttgtttggaacaatctcaaattcacagaagtgttgtgagtacgttgcaaataacttgttttttccttatgcatttcagagtaagttaccagtcygatgcccctatcactccaatactttagtgtctacttcctacaagcacagatatttcttagccataatacaagcacaaaatcgggaaataaacattaatat

SEQ ID NO: 14968 - DNA, 201 bp, Homo sapiens
attttgttgcataagcgacaagaagatagattattcatatgtctgaaacaagagaaagatggctttcaatgtatggtcattttttattaacaattttgacyagtttctttgctagattccacctttccgtgagtcataaaattctcaaatatatcagttttatcttttctgtatcttatatgtagacagtatagttgtggg

SEQ ID NO: 14969 - DNA, 201 bp, Homo sapiens
tgtattatatgagatacaaatccaattttatgtttttccaaatgactatcaaaatgattattctagtaccatttatcaaaaagttcatctgatttcaattrtatgcatgtattttaaatttatgtaaatggcattatagtagatatctttatattatttacttttaaaaatcagcacagtgtttttaagataaattcctat

SEQ ID NO: 14970 - DNA, 201 bp, Homo sapiens
ttatttgaggcactgaaagaaaaccaatgtgacaggagactagtgaatgggaagggggatgagtaatgaaaatgaggtttgggagattggaaggggctagwtctacaaagccttatgagctatagtaagtagtttgggttttattctgagggccagcaaagggatttaagcagcagaataacacgaatgatttagttcgta

SEQ ID NO: 14971 - DNA, 201 bp, Homo sapiens
tttcctacaaatgcatcataccttaaaaatgcactttaaaactgaatggaagccaggtatggtgactcacgcctgtaatcccagcactttgggaggctgargtgggtggatcacctgaggtcaggagttcgagaccagcctggccaacatagcgaagcactgtctctactaaaaatacaaaaattagctgggcatggtggc

SEQ ID NO: 14972 - DNA, 201 bp, Homo sapiens
gtatccatcccctcaagcatttatcctttgtgttataaacaatccagttacatactttttgttattttaaaatgtacaactaagctcttattgagtatagwcaccctgctgtgctattaaataatatgtcttattccttctccttttttttttttttttttttttttttacccattaacaatccccatctcactaccagct

SEQ ID NO: 14973 - DNA, 201 bp, Homo sapiens
gtagaaaggactatcattttttactaagatgaaaatatttggggggcacggtaatatgtttggtataaatgtggagagttatttttggatacatttaaatktgaaatgtctgtgagacattcaagggaatgtgtgcaattggctctgtgaatctgggactcaagagaggatagatctgagctaagaagagtaattaagaat

SEQ ID NO: 14974 - DNA, 201 bp, Homo sapiens
tctgagggcagactattatgatttttatggttgctttgcaaggagagaacattttaaaacttacctttatctttttgctctcttttcacactattagtttrtgtaatattttattacacaattatactaatacaattaatgaaagtagtcttgaaaaaagacacaactcaactagtcgtgaatgttccctgtgctatgggc

SEQ ID NO: 14975 - DNA, 201 bp, Homo sapiens
acaacaacaacaacaacaacaacaacaacaaagcactgctccattcatgcatctttcttttacaacatttggaacaaaggcagtattacaaaatagaaaayagaaaagaatacaaataaaattattttgcttttgatattcttttaagaccaaataagagagattatggagaaaggatattggcattttaactgcaacctt

SEQ ID NO: 14976 - DNA, 201 bp, Homo sapiens
acatttatttatttatttggagacgagtcttattccatctcccaggctggagtgcaatggtgtgatctcagccccctgcaacctctgcctcctgggttcaratgatcctcctgcctcagcctcctgagaagctgggattacaagtgtttgccaccacacctgactaatttttgtatgttttagtagagatagggtttcacc

SEQ ID NO: 14977 - DNA, 201 bp, Homo sapiens
acacagtttattctttaagtataggggtgtgggactaaaaccttgcctggaatggctttaggtcttttttataatttggcatcttattgccagagtctgtyctgtcagtcttatcatctctgttttaacattaatgctggccagttgttgtgttaaactacaaaagggagggagtataacaaggtgtgtctaacctgtccc

SEQ ID NO: 14978 - DNA, 201 bp, Homo sapiens
taagaccaaataagagagattatggagaaaggatattggcattttaactgcaaccttatactgatactgaatgtttgtatgactacgaaccaagttttatrtgtgtgtgtgtgtgtgtgtgtctctgtgtgtgtgtgtgtgtctctgtgtgtgtgtgtgtgtgtgtgtgtgtagtttgtaggaagaaatgtagcaacagat

SEQ ID NO: 14979 - DNA, 201 bp, Homo sapiens
caatttactaatatattcaccttctactgttagctactacaaacaaagcaactgtgactatttgtgtacaagtctttgtagggacaaatgcactcacttcycttgtgtaaatacctaggagtgggatggctgggttatatagtaggcatatgtttagctttttaagaaactaccaaactactttggtacaagtggttgtac

SEQ ID NO: 14980 - DNA, 201 bp, Homo sapiens
tcttgaattagagatgtcattggtgggtatttttgtgtatctcttgtaacagattggtgtgtatttctgtgtatctcttgtaacggaataccaagtaattmttgactgatgaatttcattttctttcctttttgttagatactaccagccccctcacaagttagtgtccctttccatctgttgtattgtcttagacttctc

SEQ ID NO: 14981 - DNA, 201 bp, Homo sapiens
tttaactgcaaccttatactgatactgaatgtttgtatgactacgaaccaagttttatatgtgtgtgtgtgtgtgtgtgtctctgtgtgtgtgtgtgtgtstctgtgtgtgtgtgtgtgtgtgtgtgtgtagtttgtaggaagaaatgtagcaacagatcaatgattcatatctttaacaggatggcatagacttactctg

SEQ ID NO: 14982 - DNA, 201 bp, Homo sapiens
agctcccatgggaactaataaatcaagaactcgctcacccctgagggagaacattaatctcttcatgagagatctgccccatgacccaaatacctcccatyaagccccacctccaacattagagatcagattccaacatgagatttggaggggacaaatatccaaatcatagcaggaagagacactccctcctatgaaaac

SEQ ID NO: 14983 - DNA, 201 bp, Homo sapiens
taactgcaaccttatactgatactgaatgtttgtatgactacgaaccaagttttatatgtgtgtgtgtgtgtgtgtgtctctgtgtgtgtgtgtgtgtctstgtgtgtgtgtgtgtgtgtgtgtgtgtagtttgtaggaagaaatgtagcaacagatcaatgattcatatctttaacaggatggcatagacttactctgca

SEQ ID NO: 14984 - DNA, 201 bp, Homo sapiens
accttatactgatactgaatgtttgtatgactacgaaccaagttttatatgtgtgtgtgtgtgtgtgtgtctctgtgtgtgtgtgtgtgtctctgtgtgtstgtgtgtgtgtgtgtgtgtagtttgtaggaagaaatgtagcaacagatcaatgattcatatctttaacaggatggcatagacttactctgcattttgagt

SEQ ID NO: 14985 - DNA, 201 bp, Homo sapiens
aagttttttggtttgttttcacattcaatttagagaccctgaagcagtattttaatgataggaattaagctatgtataactttcatggcttgaagatcagmaaattctgttttttcttggttataatgttatcttaatcagaaatgtgtgatctttgtgtctaacaatgcacttaaaaaaacaaaacaaaaaattcccttg

SEQ ID NO: 14986 - DNA, 201 bp, Homo sapiens
atgaccagtggaatctaagtttgtttatttttacaatagccttaatttggggcttgcaagttttttggtttgttttcacattcaatttagagaccctgaarcagtattttaatgataggaattaagctatgtataactttcatggcttgaagatcagcaaattctgttttttcttggttataatgttatcttaatcagaaa

SEQ ID NO: 14987 - DNA, 201 bp, Homo sapiens
tttttaattttagtaaggcacatacatggtacttttaatatcaatgactagcagttgttgagtgactcctatgggacaggatccatgcttggcacttgacwtataacatctccagtaacagtcctacaagggttgtgtggttatactctttttattgaggaggaaacagtttgttcatggagggcaatttccccaggagtg

SEQ ID NO: 14988 - DNA, 201 bp, Homo sapiens
cagtgccgaaatatatttctttctatggcaacattcttattctactatcctttttatttttaagtagtttcatttttgtcactgttgggttattttaaacratttaattggagggaaagaaatacaaattcatcaaattttacctccagaattgaatttccttcactagttccttaataagtatttaagtaaaagggggtg

SEQ ID NO: 14989 - DNA, 201 bp, Homo sapiens
agctgaagcaaagagagattaagtagcttatctaaggacacaaaaatggtaagcattagaactagggcaataattgatagattctaatttaatacagtgatttttttttctttacattgttgtgcttttttctttatatctggcacttttagatgtattacagcatatgtaaataaattaatctaaccctccaaaatcaag

SEQ ID NO: 14990 - DNA, 201 bp, Homo sapiens
aagtagcttatctaaggacacaaaaatggtaagcattagaactagggcaataattgatagattctaatttaatacagtgatttttttttctttacattgtkgtgcttttttctttatatctggcacttttagatgtattacagcatatgtaaataaattaatctaaccctccaaaatcaagatatttcattgaaaaatctg

SEQ ID NO: 14991 - DNA, 201 bp, Homo sapiens
acatatacacccttatcccctccctcatgtaccacccatatataattctctttaccgcatcctttatcacactcctacaagccttgaagcaatctgaacayagaaaccatctttgattttcaactcctaattgggactgaacatacttgtcttgaacacagattgctgccttgttagtataggtatcctaatatggcacat

SEQ ID NO: 14992 - DNA, 201 bp, Homo sapiens
tctggtggagttgactgagtgggtgaaacctgagatcaagctgctgagagagaaatgcaacacagtgcacatgtaggtgcacccgcttatcctgaaggtgsaggacggcaacaacttcagggtgtctatccaggaagacactgtggaccagctgtggaccgtggatagcacagcggcctcctctctatgcggcttctccac

SEQ ID NO: 14993 - DNA, 201 bp, Homo sapiens
agtggggttaggggggacatctcattgtggaagccctcatgaatcaatagaattttaggaaagaaaagactggaacaaaaaaaattttttgagtgcccccrcccaccagacaaaaaatttttaaaaatgaattaatgatcttcacagctgctgaagtaaaggtggggatggatctcatttccatggtagattgattgatta

SEQ ID NO: 14994 - DNA, 201 bp, Homo sapiens
aggtccagcagtactcgagggttttctatgagtgactcagaaggcatacactcgatgctggctgcatgcagagcccatgctgggctgctgcaccaattctkctagacctcagtccttgtagtccccatcttggacgagttacccagtggggtggatacaagctggctcctccataattgaagatcctaggctctcctaact

SEQ ID NO: 14995 - DNA, 201 bp, Homo sapiens
tttcccctctctactagatcatctctgtcagtaaatgaacatgttgttgtttctcctagaagtactgtttctatatctagatagtactctagctagagttaaaaaaaaaaaaaacaaaaccaacaaactcaaaactctcttcagatgttacttcacctcttgctgttactgcatttctctactgtatgttacagcagaatt

SEQ ID NO: 14996 - DNA, 201 bp, Homo sapiens
catatgtttagctttttaagaaactaccaaactactttggtacaagtggttgtaccattttacattcccaccagtgggaataagagttgcagtgcctccayatccttggcaacacttgatacagcctatctttttatttttagccattctaatagaggtatgtagtggtatctcattgtggttttaatttgcatttcccta

SEQ ID NO: 14997 - DNA, 201 bp, Homo sapiens
atttgaaaaagagcttcagaatcagactctagagtgaatcttttaaaactatatatattatgcatgtatacacatatacatactctatgcattggcttagwtaatataaaaacagcacaggaatagtttatgctgtagtattgtgcagtcttattcagaaataagaaaaatagtttttccatttagctgtgagtcattact

SEQ ID NO: 14998 - DNA, 201 bp, Homo sapiens
ttattgtagagaaaagtgacttgtaaatccaaaatttcatactgggataggaactataaaagagacatcctgcagaatactgagattataaataaaactastatgtttgaagcatttagtgtcctagctgttttatagaagtcatttcatttaatcctttcaacagctttatgaggtagatatcattacactattttactt

SEQ ID NO: 14999 - DNA, 201 bp, Homo sapiens
tcatcaccactgctttaaatgaggcatacttcctcatttggattatggcagcagtctctcttcctttagtctctccttcaaatccacctccatccttcatrtcatccatcatgtatttttccctgcctaaattccttggttggcttctattaaatccaagttccttaagcatggcaaacaggggccagcttccacgagctg

SEQ ID NO: 15000 - DNA, 201 bp, Homo sapiens
gttttatatgtgtgtgtgtgtgtgtgtgtctctgtgtgtgtgtgtgtgtctctgtgtgtgtgtgtgtgtgtgtgtgtgtagtttgtaggaagaaatgtagmaacagatcaatgattcatatctttaacaggatggcatagacttactctgcattttgagttatttttcctttggtatagatggatcatgctgatagtcact

SEQ ID NO: 15001 - DNA, 201 bp, Homo sapiens
tatatgtgtgtgtgtgtgtgtgtgtctctgtgtgtgtgtgtgtgtctctgtgtgtgtgtgtgtgtgtgtgtgtgtagtttgtaggaagaaatgtagcaacrgatcaatgattcatatctttaacaggatggcatagacttactctgcattttgagttatttttcctttggtatagatggatcatgctgatagtcacttatt

SEQ ID NO: 15002 - DNA, 201 bp, Homo sapiens
ataaatcccttcttctagctcaactaatctgtcattgtcctttgaattctcttgtttttcctagttttttggctcaccattttctaccaaccagcaacaayttatgcctacttctacttctcagtcctccatgtcctttaagactgttttgagtagtgtagatgagagataatgaaagcctggaatatcaatgaaagtgga

SEQ ID NO: 15003 - DNA, 201 bp, Homo sapiens
ggtcttggagctgaatagccgagttcaggagctccggctgcaagacctgtccagaatccattcggtgccaacctcggagcccctggccaccccaggcaacragggagatgggcccaaccaaaatctgccagttctgctgactcagttctccatcaaggtcccagcactgcttggcagcgagggacagcttctgcggagcaa

SEQ ID NO: 15004 - DNA, 201 bp, Homo sapiens
cccacctgctgctcacctcctgctgtgtggcctggttcccaacagggttgggaaccactgttctatgggttttgacaaaggtataatgacatgtatccatwattacagtattatatagaatagtttcactgccctaaaaaagccctatgctctacctattttttcctccttcctcttccctacctctggtcaggtaaccac

SEQ ID NO: 15005 - DNA, 201 bp, Homo sapiens
tctcagcaaggagacagtggtaattacacaattggtagtacagatttggattatttttcttaattagtttaagaaatattacaaagccctctgtacatgtyatctgctagggctttaaatctgtaactgtagctagaaataggattctttcttataagttgcctaattcattatatttacacctcttctgttctttaaaat

SEQ ID NO: 15006 - DNA, 201 bp, Homo sapiens
tgtcatccaggctggagtgtggagtgcagtggcgtgatctcagctcactgcagcctctgcctcccaggttcaagagattctcctgcctcagccttccttartacctgggactacaggcgcatgccaccacacccagctaatttttgtatttttagtagagacggggtttcgccatgttggccaggctggtctcgaactcct

SEQ ID NO: 15007 - DNA, 201 bp, Homo sapiens
ggaagaatcgatagtgttaaaatggccatactgctcaaagcaatttacagatttaatgctattcctatcaaactatcaatgacatttttcacacaattagraaaaactattctaaagttcacatggaactgaaaaagagcctaaatagccaaagcagccctaagcaaaaagaacaaagccagaggcatcaagctacctgat

SEQ ID NO: 15008 - DNA, 201 bp, Homo sapiens
cgctcttgttgaccaggctggagtgcagtggtgcgatctcgactcactgcagcctccacctcccaggttcaagggattctcctgcctcagcctcccaagtwgctgggattacaggcatgtgacaccatgcccagctaattttgtatttttagtagagacggggtttctccatgttggtcaggctggtctcaaactcctgac

SEQ ID NO: 15009 - DNA, 201 bp, Homo sapiens
caaaaattatgacataccattaatacagtgaaaaaataatgtgtgcagagtaacaaggcaggacagtagaatcaccagaataccagtgtcagctactacamaacagcaacaacaaaaaatggcagctttcagtctctgcctttgatgctgttttcattaaaagcctactgtaccctctattttatgtcttcaggtgagaag

SEQ ID NO: 15010 - DNA, 201 bp, Homo sapiens
cttattttggaattaagtaattttagttttaaattctaaaactaaaacatgaagaccactaaaatttgattggaagttgaaattagtagatctaatttttrtgattgagtgaaatgtcttaaaccacataaatgatggagaagagtcttaaagttcttaaacttcaaacttcttaaacgtttgggcttagttttaaaaaat

SEQ ID NO: 15011 - DNA, 201 bp, Homo sapiens
tatcatctacagactattttgaatcacagatttatgtttaccgtgattgttagctaagatttaatctcaaatggttttaagttttttggtatttgtagtcyttttttttttttttttttttttgtcctttttagggatctgcctgcctcagcctcctgagtagctaagactcgaggcacataccaccatacctggctaatt

SEQ ID NO: 15012 - DNA, 201 bp, Homo sapiens
gcaaatttgatagctgtttagttgagaaagataaataagaaagtatattaaagtatattgttaatgataactcaaagagatgaatttagttggtcacattwaaaacataacaaagtcaccataagcgtgtgctgctattgatccaatgttttaattgatggtgtccaatcccttggtgttgatcttacccattacgtctgc

SEQ ID NO: 15013 - DNA, 201 bp, Homo sapiens
ttttctaacgcaggccagacggttttgctgtctcagcctactgtggtacaacttcaagcacctggagttctgccctctgctcagccagtccttgctgttgytgggggagtcacacagctccctaatcacgtggtgaatgtggtaccagccccttcagcgaatagcccagtgaatggaaaactttccgtgactaaacctgtc

SEQ ID NO: 15014 - DNA, 201 bp, Homo sapiens
ccctaaatcagttcataccatttgacaggctttaattgcacacaagtgtataatggacaatgtaagggaagaacaaatgttgcttaatttttcaactaatkttaatcatctaagacttaacatatctgttcctcacataatataatcatcttttgcttgtttcttttactcaaactgtcaagctttatgacagattgaaat

SEQ ID NO: 15015 - DNA, 201 bp, Homo sapiens
cctacttctgcaaaaattaatctctttgtgattttcccctttcttgcaaatggttggaaaaacttttataataataaacttaggaactggtgttacaatayggtatccaatgtgaatcatttgcctgttattagtacttgttacttgaagccacgtttttgttccttttaagatggcagctgaattgagcaggtgtttttt

SEQ ID NO: 15016 - DNA, 201 bp, Homo sapiens
cacagatttatgtttaccgtgattgttagctaagatttaatctcaaatggttttaagttttttggtatttgtagtctttttttttttttttttttttttgkcctttttagggatctgcctgcctcagcctcctgagtagctaagactcgaggcacataccaccatacctggctaatttttaaatttttttttgtagagaca

SEQ ID NO: 15017 - DNA, 201 bp, Homo sapiens
ttcgacaagatgatcctaaaccactaaggggttccttggaaaaatgaccaattccagggctgggaaagtgcagggaaagtgcaaaataagcctggaaaatyttgggccagaaattctcagcaaatgaacatgttaaaaagaacaaaggccccaatatgaatgaactccccgtggtcaaatctgggaaaatttggcatcaga

SEQ ID NO: 15018 - DNA, 201 bp, Homo sapiens
taaagttcttaaacttcaaacttcttaaacgtttgggcttagttttaaaaaattactgaatcgtttataaatttttctttggttattagaggcaacatttrttttgtagtcttttttttttttttttttttttttttttttttgagacagagtttcactctgtcacccaggctggagtgtagtggcgtgatcttggctcac

SEQ ID NO: 15019 - DNA, 201 bp, Homo sapiens
attttaagatgtgtatgttttattcttttaatattcttttgctgatttgaaacctacaggaaaacaattttgataatcttgattttgatttggatttgatrccttgggagtcagacatttgggacatcaacaaccaaatctgtacaggtaattatgtgtttcactggtaaaagttttaaaaagatcaattttattttgtag

SEQ ID NO: 15020 - DNA, 201 bp, Homo sapiens
ctaagccgggctaattttttttttttttttttttgtatttttagcagagacggggtttcaccatctcagccaggctgaccgggaactcttgacctcgtgarccacccgccttggcctcccaaagtgctgggattacaggcgtgagctgctgtgcctgtcctattttgtagtctttatgaggtttacatatttatatagaat

SEQ ID NO: 15021 - DNA, 201 bp, Homo sapiens
agcactttgggaggctgaagcgggcggcttgcctgagctcaggagtttgagaccagcctgggcaacacgatgaaactccatctctactaaaatacaaaaarttagccgggcatggtggcatgcacctgtagtcccagctactcacaggctgaggcgggggtgggtggatcacttgagcctggggaaacagcgatttcagtg

SEQ ID NO: 15022 - DNA, 201 bp, Homo sapiens
agccatcttccaggaaaggaaggttgttatgtggaaaatagaattgttctgcttgttccagaagagttatctggaacaggtgcaggaaaaatatagaaagrtttcttctaaacataaggttttttgatacaatcattgtatttaaaaaccagaagagcaacccccctgcctttttttttttctacttttaggcttactatc

SEQ ID NO: 15023 - DNA, 201 bp, Homo sapiens
gcctgaaagggtcatttcccaaaagaagtttatcttttagagctggactggtcagtacagtagtcactagtcttgaaatgtagctagtcctaactgagatrtgctgtaagtgtaaaatacacactagattttgaagacttagggtgaagaaaaagtaaaatattttaataacgcttatgttgcttacgtgttgagtgataa

SEQ ID NO: 15024 - DNA, 201 bp, Homo sapiens
tgttgtttatttttccttcctgatgcattgcattaggataaatttatgttgtggcaacctcagcattctttattctgtactttttgtactttttagtttgwcatcttttttttttttttttttttttttttttttttgagacaaagtcttgctctgttgcccaggctggagtacaatggcacgctcttggctcactgcaac

SEQ ID NO: 15025 - DNA, 201 bp, Homo sapiens
cactttgttacaacagaggatatatgtggataagtgtacccaggaatatgtaacaatgttgagacatctacaaatctgattcagaattaaacaaaggccartgaagtttctacactgttttctggcttctaattaaacatttttttcatatcacaataatataaatattttaaagtactccaggcagttctccttcagtat

SEQ ID NO: 15026 - DNA, 201 bp, Homo sapiens
gtttatttttccttcctgatgcattgcattaggataaatttatgttgtggcaacctcagcattctttattctgtactttttgtactttttagtttgtcatyttttttttttttttttttttttttttttttttgagacaaagtcttgctctgttgcccaggctggagtacaatggcacgctcttggctcactgcaacctcc

SEQ ID NO: 15027 - DNA, 201 bp, Homo sapiens
taaaagtattgacaacaaatgaagtcagaatagcttgattaaagtagtttatttaaagtatctccttaatgttatagtgtatgctaattatttgctttgcrtatgtacacatcatgacatacatttatgcattagctgagacatgttcattctgtaagttttgtacaaaactaatgatcttcagttacacaagaacattta

SEQ ID NO: 15028 - DNA, 201 bp, Homo sapiens
gaggtttaagtcaggctgctggctggtgctgcagtctcatttttggggaggatctatgtgcaagctcactcgtatggttgttgggaggattcagttccttktgagcttttggactgagacctgcaattcctcactggctgttggccagagttctccctcagttccttgccatatgcgcctctctatgagacagcacatgac

SEQ ID NO: 15029 - DNA, 201 bp, Homo sapiens
gaggttataaaataattcactcatatttttactctttttttttgcttatgttaattttttgtttggaacaatctcaaattcacagaagtgttgtgagtacsttgcaaataacttgttttttccttatgcatttcagagtaagttaccagtccgatgcccctatcactccaatactttagtgtctacttcctacaagcacag

SEQ ID NO: 15030 - DNA, 201 bp, Homo sapiens
ggagtacaatggcacgctcttggctcactgcaacctccaccttccaggttcaagcgattctcctgcctcagcctcctgagtagctgggactacagctatgygccaccacacccagctaatttttgtatttttagtagagatggggtttcaccagtttggccaggctgttctcaaactcctggcctcaagtgatccacctgc

SEQ ID NO: 15031 - DNA, 201 bp, Homo sapiens
gttcactaagagttaggcagatcttctaaatatgaacatatttcattatacaatgtcaaaaaatcacattcattaatatcaccacgaatcacatcaagaargtcatactcatggtggtagatacatggtttccgaaattcggattttcactcaaaatcccaaattttataatttgcaaatactgtcaagtattttctttga

SEQ ID NO: 15032 - DNA, 201 bp, Homo sapiens
ctctggctctgtcacaatagcaacacaagagagtgtccaagatggaagccatagtatctttgtaacctaatctcagagttgatatatcatcacttttcccrtattctactcattagaagcaaactattatgttcagcccactctctatagaagggaaataccaagggtatgaacaccaaaatatggagcttactgagggcc

SEQ ID NO: 15033 - DNA, 201 bp, Homo sapiens
ttactattgatagaaaatggatagatttttaaacaatctagttagagggagatagttcagtttgcacataatgaatttgaagtggtaataactgtaagaartggccttataattaattgaatatatggttctggggcatagccatttaagggccagagatacagatttaagatgtatgtatatatgcatatatatttaaag

SEQ ID NO: 15034 - DNA, 201 bp, Homo sapiens
caaatgatcctcctgcagtggcctcccaaagtgctgagattacaggcataagccaccatgcctggtctttttcttattcttttaatagctgcattttaatrgctacatagtaacctacttcataggggtgccataattattgtaaaattttgcagtccttttcattataaacatttcttcattgaataacttggtacttat

SEQ ID NO: 15035 - DNA, 201 bp, Homo sapiens
aaaacagtagttaatatcaaagtcataagtcatttataatcagccttagaatgcctacagatgtatatacatttttcaaaacacttatactctgccttttytgaagccaagcttctcttggcttattcttacttttagtacttgtgtgctggaaattagaaacctcagatgccctgcacagtgtaggactatacaattgtg

SEQ ID NO: 15036 - DNA, 201 bp, Homo sapiens
ttgttttaatgttttttaaatttcttcttttagtgtaattatactagaattacagaaaaagcaggtatctattttttatcctgactttaattgtaatgcaytcagcattggacttggctgtataattactgatagctttttaatgttaagaaagtattcctcggatccttgttttctaggattttattgaggaatacttgt

SEQ ID NO: 15037 - DNA, 201 bp, Homo sapiens
ttcatatacaaatatatctatgggagaaattttattttatttttattatactttaagttctagggtacatgtgcacaacgtgcaggtttgttacatatgtrtatatgtgccatgttggtgtgttgcacccattaactcgtgatttacattaggtatatctcctaatgctatccctcccacctcccccaaccccacgacagg

SEQ ID NO: 15038 - DNA, 201 bp, Homo sapiens
gtcataagtcatttataatcagccttagaatgcctacagatgtatatacatttttcaaaacacttatactctgccttttctgaagccaagcttctcttggsttattcttacttttagtacttgtgtgctggaaattagaaacctcagatgccctgcacagtgtaggactatacaattgtgctaggcatgtatttataattc

SEQ ID NO: 15039 - DNA, 201 bp, Homo sapiens
tcatttattcagcaaggcttattgaattactcttctaactcatcatgagttacactcataataaaagtctgcactcctaattttggcctcccatagctcartcaatctctgtctatgtttccagtttcatttcctattgccatctcccttaaccttccactccagcacagtttttcttgctcctccccatgttgatgctca

SEQ ID NO: 15040 - DNA, 201 bp, Homo sapiens
taaattgataaacctgatattgggttataataatgtcataagcactattctggtctaactctctctttttactaatatgtaaatacaccctacaaggtgaygtgatttatttttatttttatttttagattttccaattaattcattgcaatgctgggccaagaattaaggactcctaacttccaattttgtattttcatt

SEQ ID NO: 15041 - DNA, 201 bp, Homo sapiens
tatatacatttttcaaaacacttatactctgccttttctgaagccaagcttctcttggcttattcttacttttagtacttgtgtgctggaaattagaaacytcagatgccctgcacagtgtaggactatacaattgtgctaggcatgtatttataattctttaactcttctaccaaactgtgtgctttttaagggcaaaaa

SEQ ID NO: 15042 - DNA, 201 bp, Homo sapiens
ctgcttcttctaaactcccttctaattgtttttcctcttgtttttaagctagtgattttttcccctgtattttacatatgcttatggaaagaacagatatrttttcatggcacttagcatgttataaatgcattgttttccatggagtaagatcattctaccactgagagcattaaatccatgttcctaaggtaacccatg

SEQ ID NO: 15043 - DNA, 201 bp, Homo sapiens
atagtttgagacatcagacttggatgaggaagggtaaatcatgctactagtgggccagttactctgtggttttcttatgagactgtgctttaaggaaaagktaaccacggagcatatggcattgagtttgagtcatgtggaactggttagaagtaaaatgtttctattccagcattctctgagtttgtcagcttttcatta

SEQ ID NO: 15044 - DNA, 201 bp, Homo sapiens
tttctagttctagatccttgaggaattgccacactgtcttccacaatggttgaactagtttacagtcctactaacagtgtaaaagtgttcctgtttcactrctttgtaatgattgcctgtttcctgactttgtaatgattgccattctaactggtgtgagatggtatctcattgtggttttgatttgcatttctctgatgg

SEQ ID NO: 15045 - DNA, 201 bp, Homo sapiens
ttagaaatttctttctgttactgctccagaatctgtgcttttcaattattggttctaattcagtatttttaggcctcagagaaaaagccttaatgccgtcytcacgtggtaggctaccaggtctttgaagatggccattttgtatcccacatcttctccacatctgctcatagaaatacagtttcttcatttgctccctta

SEQ ID NO: 15046 - DNA, 201 bp, Homo sapiens
caatatatacgaatagataattcacgaagaagagtggtaaattttaaaaatgaaagtatcaatggctgtgtattcctgaagggatattccctctgaaagawtactattttataactatgtgaaagaatattaattgttagcaggagagatcttgtggctggttacaggtagttcgagaatgatattcaagaatttaaagtg

SEQ ID NO: 15047 - DNA, 201 bp, Homo sapiens
cccctggaagagtctgggagtatcgttcggcttctgtcctggccacagggagagtagaatattgtctaactggagttaactgtcgtttttcactattcccrctggggaagtaccgggtgatctttttgtgtggctaacactggacgtctttaggaggtttagagcaaaatggctgggaccgccaaaaaggctacaagctat

SEQ ID NO: 15048 - DNA, 201 bp, Homo sapiens
cactatccatccatccatccatccatccactatccatccatccatccacccacccatccacccaccatccaaccatccatccatccatccatccatccatmcatatacacacacaatttttttcctgaactattttagggtaagttacatacctcacagtattttacccctaattttttcagtgtgcattttctaagacta

SEQ ID NO: 15049 - DNA, 201 bp, Homo sapiens
taatttttgtgggtacatagtaggtgtatatatttatggggtatgtgacatgttttgatacaggtgtgcaacatgaaataattacatcatgaagaatgcartatccatcccttcaaggatttatccattgagttgcaaacaatccaattattacactctttaagttattttaaaatgttacagatgtttttcaaacatgtc

SEQ ID NO: 15050 - DNA, 201 bp, Homo sapiens
ttctcacagtgctcaaagactttactctgcatttataacattcgtcttttatacagtttcttcttctctactgggtcattcccatcagcatacaaatgtctttttttttttttcctcgagggagggactcattctgttgcccaggctggggtacaatggcgtgacccatggctcactccagcctccacctcctgggctcaa

SEQ ID NO: 15051 - DNA, 201 bp, Homo sapiens
agtctcgctctgtcgcctgggttggaatgcagtggtgcgatctcagctcactgcaagctccacctcccgggttcacaccattctcctgcctcagcctcccragtagctgggactacaggcgcctgccaccacgcccggctaattttttgtattttcagtagagttagggtttcaccgtgttagccaggatggtttcgatgt

SEQ ID NO: 15052 - DNA, 201 bp, Homo sapiens
catatcatctgtgttctccatgccagttttatttttgtaatttattgttttttactttgcattctgtttattatttaaattcctttgtttcataagagagytgaaaacaggttagtgaagctgcaagaaagtaagtctttctttgtctgaggaagttgtcacacaagattattgaaataaaaatagaatgctaggtatgct

SEQ ID NO: 15053 - DNA, 201 bp, Homo sapiens
cagaaagataatattttaactaggcacattatgatttgaaaaaaaatttggagtctttttagtaaggatccaccctcggcctcccaaggtgctgggattasaggtatgagccaccgtgcctggccatccgttgttttttgtttgtttgttttattatattgagaagtccacagcaaagaatcacagtgatgaaccagttgc

SEQ ID NO: 15054 - DNA, 201 bp, Homo sapiens
cagattggtgtgtatttctgtgtatctcttgtaacggaataccaagtaattcttgactgatgaatttcattttctttcctttttgttagatactaccagcsccctcacaagttagtgtccctttccatctgttgtattgtcttagacttctcctcattcaccaccttgatgcttttacaagataacaaagcttatggagat

SEQ ID NO: 15055 - DNA, 201 bp, Homo sapiens
gggaggaaaggtaggaagccacattacagatatatattttgagaacagagctgacagaattttctggtagattgattatggagagtgaggaagagaagtaaataattaagtaataatgatcccaaggtttttggcctgagcaactgggaaaatccaattgtcattaactgagatgaggacaaagcagtaggaggtttggtg

SEQ ID NO: 15056 - DNA, 201 bp, Homo sapiens
ggaggaaaggtaggaagccacattacagatatatattttgagaacagagctgacagaattttctggtagattgattatggagagtgaggaagagaagtaaataattaagtaataatgatcccaaggtttttggcctgagcaactgggaaaatccaattgtcattaactgagatgaggacaaagcagtaggaggtttggtgg

SEQ ID NO: 15057 - DNA, 201 bp, Homo sapiens
tataaatattttaaagtactccaggcagttctccttcagtattcccaggatgtcattaagcctattcaccctgcaacagctgcaagttattccaaacattkgtactgaatctttacactctacaagcccatttgaaatcaactgtgtcaccctattaacagcttcagtaattctctattacttttctaaccaagagttagg

SEQ ID NO: 15058 - DNA, 201 bp, Homo sapiens
cactttaaaataaattcattccatccaaatttagcagccatctattgcaaagtttgcttcctttttccatgacatttaaatatacaaaagccttttttttwaaaaaaaaagcattttttagtaggtaaatgtcagtcactttcttaaactagcctgtcctagaccaacagaccagttctactttcaaaacaaaacatagca

SEQ ID NO: 15059 - DNA, 201 bp, Homo sapiens
gaggaaaggtaggaagccacattacagatatatattttgagaacagagctgacagaattttctggtagattgattatggagagtgaggaagagaagtaaataattaagtaataatgatcccaaggtttttggcctgagcaactgggaaaatccaattgtcattaactgagatgaggacaaagcagtaggaggtttggtggg

SEQ ID NO: 15060 - DNA, 201 bp, Homo sapiens
tttaaaagttttacatttgaaatagataattaagcaatgctgtgtgaaactgaaaaatgaaaactttgattaaaaaaagtattttcaaatataggatagtrcatgtatatgagaatacttttttgggtataatcttagtaacatcattatggtgttatgtaaacatatgacatatgacatataaaattatagtagatagat

SEQ ID NO: 15061 - DNA, 201 bp, Homo sapiens
actttaaaataaattcattccatccaaatttagcagccatctattgcaaagtttgcttcctttttccatgacatttaaatatacaaaagccttttttttaaaaaaaaaagcattttttagtaggtaaatgtcagtcactttcttaaactagcctgtcctagaccaacagaccagttctactttcaaaacaaaacatagcat

SEQ ID NO: 15062 - DNA, 201 bp, Homo sapiens
gaaaggtaggaagccacattacagatatatattttgagaacagagctgacagaattttctggtagattgattatggagagtgaggaagagaagtaaataattaagtaataatgatcccaaggtttttggcctgagcaactgggaaaatccaattgtcattaactgagatgaggacaaagcagtaggaggtttggtggggtt

SEQ ID NO: 15063 - DNA, 201 bp, Homo sapiens
aatttttattttcaggatatgtcatgatgtatgtctgtatatttttatgatttcaaattcccaaattgccattgctttaatgaatgagcacatttggtttytgatcaggaattactataactactagaaaacaacactagtgcaaaatgtgaatttagataaataactctgaaaggcctacttctagttgatgctttggct

SEQ ID NO: 15064 - DNA, 201 bp, Homo sapiens
tttgaggagcagttatatttcacctttgacttgtcaaacttacacttgactaaaacctacagatgtttttctttttaattttttttaatttttaatttttrtgggtacatagtaggtgtatatatttatggggtatgtgacatgttttgatacaggtgtgcaacatgaaataattacatcatgaagaatgcagtatccatc

SEQ ID NO: 15065 - DNA, 201 bp, Homo sapiens
ttgggagaatcacgtgaacccaggcagcggaggttgcagtaagcagagattgtgccactgcactccagcctgggcgacagagtgagactccctctcagttaaaaaaaaaaaaaaaaaaaaaaaatcaccttaatgccttttatctctggttacttcaacaccataattaccataaataattcatctctgttggaatatttg

SEQ ID NO: 15066 - DNA, 201 bp, Homo sapiens
ggtttagctttcaacaaataaaaactagagatcagcatctacttaagccaacagagttggtttgagcctcccactaactctccaaagtctgttattttttwttttttaatgttaagctcctcctaatggatttatctttgtacggggaaatcaagaaccttgcactttgtcagaagatgagccacttcatataatctcaag

SEQ ID NO: 15067 - DNA, 201 bp, Homo sapiens
aggaatctagggccagcttagcagggtgattctgcttccggatctctcttgagattgaagtcaagctgttgactggggctgaagacttgattgggtctcarggatgtgcctccacattcactcacgcagcaggtggcctctttctggggctgctcacaacatggcttccccaaagcaactgttccgtaagagtgagaaagc

SEQ ID NO: 15068 - DNA, 201 bp, Homo sapiens
tatgtgccaggcacttttctaagtgcataacttgtaaatactctctttaaatcttataacagctctttgaaatgaatcagggccctgaggaatacagagtraggaacagacagagtgctcagaggaatgttaagttttaggctctttttctgcttctttagtgattaaataacatttcatgctttgtgtgtgtgtgtgtgt

SEQ ID NO: 15069 - DNA, 201 bp, Homo sapiens
tctatgagaggtttatgtcattattgaaagaagttcaagtctgaggatttggtactattcagatatgggagtcatttccgtatggagatctcttaggtagwttagtcatcattgtactcatactgatatctgtatacactgggtacaagaaaacttttgcagcattcttatctctggatttagtttgttggcaccagatat

SEQ ID NO: 15070 - DNA, 201 bp, Homo sapiens
ttaaataacatttcatgctttgtgtgtgtgtgtgtgtgtgtgttttaattttaaaacttaaaatctgaaaatgggagctggaatgggagcaggtattttcytttttttttttttttttttttttttttttttttttttgagacggagtctcgctctgtcgcccaggctggagtgcagtggcgggatctcggctcactgcaa

SEQ ID NO: 15071 - DNA, 201 bp, Homo sapiens
aaagtattttggagttttgtttccttttttaaaaacaaaatgctttttaactgttcattgcctatattaccaaatagttttaagttgtacattcaggttcrgctccccttttttgagtacccaccatttatgttaagtatattactgggttctttaacagatataattgcatttggtcctcataaagcctatgtgagataa

SEQ ID NO: 15072 - DNA, 201 bp, Homo sapiens
gagtttgctcgttttcttcttacctatgaagctgttttgggaccctaactatgacagtaagtcacttggctatgcacttaatcagcatgtgtttaatatcyacactcacatttttataaatatttaacaggaagggaaatttatacctccaaacccactctaatccctgaactccaaatgcatgtaaccaactgcctgtta

SEQ ID NO: 15073 - DNA, 201 bp, Homo sapiens
cttattccaaaattgaccacatagttggaagtaaagtagaccaatatccctgatgaacatcgatgaaaaaatcctcaataaaatactggcaaactgaatcyagcaacatatcaaaaagcttatccaccatgatcaagtgggcttcatccctgggatgcaaggctggttcaacatacacaaatcaataaatgtaatccagca

SEQ ID NO: 15074 - DNA, 201 bp, Homo sapiens
ccactacgcccggctaatttttgtatttttagtagagacggggtttcaccgtttttagccgggatggtctcgatctcctgacctcgtgatccacccgcctyggcctcccaaagtgctgggatcacaggcgtgagccaccgcgcccggccaggagcaggtattttcaatattgctttagttgcatggtatatcagagcagct

SEQ ID NO: 15075 - DNA, 201 bp, Homo sapiens
gctacttattaatctgttttatcaagagacaacattaaagttgtaagacacaattagaatagaaaattttatgtgtaactttatgttctccccttgacttrtaaagattgctattgaattttagtattggaaaactttggccaatgtaaagatgattttaatttgaacatgtacaacatgcaaaagaatattttttctcct

SEQ ID NO: 15076 - DNA, 201 bp, Homo sapiens
ttacatcactacgaccaccatcacttactgattcaccaaaaattgcataaattatcttacttgtttttattagtttttattaaatgtatagctcacatttrtttcaatatttaatattagaagtgcttggggtctttatttagaagtttggtgatgtttttatagccagaaatatgctgtaggaacgtaactctcatttat

SEQ ID NO: 15077 - DNA, 201 bp, Homo sapiens
ctcgatctcctgacctcgtgatccacccgcctcggcctcccaaagtgctgggatcacaggcgtgagccaccgcgcccggccaggagcaggtattttcaatwttgctttagttgcatggtatatcagagcagctgtgaggtacattgttgatggaagtaataattttgcctcctctgtgtgtgtgtgtgtgtgtgtgtgtgt

SEQ ID NO: 15078 - DNA, 201 bp, Homo sapiens
gtgggggacaaggtgagggatagcattaggagaaatacctaatgtagatgacaggttgatgggtgcagcaaaccaccatggcacatgtatacctatgtaayaaacctgcacgttctgcacatgtatcccagaactgaaaagataataaaaaaaaaaatcacgccactcctctgttcagaacttaccagtagctttccatct

SEQ ID NO: 15079 - DNA, 201 bp, Homo sapiens
cgcccggccaggagcaggtattttcaatattgctttagttgcatggtatatcagagcagctgtgaggtacattgttgatggaagtaataattttgcctccyctgtgtgtgtgtgtgtgtgtgtgtgtgtgtgtgtcacataattttcctgaaagccatatttgtatggtacattatagcttacagagaaccttcatgtctg

SEQ ID NO: 15080 - DNA, 201 bp, Homo sapiens
aggaaatagtttgcaggatgaagattatttccttgataatctgccaaataaatggttcaggttgccagtatgaagcttctttaatttttggcaaatgggarctggttatatgcatacatacacacaaaacttaatagaaagagtaaaataaaattttgactgtcatgagattgagaagagtagagatagtgaaagtctaaa

SEQ ID NO: 15081 - DNA, 201 bp, Homo sapiens
tgtgtgatagagatctgccgctacgagcttgtcatcattctcatccactgtcttctttgtcttcttcgaagtcacgtcctactcctcttcctcttatcttytttttttcggcggggtgggggggttttgtttgtttgttttttgcactaagtcatagaactgaaaagactctgggtaatgttttcaaaataaagccacatt

SEQ ID NO: 15082 - DNA, 201 bp, Homo sapiens
tgtacttgaccatctagtacattttagagccttgattcagaaatcagaattttagcataagtgaatgggttcttataaaatatcctgatccttgggctttrcaaaatagtgttataaaaattactgccaaagtgcaactaatattttggttgagagagattcttagaattcagacatagccttagaatgggaagtattttg

SEQ ID NO: 15083 - DNA, 201 bp, Homo sapiens
ttgtcttcttcgaagtcacgtcctactcctcttcctcttatcttttttttttcggcggggtgggggggttttgtttgtttgttttttgcactaagtcataraactgaaaagactctgggtaatgttttcaaaataaagccacattgtttccaatacaacagctttctctgggttctttcactgcctccttaatgtaagtct

SEQ ID NO: 15084 - DNA, 201 bp, Homo sapiens
ctttttcaaatcaaaaagcaatattgagtcatcaggcacttggaatgctctttggaacctacaaatgattagattcatttccacccacagggtgaaacatycatttctatgtttaattaatttctatgtttaattaattaaactatattttataggttaaatcatgaacttcgaggatgggttcatagacatgaagtagaa

SEQ ID NO: 15085 - DNA, 201 bp, Homo sapiens
ggttgtgatgaacaaggtaaatatagggtgtcataagagcacacattaaccaatcttggaggggctgtcctatgcaaggaggtcttcatggagacctaacmgctaagctaagacctgcctgttctgcaagtaccttacttaaagctattacataatagctgctggggatgaaaatattctagaaggtatgatagtcacact

SEQ ID NO: 15086 - DNA, 201 bp, Homo sapiens
tggaacctacaaatgattagattcatttccacccacagggtgaaacattcatttctatgtttaattaatttctatgtttaattaattaaactatattttawaggttaaatcatgaacttcgaggatgggttcatagacatgaagtagaaaggaccaagtcaagaagaatgacaaataatcaacagaaaacccgtattcttc

SEQ ID NO: 15087 - DNA, 201 bp, Homo sapiens
gctggcacggtggctcacacttgtaatcccagcactttgggaggccgaggcgggcggatcaggaggtcaggagattgagaccatcctggctaacacggtgwaaccctgtctctaccaaaaatacacaaacaaaattagccaggcgtggtggtgggcacctgtagtcccagctactcgggaggctgaggagggagaatggtg

SEQ ID NO: 15088 - DNA, 201 bp, Homo sapiens
aaacccgtattcttcaggtatgtttctgtttgtctttgaacaatagttggcgtatttgttggaaggcttctcccagctgggttactctcttccctagaagkttggtaaacttgagctttagcctcttcccactgtctcctgctgcttccgatgcagctatcattgccactgaagtcctcctcccaggttttatagcactag

SEQ ID NO: 15089 - DNA, 201 bp, Homo sapiens
tactccgaccttccaatcatgtcacatctgtctagaatcaaggcccaaatctgtgtgacctgtgatatggtttggctatgtcctcacccacagcctcatctttttttgtttgtttgtttgtttgttttgagacagagcctcactctgtcacccaggctggagtgcagtggcgcaatcttggttcactgcaacctccgcctc

SEQ ID NO: 15090 - DNA, 201 bp, Homo sapiens
actccgaccttccaatcatgtcacatctgtctagaatcaaggcccaaatctgtgtgacctgtgatatggtttggctatgtcctcacccacagcctcatctttttttgtttgtttgtttgtttgttttgagacagagcctcactctgtcacccaggctggagtgcagtggcgcaatcttggttcactgcaacctccgcctcc

SEQ ID NO: 15091 - DNA, 201 bp, Homo sapiens
ctccgaccttccaatcatgtcacatctgtctagaatcaaggcccaaatctgtgtgacctgtgatatggtttggctatgtcctcacccacagcctcatctttttttgtttgtttgtttgtttgttttgagacagagcctcactctgtcacccaggctggagtgcagtggcgcaatcttggttcactgcaacctccgcctcca

SEQ ID NO: 15092 - DNA, 201 bp, Homo sapiens
acctttcctccatgttttccagttaaagatattaaggcagaacctcagccactttctccagcctcctcaagttattcagtctcgtctcctcggtcagtggrctcttattcttcaactcagcatgttcctgtgagtagccagtcttttacaatgattttggttataatatgctatctggaaaatatgtatatggaggaggca

SEQ ID NO: 15093 - DNA, 201 bp, Homo sapiens
accttccaatcatgtcacatctgtctagaatcaaggcccaaatctgtgtgacctgtgatatggtttggctatgtcctcacccacagcctcatctttttttgtttgtttgtttgtttgttttgagacagagcctcactctgtcacccaggctggagtgcagtggcgcaatcttggttcactgcaacctccgcctccagggtt

SEQ ID NO: 15094 - DNA, 201 bp, Homo sapiens
cagttacatactttttgttattttaaaatgtacaactaagctcttattgagtatagtcaccctgctgtgctattaaataatatgtcttattccttctccttttttttttttttttttttttttttacccattaacaatccccatctcactaccagcttctcagtaccctccccagcctctggtaaccatccttctacccta

SEQ ID NO: 15095 - DNA, 201 bp, Homo sapiens; identical to SEQ ID NO: 1321

SEQ ID NO: 15096 - DNA, 201 bp, Homo sapiens
gtgtgggagagagattgggctggagtctgactctgacaaggacaagtagggatttgtagccaaggagcaaggtgtgggggtcagtagatggaaaattactaagtggaaacaccaatgtaagggagattcttgctagatggactcaacagaattcttgctgaaggcaggccagggtgattagatgtcgagggtaatcagata

SEQ ID NO: 15097 - DNA, 201 bp, Homo sapiens
atggagaaaggatattggcattttaactgcaaccttatactgatactgaatgtttgtatgactacgaaccaagttttatatgtgtgtgtgtgtgtgtgtgtctctgtgtgtgtgtgtgtgtctctgtgtgtgtgtgtgtgtgtgtgtgtgtagtttgtaggaagaaatgtagcaacagatcaatgattcatatctttaaca

SEQ ID NO: 15098 - DNA, 201 bp, Homo sapiens
tgtgcaagatagtatattccaaattatttcatattatagaaataaaaaatattccatagtccttaagccacgcctttttttttttttttttttttttttttttttgagatggagtgttgctcttcttgccgaggctggagtgcaatggcatgatctcagctcactacaacctctgcctcccaagttcaagtgattctcctg

SEQ ID NO: 15099 - DNA, 201 bp, Homo sapiens
tggagaaaggatattggcattttaactgcaaccttatactgatactgaatgtttgtatgactacgaaccaagttttatatgtgtgtgtgtgtgtgtgtgtctctgtgtgtgtgtgtgtgtctctgtgtgtgtgtgtgtgtgtgtgtgtgtagtttgtaggaagaaatgtagcaacagatcaatgattcatatctttaacag

SEQ ID NO: 15100 - DNA, 201 bp, Homo sapiens
gtgcaagatagtatattccaaattatttcatattatagaaataaaaaatattccatagtccttaagccacgcctttttttttttttttttttttttttttttttgagatggagtgttgctcttcttgccgaggctggagtgcaatggcatgatctcagctcactacaacctctgcctcccaagttcaagtgattctcctgt

SEQ ID NO: 15101 - DNA, 201 bp, Homo sapiens
ggagaaaggatattggcattttaactgcaaccttatactgatactgaatgtttgtatgactacgaaccaagttttatatgtgtgtgtgtgtgtgtgtgtctctgtgtgtgtgtgtgtgtctctgtgtgtgtgtgtgtgtgtgtgtgtgtagtttgtaggaagaaatgtagcaacagatcaatgattcatatctttaacagg

SEQ ID NO: 15102 - DNA, 201 bp, Homo sapiens; identical to SEQ ID NO: 1323

SEQ ID NO: 15103 - DNA, 201 bp, Homo sapiens
tgcaagatagtatattccaaattatttcatattatagaaataaaaaatattccatagtccttaagccacgcctttttttttttttttttttttttttttttttgagatggagtgttgctcttcttgccgaggctggagtgcaatggcatgatctcagctcactacaacctctgcctcccaagttcaagtgattctcctgtc

SEQ ID NO: 15104 - DNA, 201 bp, Homo sapiens
gagaaaggatattggcattttaactgcaaccttatactgatactgaatgtttgtatgactacgaaccaagttttatatgtgtgtgtgtgtgtgtgtgtctctgtgtgtgtgtgtgtgtctctgtgtgtgtgtgtgtgtgtgtgtgtgtagtttgtaggaagaaatgtagcaacagatcaatgattcatatctttaacagga

SEQ ID NO: 15105 - DNA, 201 bp, Homo sapiens
gcaagatagtatattccaaattatttcatattatagaaataaaaaatattccatagtccttaagccacgcctttttttttttttttttttttttttttttttgagatggagtgttgctcttcttgccgaggctggagtgcaatggcatgatctcagctcactacaacctctgcctcccaagttcaagtgattctcctgtct

SEQ ID NO: 15106 - DNA, 201 bp, Homo sapiens
tgctattcctatcaaactatcaatgacatttttcacacaattaggaaaaactattctaaagttcacatggaactgaaaaagagcctaaatagccaaagcasccctaagcaaaaagaacaaagccagaggcatcaagctacctgatttcaaactgtactacaagactacagtaaccaaaacagcatgatactggtataaaaa

SEQ ID NO: 15107 - DNA, 201 bp, Homo sapiens
tctgggttctttcactgcctccttaatgtaagtcttaatcacacttgtattaacagtagaaacactctgcagtatctcgtttcatacagtggtgttagaarcattaactcctcagccctcataccatcacaggaaaacagcaatcattgttaacccccatccattggggagatgaagaaaatgagcaaactatgaagaatg

SEQ ID NO: 15108 - DNA, 201 bp, Homo sapiens
aaatatctaagttgaaatctcattttgtcacaatatcccatcctctacctctcctgattcctggatcactctctttcacttttctttttttcttttagagrtggggtcttgttctcttgcccaggttggagctggagtatgcggtggagcaatcacagctcactgcatcttcagacccctggggtcaaaggatcctcctgc

SEQ ID NO: 15109 - DNA, 201 bp, Homo sapiens
cacacttgtattaacagtagaaacactctgcagtatctcgtttcatacagtggtgttagaagcattaactcctcagccctcataccatcacaggaaaacarcaatcattgttaacccccatccattggggagatgaagaaaatgagcaaactatgaagaatgcagtttatttcgtctccataagactgtgaggcagtggaa

SEQ ID NO: 15110 - DNA, 201 bp, Homo sapiens
tctctttcacttttctttttttcttttagagatggggtcttgttctcttgcccaggttggagctggagtatgcggtggagcaatcacagctcactgcatcytcagacccctggggtcaaaggatcctcctgcctcagcctcccgagtagctgggactacagacacatgccaccatgcctggcttctttttggctttttgaa

SEQ ID NO: 15111 - DNA, 201 bp, Homo sapiens
ttatcaggtcagttgtaatcttggaaagcagatttagtaggggtaggcatgaagtctgtattaaaattggttgagaaattgaaaggagttaaaattgaatratctcttttttaaaaaaaaacattttttatgaagattttcaaacatataggaaatttgagaaaataatatgatcaaccccttgctctcatgaaatttata

SEQ ID NO: 15112 - DNA, 201 bp, Homo sapiens
ccacagcctcatctttttttgtttgtttgtttgtttgttttgagacagagcctcactctgtcacccaggctggagtgcagtggcgcaatcttggttcactrcaacctccgcctccagggttcaagtgattatcctgcctcagcctcccaagtagctgggattacaggcatgcgccgtgacacccggctaatttttgtattt

SEQ ID NO: 15113 - DNA, 201 bp, Homo sapiens
caagggttttaggagctctgtgacaggaaccagaataaaaaccaaatatattatttcttattatatcgcaaattcacaggcatattcttgagggaacataraagtaaccagtaacgctgctagtggcaatcatgggaggctttatgcagtagtactcgatgaaggaataaagaggattagattatgctacaggaagtgaca

SEQ ID NO: 15114 - DNA, 201 bp, Homo sapiens
aatgggatcctaataacaagtttactgtttgttaatttgtgttagatataggcatactgtcatattttcctgtaatttttcatatctggtcttgtgaactrttactagtatttttcttccatatgtattttacctaccaacttgattgtaaactgcttaaagatagaagctatgttatataagcatttcacgcatgctggc

SEQ ID NO: 15115 - DNA, 201 bp, Homo sapiens
ggcttctcagaggccagaaataataaaagataagatgagtctataatgataagctagcattggaagtggtgcttgttctggatatagttcctgatccttgyggcgtagtgtctggggatgggaaagaaagctgtggacccaagtgaggtgggaagtcacaactgaggcctcccttttcctctacccaaataaagccagaac

SEQ ID NO: 15116 - DNA, 201 bp, Homo sapiens
tatctggtcttgtgaactgttactagtatttttcttccatatgtattttacctaccaacttgattgtaaactgcttaaagatagaagctatgttatataakcatttcacgcatgctggctcaatgaatcacaaataattgggaatttggttagacatctcatctgaacagtccctgccctgataccaccctgggacattca

SEQ ID NO: 15117 - DNA, 201 bp, Homo sapiens
tgggcttatgttggtggtgcctgtaggcacctgagggaattgaatgcaaattcttctcagaagagacactttataaaagaaagtgtccatcctagaaaaaytggagacccatctcatatgcagagacacacacaggctcaaaataaagggatggaggaagatctaccaagcaaatggaaaacaaaaggcaggggttgcaat

SEQ ID NO: 15118 - DNA, 201 bp, Homo sapiens
tagaaagctgaaactggatccgttccttacaccttatacaaaaattaattcaagatggatcaaagacttaaatgttagacctaaaaccataaaaaccctasaagaaaacctaggcaataccattcaggacataggcaagggcaacgacttcatgtctaaaacaccaaaagcaatggcaacaaaagccaaaattgacaaatg

SEQ ID NO: 15119 - DNA, 201 bp, Homo sapiens
attgacaaatgggatctaattaaactaaagagcttctgcacagcaaaagaaactaccgtcagagtgaacaggcaacctacagaatgggagaaaatttttgyaatctactcgtctgacaaagggctgatatccagaatctacaaagaactcaaacaaatttacaagaaaaaaacaaccccatcaaaaagtgggtgaaggata

SEQ ID NO: 15120 - DNA, 201 bp, Homo sapiens
tcaggtccagctggaaggggcttattacggataacaaaagatgctcttcttaccccctatcactcaggaaattccaagggttttaggagctctgtgacagraaccagaataaaaaccaaatatattatttcttattatatcgcaaattcacaggcatattcttgagggaacatagaagtaaccagtaacgctgctagtggc

SEQ ID NO: 15121 - DNA, 201 bp, Homo sapiens
gtataataaaaaaaaaaaaagaaagaaaaatttccagagatacagagccagttgaacatgagcacatgtctgcttctttccctcaaaagtcattaaacacrccaggaaaccataccaccatgaataagagttagaaaaaataaactacagaatcacactctgaaagactatagatatttgaattatcagatagagaatata

SEQ ID NO: 15122 - DNA, 201 bp, Homo sapiens; identical to SEQ ID NO: 1332

SEQ ID NO: 15123 - DNA, 201 bp, Homo sapiens
tcatatggaaaaccaaatttcttagccatgttactgaatgtcagtcatttcccttacttgatctgcatcaccaacattaagtgccatgtatcagatttctrtatatgttccattataatctcatgggaccaccatagtacatgcggtccattgttgacagacacatcattatgtggtgcgtaagtgtacttatagttttac

SEQ ID NO: 15124 - DNA, 201 bp, Homo sapiens
gtctgcttctttccctcaaaagtcattaaacacaccaggaaaccataccaccatgaataagagttagaaaaaataaactacagaatcacactctgaaagastatagatatttgaattatcagatagagaatataaaatatattaaaagacagaattaaagtctggtaaaggaacaaaagactaccagaattggccagaaca

SEQ ID NO: 15125 - DNA, 201 bp, Homo sapiens
agtcacatattcttgtatgtgtacaaaaaatacacactggatctctgcaagcatagccaagcaactggaaatatgtttttaaaaacttgcttttcattctrtctcttctagtactgttttgatgctctttgaaaacaatctaattgctgtaacaaatgaccatacgtaggccgggtgtggtggctcatgcctgtaatccca

SEQ ID NO: 15126 - DNA, 201 bp, Homo sapiens
atccgcctgccttggcctcccaaagtgctgggattacaggtgtgagccgctgtgcctggcccatctctaagtgtttaagagaaaggaagattcacatgtcyctcaatttaaatcaaaagctaaaagtgattaggcttagtgaggaagccatgtcgaaagctgagataggccaaaagctaggccccttgcaccaaacagtta

SEQ ID NO: 15127 - DNA, 201 bp, Homo sapiens
aaaagaatgactaatgaaaaacgatgattggttattagatttggatgtttggcagacattttctcaaaattgaactaagttggcctcttcacggaaaacarctggtatttgttgtgccaatgataaaattggagatttctagcaaaatgtataattttggaaaagttgtgttcctccactggaagcttgacagctttcctt

SEQ ID NO: 15128 - DNA, 201 bp, Homo sapiens
gctatgacatcacttggtgataggaatttttcagctccattataatcttatgggaccactgttccacatgtgctctgtcattgacagaaatgccgttaagyaccacatgactattttttttggtggtctgttcctttttattattacagagtattccacagtatggttgtaccacagtttaactgatcacctgttgaagaa

SEQ ID NO: 15129 - DNA, 201 bp, Homo sapiens
cacttcctagctttctgatgataacttcccgtgcagatctgtatgtaaggaatggacgtagtagtcatgctaatctgagtatttatctgtgtgatacttaygaattaacgatgtaagttaataagttagcatttcgtgaacctggttaataccatttgctaaggttaaattagccaaatcctgaagtaagctgtaaaacat

SEQ ID NO: 15130 - DNA, 201 bp, Homo sapiens
aaagaagttaatatggagaagtggcaagtcttttcttctctcttctcttctcttctcttctctcttctttttcttttttctttttttctctgtcagatacygttgtaaagactttgcttttaccggaaactgatacgttgggtcatgtaccctggccagtcagttctctttattctaacacttagccgatcagttagattt

SEQ ID NO: 15131 - DNA, 201 bp, Homo sapiens
tataaagggaaagaatgtgatatgtcacccaggctctggagtacagtggcatgatcataggtcacagcagcctcaaagtttccagttcaagcgatcctacytccttggcttcctgagtatgtggcactacaggtgcatgccaccatgcccagctaacttttttgtagagacagggtctccctatgtttcccaggctggtct

SEQ ID NO: 15132 - DNA, 201 bp, Homo sapiens
aacctgggaggcagaggttgcagtgagctgagatcaggccattgtgctccagcctgggcaacagagcgagactccgactcaaaaaaaaaaaaaagaaaaaraaaaagaaaacatttacttcacataataagatatgagaaaaaatggactctctgaatgaaaaaaagaggagatcatgtgaaagatttgcgcttttttttt

SEQ ID NO: 15133 - DNA, 201 bp, Homo sapiens
atgaggggaagggacagttaatccctactgatcagataaaacctcattgtttcatactaataaatggtttttttatgcttatgaaaggaaaagccagaagkgtaatttttagtgtttagagagctagtgattctagttagggaacttaatacctttgaagttattagtttgcaagcaatagaatctactactaccaaggtg

SEQ ID NO: 15134 - DNA, 201 bp, Homo sapiens
gtgttttcaagaaccctctttattagctaagtggtgagacatgccacctggtggttatagtagtatcatttttctcactgttcttggtgcttttcttctcsttctgattccagttatactaggacaactgctataaacctggaatgtttcacactatattatttcagtaatttcaaaaacagcagaaatcactaagctgtt

SEQ ID NO: 15135 - DNA, 201 bp, Homo sapiens
tcgcttgaacctgggaggcagaggttgcagtgagctgagatcaggccattgtgctccagcctgggcaacagagcgagactccgactcaaaaaaaaaaaaaagaaaaaaaaaaagaaaacatttacttcacataataagatatgagaaaaaatggactctctgaatgaaaaaaagaggagatcatgtgaaagatttgcgctt

SEQ ID NO: 15136 - DNA, 201 bp, Homo sapiens
agtgtctttaaataccccttacctttaaagtaagaaatattaaaatcaagcagaatataataatgaaaaattcttaagatatacttactaaaaacttatcsttcggttaatacactgtatgtaggttgtacatacaatatgaaaaagtatatttttgtagcctacttttaaatccagaatagaggaggttaagaaggttgt

SEQ ID NO: 15137 - DNA, 201 bp, Homo sapiens
acaacttttctacaagaaacaaaacattttaaagaaaacatttacttcagccgggcgcggtggcttacgcctgtaatcccagcactttgggagggcgaggygggtgcatcacgaggtcagaagttcgaaaccagactggccagtatggtgaaactgtgtctctactaaaaatacaaaaattagcctggcgtggtggtgtgt

SEQ ID NO: 15138 - DNA, 201 bp, Homo sapiens
ctattattgacattattcctttctgtggtctgaggtgcctcccatgaaacttgcttctaggacactaggattgagaaccatcagcgtaacatatctgttaygctacaatagtttattttcatattttagctactttacatactcgggtataatgaactttattcatagcttctgaagcagttggcacatttgagatatttt

SEQ ID NO: 15139 - DNA, 201 bp, Homo sapiens; identical to SEQ ID NO: 1363

SEQ ID NO: 15140 - DNA, 201 bp, Homo sapiens
tcctcctatgtcatttttttcttcttatttttcttgactgtataagagagaatgtatgacatttcctgcttgaccgctgagtttgattataaattaaaatacacaatattttatacaaattgttttgtagaagatttatttacagatgctcattcacaggtaaaattgacttatgaaaatagttttcatgacaaatgtatc

SEQ ID NO: 15141 - DNA, 201 bp, Homo sapiens
ctcctcctatgtcatttttttcttcttatttttcttgactgtataagagagaatgtatgacatttcctgcttgaccgctgagtttgattataaattaaaatacacaatattttatacaaattgttttgtagaagatttatttacagatgctcattcacaggtaaaattgacttatgaaaatagttttcatgacaaatgtat

SEQ ID NO: 15142 - DNA, 201 bp, Homo sapiens
ctctcctcctatgtcatttttttcttcttatttttcttgactgtataagagagaatgtatgacatttcctgcttgaccgctgagtttgattataaattaaaatacacaatattttatacaaattgttttgtagaagatttatttacagatgctcattcacaggtaaaattgacttatgaaaatagttttcatgacaaatgt

SEQ ID NO: 15143 - DNA, 201 bp, Homo sapiens
ggtggaagggccagctgtttaagtttctataatctctgttaaatcaaatgtatattgcatttattattttaaattttaaaaacttttttaaaaatagagawgggatcttcctatgttgtccaggctggttgtgagctcctaggatcaagtgattctcccgccttgacctttcaaagagctgggattacaggcatgagccac

SEQ ID NO: 15144 - DNA, 201 bp, Homo sapiens
cctctcctcctatgtcatttttttcttcttatttttcttgactgtataagagagaatgtatgacatttcctgcttgaccgctgagtttgattataaattaaaatacacaatattttatacaaattgttttgtagaagatttatttacagatgctcattcacaggtaaaattgacttatgaaaatagttttcatgacaaatg

SEQ ID NO: 15145 - DNA, 201 bp, Homo sapiens
ggcttcaggtgatacccgagtggagtttttactccatttccattccgtaaggctataggcatttgaaagaggaaacttttctttggcaaccttccaccttyctttctacagaatatttcagtatttctagctcataggttttctaaaatattctctgtaatttattttgaaatggagtttttttatcgtttacagatatga

SEQ ID NO: 15146 - DNA, 201 bp, Homo sapiens
ttgtacgttgcttaaatctgagaaatcctcagatcacctgtactggttttgatcgaccaaacctgtatttagaagttaggcgaaaaacagggaatatcctkcaggatctgcagccatttcttgtcaaaacaaggtaaggatttaatggttgatgaattttggtaatgatttcctttttttttttttaacaacttatgtatt

SEQ ID NO: 15147 - DNA, 201 bp, Homo sapiens
gttagtaataatttacattcccaccaacagcgaggaaggagttcccttttctccacatcctcgccaacacttatcttttgtctttttggtaatagccattytaacaggtgtgaggtgatatctcattgtgattttgatttacatttccctgatggttattgatgagcaatgtttcatatacttgttggttatttgtatatc

SEQ ID NO: 15148 - DNA, 201 bp, Homo sapiens
cttccttattaaatctctaaaagcaggaatgctctggaacaatgaacaattagaatgtggtaatgtaattttgggccaaaaaatactttgtagaaatgtgrttctcttacttggaatagaaagaattctgactcgaaaaagtgcagttaatgtatgcttttctgggtaagatttgtgatagattttgattgagatttaaaa

SEQ ID NO: 15149 - DNA, 201 bp, Homo sapiens
tacaatattaatttcataaaggtaaaggcatatctgttttgttcctatttgattccttgtgaaagcacaatgcctagcgcacaatagacacttaaacttayctgttgaatggacaggtgaatgcttttaaagtctttccatatagaaaattaagtttcattacatttgacttgatctaggttttcatttcatagaatggag

SEQ ID NO: 15150 - DNA, 201 bp, Homo sapiens
tcattgtatttttagtttgcttttccctaatgactaattatattgagcatttttcatacacttattggccatctgtatatcttctttgagggagtatctgytcaaatcttttgcctattttttcttagtgagttttgatagtcatttctatattctgaatataaattatttatttgatatatgctttgcaaacattttctc

SEQ ID NO: 15151 - DNA, 201 bp, Homo sapiens
tatagaaattttattaaagcttttggtattagaatttccctttcttccctaattataaaaaatagcaaattttggccgggcatggtggctcacgcctgtartcccagcactttgggaggccgaggtgggtggatcacctgaggtcaggagttcgagaccagcctggtcaacatggtgaaaccctgtctctactaaaaatac

SEQ ID NO: 15152 - DNA, 201 bp, Homo sapiens
ggttaccccttcttgtatcacattgaaaacctaaagtttgaactattctatagaaattttattaaagcttttggtattagaatttccctttcttccctaawtataaaaaatagcaaattttggccgggcatggtggctcacgcctgtagtcccagcactttgggaggccgaggtgggtggatcacctgaggtcaggagttc

SEQ ID NO: 15153 - DNA, 201 bp, Homo sapiens
cgccccccgatcatgtctggctaatttttgtatttttagtagagatgggtttttgccgtgttggtcaggtggatcttgaactcctgaactcaggtgatccrcctgccttggcctcccaaagtgctgggattacaggtgtgagccgctgtgcctggcccatctctaagtgtttaagagaaaggaagattcacatgtctctca

SEQ ID NO: 15154 - DNA, 201 bp, Homo sapiens
agagggtcagtttactctttctgatgttgtcctgccggcctctccctatccagacttcggctatctttaggaagcggccccgggagctttgcttcacgtcyaggtaaaacctctttttctggatgtccactcgtttggaggccagctcctggatttcggctgcgcccccggcctgattaggggtggctgaggccgcgtagt

SEQ ID NO: 15155 - DNA, 201 bp, Homo sapiens
gaagttagaatgacccttgaattacaatcggccacattcatcacaaatacattaaataagagtaatttgccataaagctctatgtttgtatacttctttgktttttttttttttttttttttttttttttgagacagggtctcactctgttgctcagtctgtagtgcagtggtgtcatcatagctcactgcagtcttgatc

SEQ ID NO: 15156 - DNA, 201 bp, Homo sapiens
catttttgctttttccctatttcagtaacatttttcgctatttcagtaacattacatgtcaacaagagaatggtgggtattttggggggggttgggtgggragaaattttactaagcttgctagattctaaaaggtataccttatttggccccttttccccatttaggggaacaagggtgttggggctgggaagtagataa

SEQ ID NO: 15157 - DNA, 201 bp, Homo sapiens
taacagagttgggagtattaaaaagatgtaaagagccccttaaaattttgttgctgggaattttagtgttctactgatgaaggaaatagacactggaaggygttgtttctattaggtaacttagatatcatactgaagacttcaaatacttattgttgacactcaaaagacacacttagtgtaagtaagcatttccccgct

SEQ ID NO: 15158 - DNA, 201 bp, Homo sapiens; identical to SEQ ID NO: 1383

SEQ ID NO: 15159 - DNA, 201 bp, Homo sapiens
gtttgtattggaattaaaaaatagaaaacattaacccatggtagctgtcactgtattctttcaaagaagccaatgaaataaactgttttctccctctatgkggtgtttttctacttgaacataaatgcacattttattttatttccagactttttgtggccagcacccaatgaagagcaagttacttgcctcaagatgtac

SEQ ID NO: 15160 - DNA, 201 bp, Homo sapiens
ttccttattaaatctctaaaagcaggaatgctctggaacaatgaacaattagaatgtggtaatgtaattttgggccaaaaaatactttgtagaaatgtgawtctcttacttggaatagaaagaattctgactcgaaaaagtgcagttaatgtatgcttttctgggtaagatttgtgatagattttgattgagatttaaaac

SEQ ID NO: 15161 - DNA, 201 bp, Homo sapiens; identical to SEQ ID NO: 1338

SEQ ID NO: 15162 - DNA, 201 bp, Homo sapiens
cgggtagcaatagaggtgatgagaagtcgtagcttctgtaggtatttggaagatatatattgtgaaggatttgctgatgaattccctgtaaggggtgagaygtaaagattcatagaacattaagatattttggtcagatcatctgatcaatggaaaggtcagttatagtggacagattatgagaagaacaggtttgggtga

SEQ ID NO: 15163 - DNA, 201 bp, Homo sapiens
tactttaaaatagagattaaaattctcgtattgaatgtagaataggtaagcatttatttgtgaaatactcgaatgcttcatgtaaatactttctgagtttrtatttttagaaaggaacattttggaggctgaggcaggagaatggcgtgaacgtgggaggcggagcttgcagtgagctgagattgtgccactgcactccag

SEQ ID NO: 15164 - DNA, 201 bp, Homo sapiens
tccagcctgggcaacaagagcgaaactctgtctcaaaaaaaaaaaaaaaaaaaaaaaaagtgaatttttacatgaatattctacatgattggcatatttamatgaatggtttaaaaacccacaataatagcactgttttattttttattttgaaaattgtagattcacaagaagttgtaaaaaaaaaaatacctatataga

SEQ ID NO: 15165 - DNA, 201 bp, Homo sapiens
ttgaattttttccagccactcagtagtacccagagaattttgatacaaataactgactttgaccccatgtttagtaggttttttttttgtttgtttgtttkttttttttttttgtctttcttctccacactctcttaggactgttgtagcttgtaatgttagtgaattgtaattgtttatttgcatgtctgtctcctcttt

SEQ ID NO: 15166 - DNA, 201 bp, Homo sapiens
tgtcccgaaattacattcttaataaggagagcattcaggattggggagtggtaaagaagctgaagacttcactataaaagagcaaatggataatgtaaaawgagaactatttttttaaaaatgctaaagttggtatataatctattgaggaatataatagaacaaggcttgacaaaccttttctgaaaggaccagataata

SEQ ID NO: 15167 - DNA, 201 bp, Homo sapiens
aggctgtaaacctgtacagatgttactgtaatgaatattgcaggcaattgtaatacaatggtaagtatttgtgtatctaaacttatctaatgtagaaaagrcacagtaaaaatacagtataaaagataaaagatggtatacctgtatagggtgcttcctgtgaatggagcttgtaggactggaagttgctctgagtgagtg

SEQ ID NO: 15168 - DNA, 201 bp, Homo sapiens
cactgccaatggtaagctttgccaagtctgatgtcccgaaattacattcttaataaggagagcattcaggattggggagtggtaaagaagctgaagacttyactataaaagagcaaatggataatgtaaaaagagaactatttttttaaaaatgctaaagttggtatataatctattgaggaatataatagaacaaggctt

SEQ ID NO: 15169 - DNA, 201 bp, Homo sapiens
agatccaataaatgtcttgtttggattaatacataaatatttccttttaaaattcttaaggcttttattcatatatctcccctctccctatttccaataaygatttttggtgttaatatgatgatatttatgcttctgtttttataggaaccaaatactttgatttggttatttattctcctttggagatgtagatgagtt

SEQ ID NO: 15170 - DNA, 201 bp, Homo sapiens
gtgatcaatcatggatggcgatgcagttaatttcagtagaaatttgctgactctttttatctcttttaatagctaatgcatgagataaaattgaaggtatyaccaaggagaaatgcaggtggatagttttggaggcaaagtcacagtaagcaattcatctctccaaggaatagtgatgaaagctgagatccaataaatgtc

SEQ ID NO: 15171 - DNA, 201 bp, Homo sapiens
agcacagtcagaaaatgttctaacagatattaaattgtgagtaatttttttccctcaacttttattttggatttatgggggtgcatatgcaagtttgttaygtgggtgaattacatgttgctgaggaagttgtgagtaatttatgtcatttctaatcatgtggtcagatgtctgtggtatatgagagaattttgtatacaa

SEQ ID NO: 15172 - DNA, 201 bp, Homo sapiens
tgtatttctgagtgggggcatgattttagggattcattcaggaagttgggctccctaaagacagcactgccaatggtaagctttgccaagtctgatgtccygaaattacattcttaataaggagagcattcaggattggggagtggtaaagaagctgaagacttcactataaaagagcaaatggataatgtaaaaagagaa

SEQ ID NO: 15173 - DNA, 201 bp, Homo sapiens
ttcagtagaaatttgctgactctttttatctcttttaatagctaatgcatgagataaaattgaaggtattaccaaggagaaatgcaggtggatagttttgraggcaaagtcacagtaagcaattcatctctccaaggaatagtgatgaaagctgagatccaataaatgtcttgtttggattaatacataaatatttccttt

SEQ ID NO: 15174 - DNA, 201 bp, Homo sapiens
ccatttcttgtcaaaacaaggtaaggatttaatggttgatgaattttggtaatgatttcctttttttttttttaacaacttatgtattttatgttatttaygatttccttctaatgcatatttaacatatttcaaattccacctagttttggttcaagtcaagcatgatgttatataatcaattcagtgattgagactagt

SEQ ID NO: 15175 - DNA, 201 bp, Homo sapiens
gtgaaaaaaaattggaaacaactgcacagcagcggaaatgtcctgaatggatgaatgtgcagaataaaagatgtgctgtagaagaaagaaaggtatgttgytcattgactattctttcgggtgagaaatttaatttatatttgactgtgcaaagagtcagttgttacttgtaaacttcaagtcattgtttaggtcagagtt

SEQ ID NO: 15176 - DNA, 201 bp, Homo sapiens
ctttaaatatgtatgtttggttttcattcatattgacagtactacctctcagttttctttcagatattgttttgtatttacccatgaagacattgtttttyggactctgcaaataggacatttcaaagatgagtgaaaaaaaattggaaacaactgcacagcagcggaaatgtcctgaatggatgaatgtgcagaataaaa

SEQ ID NO: 15177 - DNA, 201 bp, Homo sapiens
ttctttctttctctctctctctctctttctttctttttctttctctttttctttctttcaagcagtcctcccgcctcagtcccccaaaatagtgggattayaggtgtgagccaccatgcacagccttacataaagccttttctaatgagatggatagtaattaacaaatgtgagtttttgatattatataaagattttttc

SEQ ID NO: 15178 - DNA, 201 bp, Homo sapiens
tcaaagatgagtgaaaaaaaattggaaacaactgcacagcagcggaaatgtcctgaatggatgaatgtgcagaataaaagatgtgctgtagaagaaagaarggtatgttgttcattgactattctttcgggtgagaaatttaatttatatttgactgtgcaaagagtcagttgttacttgtaaacttcaagtcattgttta

SEQ ID NO: 15179 - DNA, 201 bp, Homo sapiens
actaaatcaaaaggaaaaccccaattttccagacctaaataacaaaagtaccagatggctcctccctttcaactgcccctcccccacacctttctgcgtgrcacatggaaaattgaaagtatctctggttgcttctgcgtaggaatgtaactttgtaaccaatcagacggatcgcaggccaagtcgcctgcatagaaatgt

SEQ ID NO: 15180 - DNA, 201 bp, Homo sapiens
atgattggttgaaatcacattgaattccactttgtgccagggacttaagttaacgaacaaattattcttacaaaaaggtataaatgtaaggttttcattcygctaaatatgtttgtcaaactgtgttgtgatttgttctcagtgtgtcatagctaccatagcttttggaatgggcattaataaagctgacattcgccaagt

SEQ ID NO: 15181 - DNA, 201 bp, Homo sapiens
aaagattcctttcaaaatgttattgctcattgacaacacttagtcaccaagagccgtaatggagacatacaaggagactaacgttgttttcatgcctgctygcttaacatccattctgtagctcatggatcaagaagtaaattaaccttttaagtattattatttaagaaatacagtttgtaatgctttagcttctgtaga

SEQ ID NO: 15182 - DNA, 201 bp, Homo sapiens
gtaatgagaagtttcgattatacaaattaaagatgatggcaaagatggaaaaatatcttcattctagcagatgtaggagacagtatgtattatttattttrtgccaatagtatggatttatggatgatgctcttttaagacaacaatttggctaaataattatcagtattttgaaaaaatattttgttgctgttacatgtg

SEQ ID NO: 15183 - DNA, 201 bp, Homo sapiens
tttttgttgctatttatgtgattcaaattataccagtttataggcctctcacaagtaaaatgaattacctgtttgtttttgtatgcctattttagtcagtytgggggaagggatctgtgaggaaaggataagtcatagagcacttttcttttttaagagacagagtctctctgtgttgctcaagctggagtgcagtggtgc

SEQ ID NO: 15184 - DNA, 201 bp, Homo sapiens
tgcagtagcacaatctcggctcactgcaatcttcgcctcccgggttcaagcgattctcctgtcttagcctcctgagtagctgggactacaggcgccccccsatcatgtctggctaatttttgtatttttagtagagatgggtttttgccgtgttggtcaggtggatcttgaactcctgaactcaggtgatccgcctgcctt

SEQ ID NO: 15185 - DNA, 201 bp, Homo sapiens
acaaataacatttcttcttactactttgtgcatcatgtgatttagctcctcccataccattttacattagaaaatgtggctgtcctcctgtgctctagtaytggcatttcagaggactctttgcaatatgatatgtgatcaatcatggatggcgatgcagttaatttcagtagaaatttgctgactctttttatctctttt

SEQ ID NO: 15186 - DNA, 201 bp, Homo sapiens
tttattaaccataataggagtagtagcatttttgtgtgtgtgtgccaggccctattttagcattttatgtgaatgatataatttaatttttagagcatctrgaaaatgttaggtaccattattatccacattttacttgtgagaggactgagacttggaaagcttaagtaacttgcttaaggtaatacacatggcagatgg

SEQ ID NO: 15187 - DNA, 201 bp, Homo sapiens
ctgaggtcaggagttcgagaccagcctggtcaacatggtgaaaccctgtctctactaaaaatacaacaattagctgggcgtggtggcaggtgcctgtaatsccagctacttgggaggctgaggcaggggaattgcttgaactcgggaggtggaggttgcagtgagccgagattgtgccattccactccagcctgggcaaca

SEQ ID NO: 15188 - DNA, 201 bp, Homo sapiens
aatcaggcagataatctgtaaatgattggttgaaatcacattgaattccactttgtgccagggacttaagttaacgaacaaattattcttacaaaaaggtrtaaatgtaaggttttcattctgctaaatatgtttgtcaaactgtgttgtgatttgttctcagtgtgtcatagctaccatagcttttggaatgggcattaa

SEQ ID NO: 15189 - DNA, 201 bp, Homo sapiens
ttctaagtatgtttgtggacttgaataaaataaaacaaacagaaacacttctttcttctgccttcaggcttgaaatgaacatacttttttttaaaaaaaaaccttcaaaatgaaaatattaaataaaagatttaataaaaagagaaagtaaaaactgtagtttaataaagtcttcctgtctcttcatagttaaaaaatgtt

SEQ ID NO: 15190 - DNA, 201 bp, Homo sapiens
agggaatacatttgttgcttacttttttgtacctttacatgtgattgatcacttgtgagttttttctttcaaacatcttaaagcttccagagctttttctrgaaaaaaaaaccagttttaagaatcaccagttctaaaagggtaatatcttattcatctttctgagaatggagtatcatgattcatgaattagatacttgc

SEQ ID NO: 15191 - DNA, 201 bp, Homo sapiens
ttgttgcttacttttttgtacctttacatgtgattgatcacttgtgagttttttctttcaaacatcttaaagcttccagagctttttctagaaaaaaaaaycagttttaagaatcaccagttctaaaagggtaatatcttattcatctttctgagaatggagtatcatgattcatgaattagatacttgcatcttaacatt

SEQ ID NO: 15192 - DNA, 201 bp, Homo sapiens
ttttgtttgccagccggtcttcagcattttaaggcaacattattattacagttgtaatacgaatataattaccagagaaaaaactcaggaaaataaatgcytttatgaaaatgggattagaggtttgaaaataaacttgttaggagaaataatttcacaatgggatggttttttctttgttaagttttctttatgacttca

SEQ ID NO: 15193 - DNA, 201 bp, Homo sapiens
attgaatgcttcagtgaactttattatttcagtgaacatttgttatttgatgtgaactttgtgcctgttttgaaatttactaaactcaaggcatgtgttcrgaagagtgtttttgaagatgacctccccttcttagaattcactggatccattgtgtatagttacgatgctagtgattgctctttcctgtcagaagatatt

SEQ ID NO: 15194 - DNA, 201 bp, Homo sapiens
caacattaactttgttgaattttttgtttgccagccggtcttcagcattttaaggcaacattattattacagttgtaatacgaatataattaccagagaaraaactcaggaaaataaatgcttttatgaaaatgggattagaggtttgaaaataaacttgttaggagaaataatttcacaatgggatggttttttctttgt

SEQ ID NO: 15195 - DNA, 201 bp, Homo sapiens
tagccaccgcgcccagcctgaaagatgaactttaaaatggggaaggatactagtaaagccatttcttactcatgtatacatttttccctccatgaaattaragcagccaccttttacatgacttttacatgcatttcagatttttgtactagcaattaaaatatctactggatgtaaatcacatgtgcttaatgctttgct

SEQ ID NO: 15196 - DNA, 201 bp, Homo sapiens
agatgttaacctgttcctttatgacaatgtcctgtttaccaattaacagtgtgtttttgtggtgatgggggcaagacaaatctttaaatggtggaaagcaragaaagaaattataaaacatgattagttgtattatacgttgtttttggttgttggaaaaactatacatttattgagagaatcattaggaagctgaacatc

SEQ ID NO: 15197 - DNA, 201 bp, Homo sapiens
gtgtgtttttgtggtgatgggggcaagacaaatctttaaatggtggaaagcaaagaaagaaattataaaacatgattagttgtattatacgttgtttttgkttgttggaaaaactatacatttattgagagaatcattaggaagctgaacatcagctatattgctggagtgatactgtttcagtggtttcttgaccttttt

SEQ ID NO: 15198 - DNA, 201 bp, Homo sapiens
attctgaaaatgaaaaacttaagtaaaggtttagttcattgtttatttcacactgagcatttactacctgaatgttttggacattttatttccatgactgragtggacacttttacaactcactgggttctttgctgatctttctctagaagagcatagctgagagcaggattctgcctctcatgacaattggcatgcact

SEQ ID NO: 15199 - DNA, 201 bp, Homo sapiens
atagaatttcattttcttttttcttgttttttttttagacggagtctcactctgtcgcccaggctggagtgcagtggcacaatctcggctcactgcaagckccgcctcccaggttcacgccattctcctgcctcagcctccccagcagctgggactacaggtgcacgccgccacacccggctaattttttgtgtttttagt

SEQ ID NO: 15200 - DNA, 201 bp, Homo sapiens
gggacaccttccttaaagcgcattggacattggctttgtgggtaactgatctttacctgaatgaaatttatcagtactgtattaagggtctagggtggaayggatgctagcaaggcaaccgttaacatccacttactgatgaatcctataaaattttatttcaggccatacgaagtaacagtaataaatataaaaggaaaa

SEQ ID NO: 15201 - DNA, 201 bp, Homo sapiens
attgtttatttcacactgagcatttactacctgaatgttttggacattttatttccatgactggagtggacacttttacaactcactgggttctttgctgrtctttctctagaagagcatagctgagagcaggattctgcctctcatgacaattggcatgcacttatcccaagcggtgaaagctggctgcccccttgattt

SEQ ID NO: 15202 - DNA, 201 bp, Homo sapiens
cattgaaatgacatactgccctctctttgtcttctaagttttggatacttttttttttttttttttgacacaaagctgcattagaacctaggtttcttgaytttcagtccagatttctttccactctacttcctgcttcttcatagtataattttcaacactagagcagtctgcataacttttgcaaaatcagctagtctt

SEQ ID NO: 15203 - DNA, 201 bp, Homo sapiens
ctgatttccagggataaggtttagctccattaaaagctagtttgtcaaacctgtaactaaagctttttaaaaaatgaaagttttaaaagagaccatcattytgttttaacctatttaatttaaaatctgggctgaagtaggagtattgcttgaacccaggagttcgagaccagcctgggcaacacagtgagaccccatctc

SEQ ID NO: 15204 - DNA, 201 bp, Homo sapiens
gatttcaggaaaagtccaaagcaaatcataatacgttattttaaaggggggtttaaaatcctttaaaggtacaatgtgaagcattatgaaatgataaaatrcatgttttttaaaaacattaattttattttaagttccaggatacatgtgcaggacgtgcaggtttgctacataggtaaatgtgtgccatggtggtttgct

SEQ ID NO: 15205 - DNA, 201 bp, Homo sapiens
atacggttctcttgaggtgaatttctactctatcaagagtgaagtagagtatggcttaaaagttaagtgattaaaaagctaccctttcttagctaatttgkaatgtaattggtcttaatttttctaaattcgttctaaccaaaatcttattggcgtgatttctattgacatgaactagaagtgacttcagcagacaacttg

SEQ ID NO: 15206 - DNA, 201 bp, Homo sapiens
acaactgcacagcagcggaaatgtcctgaatggatgaatgtgcagaataaaagatgtgctgtagaagaaagaaaggtatgttgttcattgactattctttygggtgagaaatttaatttatatttgactgtgcaaagagtcagttgttacttgtaaacttcaagtcattgtttaggtcagagttgctgttgtctaaatgca

SEQ ID NO: 15207 - DNA, 201 bp, Homo sapiens
ctactgcactccatcctgggcaacagagcgagaccatgcctcaaaaaaaatttttttttcttcttggtggttaggcttaactatccaagaattgcaatcayggcttctattgcaaatgcccctatttcccaccttcagttggcctaaccaaatttaatttttcaatatcatatgatctttttgtataattatgtattcaaa

SEQ ID NO: 15208 - DNA, 201 bp, Homo sapiens
ccactttgggactcattatactgaattagtttcacagaggaggtaaaatctgttgtttatgattacatattaactctaccattttaccttcagcattgctrtagtatgtcatatctgaaggcaattagcacaagtgacttgaagaattgtagttttgatgacttatatgtattttataaaaggcaggcagagtttttgtgt

SEQ ID NO: 15209 - DNA, 201 bp, Homo sapiens
ccacagtacctttgattagttgccactagtgagtatgatttattacaaaaaccaaaaacttagataagtcacagtttatttcctagaacgtgtaaatataraattagtcaaaagctgatagcactttttttgtacttaaaaatattttaagcctcagtatagtgagacctcatctctacaaataattttttaaaaaattgg

SEQ ID NO: 15210 - DNA, 201 bp, Homo sapiens
cgggttggaaaccacagtacctttgattagttgccactagtgagtatgatttattacaaaaaccaaaaacttagataagtcacagtttatttcctagaacrtgtaaatatagaattagtcaaaagctgatagcactttttttgtacttaaaaatattttaagcctcagtatagtgagacctcatctctacaaataattttt

SEQ ID NO: 15211 - DNA, 201 bp, Homo sapiens
tatttcctacagacttcatctgcagagagaaagagacgattacctgtgtggtttgccaaaggaagtgataccagcaagaaattaatggacaaaacgaaaasgggaggtctttttagttaagctggcaattaccagaacaattatgtttcttgctgtattataagaggatagctatattttatttctgaagagtaaggagta

SEQ ID NO: 15212 - DNA, 201 bp, Homo sapiens
ttagagtagtcacatgttataatacttatagttgatcaaaaaattgattcctaagtgttcttattaaagacacacaccacacacacacacacacacacacmttctctctctctctctctctcacacacacacacatgcacacacacttatgtactttcttgctttttttgacctaagatcttagataactattacagatta

SEQ ID NO: 15213 - DNA, 201 bp, Homo sapiens
tgtttttcatgttctgtatctaaattaagtcagtgtagtggttttgtaccctctttgttcataagaatcacttttcaaactttaaaaaaaatgtaggtaamcaacacccaactctgaaaattctgatttaacaggcctgggttggcacctggcattggtggtttctcacaggtgattctgatatatagcccgggttggaaa

SEQ ID NO: 15214 - DNA, 201 bp, Homo sapiens
cttttttttttttttattttgagacagggtctcactctgtcacccaggctggggtgtagtggtgccatcttggctcactgcaaccttcacctccagggctsaagtgattctcctgcatgagcctcctgagtagctgggattacaggcgtgtgccaccatacccggcttatttttgtattttttgtagagatggggtttcac

SEQ ID NO: 15215 - DNA, 201 bp, Homo sapiens; identical to SEQ ID NO: 1353

SEQ ID NO: 15216 - DNA, 201 bp, Homo sapiens
tttatctcccaatgataatgaaaacgatacgtcctatgtaattgagagtgatgaagatttagaaatggagatgcttaaggtatgtttacaattataaaaayattacttcaagttctttccaaaggacatttaattaagtaaaatattaactaattctaaaccaggttccaccacaatgaaattgctactaattatgtaaca

SEQ ID NO: 15217 - DNA, 201 bp, Homo sapiens
tttggttctttgtttctttgttcattcttctctctctcccttttttatctatcatataaatatgtaaatatatattatatatccattagggaagaggaagytgtctaaagatatctagtatataggagctttgttctgcagaaaagaggatatgaagtcaattatattggaaattaatgcttaatacttttttttaaagca

SEQ ID NO: 15218 - DNA, 201 bp, Homo sapiens
aaatcagtggatgtcaaggaacaactattgttctttgtacggcatttttcaacattgtgaagagttcttatactcaaaaagtttgggagacacagtgtgayattgtttaacctgagttgaacttgtcattttgtattcttgtttagagcagggattttattttgtctctttatctaactttgtattcctaactatttcttt

SEQ ID NO: 15219 - DNA, 201 bp, Homo sapiens
ttttaaatcagtggatgtcaaggaacaactattgttctttgtacggcatttttcaacattgtgaagagttcttatactcaaaaagtttgggagacacagtktgacattgtttaacctgagttgaacttgtcattttgtattcttgtttagagcagggattttattttgtctctttatctaactttgtattcctaactattt

SEQ ID NO: 15220 - DNA, 201 bp, Homo sapiens
agatctttaaattgaacatgttttatttgggaagcaagaattaaatttgaggcatatacacagactgggtgtccttggtatctctgaagaacaaagagaaktttggaggttatagaaaaaggaaaatgtgacattgtttttccagaaagttctttggcactagtaaattttggggagttggaagctctgatgggttagtga

SEQ ID NO: 15221 - DNA, 201 bp, Homo sapiens
agacagatctttaaattgaacatgttttatttgggaagcaagaattaaatttgaggcatatacacagactgggtgtccttggtatctctgaagaacaaagrgaagtttggaggttatagaaaaaggaaaatgtgacattgtttttccagaaagttctttggcactagtaaattttggggagttggaagctctgatgggtta

SEQ ID NO: 15222 - DNA, 201 bp, Homo sapiens
tttcagatttttgtactagcaattaaaatatctactggatgtaaatcacatgtgcttaatgctttgcttcataatatctgttgaagtcaattaaaatataragacagatctttaaattgaacatgttttatttgggaagcaagaattaaatttgaggcatatacacagactgggtgtccttggtatctctgaagaacaaag

SEQ ID NO: 15223 - DNA, 201 bp, Homo sapiens
aatagagaggggcgaggattgaattcttcggtaaagctgggtgattttgttttattcaatacagtataataagtataaaaagtagaacctatagagagctrtaatgggggtagttttaaagaaattctgaaaatgaaaaacttaagtaaaggtttagttcattgtttatttcacactgagcatttactacctgaatgtttt
